United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 15

SEQ ID NO: 59330 - DNA, 414 bp, Glycine max
  Peptide Sequence Number=SeqID_176108
atggagagaagggacaccatcggtcactcaacttgtccaaagagcaacaaatgcagagaaccgatttcatcctttcatcgatggaatcatggaagcacaactatcacccggatggaagacattgaccatagattgttcaacagactcttgaacctagatgagcacatggatgcattcttgaaacaaatgaacttgttcgcgaatgatgatgccctcatgacccccagcatgatcaagatcgagagcaagaaaggagtcaaaagcatagtcaaactcaagaaactattgaggcacaatagcacgatgataataccctactcgaaactcggttgcgaggtggaagctaaaaagaagctcactagatgtatgccccctatcagtttcacagatgaggactttggggacatcgaatga

SEQ ID NO: 59331 - DNA, 321 bp, Glycine max
  Peptide Sequence Number=SeqID_176109
atggaggttaagtacctcgaggcggtcaagcgaaggttgcatgccaccaaacaatggtccccggatgaaattagggtgagcaggtctatggacacccccttgaagcaacaacctagtttgggggaaaacctagaaaattttctagctcctgcgggtgtgatcaatgtaggagatcatcaagatcacaatgttaatgttgttattggtggtgatactcatcatcaggacctgatgggaatggatccaatggtgatgccttcacagcaggaacattggttgcaaatgcaaattcctgcagctattaacatacaccaacattag

SEQ ID NO: 59332 - DNA, 162 bp, Glycine max
  Peptide Sequence Number=SeqID_176110
atgtcgaagtgtcgttacagatacaccccaccaacattcgtggaggaactcacagaggaatgcctctcacaaccgtcattttcacccaaaggagtgcaaacttggctgacatatttgattggggagatgacgatgtgcaatggactaggtggtgactggtga

SEQ ID NO: 59333 - DNA, 594 bp, Glycine max
  Peptide Sequence Number=SeqID_176111
atggttcatccaatgaaaaaagggagtagggctggagtcatcctagaaagcataggtgaagtaatcctagagcaatccctaaggttcgagtttgagatgacgaataataaagttgagtatgaaaccctcttagcccacctaagattggctaaggaggtaggagttaagtatataaattgttggagcgactccaagcttgtatctggtcagctaaatggagaatatcagaccaaagacccgcagatgactaggtactaccatatggctactcaacttaaagaggcttttaccaaatttgagcttcaacgtgttgttagagaaaataatgagcgagctgacttgccactaaagcttgatagtataaagaagaaagataatatagaacgtcatccaagaaacaaggttgtggcgagagtagctcctgttgacttggaatggatgactaagattcgggacttcttggagaaaggctcactcccaaaaaatccaacaacgacaagaaatatcaagagatatgccatctattatgtgatagagggaggagatctgtacgaaaaaggcttcacggccaccctgttgaagtgtttgacttag

SEQ ID NO: 59334 - DNA, 1353 bp, Glycine max
  Peptide Sequence Number=SeqID_176112
atgattgcatcctttgaatttcgaaacatcgatgggatgggcaaaggttgtgtctctcctgaaccattgatttgtggctctggggaatcatctttcttatcttcagtcatatttcttttctctggcatccttttatttcttttcttcaccattcaagggaaagttcaaatgatgacccttctcatctccacaacaactttaacgctgctagtgaccaagattccaacattcatgttggtgatcctaccactagtggctcaccctgacaccggtggtgtcgctgccatggaaaggttatgcctttactctgacatgcatgttactcatgtggagaatgaggccaaatcctcatcaaaatgtcatggacctggattcagaggctacagtcgtccaagtgatttctcatcgaccattcagtctcctccccctaggaaacctaacatggctaaggagtacccttcaattattcttctgggttatttcttggttcacgaggaagagagcaaacatgactttgtgcgtgttttttcgtgtgagactctctttgtgtatatgtactcctcttccttctcaactcttcaccttattgttccttttgataagtttgaggttgatgtgttgagagagttgaatgtcgctcctacccaattgcatctgaatgtctgggtgaccatgaaaacaaaaaaagttgattggatctcccttaccgatattttagataaggcagtcattggaccttacaccacctcttacaaaaattttaagggctatttcttccaagtaccctctaaactcgagttcatgcctattgattttactcggcagaggggaaagtactttaaccatcaagctctcattcaagcctccatgctcagtcaacccaaccgagatatattgagggagagggcgaacgctgtgtgtcagaaggtgcaatctgaatatgccaaggctgagcaagccttggttgaggaatctcagaagtctcttatggatacaaagactaagttgaaagaggctgaatcccaagaaaaagctttaaagatcaagctcactactgctaaggattcggctaaggctctccaggaagagatcaatcatctcaacaaggaatttgttctcattaaggtgaatgccaagaaggttgaggaaaagttaaagactgatctcgaagaagccgaagccaagatcctgaagacccatgaagccgggcccaacaaggctttccatctggtcaagtattttttcaaggatgccaacacttccttctttgatgttgacaaggacgttactcaacaaggggagttagttggtgaaaataatatgcctacgaaagaagtgcttgatttggcttga

SEQ ID NO: 59335 - DNA, 153 bp, Glycine max
  Peptide Sequence Number=SeqID_176113
atggagaagcttggaaagatccaagagaagaaaaacttgccacaaaccgggaagtccttttcaaagttgttgaagcactcagaaaagatccgagtagaactaacagttccttcgactaaagacctaatccagggcatagataagaccaaataa

SEQ ID NO: 59336 - DNA, 372 bp, Glycine max
  Peptide Sequence Number=SeqID_176114
atgcaaagcttgcaggaactagctcagcaaaggccaattatgagtgaagatcagttcattaagaaggcacctcaacagcatgagctagaaccagaaaatgatcactcatctgaagccatcatccctggagttgttgatttttcaaaaataaaattagagacaagatccaatgaggttgctcatcctggaccagtgccagtaccagctgatcacacagcagactcttccactcctatcttagagatacctgagggccagaccataccaatcctggctctggacacttctcctccgactactccagtattgcatttgacagataaggaggatgttcaggcacaggatatccaagaccagtcacatgaattttga

SEQ ID NO: 59337 - DNA, 192 bp, Glycine max
  Peptide Sequence Number=SeqID_176115
atggacccaatcaagattgcacagaatgatgcatgcactgactcaacactcagatgcaatgtggtacgtaccaacaacaaccaaatctcaggaaataacctaagcgtgtccacagggaatatcagcatgcaacagggacaggcagatgtcctcatagctaggttccctgaccctaactatggtgttaaaatg

SEQ ID NO: 59338 - DNA, 1378 bp, Glycine max
  Peptide Sequence Number=SeqID_176116
cgtttcaggcacattgtgtcacatgcacttgaggtcatctcaaaagggtgcttctttatccctgaaaatgttgatcggtgatgtggcgttactcagttatatggaacatactatactgcttgctaaattttctgccaaattttgtgctcttaggagcctcaaaacagtgaacctttccaataactcgctagtgggagagataccaaacgaacttcagggaattgagagtttacaggattttcaaattttcaacaatcacttgagtggtctgataccatcttgggtggggaattggacaaatctgagagtttttgctgcttatgagaataatttcaatggaaggattccagaagttatgatcctcactcagaacaatttaagtggtaaccttcctgttgaaattgggaattgtcaaaccctttacagtgttcgaattggcaacaataatgtagaaggtaatattcctaagagtgttgaaaatctttctagccttgtctactttgaagctaaccacaattatctttatgtttcaaatggattcactggaaaaattccgccagaatttggacagcttatgaatctgcaagtgttaatgctctctggaaatcgcctttttggtgatattccagaatcaattctgcagtgcaagaatcttagcatgcttgacttaagcaataacaggttcaatggaacaataccaaatgaaatttgcaacatctttcaattgcagaacttgctgttgggtcagaattccataagaggagtgatccctcatgaatttggaaggtgtagaaagcttcgtgaattgcaattgggaagtaaccatttgaatggaactattccttctcagattggttacaagtataacttggagatagctttaaatttgagctataaccatcttcatggaccattgccccctcaattagcaataggggtggaaataggccagctctgtggtccattgccacagtttggatcattccagaagaatccttcaagttatttaggcaaccaagggctttgtgggaagccattgaacactacttgtgaagatcatcctgatgattatgagcctacgaaagatcaataccaccatgatattgtttatgaaaccatagtaactatatttgtagcttgttttgcaggttttatagcactaactgtctttctcgttatcatcagagattggaaagaacaagtagaaaatgatgctgcgatagaaggcattcctgccctttgggacagtcttacttgtaaggaaactgatctctatggacatgactataatgtagtgccagagcaagataattatcgagctttgaaggatgagtgtcgcaacctacccttcagcgggagggcgacacgtgacacgcgg

SEQ ID NO: 59339 - DNA, 366 bp, Glycine max
  Peptide Sequence Number=SeqID_176117
atgcagagaaatgttaaattgagccagttataccaaaatatgaaagaagcatatgatgaaattcagactccattggttccccaaatgccaactacattttcaaaggtgtccataattcaagagctggatgcaacggcatacgaggaagcacctgctatcgctttcaacatgtcctttgaaattagtataaaaatgaggaagcatacagtgtttttgccttatttaagtgagttggttggactaattgatgcaactctacccccaagggcattggatagaagattccaaaaagattgggccgaagatgcaagagaaggccctaggattttcatgagccttatggtagatttcgggtccatgagctaa

SEQ ID NO: 59340 - DNA, 264 bp, Glycine max
  Peptide Sequence Number=SeqID_176118
atgaatgtgttgagtggtgcaaccctcttttgtaaaatcacccattcatccaacatcttcatgattcacatacatagggactcattaggtagtgatcaaggggttcccacggaccttaagagaataaaggtcattcctgagtggctcactccaccaagtgtcgatggaagaagcccagagtttcaagaacctctagatttgaggtcaaatccttttcaagggggaagggatgatgcaatcctaccccccaagggcattggataa

SEQ ID NO: 59341 - DNA, 171 bp, Glycine max
  Peptide Sequence Number=SeqID_176119
atgatgaatgggtgcagtttaaggaccctcattgaagggggacacaaaaataaggttattatggatagggttgctcacttcgtaccaggtgttgtttacaaaccatgtgtcatagcctacaatggttcgtttgtgaacaacactaaggacttcaaggatgtaacactttag

SEQ ID NO: 59342 - DNA, 408 bp, Glycine max
  Peptide Sequence Number=SeqID_176120
atggattacaatcttctaattggcctgcattttcgtgatgatagctcagttgatgaaatgaaaagttcacctcgcagttctcattcaggcaacagagacatgtttgataatgagatgctcacatgttggggacctctaatccagctggatcatggaacatgcctgccacagctgagagtgtgcaaggctggattggatcaccaaacaactagtggaagtagtaatagccagatctctgatagcaatcaaaaagagttgagcaagaaagaagagttccaagaggcccccccttgtagccctcaactgatgtgcattcaaacagccaactattttgagaaaagcaagtgcaacccttgtagccaactctctgcaatattgtgctattcttttggatttggagtagtataa

SEQ ID NO: 59343 - DNA, 378 bp, Glycine max
  Peptide Sequence Number=SeqID_176121
atggctcaaggaatctcaatgagaggtgtacctaggagcttacttaaatcagggccattggcaactagtagtactgtgtcctgcgatcaatgttgttgcatggttttgttcgttactgcaatgaagatagcaaacacaactgcgaatggtacaaataatcaagcaactcctaagtggattgaagtcaagagccatgttcaaagcggagggtatgagtgtggctattgcatgatgcattggatgtggaacatcgtcagtgggggtttaaagaatgattggagcatgtggtttcttgatggaacgacgttagacaaggaaacaaatgtgcagcatattttcttaaagttcaaagcaatcaatgtacaaagtcttagttga

SEQ ID NO: 59344 - DNA, 537 bp, Glycine max
  Peptide Sequence Number=SeqID_176122
atgcaggaactcctcgttcaagagcaaattgaacttgagcttcatgtgtatgtcttggtgcaaatgacactgctaatatgtcacgttacagaagataggtgtcgtaacctacccttcggcgggagggcgacgcgtgactcgcgggaaaataggggaggagcttgccacccagctcgcccaggcgagcaagattgctttctccagaagcaaccgccttctggaggaacatcttggaaggcccaagtgggcctggttgctatttgcacccccatttttactaaaactccacgaattgtgcaacgatgctttcttttgatttccgacatgtcacaaaacttcacgaattttctaacgatgggtgccaagtacctcgaagtggtcaaacgaaagttgcatgccactaaacaatggtcctcggacgaaattaggctaaaaactttttatacaactcaaacagcatcccgactctcaactcttgaccggagtcaattggttttgaaagagttgtgtagctgtcctccccatgatccactctaa

SEQ ID NO: 59345 - DNA, 379 bp, Glycine max
  Peptide Sequence Number=SeqID_176123
atggggacaagtgaagtgatttccagtggtgtccttgctcttcaaatccttgtgtctgaggtcttggatgccttgtttggagtcgatgttgaaccagaggagggtgaacttgaggtggaaattaaggagcacaatgcggccctagtagtcgacggcggcaaggagaagatggttggagaagggtttggaggagaggaggtgccgactgggaggggggaccaacggagggaggtgatgaagggtgtggtgaaggaagcgggtgtcaatgatggagatggagctgtcaaaggggaatgccatgaggccatgagggctcagatctctgaatcagtggaaggtggtgagccacatgcactttggaacacggtttgggtaagag

SEQ ID NO: 59346 - DNA, 344 bp, Glycine max
  Peptide Sequence Number=SeqID_176124
atgggtgtgggtgagagtggttatggaagaagtgagagggaggaatttaatgcttttattaaggatatagagttggaggatgtatcacttattagaagaaaatttactcggtatagatcaaatggaagggcgaattgtagaattgatagagtgttggtctcaaaaaagtggcttgatgtttggcaagaaaagattttccggaaacttgttgaggaggagtggtgtgagatagaggaaggtagatgggtagagaatcctaatgagatcaagaaggaggtgaaagctttctttgggaatagattcaaggaagttagaagtcataggccaactttggatggggcgag

SEQ ID NO: 59347 - DNA, 903 bp, Glycine max
  Peptide Sequence Number=SeqID_176125
atgaaggatactcaagtgacgaaacaaggggaaatgtggtgtggtagggttgatatcatatctttagacttggggtgctcattctatgaggaagcagatgaagagactatagtgcaagacacattagataaaagtgttgttattgggtcacaagtatgcgtagtagaaaaggaacactgtgaaaaggacactacagaagaggatttgaaagttgaagaccattacagattcacaatccgtaaggccatggacctctacgacaatgttggcggcgacaaaggactcatgcggcgtgagggggtggcacgacatgggggaagggaggcgcgatgtggggaggaggcaaagggacctcgtcacgcggccctcacattgaagctgaccagagggagggcgatggccatgaaggaggtggtggtgctgtggcgcatcggaggttggagcggtggtagtgctacggtgcgacgaaggtggcatatgaaggatttgctattacagattgtgaatccatatgattcttacggatccataagaatcatatggattatgaatccatatgaatccttcatacggatttgcaatccaaaaatgttgggtgcacaaagtaatcccccagaagggaaggtggcatcaatgttagaagtttatgagtggcaacatggtgtgggagggctaagtgtgaatagtgtgtgtaatatgaattctctagagatggtagaagagccaaaaagtctccaaaacaaagtgctacatggccaattgagatgtggaggttcgatgtatcttcaagtgttagaagcctcaatttttaaaaagacaagtgaaggcccaggggtgacacgaggcaagataagagtttcttcaagtgaagctcacacaagcaaagtggtgaggggcaactaa

SEQ ID NO: 59348 - DNA, 210 bp, Glycine max
  Peptide Sequence Number=SeqID_176126
atgcctaaccctaaggtcttcttctacatgaccatcgatgggaaacctgttggtcgcatcgtgatggggctctacaccaatgtgactcctcacaccgccaagaacttcggggcgttttgcaccggcgagaagggcgtaaggaggagcagcaagccccttcattacaagggcttgtccttccacgacatgatctcaagtttcatgtgttag

SEQ ID NO: 59349 - DNA, 372 bp, Glycine max
  Peptide Sequence Number=SeqID_176127
atggagcgtggtcatggaatgtattacacgccagcaacattttccgaatatccttcacagatgtatcagtatccttttgtaggtcatgatactgatacttctgagacctcacattcgttcggtggtgttgcggaaacacaagctcatttttcatggcccactatgactccttcacagcagcacgatgcctccatggcaacacctaacgccccatttgctccgcaatggaataggctgagcaagcagaagcggggagacaacgcggcggaagaagaaatcctgatcgtcaagcgcgaagatgggatcgaccatgtggcacatcctcacgacatcacagacaccataatgattgattttgatgtatctgtgtaa

SEQ ID NO: 59350 - DNA, 1037 bp, Glycine max
  Peptide Sequence Number=SeqID_176128
atgtcctcaccttcagaggactacaagtcctcaccttcagagtggctgcacgccctcgccttcaaaggactacacgtcttcgccttcagaggactacacgtcctcacctttagagggttgcacgccctcgcctttagaggactacacgtcctcaccttcagagggctgcatgtcctcaccttcaaagggcgacacgccctcgccttcggaggactacacatcctcgccttcaaagggctacacgccctcgcctctagagggctggacatcctcaccttcagaggactacacgtcctcaccttcagagggctacgcatcctcgccttcagaggactacacgtcctcgccttcagaggactacatgtcctcgccttcagagggctacacgccctcgccatcagaggactacacatcctccccttcagaggactacaagtcctcaccttcagagggctgcaccccctcgccttcagaggactacacgtcctcaccttcagatggctgcacgcccttgctttcaaaggagggctgcacgtcctcgcttttagagggctccacatctgcgccttcgaaggactcaagttccttggccatccccctgatctcgaaggagggccaactgtgcgagcacaaccagagagggaggctatcgtgcaactactatgcataccggggcaagatttcacccagtcgctgcaaggagacgagtggatcatgcctgcaagacacctagtggacccggagaagtccaatagggtcctggggtttccagctctgattacgggcctttatcagttctacggagtgtctgtcgcccccagcaaggtcatcaggccccctactaaccgagctttcatcaagaagtactgcgtcaccaggcaggcacaggacaaggcaccacagcaatctagggatggccggcagcgggcaatagacgcaccgccaccacctccagagcccctcagctcatctacaaaggttggagcgttgccaacgacctgtggccgatcagcaggcgaccaagtccaaagccgaag

SEQ ID NO: 59351 - DNA, 680 bp, Glycine max
  Peptide Sequence Number=SeqID_176129
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggtcgtccacggagggtgagtcagggcctaagatcagccgaaggcgtagtcgatggacaacaggtgaatattcctgtactaccctttgttggtcccgagggacggaggaggctagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 59352 - DNA, 253 bp, Glycine max
  Peptide Sequence Number=SeqID_176130
atgtctgaagaagttgatatggatgatcaaaatgaacaagaatgtggtgtgaatgaacgacaagttgattgtttggatgcgttcaatacttctcagatgatgttttgcagtgggcttgatccattgctcatgaaaatggatttgagtggcgagtataggtgtaggaagaaagaatttgttagaagagatactggaactaggaaatgtgggtgtccctttaagctttgtggcaagccagtggttggaggacaag

SEQ ID NO: 59353 - DNA, 495 bp, Glycine max
  Peptide Sequence Number=SeqID_176131
atgtgggattctaccatattcggggtgtttaatcaaaacttcccgttgtatataaagcacgaagatctctctgaaattacacatggtggtcaatgtctcagcatatgtgttatacagttgtggattctccatctgactgagacaagtgtgcgagcagggaattctgatgtgtatggatgcctcgagccacagtccattcagagatctgggcattcacaatttgaatccgaaagttacatcaagagttggatacaaagttcaaaacgagatgtttaccttggagcctatctgaataggccagacaattaccttaagggaataattaacagacaaaaaggaatcactgaatgtggctactacgtgatgaactggatgtccacgataatcttaggatctttcaggaataattgggagacgtattttaatgaagttagaccattggaagcagagagattcaaggcacttcgtatacagtgggcacagtattatctaaaa

SEQ ID NO: 59354 - DNA, 236 bp, Glycine max
  Peptide Sequence Number=SeqID_176132
gccatggcatcgaggcagcattggtctctctagacaatcaaggtatacctttcacagccaggctagggttcgactgcaccaacaacatggctgaatatgaagcatacggcttggccatccaggcagcaattgacttcaacgtcaagctactcaaagtatacagagactcggcactggtgattcaccagttgagaggggaatgggaaactagagaccacaagctgataacctactag

SEQ ID NO: 59355 - DNA, 375 bp, Glycine max
  Peptide Sequence Number=SeqID_176133
atgtctcttgatacgctatttggaaagttacaggagcacaaaatggaattgttaagattaaatcaacatgaagaaaatgataagaaaaagaagggaattgctcttaaagcttcatcttcaatccaagaagaaagtgataaggaagacttaattgatttggatgaagatgatgatcttagcctttttgtaaaaaggttcaacaagttcctgagaatcagaggaaatcaaaggagaccaaattttaaacctaaaagaaggatagaagatttaccctctactccaaaatgctatgaatgcaatcaacctggacatttgagggttgattgtctgatcttcaagaaaagaatggagaaatctgaaaagaaaaacttttag

SEQ ID NO: 59356 - DNA, 144 bp, Glycine max
  Peptide Sequence Number=SeqID_176134
atggctgtacatatacaagacttggttgctgctcttgtcaaacgcatgcaatctgctcaaaactgtatcttgctaagctcattgctaattgtttttgccagactgaggttgaaagccagtactactggaaatggtcatttataa

SEQ ID NO: 59357 - DNA, 345 bp, Glycine max
  Peptide Sequence Number=SeqID_176135
atgtcttcagtcatttacgctttcaaaagacgacaatatcttcatttacatttcaaaagacttcaatgtcttcagtcatttacgctttcaaaagacgacaatgtcttcatttacttttcaaaagacttcaatgtctttagtcatttacgctttcaaaagacgacaacgtcttcatttacatttcaaagacttcaacgtcttttgtcttttataggactcaatgatgcaatcctccctaggaagggaccagtcactagagccatgagcaagaggctccaagaggattgggctagagctgctgaagaaggccctagggttctcatgaacctcagggtagatttctga

SEQ ID NO: 59358 - DNA, 378 bp, Glycine max
  Peptide Sequence Number=SeqID_176136
atgaccggacacgattggccacgaattttgtttcctacttgcaggtacatggggatggatgcaagtggggatagggtcacaaccgaccgatcgttgccctttcccggcgctaaacaagcagagaacatcgctgcaaggcagcccagttcaagaaggaaaacgttagcccgtaagggaggaggggacatggttaatgttcccctcaaaaaaaaaatgtggcaggttagctcgcctgggcgagcaaccaacccctgcacccaaattataaaaaacgagggaggggaacgttttggcatccaaaaactcccccccccccctcattcaaaagataaagaacacaaaggcttgcggtttcttgttcccctaagccacttttga

SEQ ID NO: 59359 - DNA, 300 bp, Glycine max
  Peptide Sequence Number=SeqID_176137
atggcgaggacgtgtagtcctttgaaagttagggtgtgtagtcctttgaaggtgaggacgtgtagccctcttaaggcgaggacgtgtagccctctgatcgcgaggatgtgtagtcctctaaagatgaggacgtgcagtcctctcaacgcgaggacgtgtagtcctctgaaggcgagtacgtgtcgccctctaaaggcgagggcgtgcagcctgtcataccctaatttcgtccgaggacctttgcttgatgacatgcgacctttctttggtccttgtgaggtgcttggcacccatcattag

SEQ ID NO: 59360 - DNA, 174 bp, Glycine max
  Peptide Sequence Number=SeqID_176138
atggatagaaacaaaggaccctatgagtgtggatattacgtcatgcattggatgtggtgcatagtcaacgacggtttgaagaatgaatggaacaagtggtttccagatggaacaccattagacaaggacaccatcacgacaccacgcttacctctagattttgggagagcttga

SEQ ID NO: 59361 - DNA, 453 bp, Glycine max
  Peptide Sequence Number=SeqID_176139
atggatggattatctttgcaactttttccttcggctttgcatgtcaaactaaaagctagactttgttttctagattatataaagggtagtaagaatcccttcgatttcatctcattaatcaacagaattaatcaaagtgatagcatgtacattcctacatctgttttcatcattcatattatcaaccacataagttcagttgttgcggttgtagctgcacagtattcaacctcagttgatgagccagccacggtatgttgcctctttgagagccacgagatgggattgccaccaaaagaatacaaggcaaggaggttgaaggaagcactactagagaatgaggattctacatcggttattttggacaaactacatcggttattgatcgtcgtcgtaggggactttgtgaaatggggtagccaattctacaatagttgccagagaccgtcttag

SEQ ID NO: 59362 - DNA, 471 bp, Glycine max
  Peptide Sequence Number=SeqID_176140
atgcaaatctattgtatgcttggcctaatgttcgcaatagctgtcagaaaagcgctggatattctaccacaagacaatgtcactctgaagtttttgttggaggcaacaggtgatgtaagcacaagtgatgtggaccttgcagttgcaagcaaggccatcattttgggatttaatgtgaaagcactaggctctgtcaaaagctatgctaagaacaaagatttccattatagttcctctgttattttgtctaagacattggagtttgtactttttcatgagttattgcaattgggagttgctaccattgatccagatgatccaattctttctgctgatgacttggctaatcaaatagctgaagttcttaactattttgggctatggtataaagttttagagattttggaacagaacaaaaggaaagggaaggtggtgcaactgaggctagaagctgatgttgcgtctccttga

SEQ ID NO: 59363 - DNA, 564 bp, Glycine max
  Peptide Sequence Number=SeqID_176141
gtccacgccttcaaagggctacacgccctcgccttcacaggactacacgtcctcaccttcagagggctccacgccctctccttcagaggactacgcgtcctcgccttcagaggactacacgcccttgccatcagaggtttgcacatcctcgccttcagagggctgcacgccgttgcctttagagggctacacgccctcgccttcagaggactccaggtcctcgccgttagagggctaaatgccctcgccttcacaggactacacgccctcgccttcacaggactacgcgccctttccttcaaaggtctgcacgtcctcgccttcagagggctgcacgccctctcctttagagggctacacgcccttgccttcagaggactccaggtcctcgccttcagagggctacacactttcaccttcacaggactacacgccctcgccttccgagggttgcacgccctcgccttcagaggactacacgtcctcacctcaaagggctacacgccctcgccttcagagggttgcacgccctcaccttcagaggactacacgtcctcgccttga

SEQ ID NO: 59364 - DNA, 507 bp, Glycine max
  Peptide Sequence Number=SeqID_176142
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaacgcattgcgatggtcccctgcggatgttgacgcaatgtga

SEQ ID NO: 59365 - DNA, 402 bp, Glycine max
  Peptide Sequence Number=SeqID_176143
atgcagacaaagaatgaatgccatgacccagcttttaaacgaagaaccacacaaaacgccaatgagctagcttctgcacctaggctgctgcactgctactgctccgacgggacgtcacatagcaggctcaaagcgccaacagtactggcgcttcccacttcatgtgggctgaaatcgccaagctcgttggcgcgtccctccaggcctcgccacgtgtcaagcatgcacgaagtcgccactcccacttgcgacttgcatactgggtacgtgcaaaaacagcaccccctgggaaatagtttggaaagagccccaatctgggaaaaagtttgtaattcagtcccaaactgggaaatttgccaggtggcgatgccgatggtgctggaggtggagatgtcgatggtg

SEQ ID NO: 59366 - DNA, 255 bp, Glycine max
  Peptide Sequence Number=SeqID_176144
atgaagaataagaaggttgttatggctggtgtctcgttaagtgaggcttgtccgcttagcgagaatcatccgctaagcgaggccctcagcctgcttagcaagttgggagaatctggaggagaatatgccaagcatttggacgttcaacgcatcatcagctcgctcagtgagtcatttgtcttctctcgcgctaagcgcacccagctcactcagcagaaaatcacttactcgcgcttagcgcaaaagtggcgctaa

SEQ ID NO: 59367 - DNA, 483 bp, Glycine max
  Peptide Sequence Number=SeqID_176145
atgcacggcggtggtcacgagcgcggcatgcgttcggggaccttgccggtgcaccagattgtcggcatgggcgatgcctatcgcatcgcgcgcgaagagatggcggacgagagtgcgcgtctggctacgctgcgccatcgtctgtggcagggcatcagcacgctacgcgacgttcagctcaacggttcactcgaacagggcgcgccgaatatcctcaatatcagttttgcccacgtcgatggcgaatcgctgatcatggcgctgaaagatctggcgctgtcgtcgggatccgcctgtacttctgccagccttgaaccttcctacgttctgcgcgccatgggcgtggatcagcagctggcctacagctcgctgcgcttttcgctgggtcgctttaccacgcaggaagagatcgattatgccatcggggtggtacataaggcggtaacgcgcttacgggcgctgacgccggccacttcccgctaa

SEQ ID NO: 59368 - DNA, 1182 bp, Glycine max
  Peptide Sequence Number=SeqID_176146
atggagttgtggggaagccctaggttgttgtgcggcattgcgattcagctgtcacatgttgggatttgtgtgcccagcagtgtggtggactttttcaaggagaggaagcggaggtggtgcctagagggggtcatggtgaacaaaggtacccagtggcggacccacgtgtatcctaggatgggcaggcatgattttggaaagcaatcaggtggtgatacatttgtgatagagggattcacaaattggaataagaaagaaagactttcatctcatgttggaggtcctaatagtgctcataacattgggagtcaaggattagcttttcgtggtcatgatgaatcaaccaattctgctaaccaaggtaatttcttggaacttcttagatttcttgctaaacacaatgaatcaataaatcatgttgtgttggaaaatgctcccgaaaatcatcaattaattgctccaaaaatccaaaaagatattgttaatgctgctgcattagaaaccactaatgctattattactgatcttgaagatgaattatttgctatcattgttgatgaagcacgtgacatatcaaacaaggagcaaatggctattgctttgcgttatgttaacaaaaaggaaagtattgttgagcgtttttttggtatggttcatgttaaagatactacaactttatcattgaaaatggcaattgatgaattgttttgtaaacatgggcttagtatatcaagaattcgtggacaaggttacgatggtgctagcaacatgcaaggggaattttctggtcttaaaagtttgatcttaaaggagaattcatctgctttttatgcattgggaaaaggagaaattcctagtggacaaggtttgaatcaagaaactagtcttaaacgagtttttgatactcgttggggttcacattatgcaactttgatcaatttgatattgatgtattcttctataattgatgctcttgaaattataaaagaagatggatcaaatgcagatcaaagagctgaagcaaatggtcttttacatttgctagaggattttgattttgcattcacattgcatttgatggaaaatgtcttgggtatttcaaatgaattgtcacaggcattgcaaaggaaagatcaagacatcatcaatgttatgaacttggttaacatcacaaagctatga

SEQ ID NO: 59369 - DNA, 176 bp, Glycine max
  Peptide Sequence Number=SeqID_176147
gcacgtgaggtggtctagagaactcaaaatctccttcaacttagtcttctctttaggtgttgttaagaaagccgttgaactaggtggatggcattggttggttcttacaaatggtattgaagtgaaactacaaaggaatgatcttagcgtgattgaagcacagaacctctttgatg

SEQ ID NO: 59370 - DNA, 282 bp, Glycine max
  Peptide Sequence Number=SeqID_176148
atgagaaatagaatatcaagctttctctctctctctctctctctctcttcctccattgttgctcttttgagcacagtagtgcctcaaccctttcaagcttatgctaaagctctggaagccaaattgttgaggacaagagaggctcttaggcaagcccttgaagacaagaattcaatggcagcggaagggagaaggaagaaagatgattggagacgccacttcaaggagaagatgagtcaagaagaagctcaccaccataagaagccatggataagagcttga

SEQ ID NO: 59371 - DNA, 420 bp, Glycine max
  Peptide Sequence Number=SeqID_176149
atggcacaaaaactcacaaaatatcactccaaaagtggtttattagaagtatttccaataaatgttcgcaataagaaggagatggagttcttggaactcaaatttatgatgaggatagttgggcaagaattgcacaattataagagtgtaggcctagtgaaggataagaagtttggtgctcaaaaccgcacaaagccatatttagctctagtcaaccaacctaatcatcattataatagtcagaaaaccacgatcaatcaccctagtggtggtggaagtgtgggatctgctctttctacaccttggagatgtaggaagtgtggttgtacaaatcatgctacttgggacttcaaggataaagaggtacattggaagagattgtcccagttccaagtaggatatgaaaagtggaggacataa

SEQ ID NO: 59372 - DNA, 165 bp, Glycine max
  Peptide Sequence Number=SeqID_176150
atggttacaagccttagcactttcatagggaataagaatggaggtggtggagctattgagtttcacgggttggatcagttccagaggaacaatccatcgacgttcaaagggacatataatcttgaagtactcgcacaagggcaagtgtactctacgcagtactaa

SEQ ID NO: 59373 - DNA, 564 bp, Glycine max
  Peptide Sequence Number=SeqID_176151
atgacaatttcaaaggacagggttaagccatctccctttcctgataactggaaactaaatgaaatctttgctactggggttgtgcttggaggttacttggcactgatgactattatattcttttgggcaatcaaagagacgacatttttccttaaagactatagtaaaaaggatagggaagctcaatgggctctttctcacaagaccctgcatggacttcaaccaccaaaaatttctaatatcttcaatgaaaagaacagttataaagaactcattaagagcagttatagagaactcagtgagatttctaagcaggccaaaaggagagttgaagttgcaaggcttcgtgagcttcacaaacttaagagacatgttgagtttgtggtgaagctgaagggtctggacattgacacaatccaacaacattacaccgtaaaccttccaaaccaagacagttggatgaacactttccacaacggtggcatcaaagatagttctggaaccattgtcgaatgtgttttgaagtcaacgttgaaagcttttttctctagtagtgatgtgtaa

SEQ ID NO: 59374 - DNA, 276 bp, Glycine max
  Peptide Sequence Number=SeqID_176152
atgacatcaatgaatgtagctacaatctttggaaagctaagagagcatggattggagttaggaagactaaaggaagatgaagagattgaccagaaaaggaagggattggctcttaaacctaccacttcaaatcatggagaaagacacattaaggtagatttcccaatctacctaaagaagcaacaaggtggagataagaaacctaagaaatcaagcaagaagagaagagcctacgtagcttgggaggacaatgatgaaagctcttcaagttgttag

SEQ ID NO: 59375 - DNA, 123 bp, Glycine max
  Peptide Sequence Number=SeqID_176153
atgaagagggtaaattcgaggaagagattggcgagggtaacgagtttgattgggaagaagtgtgttgatgtgattgccaacctcaaacaagaagtccttcttgaacaactccaatggaaataa

SEQ ID NO: 59376 - DNA, 360 bp, Glycine max
  Peptide Sequence Number=SeqID_176154
atgaagaagaaagaactcctaatcttaaaagtgtgtgttgaagaattcatggcataccatgctagctcaaaagctaatcaaaattcaatgaaaaatcatgaaattcattttgaggttgaagctcaagagaaaagccttgtaaaagagcaagagtcaagagaaaaagatgaggagaaagatgagctctactatatgaagttcatggaatttctagctaaaagtcctttcggtaagcgcaagcctcacgctaagcgcatcattgttcatgcactaagccgtgagtctcaagcgcttagcgcccaacccttgcatctgaggctgatttggtctgctaagctggccaaggttgagctaagctaa

SEQ ID NO: 59377 - DNA, 709 bp, Glycine max
  Peptide Sequence Number=SeqID_176155
accgggtactgggccttcgaccatcggtccacgccttcgaccaacaccgtctggctggaccgcagccggccctcgaagatcgtgctgggccatatcgcctatgcccatgagcggcaactgccggactgccggcgcatgctgcgccagccctgcaggcccaacgaggaggctgttccgccgggcgtgggccccatgccgccgctgctgccctgcagtgcttcgtggagcgcggctttcactgcaccagcatgcgcgacatcgcgcaggctgcctcggtgagcctgggcaacctgtacaaccacttcgacagcaaggaggccttgattgccgaggtcgccacgcaggagcagaccgagctgctgcccttgctgcaggcgctggagcgggccgcagcccattcgctgccggtggtggcgcaattcctggccgcctaccaggcgctgtgccgccagcgggaatgggccgtactcagcgccgaatgcctgtccgagatcgcgcgttcgcccgggctggcgccggccttcgaggccaaccgcaggcgcatgctcgacggactggcaggcttcatggagcgcggggcgcagcagggcctcttgcggcccgccgtgcccgtgcgcctggccgcgcaattgctgctggatgccgtggaaagcgatgcgctgcgctttgcgctggcggtgacgccgcaagaagacgcgggggcggatga

SEQ ID NO: 59378 - DNA, 822 bp, Glycine max
  Peptide Sequence Number=SeqID_176156
atggaggtgcaagctaaagaaggtcagtgtgatgatgcaatcctccctaggaatggaccagttaccagagccatgagcaagaggctccaagaggattgggctagagctattgaagaaggccctagggttatcatgaacctcaggggctccataattccttcagaactcacggataagtttaggcactaccactttggggtcttcaaagaagtggtggatgccacgcagcaaaagcttggggaacaaatttatccacctaaagataggagatcagatcaaggcaagcttcttttctccgaatccaaaggctcaacacttacaagcctttcatgtccaatgctacaaggcaaggaactacttattgaagatgatgacgatgctaagtctgtcaaatttgttaaagctcgacctagtcgtctattcaaacatgagcttgaagctctaaaaaacaagtttgatctcataactctaaatggatatgacataagaaggttatgtaggttgcagaagtgttgctctgatttggaacctgaggagaagccatttgtggatgcctatcatcatgaatttgatcacaccttctcttttatggtgtctattcctttctctagattcttcttcacacacctagtggatcctatcattaaagaagttgaatttgatgttgaagttgcttctgcctccttaattgttcaagtgtattatccttcaccttctcgtgcctatgtttgtctgcttgaagtggaactcatcagaactagagaggcacttactcaagtcttgaaggatcgctctcatgctaagaaagaggctcacaaatga

SEQ ID NO: 59379 - DNA, 519 bp, Glycine max
  Peptide Sequence Number=SeqID_176157
atggttggtttctctctctctctctctctccagtcctacacaaccaacagcgcaaaagtggtatttttaaaccaaaggccacagacaaggaacttcagaggctccggcaatttctgcggcacctgtgacagaagcctgcaagacccataccacttctgctccctctcttgcaagatcaattatctcgtccgaacaacgggctctctctgcaactatctcttcgagtgcaactacctgccactaccggaatctggactcgacgacggattgatgacccctgactcggttctcgaaccggccggttcggcccgaacctcgtccggttcgggagggtacggaggggtggattgcagaaccaccttggcttgcactgccaccaccgaaattgtgagaaagaagaggaccggcggctccactttccggccaccgtgccggccggcgtgctcgccagtctcggaaatctcagcgggtctcatgaaccggaggaaagggaacccccagcgggccccactctattga

SEQ ID NO: 59380 - DNA, 189 bp, Glycine max
  Peptide Sequence Number=SeqID_176158
atgcaagttgccttgtggcggcatggtgaaacaatgacaacgacgatgattatgacagtgaaagtgaaagtgatggtagctgataaaggtgatgatgacaacgacaatcatgatagtagctacaacaatgatcatggtagtggcaacaacgatgacgaaggccctaacggtggaagtgatgacggttga

SEQ ID NO: 59381 - DNA, 237 bp, Glycine max
  Peptide Sequence Number=SeqID_176159
atggagggggatggcttaaaatctttaattatccacgatcaatacattgatgatgcccatgtttcatacttcatattgcatggaagtagtataaactttatcacccatgggcccgaaatctaccctaagactcataagaaccctagggccttctcttgcatctctggcccaatctacttggagtcttctatccaatacccttgcggggtaggattgcatcagttagtgaccttctaa

SEQ ID NO: 59382 - DNA, 549 bp, Glycine max
  Peptide Sequence Number=SeqID_176160
atggagagtgaagaaaagcaaaagtggttggatgcaaagaaggatgagattaaatccttgcattataattacacttttgatttggtgaagttgcctaagggcatgagggccttgaataacaagtggatttataaggtgaagcatgagactaactctatgtctccaagaatagttttgagtttgcctactactcttgatttggaggtagtgcaaatggatgtgaaaactgctttccttcatggtgatttggaggaagagatttatatgaagcaacctaatggatttcaagttgaaggaaatgaagactatgaccaaagacagtggtacaagaagtttgagtttgatatgtgtgagcaaggctacaataagactacttctaaccattgtgtctttattataaagttttctaatgatgacttcattatcctattattgttaaagaagcaattaggcaagtcatttgccatgaaaggcttaggagttgttaaacaaattcttggtaaacaagaagaagaagaagttgtggttgtcacaagaacactacattga

SEQ ID NO: 59383 - DNA, 213 bp, Glycine max
  Peptide Sequence Number=SeqID_176161
atgccactactggtttatcttgttgttggtcaactggttgttggtcatctagttggtcattatgttgttgttgctggtcatctggttggtcattatcttgttgttgttgatggtcctgatgttgatggtgaggaggtaggaactaaaggacatcttactgaaatacacgcatctctttctttgatcgacaaagctcctcccttagtcaattaa

SEQ ID NO: 59384 - DNA, 273 bp, Glycine max
  Peptide Sequence Number=SeqID_176162
atgaacctggtcggagccactacgatccccaccgcgctgtctgatgcgccgctgcaacatctggttgccacaacgacgaggaacactgtcattgtcaaaggtgaaggcgacaagaaagagagtgctccttgctacaattgcaagattgacttgccgccggacaacctctacaagtttgaccatatcaaagctaagatgaagaacggcgatgtatttgtgcctaaaatcaaggacaaggagaggaaagatgccatcaatgttaaggttgaatag

SEQ ID NO: 59385 - DNA, 369 bp, Glycine max
  Peptide Sequence Number=SeqID_176163
atggtggatgccgatgccgaaccttccgccaccagcctggaccgcctcgaggccgccatgacccaactcgccgcagtccaagcttccatggatttcaatctctatgcatctcaacttcgtttcacagcgacccaaacctccatgattttcaaactcgatctcattatcctgaaactggataccatgatatctctccaacgctccccattttgttcttcggtgcaaccaccatcgttgccgccgccaccagctcctccgtcgaacgcttattcttatcaccccagccagtaccctcctccgcctcgccctcacgtgcctccttctcagttcacaccacactcccacgttcctcctcagccttatccttag

SEQ ID NO: 59386 - DNA, 162 bp, Glycine max
  Peptide Sequence Number=SeqID_176164
atgactcctcttaagacaggccttgtattcgggttcggagccatgtttgggatcctaatgagtctaggtgcacagtgccacaaaacgggtcaccaccatccctggtcttgtcacacaaaagctcgtacaaaggaaattgcagaagttattttaatgatataa

SEQ ID NO: 59387 - DNA, 360 bp, Glycine max
  Peptide Sequence Number=SeqID_176165
atggccttggctgctcaaacaggcgcaagaatgaaagggtttgaaaacaagaacaaatctatctacacaaattgcaacaaatcaggtcatgatgaagcaggctgtttcttactgattcgatacccaaaattgtggggtgactatcccaaaaataatgacaagaacttgggattcaacattagtggagatgttgagaattctggcatgacaggattgagcaaggagcagttgaaaactctggtagaattgcttaacaatttgaaggaccgcactttgaagatgctgattggagtcggtgaacaaagggatggactctacttctttcaggaaattcgaaaagtgaaggcttgtagagtttaa

SEQ ID NO: 59388 - DNA, 291 bp, Glycine max
  Peptide Sequence Number=SeqID_176166
atgctcgaaattgaaggaggaatcccagtttggcttaaattagaaaatttagttgcaaggcgtagcgagtacctctaccttggtggtttgctttcttctgggctatccacatcaattatactcttcaagtttgagatacaactgaatccatattttgggagtgcccccagcctgcgaggtttggcatcttctgcagtaggacttagaaatggattaaggataagccataaatacattgtgccactctcagagaattataagcaattgggtttggatccggaattgggctga

SEQ ID NO: 59389 - DNA, 327 bp, Glycine max
  Peptide Sequence Number=SeqID_176167
atgacctttatgcctacattgcaaaaaactcagccgaatatggctacaataggaatgttcaacatagtccaatcgataagtagcctagtggggatttgccctagacctgctttagccaatatgagtaatatgcttgcaaatgtaggactagctaggaggctaacagatgccattggtcagatctgcttgccctgtgtgacatcttttgtatcgccattgggaagtaatagccaagcaatgaccatgggcaataccaatggaaaggtgtcttatgtgaataatgatgcaagcattggggcaaatgctatgagtcaaatcggctattag

SEQ ID NO: 59390 - DNA, 420 bp, Glycine max
  Peptide Sequence Number=SeqID_176168
atgggaggagacgaccaatctcagaagaataggccattatcatatgatcttaattccaacgacaaccctgaaagtgtgatcacgcaagtgcagttgtggggtgaaaactatgatgaatgggctcgagctatgaagaattctttgagagcaagaagaaaattaggtttcattgacagaaccataacgaaacttgaagaaggatcctctgtgatggaggattggttgactatccaagccatgttgctgaaatcaaacttgacccaacgcaaacaaggatgtttgtccatggtggcttattacggaaagctgaaggctctgttggatgacttgaccaactatgaacaactaccgacctgtaattgcaaaggcttcacgtgtggtgttgcagcaatacttgaaaaacacagagaagaggaatga

SEQ ID NO: 59391 - DNA, 528 bp, Glycine max
  Peptide Sequence Number=SeqID_176169
atgacgacgatggcgaacacgacggtgacaataattagtggtcgtgaggtaacgagggtaggggagagaaagtcgcgaggagagaaaagggttttcgatgagtgcggggagaaaagcaaggtcaacttccataaaagccaagtagcgggtgttggggtgagcaaaggagatattcaaagatttgttgttgtgctcaattgtatgctaagtgattgtgaagataacaaaaaagaagctctttgggtcaaagtggttatagctaggtctaaatcaagagaggatccagtacaaaatccttcaacatcgtcatggtggatgaatatttggaagatatgccaaagagggaatcaaggtgtatggttttggagtaattatagacggattctaggtgatggaagggatactttgaagcaatcctaccccccaaaggcattggatagaagactccaagaagattgggctagagatgcaagagaaggccctagggttgtcatgagccttatggtagatttcgagcttgtgggctaa

SEQ ID NO: 59392 - DNA, 195 bp, Glycine max
  Peptide Sequence Number=SeqID_176170
atgtacaaagataagtgggttcatactgagcccatgggcgcaaaatctaccttaaggcctatgagaaacctatggccttctcctgcatctctggcccaatcttcttggagtcttctatccaatgtccttggggggttctctatggcagagacacaccttaattgcttaaaggcaccactgttccttcaacagtag

SEQ ID NO: 59393 - DNA, 228 bp, Glycine max
  Peptide Sequence Number=SeqID_176171
atggccaaactggctatcttggcaagaaaggtatatgaagaaattacaaaatatgttgttctggagtctctaaaaaccttatctattgaggaggtgcagaggaaagcagttgaagaggccaccatgatggatgtatataatgagctagtgcttgaagaaatgaaggagcttaagagagttcaatctacagtggaacatggtcctatacttttgtctgtagataactag

SEQ ID NO: 59394 - DNA, 195 bp, Glycine max
  Peptide Sequence Number=SeqID_176172
atgttactaaaaatccttccacttcccagattatataggaataaggagcttttgaagagggattggctagttgttagcatgcataactatagagaagcaagcaagtctgcagatagtctattgttcttgttcatggcagattcagccccatactttcactccaaaaaaaatgcatttgcagaactgactgagtag

SEQ ID NO: 59395 - DNA, 309 bp, Glycine max
  Peptide Sequence Number=SeqID_176173
atgtgggggttcgatagagggagcaaccatacctcgagaaggtttagaagggtgcaagcgaaacacagagcaatgaacaatatcaatgattatgcagaatccctctttcagatgtgctcagaaaatggtgcggggccagaaagatatgaacttgattttgagtttttggggaacaaaacaggagagccttatttgattcagactaatgtatacaagaatggaactcgtgggcgtaagatgaggcacatgctttggtttgaccccgcagaggactaccacacctattccattaagcaagaattagaatga

SEQ ID NO: 59396 - DNA, 179 bp, Glycine max
  Peptide Sequence Number=SeqID_176174
atgggtatggagtatcagaagattcaaacttgcccgaatgattgcatattgtatagacatgaatttcaagaaatgccgaaatgccctaggtgtggggtatcacggtacaaagtcaaggatgatgaggaatgcagtagtgatggaaactcaaaaaaaggccctccagcgaaggtgttgtg

SEQ ID NO: 59397 - DNA, 213 bp, Glycine max
  Peptide Sequence Number=SeqID_176175
atgtcgcaagccatgaaggaccaaaaagagaaggcgaatacaatttgcaactcacatgtcatctccaagtatgcctccatgatcgttgttgagaaaaccatgtcaaaacctcactccctctctttgatcatcaagcagtctatagtttatagatataggaacctgaaacagcgcataatgattcacaacaacattcaatcttgtttccaatga

SEQ ID NO: 59398 - DNA, 285 bp, Glycine max
  Peptide Sequence Number=SeqID_176176
gtgaagggactctgtggtggggtcgaagccacagtagcccttgaggggtggcggtttcaagaattcgctgtggagcgtgtcgccgatgatggactcgaccaaaccgtgctcttcgatgttcggtacgaaagggcttgtggcggcgttgctggaagctgcggttgtgttcgaggcggaccaacgaggaggctgaagttgttgggggggggggttgtaaattatccactggtagtggggggttcgggtagtcatcaatatctatataataaaagagaaggaaattga

SEQ ID NO: 59399 - DNA, 261 bp, Glycine max
  Peptide Sequence Number=SeqID_176177
atgatggaattggaagcaagacgtgaacgtgttagacagaatgttgctcgaaaagtcagtggtccagacttgaaaagttttattcagcaactcccagtttcttcagaaggtaaagaggttgaagaaccacctagcgcaatgggtggcttaaggaatcctcaggagagcttagctgagaaagaaaaagatgagtctgagtcttcagagccaactggatctggtgcatcttttagaccaggaacttggcaacctccaacttga

SEQ ID NO: 59400 - DNA, 537 bp, Glycine max
  Peptide Sequence Number=SeqID_176178
atggcatcatccaagcagcaacaatcaccaataaacatcgaaagaaggataacttaccttgaaggagaaaccaagaaagagaaggaagaagatgcaccaagccgaagacgaaacaagaagcaggaagccaaagaggaagggaggaagaataagcatttgcgggggaggggaatagtgactcgtacggacgagtcactatttgattatataccaaagggtgaagggcattttagccttttcacacgagttgttgggtgccccaagcaactcccttctttcttcaaaatcgatgaggaggttgatcaggttgagcttgtgtacactaagtttgtttcgttggttaggtttgagcctgtgattcagaatttgttgcctttgggagaggtttgtgatgtgaaagatgagatttttaggttgagtagtaaagaatggaagttggctgtggagaaggatgttgatcctgttatggttttgcttaccgttattgtgtttagaattagcttggatactctttggatggatttcgctcaatcgtga

SEQ ID NO: 59401 - DNA, 324 bp, Glycine max
  Peptide Sequence Number=SeqID_176179
atggaaaacatgatgcaaaatgtcacggttccaccagagactattttacagaccgttcatgctagaggccagatttttggtgaagttagtaagaacattccaagcagcatgtattattttcttaaagacaaaggctggactcatttgcacttggagaacgttgcagaataccggcttgtattcaatcattggaggaagacacttaaaattagagttggatggaaacatttatgcgaaaccttgtccttaatagctgacatggaaatcgtttttgaattcattgatctcacccttaaccgtgtgctttattggccatgtttatga

SEQ ID NO: 59402 - DNA, 444 bp, Glycine max
  Peptide Sequence Number=SeqID_176180
atggggcggcgcctccttcttccggccgacctcctcgagcggatcgccgccgacgctcctctccctgacgccgtcgtggatcttccacttgaacaagggggtttcgggcctgctccgttttccggtgtgtcctccggcgcgcctcaggcgggtggacggagttcggggatggcggcgggtggccctccggagcggctggagatcggagtccggcgagggggctgcaatggccggcgggaatggacgcagagggcgggtggagtcgccggagatcttcatcggcagcgaaaaaatgaagcagagaggggaggggtgtatttctacggtcaacggatctttcttctaccgtcaattttactatgtctcaaaaaacaacacttttgtacgattgcttgctactttggaaaaatggcaataatatcaatttttaaaaagcttaaataa

SEQ ID NO: 59403 - DNA, 372 bp, Glycine max
  Peptide Sequence Number=SeqID_176181
atgtcattctttccacttctacataccattgcaccatacatctgtgacttcacagttcacaagactttaggttgtggtaaagaacttgttgctaaactagatcttactcataatagatatacttcacaaacaagaacacaatacaggtctggaatatactattacacacctgaacaggagaaggcagccatagagtctctggaacaacaacagaagaagctgaacaggaagattgttactgagatccttcctgccaagaagttctacagggcagaagaataccatcaacagtaccttgagaaaggagggagatttggttccaagcaatctgcttctaagggatgcaatgatccaattcgatgctatggttag

SEQ ID NO: 59404 - DNA, 261 bp, Glycine max
  Peptide Sequence Number=SeqID_176182
atggtggtggtaacactgacaacagtggtgggtggaatagtggtaatgatgaaggtggtgaggcgacaaaagcgaggtgtagtggtgatgacgatagtggtagaatggtggtggaggcgaaaatggcggggtggtgatggtggtgacaatggcggaatgatagcaatggaggcgataacgaccgcaatggtaggggcgatgatggtggtggtgatgttgagcggtgcattggattatgaaagcaacgctaaaatagtgtga

SEQ ID NO: 59405 - DNA, 5180 bp, Glycine max
  Peptide Sequence Number=SeqID_176183
ttcatgcagacttgacagagagacttggtggcagttatgaatgtgatgaagtctttcccgagtggaagccactggaggatttgttggactttgtggagagcatattacaccaacaaaattattgcattttctctaaaaatgaagaatctgtccttcctgatagttctttgggaagtgcgcttggtagtgtaaatagattgttgaatagtgggtctggtcatgagattgctgaaacaaccatagctttcatatcttccattatattggaaggcaccaataaaatattgacaaatatgccatcacatgcggtcattccacatgacttagttggagttcctttctcgctcttattatcagtactttttcttgattatagtgttcttcaccatgcttctaagttgtggcctgcaatgttttatgctggcttggatatggccatgtcagatcttggtattgatggtcgaaatgcagctcctgttgggacttctgatcttgcattgcatccagattcactaacttgtagccaacttttagatgcttctgaagttgatgctgttacatttagtatctttctaaaacaggtgcctttccatgtgatatttcctgcgatgatgtgtatgagtggtccttacatatcaaagctatctaaaattcaagagtttttactgcataaattatctgagtcaaatgatagctcgctccttcccaatctgcgactcattctgttctggactcatcggattcggtcatgttatgatgttaaaccaatagctgaaattgaacaacttttgaatctgtgtgttattcttgtagggagcttattagctcaattattggttccagaaagtggttatgactggtctataaactctgccttttattcatcaagacgtaacattcaagtgattaaaaccattttttgtcatccttgtgttttgatctcattatccttttctttgggaagttgtcagaaccttgcaaatggaaatgtagagaatgatttcaatatgctaaatgtagtatccaacgaggggtttcacaactttggcaatccaattttaaagatattaacaatgactctagagtacatgtggtctttatttggtgcccacctttgtgcgtctacagctgaagatgttgctaataattttgtgaaggcatttaaaggccttcaacaaaaactatttctcgatgtcagagaccgatttgagctgtacatttgtactaaagatgtgatgcctcttcttccaacattgtatgcttcacatactttgcatcggtttttatccccttttcagcttcttgaattagtggattggatgttcagtagggacaaggtggatgatttgccaattaagaaatcctcattatttgttggatgttccttagctgctgatgctttcagtgctttatccatttattttcagcagtcaactgaaaacagggcaccatatgatttgttttgggagatgagtcaaaagaatatgaaaactgatatttttgagcagatttacagcaaggtagttgacttttctgtatgttttgaaatagatagtgcagatagatgcttgcttgaagctgtcaatctcttgtataagcagaaaattgtgcaacaagaaacatttcatcctttgacgtcggtcatgtggaaaattataatggttactccattgaaagtacttttccattgcatttacaagacgaatgctaagaaagctgcatttttacatattcttactgaattgagttccctgcattcattgatctttgggcatttatttttgggtacagtgaataaaagtatacatcatgatattggtgtgatggaacatacctttgatcctactttctcagaagatcagtttttgctgcttctaccagcctctttgtcatacttcagcttaatttctaagagacttagagagcagagtcacaaagattttgaacatataccttacttttattccaaaattctcgtaaaaggtttcagtcagtggaagagcttttcctcaaaagatatatttgaggaacaatacggggaattctttccatcatctgctcaagaacttctccgtcttattgatcttagtcttcttgggaaatcaattcatatgttgaagtatcactttgctcttaatggggcaatgaaactgaaaaagcgattaaatctattcaaatccatttgcccaaaatttgcttcacatgatgacctgatggactgtgattgtcaagttattgatagttattctctgcatcagtctttgaacatcatcaatcgtgttgttgcaaagatatcactttgtaaagtattattgtttcatgaagaagcaggtgggaatttcaaagatgttgctgtgaaaatgaaaagcaaattgggaagatccaggatacgtttcataaatattttggtggatatttggcagtttattgttaagaaattttcattagcctctgatcaatctagaactccaaaaggcacaaacatttcattgttatataatcacttggaaggttttttgttgaagaatattcttgaattggctggagaaatgcaaaatgatcttattcaattgcaagccatttccttccttgaacaattaatcagatctgctcttctctataggtttggtgattttacaacaatgaaaactctccgagttatattatcacagcttagcaaggggaggttatcatatgatttatatcttcagttgttgctcgctcattctcagtttgcccccactctccattcagtgtgcaagcaagcaggttcctttttgaagcctgtatccagcattctgaaatgtcttgtgattccttctcttgatcattgtgaaaatgatgtgaaacacagagggctaatgaccgagctctctagtggaccattggaaattgttaaaatgctttggatactcttacgggttaaggctcatcaaattgatttggataatggaaatgatattaatgtaaatttaaaagaactgcatgctctgctttgtcattcttatggtgcaacagtcaactggattgatttggagatatacaatctgatgcaacacatcgagtctatgagtggcctgttgtctcagaatgtcaagttagattcagaaacaattgaaaaatggtacagaagccagcatagtgactcctttccgattgaccctgacatatgcgtgtcaacagttctctattttccctatgatagaactatctttgatgagctaccatctgtaaacaagattgaaccagatactgttaggaaaaaggtacttcattctcaagttgaagataaagaacgttatgatcctgtatttatattgcgattttcaattcatagtctctcaaaggcttatatagagcctgtggagtttgctggttcagggttgcttgcgattgcatttgttagcatgtcttccccagaccaagggataagaagattagcttacggcactcttgataaatttaagaatgcattggagtgccaaaagaagaaggatgtactgggacttcggcttctattaaattctgttcaaaatagtatagaagagccatggcaaagaatcccgtcagttattgctttatttgctgcagaggcatcttgtgtattgttagatccggcacatggtcattatgcagctataagcacatttttgacacattcatccaagttgaatatgaggtacctctgtcaatttcaagcagagaggtcttggatgcttcggctagtatatgcagggatgaactctgatgatgatgttgcattatatatcaggaactctatccttgagaagctaatgagcttttacgtttctcctctttcagattttttgtcaaagaacctgattattgagctggtgataaagaaatctgttaaattgcataagattacccgtcacctagtgaagcattgttctttattttcatggttttcgtctctcatctcagttgccagacagaggcttaatgtagatgaacataaacttttcttgaagcatgtgttggtagcattgaagacttgtctaacctacgtagccagatattggttccccttagactacattaagtctgctgtggaaccaatcatttggcatatattttgtatcttgctttctggtacctctggaagcatctccaagtggttacaaaatcatggccttgagcagctcatggagctctcatccaatctatttaatttcttattccatgatgcaacattggcaaatgaaactgtagtactagttaatccttttctacaaatgatagcatcagtgttgaaattatctcaaaaaaggaaaatatatcagcctcattttaccctatcaattgagggcttgtatcagatgtaccaggcaggaagtgcgtgtaatcaagccacaaaaagcattaaaccggagcttgctcttgaggccataattatgagtgcacctcctgcttccattttcttgatgaatcaggaaaggctgcagagctttcttatctgggcaactacaactgctttacagtccaagtctttacaaaggctggggtccactgagtctcagatcttaagaaataatttaagggaagattttcaagagaactcagtagtttctacatttctacgttggttaatagcatcagtaatcattggcaagctccataaaaaatcttataattgggattcagaatatgctgagacacacaaccttgaatccctgcattctttactggtgcatgtcaaaaatacctccggacaaagaaatgatattgatattggtgctgaggaggtactagcttcaacaatcttccatctccaactgcgtcttggtgtcaatcatgaagtgctaccatcagttgtatgtgctctttgtctcctgatgtttggtgcctctaaatttgcagttagcagaactgatttattgaaagactacaacgcattaatagcatcacacagttcaagggtacaatgtcctcctgaagctaatccaacttggagatggtcgttttatcagccatggaaggatgattctctggagctcactgactcacagaagatggaggaatatcatgcttgcctgactttgttagtgattgtctctaatgttcttggtggaaagaaattagagtcggctagtttatcccctgtagatttagagaaatctggcttattccaatgggaaagaagtttactaagaaactga

SEQ ID NO: 59406 - DNA, 180 bp, Glycine max
  Peptide Sequence Number=SeqID_176184
atggctgaagaactggagcagctcgctcaatgcgtcaacaaccgctcaacacgaggagccaacttggagcctgcatcttacggcttaatgtgcatctgcggcttagcttgcagcttgcggcttagcgcacagtcacttatgctagttggattgcggcttagcgagcacatgctggcttag

SEQ ID NO: 59407 - DNA, 2334 bp, Glycine max
  Peptide Sequence Number=SeqID_176185
atggaggaacccgccgcagttccaaacttccaacctaaagttagccacgaagcgaagctgaaagaactgctccaccgaatcacctctctggagataaagctatgctccgacgccgccaaagagttcgcgaagctcctcaagtccgagaccggcgccgacctcctcctagagtacgtgcgcggctcgccgaagtgctcggagcttctcgaggcgtggaagcttcgcgagggaaagcaaggcatgaactacgtgttcgacctaatctccgccattctcagccaaagtaaaggtaagtacaaccctagcgacatcgaaagcgtgaatattactaaggatttggataaattcgcgcggttactgatttccgaacgcttgagtgatatccacaaggaggtgaatagcaaggagtggcggaggcagaaggcggcattgttactcatggcttcgattgcgcggcgcggtgcgagcttggcgtcggaggtggcgaagagcttcgatttcaagctcgctgagttcgggaggatcgcgtcggagcaccggagaaggaagccagaggcgagggtagggttgctgcggaagtcgtttgtcggattcgcgatgtcgtttttggaggtcgggaagccgtggctgttgcggtgggttttgcagcagaaacagatgtattctggcgttctcagaggattaggaaacgatgatgatgaaactgtggtgtttgtgttaacggtgttgagagatagggttcttgtggaagagtctttggtgcagccgtggcttcggagtgttttgtttgggagtgccacgttggagcagttggctgaggtttgtggaagggaaggtggtggtgatgctgcggaggtggcgtttggtgtgcttgttagggtttgtactgatccgagtaatggtttgatgccggactcgagaatggggttgacgggtaatacgaagagggtcttggatctcatgaagaagctgcgggttacggaagttcagtatcataaggacttgcttttggctattgttgaggccaaggcttcttttgggttgtcgtatttgaaggagtttccttacaacatcgataatttcaagtcttcttcatggatttctgcattatctgtggcagctcagttggtttcattggtgggtaatggcatatccaaagaatctgtcaattttcaatcaaatggtccgcgcctgtttgacaatatggatttgcacagtattgtgaagtgcttgtttcctcgaccattcagcagatcattgtttaataagggattgcctcacattgaaccttatgtgaaacatggtactctaaggcttcttctggagttactgaaattgctggactctatttttggtggtttgtattgtaattctaattccaacaatccattcatgcaacatatgatgtctatcaaggtcgaaatccagaattatgttcaagcatttcttcccgatctgcaggttttattaaatctactttcctctttagatgccaattctgaagcccgtaactcaagtttaaagagaaatgcatgccatcatgaacataatagcagtagtaggaagaagttaaaacttgacacttcggagagtggtgatatagatatagttgttgctgggataagttctactccagatattgatttgactggcaacagtgaaacagttgacggtggagcaagagaagatgctttggatgatgaagaggatctcaagaatagcataggcgaaatttggggcgtggacctttgttcgatggaaattaacacattggaagaaatggaatcatacttactgtctaaactgcttgatgctctcagatattaccgccgtgctctgccttacgctttggataattcttttgaaacattcaagggtcttctcaaaagccctttggaattaacaagtcatttgcaggtctcagtgttgtctttgcttgtggaatacattgaatggtgtcctgacgatgtaattcctatcagaactccacccatgttgtacaaatacctacaaccattcattaaattgttaatgttttctccgtacaatgaaacaagggatctggcatacaagctggccttggcagctatgttcagtactggtgcttttgatgggaatcttcacgagatagcagcatggtttttatttttaccaggttatcatggaaagaaaccccctgtcaaaatcttggaggttgatgtattacagagtttgactctatttgtcatatcattcttgtgcgatgccgtttctacccttgggaataatttaattaaatattgggatattcttaagaatcatgcccattgtttggaaggtggtgaaggtaattag

SEQ ID NO: 59408 - DNA, 600 bp, Glycine max
  Peptide Sequence Number=SeqID_176186
atgacgcagctgaagaggtcttccaatagcatgaagaagcagttgttgatgcccaaggttttccaggcgggtcgactaagtcatttggtcacatgttcattggacactgacgatcgggtacttatattggcttttgcggagaggtggcataaggaaactagcagtttccatcttccagtaggagacgtcaccctcgatgacatggcctttttgcttcatctgcccatcacaggtgcattctacatctttgaaactcttcatgtcgatgaagtggtgttgatgttagtggaactacttaaagtcagtggacatgaagccagaactgaggcagaacaatgtcatggggcatatagtggacactacgcatggggagttgctaccctagtgcatatgtacaataatttgaatgatgcttctaagagcagcagcagacaacttgctaaatatatcacactattacagtgttggatttatgatcatttttcatctcttgctgaggcttttacggatgaagactatgatgaaagatcaccacatgcctacagttggacctctacgaaggcattaccagtgtcgacgtatcggaagcatatagattga

SEQ ID NO: 59409 - DNA, 234 bp, Glycine max
  Peptide Sequence Number=SeqID_176187
atggtgatgacgacagcaacaacgataataataattatggacgacaatagtgatgaagacaacaattataacaaggataacaatcatgatggtgtaataacgatggtgatcacgataacaatggcagtgactatccttgtggtggtggcggtgatgatgcgtctgggccttaaggactttctttctagggcgttgctaggtgcaccaggcatattgctcgtgcaccaagcataa

SEQ ID NO: 59410 - DNA, 156 bp, Glycine max
  Peptide Sequence Number=SeqID_176188
atgggataccagagaaagaagttgcactgtacattccgtcgttgttgtaataaagtgcatgcgttaaatggtagatggacatgctatgagggactttgtcagggcccttgtattgttgacccgtttccttttgatgaatatactagtacaatctaa

SEQ ID NO: 59411 - DNA, 588 bp, Glycine max
  Peptide Sequence Number=SeqID_176189
atggtgacgtttagggttttgcacaatctgaccaaggagttggaccaccttgattgtagtaagaaaaagggtaaagttggtggtgttaatgtgtctggcttatctaagggacatgaatcccaagggattgtggatgattatgtgagcaaggacaaggaggtgttgctgagtgttgacatggctttggagccgaaatctattttgcgacctagggttaaggttcccaaggatcagattaaggaagcatgcagaccttggaagaaggcaattgttgtgaagttgttaaggaaaaaactgagtatgagatttctgagagttaggttacccaagctttggcaacctttgggtgagatggagatgatagacctggagagtgactattttctcattaggtggtccatgaatggtcatggaccagtatttgttggttcagagatggaccctgatttttttccctatgagagacaaatgagaaaggtggctatatataggcacaaaaagaagtatgcctcttggaaggccatgagattaatggtgtgggagttgggagctctattatgtcatttcaaaaaggtcctaagtgagtga

SEQ ID NO: 59412 - DNA, 1546 bp, Glycine max
  Peptide Sequence Number=SeqID_176190
tatggcaaatgagggatcatcaaatccttctagcactgattctggatggaaatattgtactcgaggacaaggaaatagttgtgtatgcaatttctgtggcaaggttacaaaaggtggaattactagagcaaaagaacacttgatggcaaagcctggcaatgttgcagcctatgccaaatgtcccaaagaagttagagaagaactatggggatatttgaaggatacaaagaagcaagagagtgaaacatttcaaaggatgcgtcaacattttcttgaagactatggtgatagtgatgaagaaagagctcttgatgaagggcagtcatgtgacaaggaggctactgcaagggttcatcaatacatagctcgattttggtaccaagctggcttgtctttcaacctagtcaagctgcaaagctttcacaaaatgcttacaaatgtgggagcctttggaccaaatttgaggcctccttcttatcatgagataagagttccacttctggccaaggagttagagaacacagaaattttgttgaaagaccaaaaggagctatggggaagatttggatgctcaattatgtctgatgtatggacagacagaaaacagagatctatcattaacttcttggtgaattgtacagcagggacaatgttctataaatcaattgatccatccaattttgtgaaatctggtgaaaagacatttgagttgttggactctattgtggaagagattggggaggaaaaggttgtccaagttataacaggcaatggaagcaactatgttttggcagacattggtaagttgccattgataaagaagacaattctaagagcaatatcccttgttggcttcatctatagccattcaagtactttgagcttgttgaggtttgctacatccttcctcacattagaaaggctccataaggagaaaggcaatcttagaaagatgtttgtatcagatgattggacaaataataaattgtccaaggaagccaaagggaaggaagcaacgaaaactgtacttatgtcagctttttggaataatgtgctctatatacttaaggtgatggctccacttgtgaaggcaatggagaaggcaaaagaagctataaggaagtcatttgaatataatgaaagcaagtataaagaagtgtttgaaattattgacagtaggtggacttgccaacttcatcaccccttgcatgcagctggtcactttctaaacccagatttattcttcagcaatcattctatggaatttgattttgaggtggtaaatggattgtatgtatgccttgaaaaattggtgcctgatcaagagccaatgacgtataccaggcaaaagactaaaaagaaaaaggaaccagaatcccttggtgttgaagatgctacacctaagacaaaaagaggccaagtgagaggatcttcatcccttagaggaaaagagcaaatgattaaagttgaagataatgcagtcttggaagaatctgaagagttacaaggcattgattttggggactcagaagaagttagcttttag

SEQ ID NO: 59413 - DNA, 162 bp, Glycine max
  Peptide Sequence Number=SeqID_176191
atgcagaagaaaatggtggaagagggtcaaggagtggaaagggaaaggagaagtcgacacatgtcccaggccaactttgttttaataacaggaaatagattcaagatcatccttggagttttcctatcaatttttgctaactcgggctatcaagatgcatga

SEQ ID NO: 59414 - DNA, 1362 bp, Glycine max
  Peptide Sequence Number=SeqID_176192
atgtccaacaggttttgcaagttctatgcccgtggagcatgtttgaagggggatcaatgtgattttgctcatgagaaaaaggatgatatttgcagctattatcagaaaggattctgtgcatatggtagtagatgcagatataagcatgtcaaagcttcccaaccgtcatcttcagcaaatggacgccattctcctgttttggatcctgtggtgaatcatatcactaaaggaacatcaagttgggttctgaaggctgtgaagtcatcttcatcggacaagcgtgcaaggagctcgcaaaaaaagaatccagcctctcttggaaatgatgttggtcaatccagtactagtagtgctataccatctgaacatttgttttgtgcatttgctgctgccaactgcccccttgaagataaatgttctcgcattcatggaaatcagtgcttatactgtagaaaattttgcttacatccttctgattggaaggaaaaagaaaatcatttgaggacttgtgagaaaaagggaaaataccttaaggctttggaagatagtcaagaagtagagtgcaatgtttgtttggaacgtgttctgtccaaacctaaaccagctgattgtaagtttgggctgcttcctgaatgtgaccatgctttctgtttatcctgtatccgcaattggcgtaatagtgctgccccaacatctggaatggacatcggtaatgctggcactgctaatacagtcagaacctgtcctgtttgtcgcaaactatcatattttgtcattccaagtggtatttggtattctactaaggaagaaaaacaggaaattatcaacaactacaaggcaaactgcaaattaattgattgcaagcattttaactttggaaatgggaattgtccattcggggctagttgcttctacaagcatacagtgaagcctggctcttacacatggatacatcacaggccaccacctcagtgtagacagaaccattttgatatgtatgacatgttggacatgctccaagatgttgacttaacaagtgcagaatatttttccatcatgaggggttcagacttttttgatgatatggatccatttgagatgatggatatatctcataggcttgctggtgactcaggtccttgtttaggtctttttgattctgatgaggaggacttggatatttttcagatggctgcattgtcggaagcgcttgcttctggtgtggatgattttggtcccgaagatattggtaatgaagatttcaatcctatggaggctgccttgttaccaatgatgatgcattctaatatggaagatgaagatgatgatgaggaagaagaatacagtgatgaagactactag

SEQ ID NO: 59415 - DNA, 213 bp, Glycine max
  Peptide Sequence Number=SeqID_176193
atggatgtctcccatatggacctacctggccaccaacgtcctaccccaagaggcatcagaagccagaaagccattgctgaagtgtgtcgacaaagatcacacgaagtatgtcctggacaagctaggtacacagaggaatttgccaaatgcacacaggaggtcggagcatggcagctagagtcatctgcatcggttacttttggccgaccttga

SEQ ID NO: 59416 - DNA, 102 bp, Glycine max
  Peptide Sequence Number=SeqID_176194
atgggctacaaatttgtatattcattgttgatggagcaaccaattatgaggacactcatctactggtaccttttggttgatgcactcagtgaagctatttga

SEQ ID NO: 59417 - DNA, 267 bp, Glycine max
  Peptide Sequence Number=SeqID_176195
atggcggcggcggcagttaaggttgttaagggctgtttgaagggtagtagaagaggatgcttgcatgatggggagtgtggtgctgcagaggatggttttggggtggtggttgtggcggctgaggagagaattgccgatggtgatgagaacatggtggttgtggccatgaagattgaggaagtagaggattgggcttatgtggagcctgacccactgaaatctttgggggctaccaataggagtatgccatgtaagaaatcggaatga

SEQ ID NO: 59418 - DNA, 330 bp, Glycine max
  Peptide Sequence Number=SeqID_176196
atggagggttatttaaataaagaatcccccctccgtctcaaagctttcctcggatctgaccttacgcgaaagaagaaccctggaagagagcgatccataatccattggtatacacagctatctcttgagcttcttagcaaagagaattttgagcagaaacttggtggtggtgttggaagaggaacaatacatcgtccctttggtattccggcaaacccagaatccactgttggcttggatacaccgttgtgtaagctgtgttgggatgaacaagtcaagggtaagttttcacttcttgtttctttcatgtatgatgaatgggtggactag

SEQ ID NO: 59419 - DNA, 624 bp, Glycine max
  Peptide Sequence Number=SeqID_176197
atggcaccgccgccagcgccgcgaactacggcgggtatggtggcaactccagcaagaaggactctgctgagtatgtctacgacgtgcctgctggctggaaggaacggtaccaatggaacggacagtgagttttataacccaagaaagaaggcagagaaagagtacctcacttttctcgccgggtttcgccaacttgcgccaaaggatgtgattttgaacaacttggcactgtctgatgtggacctgcaggacctgattggcaatgctgacagtgtgacctctgaggaggtgaaggatgataaggggcagctgtactatgtgtatgagattgatggtgttggcactcatagcttgatctcagtgacttgtgctaagaacaagctctatgcacattttgtcaatgctcctactcctgagtggaacagagataaggacgtgttgaggcatgttcatgagtcttttaagactagtgtagctgttgcaaggtgtaagtctaggttgtttgtggttgaacttgcgagtgttcttgtagttgagttaggcactgattatctgttctatgcagaggatggtgtccttaggatggcttcttttgataaatttgggatttttactgtttgttag

SEQ ID NO: 59420 - DNA, 309 bp, Glycine max
  Peptide Sequence Number=SeqID_176198
atgcagagaaccaaggggaaccttttggaagctaatttggaccacaacccaagctttatttggcgtagcatctattcttcacaggtggtcgttaagcatgcattaggtggcgtttgggaaatggtaaaagcctcattgcatggaatgatccttggttacgcgatactgacaacccgagatagtttggaagatcttagagtttgtgaactcattgagcctactactaaaacttggcccaatgatgatattcagcataatttcaattcgagtgatgctgcaagattctatccatgccaatccattttgtag

SEQ ID NO: 59421 - DNA, 3714 bp, Glycine max
  Peptide Sequence Number=SeqID_176199
atgacccataaacttgacactctcatctcaaccttggccactaaatcccctgaaccttcacccacctcacctcaccatgcttccccatcctcacccccatcccatcctcctcgagtcaagcttgatgtgccccggttcgatgggtctgaccctttgggttggatattcaaaatcactcaattttttgaatatcaccacaccccagaccacgaccggctcaccatcgcgtccttctacatggacggccgtgctctagcctggtatcagtggatggccgccctgttcaaattaacccagaaaaccacagtgcaggcttacctctctgaattcgaggatctcgcgaaccgcatcgtgggtctcccacctcactttctcctcagctgcttcgtctcaggcctcaatgcggatattcatcgcgaggttcagccattgcaaccattaacggttacccaagctgctggtcttgcacgactgcaagaagaaaagctcttcgaggcgcgacgggcgatgcgtcctcgctcgaccccatttccctctcagcctccaccctcgggcccacccccaatttcgctacctctttctccttcaggttccacagccaagcctctctccatcatccctttgaaacgcctcaccccagaggaactgatttcgcgcagagagcgaggcttatgcttcaattgcgacgaacgctaccatcgtggtcatcgttgcaattctagggtaaacctcttagtggctgatgaggacgagcaacccgctgaagaatataacgtgttgggcttggaacccgactcgcctgacccatctgtgttaatccttgtagatgggggtagcacccataatttcattcaagactccatggttgctggattgggccttattcctcgtcctaccatgcctttgaaagttatggtgggcaatggtcaattccttcattgccaccaagtttgtcaagcggtgccactgacaattcagaacattgtcttcctcgttgaccttcacatgttgcctctgtgtggtgccaacgttgtactgggggtccagtggttacgctttctaggtccaatcttaacggactacacctcactctcgatgaaattcatgcataatggacgcattattgaattcacgggcgaagatacttccaccctccaacctctcacttccaaccaagttcggcgtctggttcgcactgccgaagccagcattgacttccacctttccgttatccccctagacacatccccttccgatacatccaatcctccctgcccacccgcaatccagtcactcttaaccaaattcgcctcactgtttcaacctcccactactctcccttcctcccggccaacagaccaccatatccacttaacctcaaattcacaacctgttaatgtgcgcccgtatagatatccacattatcagaaagctgagattgaatcacaggtagcttctatgttgcagagggggattattcgcccaagtacgagtccattttcttctccggtgctcctcattcggaaacacgatgcaacctggagattttgcgtggattacagagcacttaatgccctcactatcaaggatcgtttttcaatacctacgatagacgagctattggacgaattaggtggcgcttcctggttctctaaattagatttattacaaggttatcatcagattctcatgtctgaagaagatatctgcaagactgccttccgcacacaccatgggcactttgaattccgggtgatgcccttcgggctatgcaatgccccctcgtccttccaagccacaatgaatacaatctttcgtccttaccttcgtcaattcattattgttttctttgatgacattctaatttacagcgccacgttggaggatcatgtgcttcatttagagcaagcttttcaaattttgttgcaggaacaattcgtcctgaaactttccaagtgcatgttttctcaacctcaagttgaatacctgggccatgtggtatcggcacagggagttgaaccagtgatggccaaggtgcaggccatacagcaatggccggaatcgcagtcagcacgcactctcaggaattttttgggccttgctggtttctatagacgcttcattcgcggctatgcaaccattgcgacctctctgaccaaattggtcacggcggatccttttcagtggactgaggaagctcatgctgccttcgttcaccttaaacaaatgctgacatctactcctgtgattcaaacacctgagcagcagatgtatctcgctcgcttgatgggatatgattacaccatcatgtatcgttccggtagttccaataaggctgtagacgcattttccaggacgtatttggcttccccaagctctaccttttacttcaacactgctctcggagtaccattttaccccaaccggcggccacatgggcatagccaagaccttagcacgattgacggagaacttctactggaagggaattcgccaggattacgaaactcgcaagccggcgggattgctctgccccttaccgatacccttgcgcccatgggaggacttatccctcgacttcatcacagggctcccggtgttccaaggccataccgttattctcgtggtcttgaccgcttctccaaaggcatttatctcgaaatgttgcccacgcgacacactgcatacacggtggtcgttctcttcatggatctcgtcgaaaaacttcatggaatgccccgcagcttagttttcgatcgtgaccccttatttctcagtaggtttgggcaggagctttttcatttgagtggcacgaagctcaggctcagctctgcatatcaccctcaatctgatggacagaccgagatcctgaacagagtgatcgagcaataccttcgcacttttgttcataagaagccatcttcctggggcaagctcttgcgatgggtggaatggtcgtataatacctcttggaattcaagctccggtctctccccgtatgagattacttttggtaagaagactgtcaattttccgcgatacttggaaggtgattccaccattgctaccgttgaagacatgctcactgatcgtcaagctattttcgaggaaattaagaagaaattggagaaagcccagagtcgtatgaaacactttgctgatgctagaaggcgcgatgttcacttcaacgttggcgacatggtcctggtcaaactacgaccacatcgtcagaagtcagtgacgggtcaacccagtgggttctccaaacatgacaagacattttatgggccttttcgggtcattgagcatattgggccaacaacttataggcttaagttaccagaggatgctcatatacaccctatccaccacagttcactcctcaagccttttcgttctccagagcccgataatgaccagtattgcagcacattgcctgctcgctatgagaatgatcaccttgtgattaccccgttagccatcctcaacacgcttaactctgcagattctaaactagaggtccttgttcaatggcaaggtttatcacctgatgataccacttgggagaactgggatcagttgcgtgaagcttatcaccttgaggaccaggtgcttccggaaggggtgaaggatgatagcaaggcagcagcagctagagaaattagaccaagaaggaagaacagagcaccaacatccctcaaggactttgtctga

SEQ ID NO: 59422 - DNA, 2274 bp, Glycine max
  Peptide Sequence Number=SeqID_176200
atggcttccggagctgtgccaactacgttttctaccctcaagacatgggattccagtttggggtttgcaaaaagcatggattttgtgagagtttccgatttgaagagcatgaaatcttctgcgaggaaaagggtgtcaattatcaggaactcaaatcctggccaagatattgctgaacttcaacctgcatccccaggaagccctcttttgggtatgcttgctttctttcttagctttggtttattgtttgttgagccatttaaagctttgattgctttcagtgtgtttggacctgttgagaagagaaaaacaaacacagtgatggttggtaacgtggctattggtagcgagcatcctataagaattcagaccatgactacgactgacactaaggatgttgctgggacagttgaacaggtgatgagaatagcagataaaggagctgatattgtacggataacagttcaagggaagaaagaagctgatgcttgttttgagattaaaaacacccttgttcagaaaaattacaacataccgttggtggctgatattcattttgctccctctgttgctttgcgggtagctgaatgctttgataagattcgtgtaaaccctggaaattttgctgatagacgggctcaatttgaaacattagagtacacagaagaagactatcagaaagaacttgagcatattgaaaaggttttcacaccattggttgagaaatgtaagaaatatgggagagcaatgcgcattgggacaaaccatggaagtctttctgatcgtataatgagctactatggagactcgcctaggggaatggtagaatctgcttttgaatttgcaaggatatgccgaaagttagactatcacaattttgttttttctatgaaagcaagcaacccagttatcatggttcaggcataccgcttacttgtggctgaaatgtatgtccaaggctgggattatccattacacttgggtgttactgaagctggagaaggtgaggatgggaggatgaagtctgcaataggcattggaactcttcttcaggatggattgggtgatacaattagggtttctctcacagaaccaccagaggaggagatagacccttgcagaaggttggcaaatcttggaatgatagcttctgaactccagaagggggtggaaccttttgaagaaaagcacagacattattttgactttcagcgccgatctggtcaattgccagtgcaaaaagagggtgaggaggtggattacagaggtgtactgcaccgtgatggttctgttctcatgtcagtctccttggatcaattaaagatgccagaggtcctctacaagtcacttgctgccaaactcattgttggcatgccatttaaggatctggcaactgtagattcaattttattacgggaagttcctcctgtagatgatgctgatgctcgactagcactcaagagactgatagatattagcatgggggttataactcctttgtcagaacagctaacaaagccattacccaatgccatggttctagtaaaccttaaggaaatatcttccagagcttataagcttttgccacaaggcacacgcttggttgtgtctgtacgaggtgatgagccttatgaagaactggacattcttaaaggcattgatgctactatgcttctccatgaccttccttatacagaagacaaaattagcagagtgcatgcggccaggcggttatttgagtacctatccgacaattctctaaacttccctgttattcaccatattcagttcccaaatgggattcacagagatgacttggtaattggtgctggttctgatgctggagcccttctggtggatgggcttggagatggacttcttttggaagcgccagacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccccggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagaacatggacgatgggtggaccctcctgccgaggagtaa

SEQ ID NO: 59423 - DNA, 204 bp, Glycine max
  Peptide Sequence Number=SeqID_176201
atgccttggtgttgttgtgtaccggttccgttttcatcacgtgaagaaaaaaatagatgttcttccatttcgtgtttgacgttagctacgctagagctagaacctcaacaggttacaactttagtgatggagaggaacagaaaggagagttcagacgaatggagaagaacgaaaatgggaaacgggacaacggcgagtcactga

SEQ ID NO: 59424 - DNA, 1083 bp, Glycine max
  Peptide Sequence Number=SeqID_176202
atgcaagctgatgaggatgttggaaagatagcactcgctgtgcctgttttagtttgctgctggttgtttgtttgtcatatacatgttgttgacattgctcttgaatgcattacagctaaagctctagaactatttttgcaagatctttgtgaccgcacttatgaaataactcttcaaagaggagcaaagaccatgaattcattgcatttttataaatggaagctaaatgtgaaacaggaaagtagccatattcttagctttggaagagagacccaggggatgatagctcgttctcgttcagtgcctgttaataccaaagaaaaaggcataaggagaatggattcggttttccgcattattccatccactcctcgcgtaattgaagtgaatgaaacaacaaaggatacagaaaatggtgatgatggtgaagatattgctgaagaggaagccgtgtgcagaatttgtctggttgatctatgtgaaggaggtgagacattaaagatggaatgcagctgcaagggtgaacttgctctggctcaccaagaatgtgctattaaatggtttagtatcaagggtaacaagacctgtgatgtgtgcaaggatgaggttcggaacctccctgtcactctcttatggatccgaagtgttcgaactcagaatactagagcaaggtccgagcagggagatgatttcagggcttggcaggaactcccagtgcttgtcattgtcaacatgcttgcttatttctgtttccttgagcagctgttggttggaagaatgagaaccaaggcaattttcatctctcttccgtttgcctgtgcactgggtctactctcctccgtaacatcatcaaccatggtcaaaggaatcaggatcagccatcgagggttagttcaaatattggttggtaagcatgcggttttggcaatccttcttgcaacgtttgctgggtttggcgtggtgatgagtggaagttcaattcttttggagtcttctagatggagaagaagatggcaagctttatcagagctgcagcgtggttcttcagcgatgacacaagaagggatatcaagtcagagctga

SEQ ID NO: 59425 - DNA, 288 bp, Glycine max
  Peptide Sequence Number=SeqID_176203
atgattgcttgcaaagttgctgaaaaaccagcaagcttgtgttcgtctccatacctgaaacaagaaatagagccaggaggagtgagaggaaggttgggaatcgtggatggtgatctcttgaatttcgtggtggaggacgtcatcgacctgggagacgcttgtggcggtgctgctgccgcccctttcagcggcgtaaccgctgctggtgggactggaggggtcggaggagggtcgggcggaggatccgtgagagagctccggtggttcggaatcgaagaggctcggtga

SEQ ID NO: 59426 - DNA, 954 bp, Glycine max
  Peptide Sequence Number=SeqID_176204
atggctatcttttatgttttcaggggtgaccatgtcaaattggtgagggctggaaagcatcaggtggtttttcttgtaaaaggaccaatttacttggtctgcatcagctgcacagaagagccttatgagtcactaagggggcagttggagcttattcatggtcagatgattgttatactaacaaagtcagtaaacagatgttttgagaagaatccgaagtttgatatgacacccttgcttggtggaacagacattgtcttctcttcactaatccactcttttagttggaatccagctacatttcttcatgcctacacttgtctacctcttgcatatgcaaccaggcaagctgctggtgctatcttgcaagacgttgctgattctggtgttctgtttgctattctgatgtgcagacacaaggtaatcagtctagttggtgctcagaaagcctctcttcatccagatgatatgctgctgttggccaactttgttatgtcatcagaatcctttaggacttcagaagcattttctcctgtttgcttgccgagatacaatgctttggcatttttaggtcacagagctttacatgtgtggcaggatgacacatacttgatgttgctgaccacaagttctgatgcattttatcatcttaaggattgcaggattcgtattgaaatggtccttttgaagtcaaatgtccttaatgaagttcagagatccttgctagatggtggcatgcatgttgaggatctaccacccttacctcgttctggatcatctcctcatttgagtcagcataggcttccatcagattctcctgaaagggaacctacttgtcgcattggtggtgttgctgggttgtggcatttcatatatcgcagcatttatctggatcaatatatatcttcagagttctcatcaccaattaacactcctaagcagcagaaaaggtag

SEQ ID NO: 59427 - DNA, 606 bp, Glycine max
  Peptide Sequence Number=SeqID_176205
atggtgtctccacaaaggaggaatacatggacagttgttgatctcgtgccgtatgtggagaaaataagcattttatccaaagagcaagagagaatcacggagcttgtgtcacatggtcaagcaacagagcatccacaagagtttcatattctcccgtcaagtgttgaaactcaaggcataggcaaacgaagggaagctgttgaagcggaaccatatttctacccacagatggaagagcgtggccatggaatgtattacacaccaccaacattttctcagtatccgacacagatgtatcaatatcctttcgaaggtcatcaaagtgatacttctgcaagcgaacattcattgggtggtgttgcagaaacacatcctaatttttcatggcctactatgaccccttcacagcaacatgatgccccaattccaacacttaatgccccattcggtactcaatggaatgtacccggaacaatacctaatatggatgacttattaggtgttgatttacgtcataaattttctattgaggctgaccaagttgaagcggggagacatcgaggcaaaaaacgatatatttgtgcgatttggtgtcaacaacattaa

SEQ ID NO: 59428 - DNA, 456 bp, Glycine max
  Peptide Sequence Number=SeqID_176206
atgtatatcggggtaaagggtgtcacagtagtgaatttattgcaatacgcggatgacaccatattctttgggaaagaaaatacacaaaacatgttggttatcaaatcgctaatgcactgtttcaaagtggcatccgagctcaaaggtgggaatgaggataggagaaaaatagcttgggttagttgggaccaaatttttcgtccaaaagagtgtggaggtctaggaattaaaaacattaggcggtttaatgaggcgttgcttggaaagtggaggtggaacttattccatgaagaaaatgctttgcgaaaagagattttggtatcaaaatataatggttggagtgggctagtaagtgaggttgagagtgagagggatttctcaatttggtggagagacctaaggcttgtttgtggaagtagaagtgaggttacttggtttgacgacaatgtggagtga

SEQ ID NO: 59429 - DNA, 351 bp, Glycine max
  Peptide Sequence Number=SeqID_176207
atgtgtatatatgttcatgcgagaagtggtttaagcagaagcacaaaagagctctatacgagtcacttgaaaagatcaaatcagcttatgttgttggggttcatatcattgctcctaacggtaggacaaggtctaatatcgaggatatgcatatcagaaaaggttgccggaacatttcacccctgcagtaccaaaagagtgaaacacagcacgcccccattagatcatgatgatgacgaaaccaatggccggagattactagcggcgattctcagttccgatgacgagagtcaccggcgcattttagccttgggtgcaagggacaagtgcgcagcccaggtatgtatgtag

SEQ ID NO: 59430 - DNA, 480 bp, Glycine max
  Peptide Sequence Number=SeqID_176208
atggaaaaatccgacaagatgaatttcaaagagaagaaagaaaagaaaggatatatcacttgggaagataatgtcttaaattattcaagtgattcagagaagaaaatcataagtttgggtatcatgatgaaagactatgaaaatggagaagagcaaagtcgatacattgatagcaatttctccaaacacatggcatgcatcaaattggaagttggaagtagttattggaagttgaaagttaaaaatggaagttggaagttggaagtggaagtttactggaagttggaagttggaaatgaaagttattggaagttgaaagttgaaaatggaggttggaagttggaaggggaagtggttgtcatcatcaaaaagggggagaatgtaaatcatgaagattttgatgatatcaagaagaatttgcttgagaaagagggagatgtaaatcatgcaagctttgatggtgtcgagaagaaatcacat

SEQ ID NO: 59431 - DNA, 780 bp, Glycine max
  Peptide Sequence Number=SeqID_176209
atgcggccggagcaatgcaacccggcccatgccgactatgcggcggcgcgcgagctgatggagcaggaggtcaacgcggccatcgacggcgctttcgccggcggggccaccgcggtgacggtggccgacagccacgccatgatgcagaatctgcgcgccgatcgcctcgatgggcgcgcgcgcctggtgcagggtaaaccgcgtgggctgtcgatggtggaagggctgcaacaccaacgttacgacggcctgatgttcatcggctaccacagcgccgccggcgagcatggcgtgctggcgcataccatcaacggccgggccttttaccgcgtcagcctgaacggcgaagcggtgggcgaaagcgatctgtacgcggcggcggcggccgagttgaacgtgccgctgtggctggtgagcggcgacgacgagctgcaacgctgggtagcggaacgttacccgcacgtcggctatgcctgcgtcaagcgtgcgatctcgcaaaccgccgccgaatcgctcagcccgcagcgggcgcgcgccgagatccgcgaacgggcaatgcagcaggtgcgccagggcgggaagctgccggtggagcgccgcttcatgccgccttaccggctgacgctgatggcggccaaaccggtattggcggatctgttcagcctggtgcccggcgtggagcgccaggacgcgctcaccgtggccttcgacagcgacaacatggcggcgccaatccgcctgctcagcgtcttttcgtatctggcgacgacgcagaattga

SEQ ID NO: 59432 - DNA, 1183 bp, Glycine max
  Peptide Sequence Number=SeqID_176210
aaaaccgccgcgtttcggcggcaaggtggcggccttcgacgccgaacgcgtgctggcggtgccgggcgtggtggcggtgaaacaggttgccaccggcgtggcggtttacgccaaaaatacctgggcggcgatccaggggcgggagcggctgaaggtgacgtgggacgatgcgcaggccgaacggcgcaacaccgaggagatctacgccgaattccgccaggtggcgcagaaaaccggcgtggtggcgaagagccacggcaagccggacgaggtgttcgacaaggccgataaggtgatcgaggccgaatacaccttcccgtacgtcgcccacgcgccgatggagccgctggacggctatctgttctgggacggcgagagcgtcaaggcgcgctacggctgccaaattcaaacgctcgatcacaagcagctgtgcgatctgttcgagttgccgccggacaaggtgcagattgaaaccattctggcgggcggcagcttcggccggcgcatcgatttaggcaacccgacgctggggccggatctggcggccgacatggcggcggcggccaagggtatcggccccggccacggcgtgaaggtggtatggacgcgcgaggacgacatccgcaacggctggtatcgcccgatgatcctgcaccgcctgcgcggcgccattcgcggcggcaaggtggtgggctggaccgataccgtggtcggccactcctggacgcgccacagcgcgatggatgcgctggtggtcaacggcctcgatcagatgatggtcgagggcgccagcgaggtgtcatacaccttcgaagccttccgctgcgatgcgcacatcgtgcccggcaaggtgccgaccacctcgctgcggtcggtcgccagcacccacaccggccacgcggtggagagctttatcgatcaactgctgcaggaaaccggccaggatccggtcgaagggcggctggcgctgatgggcgacgcgccgcgcgcggcgggcgcgctgcgggcggtagcgaaagccgctgactggcagggcgcgaaagtggtggacgggcgcgcgcgcggcgtgggcgtcgccaaggcgttcgatacctatgtggcgcaggtggccgaggtgtcgatcggcgaaggcggcatcccgaaagtgcacaaggtgtggtgcgcggtggactgcggcgtggcg

SEQ ID NO: 59433 - DNA, 438 bp, Glycine max
  Peptide Sequence Number=SeqID_176211
atgaggacacgtagccctctaaaggtgagggcgtgcaaccctctcaaggtgaggatgtatagtcctttggaggtgagggcgtgtagtcctctcaaggtgagggcgtgcagccctctgttggcgaggacgtgtagtcctctaaaggtgagggcgtgtagccctctgttggcgaggacgtgtagttctctaaaggtgagggcgtgtagccctacgaaggtgagtacatgcagtcctctgatggcgagggcgtgtagccctctaaaggtgaggacgtgtggtcctctcaacgatgaggtacccagggtgagggcgtgtagccctctcaaggcgaggacatgtagtcctctggaggtgagggcgtgcagccctctcaaggtgaggacgtgtagtcctctcaaggcgaggacgtgtagtcctctcaacggtgagggtaactag

SEQ ID NO: 59434 - DNA, 393 bp, Glycine max
  Peptide Sequence Number=SeqID_176212
atggttgagaagacaaagaaaagactggaagaagctgcccaatctggaagcactgagggcatcattgaccctccatctcccatcagacgccacgattctttggaagagcaggtgtcacagggatcgttcgtccctcatggacgtcaggatgtcctgactgttgccattgggcaaccagagtaccctggccgtgttcgtgcagttggagccggtgtcaccataaagcaatactttggatcggctccacgaacgtcccgaagttcttcctccatgcctcctgaagacctacaacagctgacccaacaaatcagagaccaactagaggagtcaatcacagaaaaagtgactcgacagctgatggcatccttcagccagatgcagtcccagttttag

SEQ ID NO: 59435 - DNA, 951 bp, Glycine max
  Peptide Sequence Number=SeqID_176213
ttcagaggtctacacgtcctcgccatcagagggctgcacgccctcaccttggaaggactactcttcctacccatcaaagggctgcaggccctcaccttcagaggactacatgtcctcgccatcagaaggttgcacgccctcaccattagaagactacatgtcctcgcaatcagagggttgcacgccctcacctttagaggactacacgtccttgccatcagaggactgcacgacctcgccttcagaggaatacacgtcctcgctattagaggttcgcacgcgctcaccttcagaggactacacgtcctcaccatcagagagctgcacgtcttcaccatcagagggctgcacgtcctcaccttcagagggctgcatgtcttcaccatcagagggctacacgccctcaccattagaggactacacgtcctcgccattaaaggactacacgttctcgccatcagagggctgcactcccacaccttaagaggactacacgccctcacctttagaggattacacgtcctagccatcagagggctgcacgccattaccttcagaggactactaatcgttgacatcagagggccgcactacctaacctttagaggactacacgtcctcgccataagagggtcgcgggtcgtcacattcagaggactacacgtcctcaccatcatagggctacacgccctcatctttagaggactacacgtcctcaccatcacagggctgcaggccctcactttcagaggactacatgtcctcgccatcagagggttgcacgccctcacctttagaggactacacgtcctcaccttcagagagctggacgtcttcaccatcagagggctgcacgtcctcgccatcagagggctgcacgccctcaccttcagagggctgcacgccctcaccatcagagggctacacgccctcacctttagaggactacac

SEQ ID NO: 59436 - DNA, 285 bp, Glycine max
  Peptide Sequence Number=SeqID_176214
atggaaggagttcttggagcttctacgtttttagaaatttttggagagagagaaagggccaaaaaggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattgtgcaagcaatcaatgaggcaaaacacaccgaataaaatagaagatgaaggctcaaattctcaccaagggtaa

SEQ ID NO: 59437 - DNA, 219 bp, Glycine max
  Peptide Sequence Number=SeqID_176215
atgtacgcagttatgaacaagtctcagggctctccaatcaggttcgcaaaatattcgttttctgtcactactaaggttgatgcgctgcctcctgctatccctccaagtagtacacagccacagccctttattccccttctagctccttccccattgatacctttcacaaataattcggtgcctaagttatcaggtataaagggaggaagagagaggtaa

SEQ ID NO: 59438 - DNA, 294 bp, Glycine max
  Peptide Sequence Number=SeqID_176216
atgcatggtgcaagcaaaccgccagtgggactggcgggtttgctgctggtgactggactcgccactgacagtggcgatatgcacatgcagatgaaggactcgccactcagagtagcgatatacacatggagtgggaaccgccagtcaaactggcgagttccaggctgcttcgtagggttgctttttcagcctttttcaggtggcagggggtgcttcagctttttcagccaaaaggcaagttgcaactgccattggcgagttaagggcaagttgcaactgccattggcgatttag

SEQ ID NO: 59439 - DNA, 420 bp, Glycine max
  Peptide Sequence Number=SeqID_176217
atggaagattggaaagacaccctcaccaccctcatcatcgctgattggaaagacattgccggggagatccccacttgcgtcaccgcgcttccctctctccgcctcctggacctcatcaacaacaagctctccatcgagatcctcgctgacgtcggcaaactctcacgtctgacagtcccgaaacttgccaacaacgcccttagcggcaaaattccagcatccatcactcgactgggctcactaaaacacctcgacctcaacaataatcagctctgcggcgagattccgaaagactttgggaatctggccatgttgagctgcatgttgctaagtcggaaccagctaaacggtacgccgctgagagagagttacggagaatacgtgtggctaagagagggagagaaagctggtgtgcgctga

SEQ ID NO: 59440 - DNA, 288 bp, Glycine max
  Peptide Sequence Number=SeqID_176218
atgtgggatactctccaattaacccatgaaggaaccacagatgtaaaaagggaatggcagcccaaggaacacgagatggaacttcaacaacttaatcaaaatgaagaaaatgacaaaaagaagagaagtatagcccttaaggcctcatcatcaatgcaagaagaaaacgaagaagaagattcagatgatgaagaagatttttctttctttgttaagaaatttcataaattcatcaagaaaagaagaattgataggcgtcagaacttcaataatggaagaaaatcataa

SEQ ID NO: 59441 - DNA, 342 bp, Glycine max
  misc_feature (247)..(247): n is a, c, g, or t
  Peptide Sequence Number=SeqID_176219
atgttagaagacgactgtcggtatctgatggtaagtaagatacctacggtcggtatatctttgaaagctcagacggagataaacggactcctcgagggctacttaaggcactttagtgcaaaccaaccagaaggactggagctgttggatgtagctcagtgctgctataaattaacaaccaaaaagctctgcgtcgaacttcagccccttcgagttggccacggggcaacagcctctgacgccccanaccattgcggcaggaggaggcttgcccatcagcctacttttttgccaagacgtggcaggagcgcaacgaacctagcccaaacctacttaaactaa

SEQ ID NO: 59442 - DNA, 805 bp, Glycine max
  Peptide Sequence Number=SeqID_176220
atgctgaacaaactccaccaacaattgattcatttggtctgtagcgaggaaggcgccagccgcgctgacctcgcccgcctgacgggtatgagtaaagcggccattggtgcgctggtaaaagagatgctggctgatggtctgctacaggagagcgatatggccgcttccggcggtcagggacgcccctccgtcaccctgtccctggcgccggacgctgcttacgccatcggcatctcactgattgataatcagcttgtgttggtgctgatgaatgccagcggcgagaaaatcgccgagcgcctgctcacgccacagcttgaaatccccgacgtaatccagcaactggcgggtgaaatccgcagtttattaaacgatacgctcatcgagcgccaacggctcgtcggcatcggttttgccctgtctgcctttgtggacgccgcgcaagcggtctgcgtacagtcggcgctgctgggctggcatcaggtgccgctagctgaattgttaagccacgcgaccggcgggatcccggtatttattgaaaacgacacccgggcgctggcgaactgggagaaaacgtttggtcatctgcgcaagctggagagcgcagtggtgatttcccacggcagcggcatcggcagcgcggcggtcatctatgaccgaatctggcgcggcgcccacggcggcgcaggcgaaatagcccattgcaccattgtgccggcgggcacgccttgtcgctgcgggaagcgcggctgtctcgacaccattgcgtctctcaccggtatctttgaacaggcgcgcatggccg

SEQ ID NO: 59443 - DNA, 279 bp, Glycine max
  Peptide Sequence Number=SeqID_176221
atgcagggtttgcagctgcaacaggctggattcgccaatgaggatggcgggatgcgcttcacgggaatcgtcaagctggctgacgattttctttgtttcaaatttgtccattataaaagcgggaactcatctacgcttgcattgctttcttcttcttcttcatattactccagttcttcatattactacactacattgatgacagtgcttgttcctgttactattacatggtttcttctcctccgagctattacgtggtttttctatttgatatgctaa

SEQ ID NO: 59444 - DNA, 471 bp, Glycine max
  Peptide Sequence Number=SeqID_176222
atgtccatattaaaggccttcatacacctaaaactaagaccaccattagattttgcatcagttaacttattccagctcatccaatgcgtcccagaagaatctctaagtcatacgttcaagttaattgcacaaagaggaaaggaattggtaacaactcatgatgtcatttttggccatcacttaaaggataactgggacctacatttcacgatctccgacgaaatctcacaagaaaatgacttgttggctatcttcagctattccaatctcttgaagcttccaacttccgacagaatctttcgaaaagccattgctagagacatcgagaaccagcaacagtacatgatcacattggttaaccagggcagaaacttgccacacacaattgcgctgaatgttcaaaacctcaagaatgctggaacacatggtggcttgaggccacgcgaaatctgtgaacccattaaaccctaa

SEQ ID NO: 59445 - DNA, 2325 bp, Glycine max
  Peptide Sequence Number=SeqID_176223
atgcaagccggtattatgatgattccggcgagaaacatgccttcgatgatagcaagaaacaacaacgttgtagggttttttggatcatctgcacttttcactcttgcccagccgaacctgatggacgcgttggagatgggtcagaacacttccgagagtgaggttcctcgaatcctagaagacgagttcgacagtgccaccaagtccggtagtgaaaaccatgaaggtgcctctggtgaagaccaagaccctcgtcccaacaaaaagaagcgttaccaccgccacacccaacaccagatccaagaaatggaagcttttttcaaggagtgtccgcacccagatgacaagcaaaggaaggaactgagcagggagttagggttagagccattgcaggttaagttttggtttcagaacaagcgtactcagatgaagacacagcacgagcggcatgagaatacaaatctcagaaccgaaaacgagaagcttcgagcagataatatgaggtatagggaggctcttagcaatgcttcgtgtcctaattgtggtggaccaaccgctataggagaaatgtcattcgatgaacatcacttgaggcttgaaaacgcaaggctaagagaagagattgatcgcatctcagcaattgctgcaaagtatgtagggaagccagtggtgaactattcaaatatttctccttctctccctcctcgtccgttagaactaggggttggtggtgctggttttggaggccaaccagggattggtgtggacatgtatggagctggggatcttcttaggtcaattagtggacccactgaagctgataagccaataatcatagagctagctgttgcagctatggaggagctcattgggatggcacaaatgggtgagcctctttggttaactacccttgatggcacatccactatgctcaatgaggatgagtacattaggtcttttcctcgagggattggtccaaaacctagtggcttcaaatgtgaagcttcaagagaaactgctgttgttatcatgaaccatgtcaacctcgttgagattctcatggatgtggtgtcttccctggagagaaaaagaaagaaaatgttcaagaaccaatggtccacagtgttctctggtatagtctcaagagccatgactctggaagttctatcaacaggggtggctgggaactacaatggtgccttacaagtgatgacagcagaactacaactacctacaccacttgtgccaactcgcgagagttattttgtgaggtattgtaagcaacatgcagatgggacttgggcagttgtggatgtttctttggataatttgcgcccaggtccttcagccagatgtagaagaaggccttctggttgcttaattcaagaaatgccaaatggctattcaaaggtcacatgggttgagcatgtagaagtggatgatagaggtgttcacaatctttacaagcagcttgttagctctggacatgcatttggtgcaaaacgttgggttgcaaccttagatcgacaatgtgaaagactcgctagtgccatggcaacaaacattcccactgtagatgttggcgtgataacaaaccaagacgggagaaagagcatgatgaagctggctgaaagaatggtgataagcttttgtgctggagtgagtgcttccactgctcacacatggacaacactctctgggaccggtgctgatgatgtaagggttatgaccagaaagagtgtggatgaccctggaagaccccctggcatagttctcagtgctgccacttctttttggcttcctgttccacctaaacgagtctttgacttcctccgtgacgaaaactctaggaatgagtgggacattctttccaatggaggagttgtccaagaaatggcacacattgcaaacggaagagacacaggaaactgtgtatctctacttcgagtaaatagtgcaaattcgagccagagcaacatgttgatattacaagagagttgcaccaattcaacaggctcttttgtcatttatgctccggtggacattgttgcaatgaatgtggttctaaatggtggagacccagattacgtggcacttcttccttcagggtttgctattctccctgatggaaccacatcgcataatggaagtggtggcattggcgaaactggccctagtggttctctcttaaccgttgcgtttcaaatattggtggattctgttccaaccgcgaagctttctcttggatctgtggccactgtgaacaatctcattgcatgcactgttgagagaatcaaggcttctttgtctggtgaacctgcttga

SEQ ID NO: 59446 - DNA, 611 bp, Glycine max
  Peptide Sequence Number=SeqID_176224
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccatatctgcatgaagatggctatactataggtggtatagtaggctgcacccaaccaaggcgtgtggcagctatgagtgttgccaagagagttagcgaagagatggatacagagttgggtgataaaattggctatgctatacgttttgaggatgtgaccgggccaaataccattataaagctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaagctgcaccg

SEQ ID NO: 59447 - DNA, 796 bp, Glycine max
  Peptide Sequence Number=SeqID_176225
atggttttggccttagttgcacaagaagacatggaattggaacaacttgatgtaaggatagctttcttacatattgagcttgaagaagaaacctacatgactcaggcagaaggttttgtcaaaataggtgaagaaggaaagaaaattgagcatgatgttattgtctacttactcctctatgtaaatgatatgctaattaattgcaacaacaaggaagaaataaaaaaggtaaaggtgatgcttgagaatgaattcgaaatgaaggatataggggcttctagtaagattctgggcatgcagatcttaagggacaaaaccatgggaaccttattcatcactcaaaaaagctatatagctaagattttgaagaagttcaacatggatatgtctaaggcagtgtcaactcctatagctcaacattttaagcttttacatcaagattcaccaaagactgaagatgagttcccgaaaaaactccaaaccgagagctacaacagcttctccgcaagccgctttgacgccgagggagcttccagcttagccaacctctcgccgtggcccatcgctgctcactttaacttcccgttggctcaggtaatgcttcctgtcattggtggcaaaggcatcatcgtttgggatcacaagcatgacctcgatttgtcggagcaattgcaatttgcaaaagtgaaaatgatggagaggtttgctaagttgcttttgggagaggacatgtttggaggtggaaaaggggtgtatactacacttacaatctccaatgcaataaccaatctccctg

SEQ ID NO: 59448 - DNA, 423 bp, Glycine max
  Peptide Sequence Number=SeqID_176226
atgtcgtgggttcaaatctttcccactaacattctaacaaaaacaaacaaattaaaggaagctctagaaggagaaaataaattttccaccacgctatcaaacaaggacaagaaggatattcttgataaagcccatgatgccttgattatgtatcttggagacaaggcattgcttctactcaggtcactgccaagtgaatttgataacctttcaaacacactcatccatggcagagatacaatatcattaaaagaggctcaagctgctctgtcttcaaaggaattgaagcaaaggtctcagggaagaggaaatcaaacaggtgaagaactatacacaaggggcaagtcagaaaagagagattctaagaacaagaaaggattaagatccaagtcaagaaatggcaagaaagagtgccctgactaa

SEQ ID NO: 59449 - DNA, 285 bp, Glycine max
  Peptide Sequence Number=SeqID_176227
atggcgactcttgattccgacgtgcctatggttcccgccggcgagccctcgagcagcgccggtccttcttccaagaagcccaagcgcttcgagatcaagaagtggaacgccgtcgctctctgggcttgggacatcgttgtcgataactgtgctatctgccggaaccacatcatggatctctgcatcgagtgccaagccaaccaggctagcgccactagcgaggaatgcactgtggcttggggtatggtccgaacccctcttgttttatacttcgattttatgtga

SEQ ID NO: 59450 - DNA, 888 bp, Glycine max
  Peptide Sequence Number=SeqID_176228
atggtggcttggggtcattgttcattgaatttctcagctgctcaagatataatgaccacaactgctactgattgctggacttcctttgctccatatttggcaaacgttgtatgttgtcctcaatttgatgccatgctggtgaccctcatagggcagtctagcaaatactctggggtgctagctttgaacacaactcatgctcatcattgcctctctgatgttcaaaaggtcctggccagtcaaggagcaaatagggacctaaaaaaaatatgttcagtccacccaacaaatctcactgaggcctcttgtcctgttgtatttgttgatgaatttgagagtattgtagacacttcaagacttctgactgcttgtagaaaaattgatcctgtaaatgagtgttgcgatcaagtttgccaaaatgccatacattatgctgctagaaaaattgccttgaatgatttgtctaattcagatggaaatcatagcttgccttggccaacaactaggatcaatgattgcaagaatattgttcttcgttggctggctaataaacttgatccatccactgcaaatagtgtttttagaggactctcaaactgcaacctaaacagagtatgcccattggttttaccaaatgtcacaagtgttgtgaaagaatgcgggaatctcataaataaccaaacagcttgctgcaaagccatcaaaagttatgtgtcctatttgcaagaacagagttttgtaaccaatctgcaagccttgaaatgtgctacatcacttggaaagaaattgcagcaagaaaatgtctccaaaaatgtttataatctttgtcgtataagcctgaaggacttttctcttcaaggttggcattgtcatatttctcttgcttag

SEQ ID NO: 59451 - DNA, 228 bp, Glycine max
  Peptide Sequence Number=SeqID_176229
atggtgtcatctccttacttttgtgactttggaataagatatagtgcattagtgtgtaggtcattgcctcatgaggcttctgtggttgttactattcttcttagcttgcactggattactcaaactgttaacttctctggatttcattttatacaggagtttgtaaccatgcttttcacttccattgcatcagtcgatggctcaagactcgtcaagtttgtcctctag

SEQ ID NO: 59452 - DNA, 435 bp, Glycine max
  Peptide Sequence Number=SeqID_176230
atgaaaacagtgaatgatttcaattttaaagacaaaaaggctttagtaagggtggattttaatgttccgcaagatgatcagcttaaagttacggataatacaagaattgccgcggttaaaccaactattgataaaattcttaatgatgggggatctgtgattttaatgactcacttgggaagacctaaaggagaggtgaaagacgagttttcattgaagcatattcttgaggaagtatccaatgttttaggaaaagaggtaaaattcgtagaagaatctgtaggaccaaaagctgagcaggctgcttccgagcttaaacctgagaaaggagatgaaggctttgctgagcagctttctaaattaggagatgcctatgtgaatgatgcatttggtactgcacaaccgtgcacatgcttctacagcggtaatcgctaa

SEQ ID NO: 59453 - DNA, 588 bp, Glycine max
  Peptide Sequence Number=SeqID_176231
atggaagagctctccgcggggcctctcgtccccgccgtcgtcaaaccggaagcgtccaaaggcgccgccgtcgccgccgacacctccgccgcggcctccggcggcacgttcccggcctccacgtcggagccggacaaggacttcctctgcccgatttgcatgcagatcatcaaggacgcgttcctcaccgcgtgcggccacagcttctgctacatgtgcatcatcacgcacctccgcaacaagagcgattgcccttgctgcggccactacctcaccaacaccaacctcttccctaacttcttgctcgacaagctactgaagaagacttctgcgcgtcaaatatcaaaaaccgcttcacctgtggaacatttccggcaggcattgcaaaagggttgtgatgtgtcaattaaggagctagacacccttttgtcacttcttgccgagaagaaaagaaaaatggaacaagaagaagctgagagaaatatgcaaatattgttagacttcttgcattgcttacgcaagcaaaaagttgatgagttgaaggaggtgtgcttgctgcaatctctctccctctactctaaagtctaa

SEQ ID NO: 59454 - DNA, 213 bp, Glycine max
  Peptide Sequence Number=SeqID_176232
atgcacttccctcggcatccttacctcaatcaccctctaggtgcgacgccgacgaagataagtaatggtctgaaaatggaaagtgtagaaagcaggtggttaagtgcagaaggtaaatgccatgttgggcgtggaaagggcccaacgccacaaccgcagcaccacacaaacaaaatctatggcccaaacaactgcaaagacattttggaatga

SEQ ID NO: 59455 - DNA, 891 bp, Glycine max
  Peptide Sequence Number=SeqID_176233
atggaaccattgaaaggttacattttctctacagacacctcgggataccacggcttgggtgaggaaccaccagacggttgtggcagctttgttcaatcaaatgtttcctttaaagacaagatgatggagaataaagaaagggcaccttcacgtaccagaagggatctcttacgtgagaatatgacaaaaatagagtttgaaaatggaaactcattgaagaaaatggtccacattgatgattcggtgtttgatggtttgaggtttccttggcaagatgtgctagtggtgaaattgttaggcaagtctattgggaataacttcttcatgttaaagtttaacttgggggaggacaaaaatctggttatggatggaggcccttggatggtgttcgatcactatctagcagtgcaactttggaccccagagtttgtagctatgactgcaacgatcaacaaaacaatgacgtggattaggtttccagggcttaatctttatttctatgatgaaagtgtcatgctttctctagcaaccacggtggggagacccatcaaagtggatgccaacaccttagatgtcaagcgaggcaaatttgcacgagtatgcgttgaggtggatatgaataaaccaatgattgggaaagtatggatgaggggccattggtatatgatggagtatgaggggttgcattgcatatgttctgattgtgggtgttctggtcatttttcccatgaatgcatgagtccaaaacccatgaaggtagttgttccaccaccatgtatgtcggaggaaaaaatgacgacgacagtgacttctcagccacaagatgcctctagtctcaacaaacaatcattagccattttcaaatttcaattcaaaatctttggttattga

SEQ ID NO: 59456 - DNA, 699 bp, Glycine max
  Peptide Sequence Number=SeqID_176234
atggtgatttgggattgctgtggaaaagatgtaggggttcaagacccttgtgcggaagccgtggtggtgcatgataacgctatggtcaagcgcgttgcgaaaggaaacgacattgatagccagggtggtggaagaagacacgcagtggttgtgtgtgtcgacatcgattctgactcggcagcagctgcaagtcctccagtgttgtttcagctaagctcacatggttcatcagtcttccctagatatgcttctgcaatttccttcatcttggtgagaataaaggcactaatcatcaccaaagcgcctaacaatcaaccacttggtatcaaggagagtgtttggtgggttgggtacagcttgaggcacagctgggtcctgtacctcgagcacaagaggaggaagactattaccgcaatggaagttgtttatgctctcaagaggcaaggcacggtgacgtggtgctacaagcttcaccgcagtgtcgccttcgctgctagagtttgcaacatttatgcggaaattgctttccattttcgagggtgctctcaaaatcaatcccaagggattgagttggatgtacataaggagaaggtgtgtgtagaaatgaaaggaatgggtcctacaaaaatggttgttggtggatggttgtgtggagaggatgccatggaaagaggtggtttggcgggtggtgtaggctag

SEQ ID NO: 59457 - DNA, 586 bp, Glycine max
  Peptide Sequence Number=SeqID_176235
tggcgtttctcgttttcgatactgcacggggattggtatgggatgggtacaagcaggagatgtcattgacttattgggtgcgactaaccaagatggggacaacaggtttattttgtggggacgtattaggaacgacattggttttagaatccaacgaaggaatgaagtcagagggaccgggagtaaactggacgccaagaccgacgacgagctgcttcaggtagacgtgatggcgacagaagtagagcttggcggagagccactttttgacgacgaaggcagtggccttgatggtgatagagattttagttccgacgacctcgatggtgtagatgtcatgattgaaattggtttcatggcggatgactttggccatgctttggaaacattttgcattcacaacaaccctcgtctcctatcaagaaattccaatcaatatgagaatgagaagaccaaaatgtgggatgttggtggtgatgcatttgattcaatgagggatgtgggatttttagagtttgcagaactctcacttaatgagccaaaattggagaatgagttggtcaccgagaatgttgataatgcttga

SEQ ID NO: 59458 - DNA, 2652 bp, Glycine max
  Peptide Sequence Number=SeqID_176236
atggatactgtcattggaagatcagcgttacctgcaattatggctgctgttaaggatgttaattctagcaccagcatgcgccctggcattgatctgcaagttattttacatgataccaattgcagtgcttttcttggaacaatggaaggtacttttggtgctgttttccaatcaaaattagagtttcacctcggtcatctacatatcgaagctctgcagttgatggagaatgatgtggttgctgttgttggtccagtgtcatctggaatagctcatgtcatatctcatgttgttaatgaactccatgtgcctcttctatcgtttggggcaactgaccccactctatctgctctacaatacccatattttgtccgcactactcagaacgactattttcagatgtatgcaattgcagactttgttgattactacagatggaagaaggtgattgccatctatgtagatgatgacaatgggaggaatggagtttctgtattgggcgatgcaatgtcaaagaaacgtgccaagatctcttacaaggctgctttccctcctgaagccaaagaaagtgacatcagtgacttgttaaatgaagtgaacttaatggaatcgcgggtctatgttctacacgtgaatcctgatcatggtttagcaattttctccattgccaagaggctaagaatgatggacagtggttatgtttggattgcaacagattggcttccttcagtgctggattccttagattcacctgatactgacacaatggatctcttgcaaggtgttgtggcgtttcgtcatcacattcctgatactgatctcaagaagagttttctctccaggttgaaaagccaaagagacaatgagactgtgagcttcaattcttatgcactttatgcatatgattctgtttggttagcagctcgcgccctcgatgcttatctcaatgaaggtggaaatgtatctttctccagtgaccctaagttgcgtgacacaaatggaagcatgctgcagttagcatcgcttcgtacctttgatggtggtccacagtttctcaagacaattttgggaatgaacttcactggtttgagtgggcaagttgagtttgacatggacaagaatttagttcatccagcctatgatattttaaatatcggtggtagtggatcccgtagaattggttattggtctaatcactccggtctatcagttatagctcctgaagttttatatgagaaaaaatcatctaagacttctttaaagagcaatcaagagctgtacagtgtgatatggccaggagaggccacaactacaccaaggggatgggtgtttcccaacaatggacagccactcaggatagcagtgccgaaccgagtgagctacacggattttgtttctaaaagcaagaaccctccaggggtacaaggctattgcattgatgtctttgaagcagccttaaaattgttgaattatcctgtcccgagacaatatatattatttggaaatggtgaaaggaatcctagctacaacgagcttgtggagcaagttgcacagaataactttgatgcagttgttggagatgttacaattgttacaaataggacaaggattgtggattttactcaacctttcatgccatcagggcttgttgttgttgttcctgtggagaagaagtcaagcccttggtctttccttgagccgttcactgctcaaatgtggttggtcactggtgctttctttcttttcgttgggactgttgtgtggattcttgagcaccggcacaatcctgagtttcgtggttctccgaggaaacaacttataacagtgttttggtttagtttctcaacaatgtttttctcacacagggagaacactgtgagtggacttgggcgattggtgctaataatatggctctttgtggtgttgatcataaattcaagctacacagctagcttgacatctatcctcactgtgcagcaactgtcatcacaaattgaaggaattgacagcttgatctcaagtactcaaccaattggaattcaagacgggtcatttgcacgcaagtatctgatagatgaccttaatatagctgaatctaggatagttacattgaaaaacatggaggattatattgatgcccttcagcgtggtcctaaagctggaggggttgtggcagttgttgatgagcttccttatattgaggtcttgatgtccaggactgactgtaagttcacaactgttgggcaggagttcactaaaagtggatggggatttgcattccaaagggactctccccttgctgttgatttgtcaactgccatccttcaactctctgagagtggggacctgcaaaggattcatgacaaatggcttaataaaaaggagtgtgcaaccgttgatgctaattcaaacaaactagctctgacaagcttctggggcctctttcttatatgtggcattgcttgtgtcattgccctgattattttttttgctagaatcttctgtcaatacaacaaattcagccccgagcctgagaagaccgacaaggaaatgcaaccaatagaagagaagcagatatcaaagagatacttagggaaaacaaaaaaaggagacacagcattggataagcattctgtttcatcagccacctag

SEQ ID NO: 59459 - DNA, 1533 bp, Glycine max
  Peptide Sequence Number=SeqID_176237
atgaggagaactggctttcacaggaggcaaagcggaggaggctcaggattcaaaggaatgattgtgaagttgtcggttgctgctgtggtgctcttgatctgcacgctctcattgttcttctcctcaacaggaacttcttccaatcttcaatccaactatcgctccgagatccgtttagaagagctttggagcaacgcagattccggcggttggcggccttcgtctgctccgagaactcattggccccctcctccgaatgagagcaacggctatttgcgtgttcgatgtaacggtggcctgaatcagcagcgtagtgcgatttctaatgctgttcttgctgcgcgaatcatgaatgctacacttgtgctacctgagttggatgcaaactctttttggcacgacgacagcggtttccatggtatctatgatgttgaacatttcatcaaaacactgaggtatgatgtaaagattgttgaaagcattccagagaatcagaaaaatggcaaaaagaagaaaataaagccatttcagcttcgccctcctagagatgctcctataagttggtatactactgatgctctgaagaaaatgaaagaacatggtgccatctatcttactcccttttcacatcgcttagctgaagaaattgacaatcctgagtaccaaaggttgaggtgtagagtcaactatcatgctttaagattcaagccacatatcatgaagctaagtcaatcaatagttgaaaagctacgtgcacaaggtccctttatgtccatacatcttcggtttgagatggacatgttgtcatttgctggatgctttgatatatttacacctgaggagcaacagattttgaagaagtatcgagaagaaaattttgcacctaaaagacttgtctatgatgaaagaagggctattgggaaatgccctttgactcctgaggaggttggtcttattttgcgtgcattgggttttgacaattctaccaggatatatcttgcagctggtgaattgtttggtggggatcgatttatgatgccatttcgaagtttgttccctcgacttgaaaatcattcttctgttgaaaactctgaagagcttgccgaaaacactaggggattggcaggttctgctgtggattacatggtctgtcttctttctgacattttcatgccaacttatgatggcccaagcaactttgccaacaatctccttggacatcgcctttattatggcttccggactactatcagacctgatagaaaatctcttgcccctatcttcatcgatagggagaatgggcgaacggctggttttgaggaagctattaggaaagtcatgctcaaaacaaactttggagaacctcataagcgcgtttctccagagtctttctatactaattcttggcctgagtgcttctgccaaacatctacacagaacccggcagacaaatgtcccccaaatgacattttaaatatcatgaatgacgaattacagaaaacagagaccgacgcaaattctacaatatcttga

SEQ ID NO: 59460 - DNA, 423 bp, Glycine max
  Peptide Sequence Number=SeqID_176238
atggttggaaatcttgatttggaagagggaggagggtgttgttgtgggctcgaggtggaaggttcgagaagcttccagagcaagggttggtcaattcgtaatgcattgacattacagattgatcaatttgtaatacatcatgaaggagttttggcttgcgctaaagtcgtggatggtggggccatagtcgcgagtgtgacagaggacatggatatggggtggatgggtcgagaaagggtcgtgcgatcttggcttgtaatggttccaaggggagtggtggtggtcagtgcaactaatggaagtggtgggagggaggaagaagaagagaacgagcaagggaagaacaaagatagaccagaacaaaagattgggagggagtggaagataggagggagtgtgatgaagaaaatgggaatgtgttag

SEQ ID NO: 59461 - DNA, 714 bp, Glycine max
  Peptide Sequence Number=SeqID_176239
gcatttatgagcccgttgaacataataaccctgcactctctcccaactacgaatctcctgtctacgaggctgaagaggaggaggatgatgaaatcccgaaggaacttgctcgattattggaatatgaaaagaaaaccattcggcctcatgaggaggtagtagaggtgattaacttgggaaccgaggaagataagaaggaagtcaagattggggcatcgcttgaggcaactgtcaaacgaagggtgattgaattactcaaagaatacgtcgatgtgttcgcatggtcgtaccaagatatgcccggcttggatccccgtattgtggagcaccgtttgcctttgaagcccgaatgcccaccggtcaaacagaaactgagaagaactcgccctgacatggctctcaagatcaaagaggaagtacagaagcagatcgatgcaggttttcttgtcacatcagagtatccccaatggttagccaacatagtgcctgttccaaaaagggacggcaaggtcaggatgtgcgttgactaccgggatttgaacaaggctagtccgaaagatgactttcctctacctcacatcgatgtattggttgacagcgctgcaaagtccaaggtcttctccttcatggacggtttctctgggtacaatcagatcaagatggcagttgaagatagagaaaagacatctttcatcacgccttggggcacctttt

SEQ ID NO: 59462 - DNA, 192 bp, Glycine max
  Peptide Sequence Number=SeqID_176240
atgaagtgtggcggtgaatatcaattggatggggcacaaagattcttgttggatgctctcaatgctcaaatgcaaagactattgagagagaaaaatgaggagttgtatgaaagaattgagcgattagaccctcgtgaacgtcatgaagacgaaaggagaggaggaaatggtggtggtccaaggccaaactaa

SEQ ID NO: 59463 - DNA, 504 bp, Glycine max
  Peptide Sequence Number=SeqID_176241
gtcaagatcaagagcctaggagttgccagtctgaaagagttaggacagttgatgggtcaactccagcgacaagcctttcgcaaagcctatggtaagatctgggacctaactatggtggaggtctccacggaggccattgcctcccttgcccaatattatgaccagcctttgaggtgcttcacctttggggacttccagttattacccacggtggaagagtttgaagagatcctgggatgccctctgggaggaaggaaatcgaaatgtttggaagcaaaggcaagaaccttggcaagtcaagacgaatgggccccgttcatggatgtcctggcgctcttgatatttggagtggtcctctttccaaatgtggataggttggtggacctggcaatgattgatgcttttctcgcctttcacgaccgcaaggaaagcccggttgtcgctatcttagctgacctatatgacacattcgaccgaagatgtgagaagaacagtgcaaggatt

SEQ ID NO: 59464 - DNA, 252 bp, Glycine max
  Peptide Sequence Number=SeqID_176242
atgttgtcgagtattagcgatcaaaattgtcattccttgggtgatggggttgaaccaagctcatgcttttacgaaaaggttcatcaagtcaagttgaagcatggaagtaaccatcttgcaaaaattggggcaaaagatggatcgagttacatcgctgcttcgtctactgccaacatatttaggattgttgatgtccttgttacttccagtttcaccttgacaaagatgtcatggaccatgttgaaaatctaa

SEQ ID NO: 59465 - DNA, 276 bp, Glycine max
  Peptide Sequence Number=SeqID_176243
atgaagcttgcttctacatcagccagcctacatcaatcagactttggaccttatatgtttcagggtcatacaatgttcaatggaatgtccctgaactcccccatgaggagcacatgtcatgttggggttgtatcctctgggaaatggaggttgaggaatctttgttgggcttatgactgccattgcattatcgagcatataagggagcttcttttatggaaaactccttccctggttggtgttttggttcgtgctaagggtggtgtttggtattag

SEQ ID NO: 59466 - DNA, 156 bp, Glycine max
  Peptide Sequence Number=SeqID_176244
atgaatgcaaaagagaagaggatcatcgacatgagggaaaagtcacgagttcaaggacgtgatttcagaaactttcatgtggaagagagaatgaaggaaggtgttaacatcttggttgtcagttatggtgccccaggggcttgcccttatccctga

SEQ ID NO: 59467 - DNA, 414 bp, Glycine max
  Peptide Sequence Number=SeqID_176245
atggagaaagtgattgaggaagcattatgtcttccaagtaggggaattagaagaaatcctaagaacaaggccataaaaatcaacaaggaaaacatgaccactttggcacaattttggatagccattgttctagaaaatgtggctccaaactctcataagtcaggtattcccttgtcaagagctcaactcatctttgctatcatcaaagcacctcaaaggcgttatgcccattggcctgccctttccatcctaggaggagatggagctagagttgaagatgctaaaggagatgatgtgagtgctaagactaaaaatgatggagtcattgttgttgtagctactgaagaagagaagaccaaacttattgttgggggtgtgaaagagcctcaacttatggaggagggaaatgattga

SEQ ID NO: 59468 - DNA, 1422 bp, Glycine max
  Peptide Sequence Number=SeqID_176246
atggttgcaacagctgctacggcgtcgtttctccctgtgccttcgccggacgctggaaaagggaaacccaagggtggtggtggcggcggcgtttctgtgaacctcggaggactcaaagagaagcaaggtttgtgcggttgcttgcaggtcaaggcaaacgcacaagcccctccgaagaccatggagaaggttgagaatgatttgccatggttgccgtcgtcgtcgatttcgcacgccccgaggacttttataaatcagttacctgactggagcatgcttctggccgccatcaccaccgtgttcctcgcggcggagaagcagtggatgatgctggattggaagccgcgccgccccgacatgctcattgacccctttgggattgggaagatcgtgcaggacgggctcgtgttcaggcagaacttccccataaggtcttacgaaattggcgcagacaaaactgcgtcaatagagaccttaatgaatcatttgcaggagactgcacttaatcatgttaagaccgctgggcttctaggtgatggatttggttccacgcctgaaatgtgtaagaagaacctgatatgggtggtgactaagatgcaggttgtggttgataaatatcctacatggggtgatgttgttcaagtagacacgtgggtttctgcatcagggaagaatggtatgcgtcgtgattggcttgtgcgtgacgccaaaactggtgaaatcttgacaagagcctccagtgtttgggtcatgatgaataaagtgacaagaagactgtctaaaattcccgaagaagtcagggcagagataagctcttattttgtggattctgctccagttgtgccagaggataacagaaaactaaccaaacttgatgattcagctaatttcattcgcactggtttaagtcccagatggcatgatctagatgtgaatcagcatgttaacaatgtgaagtatgttgggtggattctggagcaaggctcatctgaccttttgcaaggcaggttgaatggtgattctgtaattctgcaacacccactttcctttcaaaagactctaaagaacccattgggtctatatgatagtgtgccaaagcaactaccactctgccagtgttttcttttgagaggaatctggagtgctccgcagccacttttggagagccatgagctatgtgccatgacattggagtacaggagggagtgtggcaggaacagtgtgctagattccctctctgatctctccggtgctgatgttggaaacttagcagatgatggattttttgagtgcaagcacttgcttcgacttgatgatggtgctgagattgtgaggggcaggaccgaatggaggccaaaacccttaaacagaaactttggtcatgttttgagtcaggttcctgttccagcagaaagcacctga

SEQ ID NO: 59469 - DNA, 258 bp, Glycine max
  Peptide Sequence Number=SeqID_176247
atgagtgaatatctcattcatagacttcacaataaattgaagctccaaggcttatttggtgaggccgatgcaaaacaaccagcgaacgagaataccaagagtgaacttgttggggtggcatcctttttggtgcattttatcaaacaattcaagtgtgtggttgaaggcgtgagatttgcaaagggaattgatgaggaggttgaaagtgtaggttcgaggcggtggtgttggagggtggaacgaatgtggagattgtag

SEQ ID NO: 59470 - DNA, 216 bp, Glycine max
  Peptide Sequence Number=SeqID_176248
atgaaacgtgtatatacacagtacgaaggtggggcaaacgaaggtggcaaaggaccaagtatatgggataccttcacccacaaatatccagataaaattgtggatagaagcaatggagatgtcgcaaatgaccaatatcaccactataaggtatcacccaaaaatccagatgatggtagagaatcgatcaaagaactaagcatgatccctttttaa

SEQ ID NO: 59471 - DNA, 159 bp, Glycine max
  Peptide Sequence Number=SeqID_176249
atggctgaagaaaaggggttagttgttgatttcaaaggtttcgatagtgctatggaagctgcaagagagagatccagaagtgctcaaacaaagcaagctggtggtgccattgtcatggaggctgatgctacctcagcatgcgttttgggggggtggtag

SEQ ID NO: 59472 - DNA, 846 bp, Glycine max
  Peptide Sequence Number=SeqID_176250
atggcatccaggaaaaggaaaagcgccacttccaggcctcaagctcagtatgataccaagagattccaatccttggaagcctggaaccgatacacagataacattctggactggaggatccttccggaaaagaatgttaagatctatcataccgaatttgacgagtttaaggcagagatggagaggcgtaacttacacaaacgcctcgccaatctccaagatggaagcatagatgtagctgtggtgaaggagttttatgctaacttatacagcccggaagaccagacccctaaacaagtgagggtaagaagacatttaatcaagattgatgctgacagcctgaataccttcttagagacccctgtagttttggaggaaggtgagacacaacctacctattccagatttacgaggatgaggattgatcctcaagagttttctacctgtctctacatccctggtaggggttttgttctgaatgtagagggccatccttggaagcttctgaggaaagatctcaccactcttgcacagacatggagtgttttctcctacaacaacctgactcccacttcccacacctctgatcttaatatggacagagctaggttggtgtacagcttagtcacaggcatggacatgaatatcagagcccaaatctcgggtcagatttctaccactgtccagagtaactcttctaggttcagattcccaaccttgaacaccatgccattcccatttcggcccaaaccccttttgggctcatatccatgccccaacatcacccaagctaccatcaacgcggcaccagatgagggtggctataccgggggagactccatataa

SEQ ID NO: 59473 - DNA, 1172 bp, Glycine max
  Peptide Sequence Number=SeqID_176251
aaggaaagctaaatgggggcataaatcaagaaggagtcaaatattacaacaacctcatcaacgaactaatagctaacggcttacaaccatttgtgaccctttttcattgggatcttccccaagctttggaagatgaatacggcggcttcttaaatccacgcattataaatgattttcaagactacgcggaactttgttttaaggaatttggagatagggtgaagtattgggttactttaaaccaaccatatacttatagtacgggtggctatgcgaatggggtaaaagcaccaggtcgatgctctaaatggttgaatccaaaatgcactgctggtgattcagggacagagccttatttagtttcacatcaccaacttcttgctcatgcagcagttgtccaagtgtataagaggaagtatcaggcatctcaaaatggtgtgatcggcataacccttgtgtctcattggtttgtgccaatttcaaataacaaattagatcaaaatgctgctgaaagagcaattgacttcatgcttggatggtttttggagccactgacaacaggaaactatccccaaagcatgcgttccttagttggtaaacgattaccaaagttctctaaacaacaaaccaagtcaatactcggttcatttgattttattggattaaactactacacctctaactatgctatccatgaacctcaactaaggaatgctaaacccaattacctcaccgattttcaagcgaaactcacgactcagcgcaatggaattcccataggttcaaatgcagcatcaagttggttatatgtttatcctaaaggaattcaagaattattgctctacgtcaagaaaaagtataacaatcctttgatttacatcaccgaaaatggaattgacgagttcaatgatccaacgttatcaattgaggaagtccttatagatacatatagaattgactattattatcgtcatcttttttatcttaaatctgcaatcaaggatggtgcaaatgtaaaaggatattttgtctggtcgttgttggacaattttgaatgggctaatggttatacagtacgctttggaatgaactttgtggactacaaaaatggcttaaagagataccagaaactatcagcaaaatggttcaagaattttctcaagaaatattag

SEQ ID NO: 59474 - DNA, 354 bp, Glycine max
  Peptide Sequence Number=SeqID_176252
atgagaaggattgccctagagaggagggagagaagcacgggtcagccgcaagggctgcaagtgaaagaagtccccttgtgtcacatcgacgtaagatttgtcaatacgggttggatgtgcgaaggacgggtttccgtgatacatgaggaaacccctcaagaccaaccaaattgggtgcggccgtgtcctccaaagttcgaattagggaactggcgaatcttcaaacaacccaggatttccgtggcaaactcaatatccaacaataagtccagcaaaagtagtgataccgaggacccagatgttgattttatgcaactgataaatcaagccgaggatggggaagatgaggattga

SEQ ID NO: 59475 - DNA, 1103 bp, Glycine max
  Peptide Sequence Number=SeqID_176253
atgggttcgtcttcctgctcttgttggggttggtgttcacgctttgcctccctccctcctccattcagccctttcttctgtcaggatctctgtccctacaatgatcctcatggtgctccccggtccttcctctggctagatcatcaagatcctttacgaacaaggctagtgcttggttttgtgcagcccaggtctgggagaagggtgtgtaacgctcgtacctcagtccccttggaagaggctagcgcttatctggtcggtgccgcttgttcgactattcattcaacaagggtgtcgaagctgtctattgacctcgaagggagtccttcgcacaatgccaatgttgccaccttcaggaacgtagggcagcctcgacacaggattgcatcgtcattggtcgacctccttgattcaatcaacaaaaagatgttgtcaagtcattcgtgcttcatggcgatgtgcatgcgagatgttgttatcattcagggtattgttggtctgacggggatgcgattcaccctgggtgtgctcgttgattgtatgagcaaaatgtttttccccttaggggtgtcttataccggcctccaactcattgtgggtattattggtctgacagggatgcgattcaccctgggtgcactcgttgatcgtgtgagcggaatgtttgtccccttgggggcgtctcataccggcctccaactcattgtggttggccttcaatttcctgagttcctcctcatgaaagatattgtcaagtcgtctgtgcttcacgttgatgtgcatgcgagatgttgtattcatgcaggaatgtttgtccccttgggggcatctcgtactggccttcaacttgttgtggttggccttcaatttcctaagttcctcctcatggcgacgttccatctctgtgatgcgggcttggagttggcgaaaagcatcactgtctgtcattgtcgtgagaagggaattgggaattggattggctctcgcctaagatcggatcatgtgttgaccataagtgcgggtggccacagtggaagttttatcgtagcaccatggtggacgctaaatgtacttactgaaatttggagcaaactaacgtcaag

SEQ ID NO: 59476 - DNA, 804 bp, Glycine max
  Peptide Sequence Number=SeqID_176254
atggctccaaagaagctcctatctaagagagcaaggaaagatgccgctggagaaggatccagtgcggccccgcaagtggatatgaaatttgatggacaccggttccaaagtgaggaacaccaacaccattttgaagcaatcaagggtttgtctttcctcaaggagagacgggtccagttgagggaagaagaatttgttgagttccaggaggaaattgacaagaggcagtggactcaacttgcagtgcccatggctaagtatgatccagaaatattcatggagttctacgtcaatacatggcccatggaggagggagagaccataggccagctgctgtgtgttctaggtcaggacttcgcacggagtgtgacggggagacagctggtctatgccatcttaacccaggtgagtgttcatgtggtccagttgatctcagatgccatctatcaatttgcagggatcacgcctcccagacacccagtggacttagagaagtccaacagagcactaggatttccggccttgatcacgggtctctgccagttctatgggcaagaggaggaccagcaacagccagccgcagatgcaccactgccatctctacgacagccaccatctctagagtctatctctgctcacatgcgaaggatggagctccaaatgcacgcatatatgcaacatgtgactgaccagcaggcggctaatcataggggtcaagtgcagctgaatgagagcttttaccagtacaccctacaccaacagagccaggaccctggccccttcccgtggcctccccccgagtag

SEQ ID NO: 59477 - DNA, 525 bp, Glycine max
  Peptide Sequence Number=SeqID_176255
atggcagaagaggccatcaactcagccctcgtccaagaggatggaaagcaccaaatacccatctattttgttattcgtgtccttcatgatgttgagaaacggtaccaaatgaccaagaagggttcaatggagctatctgttgagtttgattacaaagacgtgttttcatgggaaatggataggagagaatttggaactgcattaatcactagtcccataagcacttgccaaaagctggcaaaaaagttctcctcaaatcttgtgctcaaaagtggcacaataataggcattaattggctttcttgggaaaagctaatgatgaagaaggaatttggaggcctagagttccaacatctttatgtattcaacctctccatgctagggaatcaaggctataaattttccgccaatctagatgctatagctacaaaggtattccaagctaaatacttccacaatgatggatttatggaagcccctcttgggcacaaacccagttacatatggcataacatccacacttga

SEQ ID NO: 59478 - DNA, 1134 bp, Glycine max
  Peptide Sequence Number=SeqID_176256
atggagcttactaaggacatggcaactagtgatcatgccatcctccatgataggctgcatatttcttccaagaagagtcttctggaacttacttctcaagatgcattgctagctcaaaacaagattcttgctaaacaacttaaaccctcatggtcacactcaacaagcatccacgaccattgcattcctttcagccaactcaatcttccactatgtaagttagaggatgcaccttatgtggcttatgaatggttcaagatgaggcatctatggaggtcaattacatggcaaaccaaaaccgtcaagactatcatcaaggaggcaatcatcaaggtggtaacttttctcaaaatcaaaggtcaagggtgcaaatctctttcgaggaacaaattcaacaaagatcaaggggttccatcctatcgacctcccaaccaaggcctaaatttatatgagagaactactaagcttgaggacaccttgacacaatttatgcaagtctccatctcaaaccacaaaagcaccgaatcggcaatcaaaaaacttgaaatgcaagtgggccaactttcaaagcaacccgcagagaagtccaatgggaaatttgtagctaacacagagcaaaaccccaaagagcaatgtaaagaggtgcttacaagaagcaagaggatgaagggccttgtttctgatgagttagtggagggtatagtagaagatgtgagtgatgatgatgaaggagttgataaggtcttagcttctaagaccaagagtcaaatggcgagaaaagcaaataagggagcacctagtggccctaccaaggatgttcccttcacttgcaagctacaaacaaccacatcaatgaccatcattgttaagttggaccacacctcctcgcgacaagccaaccatggtacccatgttcttgctagggtgtctatgttttatgctagcaacaatgaatttgagtgtatgcccattagtatctctgaaattgctgtcgcaacctatccttcagcgggagggcgaggtgagacccaaggaataagggttcgggagttgtttacgtgcggggaaggtattagcaccccatgcgcccgtcacaaaggacaacaacctttaatcgagcgtgcaaaatcatga

SEQ ID NO: 59479 - DNA, 2325 bp, Glycine max
  Peptide Sequence Number=SeqID_176257
atgcataaacccgcagaggcactagactttgctctcatggagacctcacccaacataggggcaggtgcggtaatgagggacaagctttcctgcacctatgacctggttgaacaaatgcagtacctctatgttagagtggtgaaagccaaggatttgccagggaaagatgttactggtggtgtggatccctatgttgaagtgaagcttggaaactacaagggcctcaccaagcactttgagaaaaagtccaatcctcagtggaatcaggtttttgccttttccaaagaaaggattcaagcttctgttctggaggtggtgatcaaagacaaagatgttgttgtggatgactttgtagggagagtgatgtttgatattaatgaaatcccaaaacgtgtgcccccggatagccctttggctccccagtggtacaggctggaagataggagaggtgacaaagccaagggagagttaatgttagcagtttggatgggaactcaagcagatgaggcatttcctgatgcatggcattctgatgcagcaactgttggtcctgaagctgttgcaaacataagatcaaaggtttacctttcacctaagctttggtatgtcagggtcaatgttattgaggctcaagacttggtaccaagtgacaaaacccggtatcctgaagtctttgtgaaggctaatctggggatccagtttttaagaactagagtatctcaaagtaagaccataaatcctatgtggaatgaggacttgatgtttgttgctgctgaaccatttgaggagcccttggttctgactgcagaagacagggttggaccaaacaaggatgagatcttgggaaggtgtttgattcctttacacaatgtgcaaaggaggttggaccacaagcccgtgaacacaaagtggtttaatcttgaaaagcatgtggttgttgagggggaacagaagaaagagaccaagttctcaagtaggatacatttgagggtttgcttggaaggtggctaccatgtgttggatgaatcaacacactatagtagtgatcttaggccaactgcaaagcagctgggcaaggccagcattggaattctggaagtggggattataagtgcacaagggttgatgccaatgaagacaagagatggtagaggaaccacagatgcctattgtgtagcaaagtatgggcaaaagtggatccgtactaggacaattgtggatagtcttgctccaaggtggaatgagcaatacatttgggaggtttttgatccatgtactgttatcacagttggagtttttgataatggtcatttacatgggggagacaaatcaggtggatcaaaggattcaagaatagggaaggtgagaattaggctatcaactcttgaagctgatagggtgtatacatactcttatcctcttttggtactgtacaattcaggtgtgaagaaaatgggagaagtgcaattggctgtaaggttcacaagcttatctttgataaacatgctgtgtatgtattcacagccattgttgccaaagatgcactacattcatcctctatctgtgattcagcaagacagtctcaggcatcaagcaatccagattgtgtcaatgaggctgagccgggctgagccaccactgaggagagaggtggtggaatacatgctagatgtggattcacacatgtggagtatgagaaggagcaaagctaatttcttcagaattaccaaagtccttggtgggttgatagcctttggaaggtggtttgatcagatatgcaattggaaaaaccctctcacatccatactcattcatatccttttcataatactggttctttatccagagctaatacttccaacaattttcctttacctttttatggttggaatttggaacttccgatggaggccaagacaccctcctcatatggacacaagactatcacatgctgatgctgctcatcctgatgaactagatgaagagtttgacacattcccaacttcacgatcatcggatatggttaggatgaggtacgatcgcttaagaagcattgcagggaaggtccaaactgttgtaggtgacttggccactcaaggagaaaggttccacaatctgcttagttggagagacacaagggctaccactctctttgttacattctgtttcattgctgcaatagttctctatgttactcccttccaagttgtgttccttctaattggcttctatgtgctaaggcaccccagattccgccagaaacatccttcagtcccattcaactacttcaagaggttgcctgctagagtagacagcatattgtaa

SEQ ID NO: 59480 - DNA, 6996 bp, Glycine max
  Peptide Sequence Number=SeqID_176258
atggatccagaaagatcagtagaggaccaattctccaagctgcatccttccatgcctgtaaacaccagaattggaatagtgggtgctggtccaagtggcttatcagctgcttatgcactggccagacttggttacaataatatcactgtcttggagaagcatcatacagttggtggcatgtgtgaatcagtagaaattgaaggaaaagtatatgatctgggtggccaggttttggctgcaagcagtgctcctgtcatctttcacttggcaaaagagacaggctctccactagaagaaatggattcccacaagcttgctgttattgacagttcctctggaaaataccgagatgttaaagttgctgatgattacgtatctgttatgacactaacattagaaatccaagaaaaggtgaagaattctggtcgttttggggttcatgctctcagtgaagttgcttcagacttagctccagattatcttgagcgtcatggacttaaatctgttcctaaatctgtggcttatggttacactgcttcaggatatggatttattcaagacatgccttatgcttacattcatgaatttaccagaacttccatggccggaaaaattcgacgattcaaaggtggatatacaagtctttggcagaggattgctgaatcacttcctataaaacttcattataacactgaggtgttggcaatcaggcggaactctgacagtgtcactgttaatgtcaagggttcaaatgaaattgaaactatggaatatgataagatcataatctctgagaatgaaacagatgtaatggatgtaagtgagcttgaaaaggatttgttcagcaaagtagaaacaaatgactactacacaacagttttaaagatcaaagggctggaacatatgccggttggattttattattttggtgaatatatggaagatcccagcacaattggaaatccagttgccatgcagaaattttatgccgacagtaacatattcttgttctggtcctatggcaactctgctgatattaagggaccgactgtcactgagcttgcaatcaaatcaatagaatccatggggggagaagttgagaatttcattcttcaacgtcgctttaagtattttcctcatgttagcagccaagatatgagaaacggattctatgaaaagttggagtcagagcttcaaggctcaaggaatacttattatgttggtggacttatggcatttgagcttacagagagaaattcatcttatgccatggctttgatctgcaagaactttgcaagtagcagtgatttaccagtgtttccttacactaagattttacatactttgagcagtcatgttttccaaatagagctgcacttactagaagagtgtcttctgcagagtttgtttcccttgcaaactgagatccagaaaaaggagcctaaagagctaggtgaattgcctggagtgaaatttcccaattttcctgctttgaatagctatttaaagcactggggaacacatccagtcactcagaacagaactctttatacttggctaaatgaaggagggacggtggttgacaagaggacatatggagaacaacatttaaatgcttcttgcattgcacataagctcttaacaagccaaaagccagttatcaagcctggtgacagggttctcctggtctatgttcctggcctcgattttgttgatgccttctttggatgtctaagagctaaagttttgccagtcccagttcttcccccagaccccatgcagagaggtggacaagcacttatgaaaattgagaacatcaccaagtcatgcggcatagtggcaattttatcaactgtatcttatcattcagcagtacgtgtaggtctagtgaaaagtttaatctcattaactggaaaaaatgggaaatccacagctcaatggccaaaacttccgtggctgcacaccgatacttgggtcaataactcaagaaattcagctgtggaagatgtagatgatcaatgtgaatcccagcctggtgatgtatgtttcttgcagtttacctcaggctcaactggtgatgctaaaggagtcatgataacgcatggagggctcattcacaatgtgaagttgatgagaattatatacaagagcacctcaaggacagtgctagtgagttggcttcctcagtatcatgacatggggctgattggaggactttttacagctcttgttagtggtggatctgctgtgctattttcaccattgacatttattaagaaaccactcttatggcttgaaaccatcagcaagtatcaagcaactcacagtgctggccccaactttgcttttgagctggtggttcgaaggttagagtccgagaaagacaagcttcagaatttagacctttcatccatgattttcctaatggttgctgctgagccggtgaggatgaagaccttgaacagatttcttgatctaaccactccttttggcttatctcaaaaggtgatggctccaggatatggcttagcagaaaattgtgtgtttgtgagttgtgcatttggagaaggatatcctattcttgttgattggcaaggaagagtttgttgtggatatattcacccaggtgatgcagatgttgacattgcaatagttgatccagagagtggtgaagagcttgaggaagatggaaaggaaggagaaatctggataagtagtccaagtgcaggaataggatactggggaaaggaagaactgagtcagaaaacttttagaaatgagcttcagaaccatcctggacgcaactacacaaaaactggagacttgggaagaattatagatgggaagctattcatcactgggagaatcaaggatcttatcattgtggctggaagaaacatctactcagcagatgttgaaaagacggtcgagagttcgtctgaatttcttcgtcccggttgctgtgcagtcattagtgtccctgaggaaattttatcagcaaaggggatttccttgccagatggatctgaccaagttggcttggttgtggttgctgaagtaagggatggtaaaacagttagcaaagatgtgattgagcatattcagacacgtgtggttgaagaacatggagtcagtgttgcttctgtcaagttgatcaagcctagaaccatcagcaaaacaacatcaggaaaaatcaagagatttgagtgtctcaaacagttttcagatgaaacactaagcttggtgccacaacctattttgacaaagaaatcactggtgaggtcatttactacaggaacttgcagagaaggaagaacaccccgggcacatctggtgagaagtagtactcctctacctattccaagaatcagcaacaaagaaatagtggaacacctgaaaaggcttatttctgagcagtctggaatcccagtcaacaatatctcagtcactgacaacatgtcaacctatggaattgattcaattggagtggtcaaagcaactcaaaaactcacagatttcctgggagttccagttgcggctatagatgttttcactgcatcatgcattcaagaattggctaacttctctgagagtcttctactcaagtcacaacctcaacttatgagcaattcatcacatgctccagaagctgaaattgactctattgaagtggttgtggatgtgtccaagtctcgccaatggggtatctgtttacttcaactcctagcacttgtttatatttctatcatgctggtcactcctgcttatctatccatcactgcttttcaaagtttcataccaaatgtcagtgaatcggtatatggaatgccttggtcaagctatttgatttctttgactttggcaccactttcttggatcctttgcatggtttctacttgcatttgcatttccttttttgggaattctttcttgaggccaaactatgcccttacacctgaaatatccatctattcaatggattttgtcaagtggtgggcgctctataaaactcaggaaatttcttcaaaagttttggcaacacacctcagaggaacagtgtttctgaaatactggtttgagacgcttggtgcaagaattggatccttagttttgcttgacacagtggatatcactgacccatctctggtttcaattggagatgaagttgccattgctgaaggggttttggttcaaagccatgaggtgaagaacggaattctaagtttccttcctattagaataggtaaaaattcttcaattggaccttattctattattcaaaaaggaagtgtcatcaaagaaggatctgaagtacatcccctggaaaaggttgaaggaggccaacatgtgctcaaacctgctaagcttaataacgttaaagagaatgcagtgttgcttgttactaccaacaaaactcagtccaatgccatgtaccattttctggggatctatctcactggccttgtcagctcccttgctgcagctattgcttacatcctgtacataaggctctttcacttgcctgcatcattccaacacttctcatttctttgcatatgtggtgccttccactggatcccatttaccattgtagcatatgccaccatgttttctaatgtcccatcaaatcccattgcctttaccttttcatttaccagcgcatacctgcttcatggcctcatactcagctctctcacttgtgctttgacccgtttgctcaaactcaaccaaaaccaaacccattttaaaacctggcttagacatcaactgaccattttctgccaccatagatttgcaaagcttctctcaggaacagaagccttctgcatatatttacgccttttgggtgcaaaaattggcaagcactgttccattagagccatcaacccagtttcaaaccctgagttaatgtcaataggtgatggtgtccatcttggtgatttcagcaagataatcaccggtttccactattccaatggatatgcttgtggaaaaatagaggttcaggataattcagttgtggggagtcaaagcctaatcctcccaggttctgttgtagaaaagaatgtcattctaggtgcactttcagttgctccaatgaattctatcctccatgagggtagcgtgtatattggctctcaaacccgagttgcaaccagaaactcttcatatgatttagatgaaaggatagaggagatggacatggagtacaaaaaagtagttgcaaacatggctgcaaatttagctgtcacgactattaatgtcaaagcaagatacttccaccgcattggtgttagtggaaaggggcacttgaaaatctatgacaaacttgatgatggcattccactgcacaagatttttcaccctggaaaaagctaccctataatggtaagacacagtaatagcttgagcgctgatgatgatgcaaggattgatgcacgtggtgcagctttgaggattctttctgatgcaccagattctaaccaccacgttcccctcattgacctgacactaaaaactggcaacgcattctatgctcgcactcttgctgattttgcaacctggcttgtctgtggacttccagcaagggaggaacttgttaagcgcaccccacatgttcgtgaagcagtgtggaattctcttagacatgctaactcatatgctgaattgcactactactcaaacatttgcaggctcatgcgcttcactgatggacaagaaatgtacgtgaagtttaagctaagaccttttgacacaagcataagtgaggacacaggtaaggttgtgccaactgggattcttccaccagaaacaggtgcaattcctagggatgaaaaggacacacgtcctttgcttttccttgctaaagattttcaacgtcgcgtgaattcccctggtggagttcgttatgtgttccaagtgcaacttcgagccgtgccagaagatgaagccgcacgtgacatggcactggactgcaccaaaccgtgggatgaaaatgagttcccttacattgatgttggagagataaacatcaatgagaatctctctagggaagaatcagataggcttgaatttaacccttatctcaaaagccatgagttggatgtgatccctgccacttccaacacccaaagtgcttcaattgatcatggccgttcattgatctatgagatttgccagcacgtgcgtaacagacagccactcccagaatcttggaggaacctcgtagagcagtcaaacgttaaggtggacttgtcttgctgtcccgtggcagcattattgcccaaaaaggagacaaaaaaagtgatgacaaccttaaccttgacaagaacctggtaccagacattctcagcacttttcactcaaccgttgttgcaaactgttttgccttacacggtggtgggtttagctgtttttgctcctttaaactttcttgttaacatgaagaacgttgagaaaatcccagtgcaatggatgtttcctttgttttgggttgtctcaggtgtcatggctgcactggcatgtgtggtggccaaatggattctcgtgggaaggaagaaagacggtgaaaccgtacccatatggagcaaaagggtcgccatggatagcacgtggcaagcgattagaacattggttggggattacttcatggacatggcaagtgggtcgtttttgtttgtgatgtggatgaagctgatgggtgcagacatagacatggaaggtggtggagcttacgtggacagcacgggggcattgttgaaccccgaaatggtgaagattgagagagggggttgtgtgggaagagaagcattgctatttggacacatatatgaaggtgatgaaggtggaatggtgaagtttgggggaatcaaaattggtgaagatgggtttgtgggaagtagggctgtggtcatgcctggtgtgcatgtggagaatgaggccaatctttctgctttgtctctcgccatgaaaggagaaatagttaggtcaagataa

SEQ ID NO: 59481 - DNA, 204 bp, Glycine max
  Peptide Sequence Number=SeqID_176259
atggctaccatcttttttcgtaaacttaagcaggatttctccgtaatccttctcgcacattccaattcattcaacttctgtcaataccgtgcagaacttccatcaatgacaacacctccaccgcttctaaacagtaattcgataaaccactgcaattctgccgcgactaccaaagaacaaccttcttcaaatacacacttctaa

SEQ ID NO: 59482 - DNA, 267 bp, Glycine max
  Peptide Sequence Number=SeqID_176260
atgtggtatattgtgagagattttaatgatgttaaatgtgaggatgaaagaaagggtggtttggagcattcaagacaagaggagatccaggcgtttgaagagttaatggaggaagctaaagctatgaattcatctattgttggaatgaggttcacttgttatcgggatgatgtcttaacacttaagggaacacagactatcctccctcttagggagcccaacttattacataaggatggacaagaggaagatacattcatgacttaa

SEQ ID NO: 59483 - DNA, 2856 bp, Glycine max
  Peptide Sequence Number=SeqID_176261
atgtccctttctcagagcaagaagttgtctcagctcacagctgataatgctcaatgggaggatcggcaactgctgagatcaggagctgttagaggtacagaggttcagactgaatttgacgatgaggaagaacacaaagttattcttcttgttcatgatacaaagcctcctttccttgatggcagagttgtttttactaaacaggcagagcctattatgccattaaaagatccaacatctgacatggctataatatctcgtaaaggatctactcttgttagagaaatccatgagaagcagagtatgaacaagtctcgccaacgcttttgggaacttgctggctcaaaacttggtgatatcttgggtgttgaaaaaacagcagagcagattgatgcagacactgccgaagtgggtgaagatggtgaaattgattttaaggaggaagctaagttttcacagcatatgaagaagggagaagccgtgagtgactttgctaagtcaaaaaccattgcagagcaaaggcaatatctgcctattttttcagtggttcgtgaaaatcaggtggtggtggtggtcggagaaaccggttcaggaaagacaacacaattgacacagtatctgcatgaagatggctatactataggtggtatagtaggctgcacccaaccaaggcgtgtggcagctatgagtgttgccaagagagttagcgaagagatggatacagagttgggtgataaaattggctatgctatacgttttgaggatgtgaccgggccaaataccattataaagtacatgactgatggggtacttctacgtgaaacactcaaagactctgatctagacaagtatcgggttattgtcatggatgaagcccatgaaagatcactaagcacagatgttctttttggaatattgaagaaagttgtagcccaacgtcgtgatttcaagctgatcgtcacatcagcaactctgaatgcccagaaattttcaaatttctttggaagtgtaccgattttccatattcctgggcgaacatttcctgtgaatatattatggagtaaatctccagttgaagattatgttgaaggtgcagtgaagcaggctatgactattcacataaccagtcctgctggtgacatccttatcttcatgactggccaagatgagattgaggcagcttgctatgcccttgctgaaagaatggagcagatggtgtcatcttcaaagaaagctgtccctaaactcttgattcttcccatatactctcagcttcctgctgacttacaagctaagatattccagaaagctgaagacggagcccgtaaatgcattgtggccactaatattgctgagacatcattaactgtcgatggtatcttctatgtcatagactcaggctatggtaaaatgaaggtgtataaccctaggatgggcatggacgctctccaagtcttccctgttagtcgtgctgctgctgaccagcgtgccggtcgagctggtagaactggccctggtacgtgctatcggttgtataccgagagtgcctacctaaatgaaatgttgcccagtcctgttccagagattcagaggactaaccttggcaatgtggtcttgttgctgaaatctcttaaagttgaaaatttacttgattttgatttcatggatccacctcctcaagataatattctcaattccatgtaccagttgtgggtgttgggtgcccttaacaatgtggggggattaactgatcttgggtggaaaatggttgaatttccactggaccctccgcttgctaagatgcttttgatgggtgaacagttagggtgtcttgaggaggttttaacaattgtttccatgctgtcagtgccatctgttttctttagacccaaggaccgggcagaggagagtgacgctgcacgggaaagattttttgtgccagagtctgatcatttaaccctctacaatgtttatcagcaatggaaacaacatgattacagaggtgattggtgcaacgatcattttttgcatgttaaaggtctaagaaaggctagagaggttagatcccaactgcttgatattctgaagactttaaagatccccttaacctcatgttggccggatactgacattgtcaggaaagcaatttgttctgcatacttccacaattcagcaagattaaagggtgtgggagagtatgttaactgcaggaatgggatgccgtgtcatcttcatcccagtagtgctctatatggtatgggttgcactcctgagtatgtagtttatcatgagttaatcctgaccaccaaggagtacatgcagtgtgcgacagcggtggagccccagtggctggctgagctgggacccatgtttttctctgttaaggattctgatacatcattactggagcataagaagagacaaaaacaagagaaaacagctatggaggaggagatggagaacttgaagaaggtgcaagcagaggttgagaaagaaaggaaacagaaggagaaggaaaagatggctaagcatcagcagcaaatctccatgccaggtttacgaaagggttcttccacattcttgagaccaaagaagtttggtttactaagaaagaaaaggttgcagattccttggatggcggcaggactgccagagtacactgtatttacattatggaaaacaatattcgaaagactgatatattattttggtaatagcactgcgctcttggaacattgtcacatccactgcaagtttgtagggttcataactgcacaaagcagaaactgtccacaggaaataactggttatgttttcccaagtcattgtaagctcttcaacatgttcaactcctaa

SEQ ID NO: 59484 - DNA, 554 bp, Glycine max
  misc_feature (15)..(15): n is a, c, g, or t
  Peptide Sequence Number=SeqID_176262
gaacaacaagttggntggtaaacgcgcggagacagattatgcgccctttatcattcaagagcagcaagctgagtggataaacacgcatagacaaattttgcacactttatcattcagaaacaacaagttgggtggtaaacgcgcagagacagattctgcgccctttatcattcaagagcaacaatctgagtggataaatgcacatagacgaattctgcatcctttatcattcaggagcagcgagtcgagtgatttcgcaaattgggtgataaacgcgcatagacgaattctgcgccctttatcattcaggaacaacaagttgggagagcagcaagctgagtggataaacgcgcagagaaaaattctgtgccctttatcattcaggagcagcgagtcgagtggaacaacaagttgggtggtaaacgcgcagagacagattatgcgcccgttgtcattcagatttcgcaagtcgagtgataaacgtgcaaggacaaattatgcgcctttatcattcggggacagttctactggcagggaggttcactggccgaatg

SEQ ID NO: 59485 - DNA, 276 bp, Glycine max
  Peptide Sequence Number=SeqID_176263
atgttggagttaagtcgtatagcttctcacctactatggctaggaccttttatggcagatattggtgcacaaacccccttcttctatattttcagagaaagagaattaatatatgatctatttgaagctgcgacgggacccatgcttcgggcttccggaatacaatgggatctccgtaaagtggataattatgaatgttacgaagaatttgattgggaagttcaatggcaaaaagaaggagattccttagctcgttattttagttcgaattggtga

SEQ ID NO: 59486 - DNA, 243 bp, Glycine max
  Peptide Sequence Number=SeqID_176264
atgactaaacttggtctctgcttgtcatcgggcccgcagcctctggatgacaaaagggtgcgaataaccgtaagaatgaccaaacttggtctctgcttgtcatcgggcccgccgcctctggatgacaaaagggtgcgaataaccataagggtgcgaataaccgtaaggtatctccgcgtatcatgggtgcagaatgaccaaacttggtctctgcttgtcatcgggcccgccgcctctggatga

SEQ ID NO: 59487 - DNA, 219 bp, Glycine max
  Peptide Sequence Number=SeqID_176265
atgcgagcggggatttctgatctgtatggattcctcgagccacaatccatacaaaggtctaggcaatcacagtttgagactaaaagttacataaagagttggatacagagttcaaaacgagatgtctaccttggagcctacttgaatggtgctttaaaaggtcttgatgatgctccacaacataaatcaaaggttcctgctaggtggattgtcgtcaag

SEQ ID NO: 59488 - DNA, 260 bp, Glycine max
  Peptide Sequence Number=SeqID_176266
gatttaaaaactcacctgggttgtcgggtttaccccagaccggtcgggtcattctgggtcagatacatgaccgatacaataaccaaaccggcctagttatgtcgttaggtcccaacccgaccagtcagtggtggatggtggtgggtattgttgcaaatggaagcaccaccacgaagcatgtgatggaggtatgtcgagatgggaaagacgaagagagttgtgtagaggcaatgtcgtcgcggcagctcatcccggcatag

SEQ ID NO: 59489 - DNA, 522 bp, Glycine max
  Peptide Sequence Number=SeqID_176267
atggaggatagtctgttaattctgaccaggggctttattctaaacatagagggccaaccatggaagctccttagaaaagatcttaccaccctggctcagacatggagcgtcttctcgtactcaaacctagatcctacctcccatacttcagatttgaacacagacagagctaggttggtctatggcttaatcacaaggatggacatgaacattggtggtttgatctatggacaaatgaccatgatggctcagtctaactcttctcacttaggttttccagctttaatcacaaccttgtgtagatcgaggggagtaggatttgatgcccttacctcctatgaaaacttaaggccgaccattgacttagcttatatcataaggaactgttggaatgcaaatgaccaaacagttaaatttctagaggcaaggaagagcaagctcagagcagctgatgctccctcttcctttgcgccaatagctggcatccttgcatcctctacttcaccccactcccagctttag

SEQ ID NO: 59490 - DNA, 910 bp, Glycine max
  Peptide Sequence Number=SeqID_176268
gttatcagtgaagcaattctgcaagacccttatatgccagatagaggaaactgatcatcctttgatggacaacttgaacttgctcctccaaccatataggctctccttgaattccaaatactcaaaggctgttctataccattttgaagccttcataaaccagtccttctaccaagactttgagaatagtgtgttccaaaagaatggctgcacaaaattcttggaccctcggcaggatcgccaagcgcaattctcatcgtttgttgcacttaggaatttgagctggaacgaggttctcagaaagggtactaagtattacagtgaagagtttagcaagttctgcgaccagaaaatgagttgcatcatcactacactgaattggactaggccttggcctgagcaactccttcaggctttctttgtggcagcaaagtgcatatggttgcttcatttgctggccttttctttcaaccctccattgggaattttaagagtggaagagaatagaaactttgatcctcactacatggaagatttggttactgatagacagaggtcacaaggtccaagccgagtcaagattatggtggtgccagggttctatgttcaggataggatcttgagcgaagggaccttgcacgatgatgaaggaggagcaaagggacctcgtgtgacgatgaagggggtggcggtgacctcacgtgacgatgaaggagctggcggtgacctcaacagccttgctgcgtcgaaggttggagcaaagggcaacggtgatgatagtgctacggtgtggcggaggtggcatagcggagttggtgaggaggaggtggggaaggaatgggcttaccggcttagaatggaatatgtacgtgtgcaaggttgggttcttgacgacatacagaagttttaa

SEQ ID NO: 59491 - DNA, 966 bp, Glycine max
  Peptide Sequence Number=SeqID_176269
atggagaaggatggagctggagctggtgctggtgtcgttgacatagacaagatcacggcgacattggaaccggaaaaacctaccagtggtggactctatgttcctggcaaggataggatggtttacgtgcctcaggagagaaaatcgcgtttaggactcgatgcccttgccagcgcaaaacggtctcaacatgatgcgggattcaaggtgccaaaagaaagaaccatttccattgcagcatctgcagaggatgaagataagtctgagttgtctgtttctgaagaaagcgggcatgatgggattgtcaacagacgcagacacactaatcggagataccgtgatacgaccaatgaaacatctcattcagaaagttctgtgaccgaagatcactatggtgataccaaccggactccttcatctgagcataagggttcagacgttcctgcatcgccttctggatatgacagggaggatcataggagtgagaggaggcatcacagggatgattcaagaagcggtaatggaagagtgcggcattgggactactatgagagcaagggatcttattcagaaagggattcacatagtaggtatgaccgtgagtatggtagaaagcgaaacagatatgaaggttccaggagaatgcctggcaggtctgactgggacgatggccaatgggaatggggagacactccacgaagggacagtgtctctagttctagacgtcatcaaccttcaccatccccaatgtttgtaggtgcctcacctgatgcacgattagtttcgccatggttggggggccacactcctcattcatccttcacttcaccttctccctgggaccatgtttctccgtctcctgtcccaatacgtgcttctggatcttcagccaaatcttctgtctctagacataatggaaggtcacatcaactaagtttttcatctgaaacttcaaatagatatgag

SEQ ID NO: 59492 - DNA, 477 bp, Glycine max
  Peptide Sequence Number=SeqID_176270
atgctacaatgcgaagggttttcctctaagatcagatatgattttcaaattaccaacggtgagaatgttcggaattgggttgcgaacatgatactcaaatttcacgacgattcaacggtgaacgggttcgagatcgtcgtttttctgagacaggccgagtgtgatgagttagctcagcgtgctgaggctttgaaggaagaaaatgcttctctccggtcagaagtaaatcgaatcaggagtgattatgagcagctagtctccgagaattcagctctcaagagtagagaccacaaaatggtgtgccaaagttctagagtgtgggcatgtggggttgtccagaaactccactggtatgccatgagttggcaggaaatgcaactgatagctttggatcatgttgtttgtgttgaagagaaaagagactggtgttatttagcctttaaaaggaatgagtttcacatagggcttggattctaa

SEQ ID NO: 59493 - DNA, 375 bp, Glycine max
  Peptide Sequence Number=SeqID_176271
atggtcatagaccagtcccttttctttgaactcactcaattgttcagtgtcggtgtaccgtttaagggtacacttgatgatgagtggaagttcgatttctctgtttctgatgcttgccggatggtttgcaccaaccaagcggatatgaccggaaggattcttgccggatcattggcattcgaatgccacatcatgcagtacttgattgtgcgcacatcctacttcctagatcatccaaccttgcacagatctttctctattggtgcgaatgtggtctcctcttttggataccgcaaagaaagggatggtacttgggtgaagaaggacgcaccagcacaggccgcagaagaccgttctccatcaccacctccttag

SEQ ID NO: 59494 - DNA, 357 bp, Glycine max
  Peptide Sequence Number=SeqID_176272
atgaaaatgatttcgcttgcaatcactagtcttagaagcaacgtgaataggattgggattgtagttgaaaagaatcccttagaacacgttctaaaaatcgtgagccaccctcttaggaggttactcattcttgtggtgagaagaggaggagaaaacttgagggttgttgcaaaggattcaagaatcgagctcaaagatcatgaattgaataataagaaaggttattgggtagtaataatgagtgacactgaaaatccatctatggagaaaatgggaaccaaaagtatgaaagaattgaataaaaagagttctaaccgatatttttcttgggaaaaaatgcaaaagaaaataaagtaa

SEQ ID NO: 59495 - DNA, 198 bp, Glycine max
  Peptide Sequence Number=SeqID_176273
atgcctgcgagagcagagcgcatggctcgaaggagtgattttgatcaatacaccccttgttgcagtggggaaacctacgatgttgttatatattgtgggattattgacattttgcaagattacgatatcagcaagaaactggagcatgcttacaaccatgataatgaaggcagggagatctttgtacatggaggatga

SEQ ID NO: 59496 - DNA, 1473 bp, Glycine max
  Peptide Sequence Number=SeqID_176274
atggctccaaatttcttgcaccaagtggcattccttcttgtgctctcaactgcggtttccagtggctatgcttgggttggtgtgaactggggaaccatggcgacgcaccagcttcaacccgagaaggtggtgaagatgctgaaggaaaacgggttcagaaaactgaagctgtttgatgcagacgagttcattatgacggctctgatggggaccgatatcgaagtcatggtggccatacctaacaacatgttggacaagataagcaatagtcctaaggctgcagattcttgggtgaatgataatgtcaccagttacttcactggtgtcaaaatcaagttaagtgctgctatagctatgtatgttgcagtgggtaatgagcctttccttaaagcatataatggctcctttgcaaagaaaactctgccagccctcaagaacatacaaacatcacttaataaggccgggttgggttcaaagatcaaaatcactgttccattcaatgctgacatttactattcgcccgattcaaatccggtgccatcgaccggtgacttcaggccggaagtgcgagacctcaccgtcgaaataatccaattcttatatgcaaacaatgcacctttcacagtgaatatctacccttttcttagtctctatggcaaccaagatttcccttttgattttgcattttttgatggaaacaacaagcctctaagggatggtaaggcactttacaccaatgtgtttgatgcaaatcttgacacacttctgtgggctttagacaaggcaggataccctgacatgaaggttatgattggagaaattgggtggccaactgatggtgacaagaatgctaatgctaagaatgcaaaaagattcaacttgggtttgcttaaacatgctcttagtggcaagggtacccctaaaaggaatggcacagttgacttgtttctattcagcctcattgatgaggacactaaaagtgttgctcctggtaacttcgagaggcattggggtatttttgagtttgatggcaagccaaagtatgaattagacttaattggtcaacataaggaaaagggtcttgtcccagtggaagatatcaagtacatggaaaagaggtggtgtattttgaatccagatgttactaagttggatgatttggctggtagcattgactatgcttgtaccttttctgattgtacttcccttggttatggctctacttgtaataatcttagtgtccaagggaatgcatcttatgccttcaatatgtattatcaagtaaacaaccaacagaattgggactgtgacttctctggtttggctgtcataacacataaggatccatcacaaaatggatgccaattccctgtaatgatttctagtagttcttctttgcttcttcatggagggctttcagaaatccttaagaaagcattgagggtgtatatttttgtcatgtttttgctatag

SEQ ID NO: 59497 - DNA, 885 bp, Glycine max
  Peptide Sequence Number=SeqID_176275
atggattctttccttgaaatcagaaaagtaaccattgtaataaaaaagaaagatcacgctttacgacacccttactggaagcatgccaagaccaagataatgagtgaaatagaggaggtgcaggaacaaatgaagaccgatatggaggccatgaaggagcaaatgaagaaaatgatagaggcgatgatggatatgaggaagataatggaggttaacgttgctgccagtactgctacagagaggaacccaactcactcgcccatttttaatcaagaaagtaacctagtgttaggtgtggaaggtcaaggaggtgcaacggggactgaagcctataactctaatgctagggatgaggcacgagaagctcccttagaccacactgatgtattgcagaaggatgggggcttatgcgaaggacgagaagttgttaatgcattttttttaggaaagcctgactggggtggctattatctgtacaactctaacatggcaccagatagaatacaactacaaaacctatccaagagaaacaataagtcattcaaagagtatgctcagaggtggcaatatctagcagctcagctttacggattttgtgtttacggggaaatgattgaagttagtttgaagaaggggaagtttgattatgttgcttcaacgaattttggtagtaagaggcctaggatgaatgaagtgaagaagatagagggagaagcccatgtcgtggcaacaaaagatcttcaagggaaatgggccccaaactataaaggaccttttgtggtgaagaaggctttctcaggtggagcgttgatactcacgaacatggatagtgaagaattgtcttcgcctgtgaattttgatgttgtcaaacaatactatgcatga

SEQ ID NO: 59498 - DNA, 282 bp, Glycine max
  Peptide Sequence Number=SeqID_176276
atgacatccagttataaagacattaaagaagtgctcctgggaggtaacctaatggctccaaagaaactcacctttaagagattcaggaagatcgctgcaagagaaggatctagcacaactccacctatagaaattgagtttgatggacatcgctttcatagtgaggagcatcagcgccgctttgaagtgatcaaagattggtctttcctcaaggaaagaaggatccaattagctgaaggtgaatatgttgaattccaagttgagattgctaggaggcactag

SEQ ID NO: 59499 - DNA, 669 bp, Glycine max
  Peptide Sequence Number=SeqID_176277
atgggggtgcaaatagcacccaggcccacttgggccctccggaatattcctccagaaggcggcacttctctctctttcgaatttgcttggaaaaattgtttccgtgaagaaaatctaagccgaggcgcttccgtaacgttttccgtgaggaatttcgcaaagatttcaaccgttcttcgacgttcttcattcgttcttcatcgttcttcgatcttcaacgggctgccgtcccttggggcggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccacgagtctcgcgtcgccctcccgccgaagggtaggttgcgacacaatcgaattatggtgtttgtcaccgattacaacgcaaggctaaggggtcgctcaaggctagcatctagctcgcctaagctaagagaaaacttcaaccctaagcaaggcactcgcctggtcatgcaggggaagaggaaaagaggtttagaacttaagaaacagagggaaaacgtagaagaagaaggagaagaagaaaagcaaagtcgaggcgctacagaattgtga

SEQ ID NO: 59500 - DNA, 159 bp, Glycine max
  Peptide Sequence Number=SeqID_176278
atgcatatgacacagatgcaatttacgaatacgggagcccgagaaactgtctccttcttagatacaacgtctaggggtagcaaagtgccccaacagggaatcaagacagaacccatgtgcgatgcatatgcgaaaggcgcaacacgggaatgtacatag

SEQ ID NO: 59501 - DNA, 434 bp, Glycine max
  Peptide Sequence Number=SeqID_176279
atgggatcaagtcaaaagccttcgtttaaaaagaggttctatcaagtcaaaatcaagagcttagaggtcactagtttacgagaggttgggcaattaatgggtcaacttcaacggcaagccttccgcaagcctatggacttccagctagtgccgactgtgaaagagtttgaagaaatccggggatgcccactgggaggaaggaagccatatcttttctctgggttgtatccctccacgacaagagttgccaaggtagtgaaaatctcagcacaagagttgaaccgtgtaaagcaaaacagaaatggagtagtcggagtaccaaggaagtttgtcctctttccgaatatggaagggttagtggacctagcagcgattgacgctttcctcgcctttcatcatggcaaggaaagcccagtcgtcgccattttggccat

SEQ ID NO: 59502 - DNA, 579 bp, Glycine max
  Peptide Sequence Number=SeqID_176280
atgccaagtttttaccaggagcctgctcctgctaaggcggagctaaagaagataccaactacaagagcaaaatcacccaagcttggtcgtaagaagagtacagcaaattcagagtcagatggcaacaatagcagcagttcacgactagctcgtttaagtttggatgagaaagtgtcagagagtaatcccactaagggacctactcctcctgtccatcaaaagaagccgcaacgaagatctcttcctgctcgactggcttctgaagggaacagtgtatcaaattcaagaactgcactgacttcatccaaggcagctatcaaagatgaaaagtcttccttatctagtgctgctaaaaaagataacaacttaaccaatgctacaggagaagccaaaaccatgacgattgcagcaaatgaagagaaaagtaccttgtccagtgaaacaagtgctgttatgccgctgaatttgattccttcagataagctaagtgaagaagagtctcatgtgaatggtgacatagcagtcaaagagtattctcagctctccttggaacaagaacctatcgcggcggagcgttga

SEQ ID NO: 59503 - DNA, 225 bp, Glycine max
  Peptide Sequence Number=SeqID_176281
atgttacataatggtgtcagagccaggtttctctcccagtatggtgtggttcgaggacaaactaaagaggaagctagtgggcatgtaacactacggacagttaatgatcttgaaagtagtcaagcgttacaagttatatcagagatggttgtcgatgtctcaaaaaggttacctatagaggattatgatcaatggagagttttgaccaacgagaaagttgagtga

SEQ ID NO: 59504 - DNA, 198 bp, Glycine max
  Peptide Sequence Number=SeqID_176282
atggttaccattagacatggcagcggaacccgaccctctcctcagtcctcactctacctacctctctctatctctcacaaatttactcgccgctacagctcctcagtcctcactctaccactcttgtacttcgatctcctctccgatatcgattctgccatagacgaggacaccaaggtttctctctctctctcttaa

SEQ ID NO: 59505 - DNA, 2103 bp, Glycine max
  Peptide Sequence Number=SeqID_176283
atgtttgggttctcaggagttgacgatttttgccctatgggatcaatatacgccaaccccaaggaagcaagtttcttcttgtcccttggccctcaagttgatgtatactttcctcctcggaagagatcgcgtgtcaatgctccattcgtttttgatggagaatggttcgagcaaaagcagaaaacctctattgaagccttgccagatgagtgtctctttgagatctttagaaggttgcctgctggcgaagacaggagtgcatgtgcctgtgtttccaagcgctggcttatgcttctaagcagtatttgcaaaagtgaaatctctgttaacaaaaataccacagtagagaaccctgaaaaggagggtgatgatgtagaatttggaggtaagggatacctctctcgaagcttggaaggaaagaaggcaacagatgttagactggctgccatagctgttgggacttcatctcgaggaggattggggaagctctcaatccgtggaagcaacattgtttgtggggtgactagtcatggtctcaaggctgttgctcgtggatgcccttctttgaaggctctttctctatggaacgttgctaccgttggtgatgagggccttattgagattgcaaatggatgtcaccaactagagaaacttgatctttgcaagtgccccgcaattactgataaggctttggttgcaattgcaaagaactgccagaatctgactgagttgtcattggaatcttgccctaacattggcaatgaaggtctactagctattgggaagttgtgctccaatctaaggttcatatccatcaaggactgctctggtgttagtgatcagggaattgcaggattgttttcttcaacttctttgtttctaacaaaggtgaagctccaggcactgactgtttcagatctctctctagctgttattggtcattatggcaagtcagttactgatcttgtccttaattgcctcccaaatgtcagtgagagggggttctgggtcatgggtaatggtaatggattgcagaagctaaaatcacttacagttgcatcttgcagaggagtaacagatattgggcttgaagctgttggaaagggttgtccaaatctgaaaattgcacaccttcacaagtgtgcatttctgtcagacaatgggttgatatcatttgccaaggctgcttcatcacttgagagcctacgattggaagagtgccaccgaattacccaacttgggttttttggtgtcctttttaactgtggtgcaaaattgaaggctatctctttggtgagctgctacgggatcaaagatctgaacttggtgttgccaacagtatctccatgtgaatcacttcggtctttatctatcagtaattgccctggatttggcaatgcctccctctctgtattgggaaagctgtgccctcagcttcagcatgttgaattgagtggactcgagggagtgacagatgcagggcttcttccactccttgagagttccgaggctggtttggttaaagtgaaccttagtggttgcacaaacgttaccaataaagtagtttcgtccttggccaatctgcatggttggactcttgagaatctaaaccttgatggttgcaaaaacatcagtgatgctagcttgatggcaattgctgaaaactgtgcattgctatgtgatctcgatgtctccaagtgtgctataaccgatgctgggattgaagccctggcacatgctaaacagattaatctgcaagttctttctttgtcaggttgcactttggtctcagacaggagcttgcctgcgttgagagaattgggtcacacccttttgggactaaacatccagcactgcaatgcaatcaacagcagtacggttgacacacttgtggagcttctctggaggtcttcatcgtccagtgactcggttcctttttaccggagtgtgcagtcatttagccctcatttttgcaggttccttcaatgggaagcctgttctttttggcatccattttgcccccttttaaatggctgcatatctgagaacatagctaccgggttctggagtgtaggaatctttgttactggtgttggcacctga

SEQ ID NO: 59506 - DNA, 206 bp, Glycine max
  Peptide Sequence Number=SeqID_176284
gtgaagtggcctctaggtctggtccattgttggcaggaagtggtttctttgaagcaataataagtggaaaaggaggtcatgcagctattcctcaacaatctatagaccccatattggcaacttctaatgttataattagcttacagcatcttgtttctcgtgaggctgatcctctggattcccagaaagtaagggcagcgctatag

SEQ ID NO: 59507 - DNA, 101 bp, Glycine max
  Peptide Sequence Number=SeqID_176285
gttctatgagctataaagttgttgttgaatgtgctactgtaatgaatgaaatggtttcagatgatgaaggtagaatgatggatgctggtggcactgattag

SEQ ID NO: 59508 - DNA, 267 bp, Glycine max
  Peptide Sequence Number=SeqID_176286
atggagcagttcactgagatggtagcctggcctgggacccaaccttctcttcacagggaagatgaagagccttctgcacaaggggaggacataccctcacctcagcctgcagcagacccctccactcctcttctagagatgctacaggacccgactacaccagtcctggctatggacacttctcctctagctactccagtattgcatctgacagatgaggaggatgttcagacacaggacacccaggaccagtcacaggaattttga

SEQ ID NO: 59509 - DNA, 270 bp, Glycine max
  Peptide Sequence Number=SeqID_176287
atgcacatacggactgcagattgcttgatgatgtcagaagacgcggttattcacattgtcgggctcatgtctcatagtgttcttgccgctaatttagtaggtacactttgtagtgtctgtgatatgaacatgctgtctaggaaggctagtcatgactctcatggccaagactcttcttactttctagggtggcaagagtacgagaagaatccttaccaccccattcaaaatccaaccggaatcattcagatgggacttgcagagaatcag

SEQ ID NO: 59510 - DNA, 1335 bp, Glycine max
  Peptide Sequence Number=SeqID_176288
atgaggagagttatgagaaggagatatgtgccaatcagctacagcaggattgtgcttttgaaacaccataagttgtcccaaggtaatataagtgttgaagcgtactgcaaagagatggaaatggcactgattagagccaacatagatgaagataataaggcaaaaaatactcatttgctgagtggactgaaccatgatattagagatgttatggagctacaggagtatgtggagttagaagatctggtgcacaagggggaaggatcttcaaccagtccaatagtgacttctccacatgggaaatcaccactgaagcctaatacatcagctttaagaactggaactagagacatcaaatgtttcaaatgcttgggtagaggacacattacatctgaatgtccaaccaaaaggacaatgctcgtgaagaaatatgggaaaatcatgagtgaatcctcaactattgatggtggaagctgcactaatgtggccaattccatattagtgtccgaattaaacttggagactaagccacatcctagatacaatgatgtggttccaatgaaggcaagccatttcctcttaggaaggccatgcgagtatgacatcaaagcaatacattatggattcacaaacaaaatttcttccaggaaaaatgagcaaaaaattgttctcaaaccattatctcctagagaggaatgtaaggatgtgtttccaaaggaggttctaaatggattgccacctttgaggggaattgggcatcacattgatctcattctagaaggatgggtgcaagggaacatgagtttgagtgttattccgatgattttggtacctaaaaaggatggaacatggaggacatgcactgaatgcagggctatcaataacatcacagtcaattatagacatcttatccccaggttaaatgatttgttggatgagttgcatggtgcttgcatattttctaaagttgacttgaaaagtgagtaccatcaaattaggatgaggggaggggatgaatggaaaattgtctttacaactaagtatggtttatatgaatggctagtgatgccctttgggctaactagtgccccaagcacttttatgaggttgatgaaccgtgttttaagggaatttttaggcaagtttgttgtggcttgggaaaatttggctgttgatgggagaggatcctctagtctcaaggagacattgaaagggttgaagagtagactaaaggagtggaaccaaagttactttgagaatgtccataaaaatattgcaattgagaaggctttgaatgaattagacaaaaagggggagattgtggatttgttctaa

SEQ ID NO: 59511 - DNA, 603 bp, Glycine max
  Peptide Sequence Number=SeqID_176289
atggtgaggggtattgaggtagatggtacttgggtggaaaaccctttagagaaactaaagagaccatttgggattgtggaaattcaaagagttcggaccccggatggctttaatttgaagttcatcaaagaaagttggggtgtgttgaaagatgatatatttaacttcctaaaagatttccatgagtcgagcacctttgctaggggtactaatgcttcttctattgcccttatcccaaaggttgaagagccacaagggtgggaggagggggactatagactgatattgttggtaggatggatgtgtaaggtggtggccaagatattggctaagaggcttcaaaaggtcctctatggagtgattgatgaaagacagagtgtatttgtagaaggaaggaatatactacatagtatcctaattgcgaatgaagttgttgatgaggcttggaggaagaaaaaaagtgagttcctcttgtatatgttgggtaggcttgggttccatgagaaatggatcaagtggatacatggttgtctaaaatctagttcaatgtctattcttgtcaatggaaacccatcaaaagaatttatgttacaaagaggataa

SEQ ID NO: 59512 - DNA, 573 bp, Glycine max
  Peptide Sequence Number=SeqID_176290
atggacgcagaggataagggaagaagcttagtagagggagagagaaaggttcacgcccttttcgagcaagggaaggctccttatctttacaaagttccgtccaagactcccacgacgtatcttctggaggttcaccctcccactgtgttagaacccatcgagtgggcgaggacggggacggaccgcaatgtgcgcggaggagagaggagtggaacaccggatgaacttgggattccggcggaagttggagacgataagccacttctccgatacgctccattatcagaaaggggccaaagaatctccgggacagcttggggtgatggtggtgaccggcgatggagttttgcttccccggtctcaactttacatagacccattggccaacatcgaatcgctcatcgcggcgatgggcgtccgcgtaacgcttcatggcctcctgagccttctgcaacctattttggagtttggaatggaggttgtggtgctcctgtaggacagagtgaacaacttcgttctttgtggtaccagaaatatagtcaacgaccgtcggcgggggcttgccgaaagtga

SEQ ID NO: 59513 - DNA, 3397 bp, Glycine max
  Peptide Sequence Number=SeqID_176291
atgaatgaaaccacgctcaacaacatcgagagctacctgtacctgcatccgagtgagagtccagccattgccctcgtctctccagttctggatgcaaccaactatcattcatggagcaggtccatgatcaccgcgttaagtgccaagaacaaagtggaatttgtggatggaagcgcgcctgaaccattgaagactgatagaatgtatggagcgtggcgtcgatgcaataacatggttgtttcttggattgttcactcagtagccacctctatcaggcaaagcatattatggatggacaaagctgaagaaatatggcgcgatttgaagtcgcgatactcgcagggagatcttttacgaatctccgatctccaacaagaagcatcaacgatgaagcaaggcgcactctcggtcacagagtatttcactcgactgcgagttatatgggatgaaatcgagaactttagacctaatccaacttgcttctgcaacattagatgttcttgctccgcgctcgccattatcgcacaacggaagcttgaagatcgtgccatgcagttcttgcatggactgaacgagcagtatggaaatatcagatcacatgtgcttcttatggatcctttacctgcaatttcaaagatcttttcatatgtggtgcaacaggaacgtcaactattaggtaatgtttcttcaaatcttaatctcgaacctagagatatctccatcaacaccgcgaaagttgtctgtgatttttgtggacgaacaggtcatttggaaaatgtctgctataagaagcatgggatgccactcaattatgatggtaagagcagaaacaataatgtgagatatggaaaaacgtgcactcactacggtaagatcggacacaccattgacgtctgctacaagaagcatgggtacccgccgggatacaagaccttcaatggaagatcaaccacaaacaatgtggtggcagtagagagtaaagccacagatgatcaaactcaacatcatgagtcccaagacattgttcgcttttctccagagcagtacaaagccctactcgccttaatccagcagccatctgccggaaacacagctcctaaccaaactcaaacatccacctcctggatactagattcaggagccacagatcacgtaacatgttcgctaagtaaccttcattcttttaatcgtatcaatcccatcatggtgaaaatcctaaacggccagcatgtctgcgccacccattcgggagtggtgcacctttcaacattcataaccttacttgacgttctctacatacctacattcgcctttaatcttatctctatttccaaactcgtatcctctaccaactgcactctaatcttctcttctacatcaagtaccttgcaggatacgagcaatcgtgtgaagattggtacagttgaagtgagacatgggctctaccaactcacgccagaccaaataatccctaataccatatgctctactatcgttcatcctaaatgtaatatcatccctatagacctttggcactttcgaatgggtcatccatcgtctgaaaggctacaatgtatgcagtcctactaccctatcttacaaaatgacaagagctttacatgtaatacttgtcattatgcaaaacacagaaagctaccttttccttctagtaactcatacgcattacacggttttgatttgttgcatatagatatatggggaccatcatcaacatcttctcaactcacacgcgctctcctttttcaggcaagcctaccacccagtgtttggtgttacgctttgcctcatgctgcatatttaatcaactgcattcccactccatttctgcataacgttttgccttatgagaaactccatgggcattcatgtgatatatctaatcttcgcgtgtttggttgcttgtgttacgtcaacactcttaaagcacaccgccaaaagctcgatcctagagcacacccatgcatcttcattgtctccagcgaccatttcgacccaccagctgagactatgaccactatccccacaatccaaaacttccttactcatgctgaaccttcttccccgcaccttcgtcaatccacaagaccaaaacatgcgccaacataccttaaagattatcatcgtgatctcacttcactcactgccagcacttcaactattgttcgttatccgctaagctcggtcttatcgtattcacgtctttcaccatcccatcgacattttgtcatgtctatttcctcaaacactaaaccttcctcctatgctgaagcttcctgccatgactgctggattaaggcaatgcaggctgagttacatgctctccaagtgaacaatacttgcactctcaccaatcttcctcctcacaaaactactattggttgccgttggatatataaaatcaaatatcatgttgatgggtccatagaaaggtacaaagcacgcttagttgcaaagggttatacgcaaatggaaggattagattaccttgacacattctctccagtcgcgaagcttaccactgttcgtcttctactagcattagctgctcttcatcaatggcatttgcggcaacttgacgttaataacgcctttcttcatggagagctcactgaagaagtctacatgcaagttcctccagggctttcagtcgagaaccctaaccttgtttgtcgtctgcaacgttctctatacgggctcaagcaagctagtcgacaatggttcaccagattatcaagctttctcatttcccatggcatgcttggttctcgtccacattccactcctatggactactccacaaagttacaagctacatcagggactcctctatcagctgatacttcttcttcttatcgaaggctagttggcaggctcatttatctcaccaatacacgtcccgacattacctacgatgtccaacaactcagccaatacatgtccaaccctactaccagtcaccatcaggctgcttttcgtatctcgcgctatcttaaggggacaccaggatcaggcctcttctttgcgaccacaggcacacatcagcttcaagcttttagtgattcaaattgggcgggttcttcggaagctgagtatcgcaccttagcatccaccacttgcgagctacaatggctaacgtaccttcttcaagactttcgtgtttcttttatacaaccagctaccctttattgtgataatcaatcagctattcaaatcgcgaccaatcccgtattccatgaacgtacaaaacatatcgaaatcgattgtcacattgttcgaaacaaagttaattcaggactcattaagcttcttcctgtttcttcttcgaagcaactcgccgacatcttcaccaaggctttgtctccagcggtttttcaag

SEQ ID NO: 59514 - DNA, 3141 bp, Glycine max
  Peptide Sequence Number=SeqID_176292
atggcggatcatggaaccaggaagaccacgacggaccgcctggaagaggctatcgtccgtctctccaatagccatacttccataaacgatcgatacaatgaccttgcgagcaaagttgattcgatcttggagcacttgcggctacgagactccagccctccccccgccgccgtgccaatggcctctcctagccatcaacggaatgcagttaagctagatattccaaaattcgacggccacgatcctttaggatggattttcaaaatcactcagctgttccagtatcaaaagactcccgaagacgaacgtgtcaccattgcctccctgtacctcgacggcgccgccttgagttggtaccagtggatgtttagcaatggtctgatcacgtcatgggaagggttccttcaggctctcgaatcacgtttcactcctacgttctatgaagatcctaagggagccttgttcaaattaacacagcacggtactgtgaacgagtatctcacgcagttcgagcgtctcgctaaccgcgtgttacgacgcgaagtcatggcgtttcaaccaatctccctcctccaagctcaagccctagctaagctccaagaggagaagttacgtgacaaaccagctcccatgcctcgaggtcctgttttttccaagccttcctttcaccaaaacgccaccgtctccacacgacctaagtccaatttcgtccaacgcactccggccgagatggcctttcgacgagaaaagggactttgctataattgcgacgagaaatggcacataggtcatcgttgtaagggtaaggtaatgttgttcattgctgaggaccaagctccgagtccggattcaatggaacatgaagttgcggaagatcccggcacggccgtgcttgacaatcccgaaccctccgttgactccgattgctcgcatataagcctccatgctctcgctggattaccttcctcggagactttccggatctatggcaccatcagaaacgctatgttgacgattttggttgatagtggaagcactcacaactttcttcaaccgcgaatcgcacagttcctccatctccggcctcaaagtacacaaccacttcgcgtcatgggccacaccttcacggtttccttccacctccttccaataagcggcgcagacgcggtgcttggcattgattggcttaaagaacttggaccggtcacgacggactacactgagttcgtcatgcgtttccatcattccggccacgatatatcgctgaaggcagatgtcgcaagtgggcctgaaccaacctcagcaacccagctttgcgccgattatcgagctctaaactcagtcactgttcgcgaccgcttcccaatccccacaatagatgagctattggatgagttgggatgtgcttcgtggatctcacggacccataacggacacttcgaatatttggtgatgccctttgggctgtgcaacgcaccatctatgttccagtcggccatgaacacgcttcttcgtccgttcttgaggcaatttgtcacggtgttcttcgatgacatcctcatctacagcagctccttgtcatcccacttacatcacctcgagaccatctttcaggcccttcagcagggtgagtttgtcctcaaacgttccaagtgtttgtttgctcaacggagcttggaatatctaggccacgtcgtctccgataaaggggtcacgccagaaccttcgaagattcaggctgtaatacggtggccgacacccaagacgaccaaagaactccgcgccttcctcgacctcactggcttctatcgcaaattcgttaaggggtacgcatccattgtcgcacctcttactaagcttctgtgtaaagatgccttccagtggacacacgaatcacaaacagcatttgatctcctcaaaaccgccatgaccaccacccccgtgctagcattacctaaatttgcagaacctttcatgctcgaaactaacgcatccagcactgctattggtgtcgtcctcatgcaaaacggacatcccttggcgtacttcagtaaacacttaggtcctcgattactccatgcctcgacatatataagagagctacatgcaattgtcaccgtagtaaggaaatggaggcaatacctcctgggaagaccctttacgatactcacagaccataagagtattcgtgaactaatgtctcaaatcattcagaccccggagcagcattattacctttcgaaactcctaggatatgattactccatacagtataaatctggcgcttcgaacgtggtggctgatgcgctttcacgagctccggtcaccaacggcgagttcctcctcctttcggcccctcagctcgacttcctccgcgacatcaaaaagtctctagaaaccaatttggagttccagcaactcacaaaatctttccacgacgaccccgcgtctcatcctgagtatacactccgcgatggcctgattctattccgaggaaggatttggttgaacgatggtaacccttctatacccagcctcctaatcgaataccacacaacgccactagggggtcacctgggtatcgctaaaaccacccatagacttgaatctaacttcttttggaaaggcttgaagggtgatgtcaaacgttttattaaggaatgtataacttgccagcaaaataagaaccttcatcaacgtccctcagggttacttcaacctctaccagccccgtcaaatgtatgggaagacctgtctatggattttattacgcatcttccttcttcccatgggtttacagttatcttggttgtcgttgatcgctactctaaaggcatacatcttggtgcattgcccactgggttcactgcgttcaaggttgcaacattgttcatggagatcgtctgcaagttgcatggctttcccaagagcatcgtttcagatcgtgaccccgtcttcgtgagcagcttttggaaggaattgtttcgcttaagtggcacccggttgcggttgagcactgcttatcacccccagtccgacggccagactgaagtcctcaaccgcgtcctggagcaataccttcgttgctttgtccatgaccggcccgcttcttggttcccttacttagctctagctgaatga

SEQ ID NO: 59515 - DNA, 363 bp, Glycine max
  Peptide Sequence Number=SeqID_176293
atgcaaggaaaagcaggtggaaatagtcgcggaaacgaagaagacgaaaagggagaagttgcggaagaagaggaacaaggaagaagatgcagaagaaggacactatttgaaccttctttggtgaaagaacaacatttctctttggtctttgagcattgtaaacgagataagggaaatgtttcaattgaggcacctcgagaagtctcgtcaatttcacacagtacatgtggaactattagagtattagaagttccaaacgaacatgccgtaggatttgagaggttatctaaaccgtttattggtatgtcgaggtggggagggggaagttgttgtgtatttggaggagaaggttgttttccatga

SEQ ID NO: 59516 - DNA, 171 bp, Glycine max
  Peptide Sequence Number=SeqID_176294
atgacgcaattgtctagggatgatccaaaatcaatgcgccatttgaggatgacactaactttgatgcctagcgctctgttggggagctcaatgtggaagatagtcttcgtcgaagtcgatggtgagggaagagatggaagaatgggatgtggtggcggtggccacttgtag

SEQ ID NO: 59517 - DNA, 147 bp, Glycine max
  Peptide Sequence Number=SeqID_176295
atggatgttagagatataaaggaccctgagcatccatattccttggaagagcttaaggtgattaccaaggaagcagttgaagttgatgatcagcataattatgcgaggcattcaaagttaacagatgcagcattcaaagatggttaa

SEQ ID NO: 59518 - DNA, 600 bp, Glycine max
  Peptide Sequence Number=SeqID_176296
atgcggaggatgccagatcgagtttacgggatcaaacttgacaacattttcattggcaggaaaaaaattcaagtcaattctccgaggcatggtcatggtgtggtggaagggaagaatatgagggaatctaatggtggtggagtgaaacaacctttgcaagtacaacgtgacgagtatgatatagcgggtatggtggccacaaggaaggactgtgtagaggattggtttgatgagattattccatggatgataggtcttggtgtttatattgtacacataaggcttcttcctcatgggagacaagttcagatgaagataaatcttgaatttgaaactgatgagcacacaatcgtgaaggaatgtaattgtgtgattgtgaaggaagttaattgtgtgattcaaattccaaatcccaggagtaacaaagaggcgataagtaatgtgaataaggcgggattctccctggaagatatttttgaggtaccagaatcatcagagaatgcaaatttgggcctatattgtagactatatcaatttgaaaaggatgttggaaatggaaaaggcaagggcattgttaggtgcaccccagcacttttttaa

SEQ ID NO: 59519 - DNA, 489 bp, Glycine max
  Peptide Sequence Number=SeqID_176297
atgagaaatcgtggagtgctagctgaagaatcaaagcaatgtggagaggaaacaaatcaggatctgatccaattgggttcttggaacccctttgaaacaggagatcaagaatctgcaggtgccaagagaactactactcacagtgttgctgagcatccttcttccttggacgtgattactattgaggctaaagaacaaagctaccacgcagcaaaggagcatgatgatgatgatgacgattctttggttgttttgagcaaatggagcccctccttgattttcaataactatggattctctcaagataatttcagtccttgggaaagctgtgggaggcctaaaacaatcacatctttgatgcgccgacagaaatgcgcaagcctgctatgtatttgtttactttcctttcagaaatttaacggagtaagacacttgggtgatccacacattcccttcgaagtcaagattaaaattgacttcatcatttga

SEQ ID NO: 59520 - DNA, 642 bp, Glycine max
  Peptide Sequence Number=SeqID_176298
atggggaacaccatgggaaggagtaaaaagaccaaggtgatgaaggtggatggagaaacgttcaagctgaagactccagcgagagcaaacgacgtcgtaaaggactaccccggtcacgttttgctggactccgaagcggtgaaacatttcgggcttcgggccaaacccttggagccataccaggaattgaagcccaaaaagatttactttctcgttgagttaccgaagattcagcccgaagaggaaaaaacggcgctaccgaggagggtgcgatccagtgggatacgcggcatgaacgcctcggataggctcgagcttctcatgctctccaaacgctccgtttcggacctccctctcgccaggcagggcccgaagatgggctccgatgggcccatgagggtcaagatgaggctccccaaggcccatttggacaagttgatggaggagagcaccgacgggtccgaggtggcggagaaaatcatgagtttgtatgtgggaaccaatgccggcgagggtggtggcgttgcggcggtggcggaggaaggtggcgcaaagacggtgtacaatcacaaaccacgtgggaaaggaacaaaaaccatacgctttatcggtaggattcaacatcagataccgaggatctag

SEQ ID NO: 59521 - DNA, 369 bp, Glycine max
  Peptide Sequence Number=SeqID_176299
atgaaatgtccagaacaatggccacattctacaaccaccaaatcaaactacaagcatatggtcactactaaaagaaaatcaaagctgcaaagattctttttccagtttgctaacaatgacattgaaggcttcaaggggctttcagagaaggatttttcttcgatcaatgaggttgggctctggtatggccaacaaaacggatcgaagcaatttgttcttgagcacaaaacctatttgatggttgctgcaacttatggtagcattaatgttatgaagattatactgttgtaccccgaggcagatgtggattttggcgtgtggggccaacaaaagcactgcccagtttttgcctacaaggtgtttgattaa

SEQ ID NO: 59522 - DNA, 153 bp, Glycine max
  Peptide Sequence Number=SeqID_176300
atgggggttggttggttggttcaagtttggaatgtgatccagatttgtagactgaaagtgttgtacgatacatttggaacactgaatagtctcaaagattgggtagagtacccgaaaaacagtgtttatcccaatgttgcagagggcagttaa

SEQ ID NO: 59523 - DNA, 356 bp, Glycine max
  Peptide Sequence Number=SeqID_176301
attgcgaccttcttggacgaacaaaacctcctcattgtataactagtgtgttgttcatggtgggaggtattgcaatcgttacagaaggtgatgatggtgttattttggtgggggaagtgtttcaagcacgatcaccgcagggcggaggcaacggcggtggccgtacggcgggcgttggagcttctgcagctgaacgaccccgttttgagggtccaagcggcgagggacatccggcgcctcaccaagacctcgcagcggtgccgccgccagctccggcaagccgtggcgccactcgtgtccatgctccgagtcgactcgcccgagttccacgaacctgcgcttctcgctctgcttaa

SEQ ID NO: 59524 - DNA, 867 bp, Glycine max
  Peptide Sequence Number=SeqID_176302
atggccgccaaatctgaaggcatccaagaagaaatgccaagtatggaagagggtgtttcttcccctagcccttccagaacctgtaacgtatcacataactgttgttcaaaccatgttgtagccctcgcacagaaggttttcgcagaagttattggtacatattttgtggtatttgccggttgtggctctgtggcagtgaataagatctatggctcagtcacatttccaggggtttgtgtcacatgggggctgattgtaatggtcatgatttactctcttcgtcatatctctggagctcacttcaatcctgcagtcaccattactttggccatctttcgccgcttctcatataaacaggtgccactctacatttttgctcagttgctggggtcgatccttgctagtggcacattagccctaatgttggatgtaacgcctaaagcttattttggaacggtaccagttggatccaatggccagtctttagttgctgaagtcatcatcacttttcttttgatgtttgttatatctgctgtttctacagatgacaaagcggtgggtgactttgcaggagttgcagttgggatgactataatgttgaatgtcttcattgccggcgagtgggagaaggagagagtaaacggtgccggtggaggattgagagagaaaggaatgggaagaaagatccagtgtggagggcctgtatcaggggcttccatgaaccctgcaagaagtattggtccggcacttatcaaacatgtttaccaagggttatggatatacgtagttggtccaattgttggatccatagctggagcacttgcctataattttcttagatccccatacaagccaccatcagaataa

SEQ ID NO: 59525 - DNA, 228 bp, Glycine max
  Peptide Sequence Number=SeqID_176303
atgttcaactccaacttaggcaacccctcctctttatgcaccattcgttctctctccatgaatccctacagtagttggttcaaggtggaagttgctgccggcagccagaagaataacaacaacaaggccttcgatgcagtggcattcgaggcggaggcccaaccatggtggaagctaccgaccctacctggaacaaagaagaggaaagtagaagaaatgggtaactaa

SEQ ID NO: 59526 - DNA, 384 bp, Glycine max
  Peptide Sequence Number=SeqID_176304
atgaaccttggtggcggtggtgttggaggtggccgtgatggtggtggtggtggtggccgtgatggaggtggtggtggcggtagtggcgatgaatcatcacaactctctggtggggttggagaggaaatctctggaaggaatagtggtggcggggaagctggaggcggaggaggaggcgatagaagttgctcatcacaggggtttccacaaggacatgatccacatttgatttcagtgtgtgttggctgtgaaaccagtgattggtctaatttgctagaaaatgtgttggcctcaaccggtgatgaaattgtaatgcagaaaagaagcagcactattgtgagtttttgtgtagtccaactctttgttgtagacaccattgtgtga

SEQ ID NO: 59527 - DNA, 161 bp, Glycine max
  Peptide Sequence Number=SeqID_176305
cagttggaggattgagatgctatgagagtccacagaataagattactgcagtacctactgaggaagaagaaatctggggtgcattcttcaaggtaatcgtagagcttaagaagttagagttgaacatccattatgtaactaggattgcccgttgcaactaa

SEQ ID NO: 59528 - DNA, 168 bp, Glycine max
  Peptide Sequence Number=SeqID_176306
atgtctcctgcacctctagaacctcacaatcactcacagactcatctcatgctttcaggatggcttcctcttcaaggtggccttgttggtgcttgcgcgcttagcgcaactctggctcgcttagcgtgcatacgtgaatttgggcttagtgcccaacttctcgcttag

SEQ ID NO: 59529 - DNA, 247 bp, Glycine max
  Peptide Sequence Number=SeqID_176307
atggcattcttgggagagacaagcagtcagacagttgtgaactccacattagatgttatttttccaaatggatccattgttcacaacgacagtggtgtttcctttcaagcttccactccagtccccattcgagtacccatcgagtgtgatgttcaaatgttaaaaaccagaatgcacaatacccttaagctaaccaacaagcaatttttggatgaaatttactaccggaaacctttcacatatgcag

SEQ ID NO: 59530 - DNA, 452 bp, Glycine max
  Peptide Sequence Number=SeqID_176308
cgctctgtgcgcgtactccgaaaggaatcggcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 59531 - DNA, 747 bp, Glycine max
  Peptide Sequence Number=SeqID_176309
atgttcatctttgcacagaacagccgggcgttttttaccgcctggccaaccgcgacattgccaaacaccgtggtgatgcccagcagccgctgcgtgcgcgccgcatacgccagcgcaaaggcgtcatccacgccgatatcagtatcaaaaatcagggtacgcatcggaatctcctcgctgatgatgtctgccacggtgaatattgtcacctccgccgcgccagcgtattatcgtgcctctgaggtgatggcgtgccaccttacccaaccgccctctggttacagacggctgatgacgcctgacaacttgcttatccctgcgcgggagacggcggagctccagactatgctgaagtcgctgttcgcggtcatgatcggtggtgccatcggttgcacgctgcgctggcttatctctttgcgtttcaatacgttattccccaacctgccgccagggacgctgatcgttaatctggtcggtggctttattattggcgcggcgatggcgtggtttgtgcgcaatccgcacatcgatcccgtatggaaactgctgatcgtcaccggcctgtgcggcgggctgacgacgttttcgaccttctcggccgagatcgtggtgttgctacaatcaggaaaatacctgtgggcaatgtcgagcgtgatggtgcatgtcatcggttcattgctgatgacctttgccggtttcgccgtggtgaacctgctgggctatactacacgcttgaatcacccttga

SEQ ID NO: 59532 - DNA, 397 bp, Glycine max
  Peptide Sequence Number=SeqID_176310
ggttcctggtgattcggaggggagggacgaatcaaagcgacaagggctgaatctcagtggatcgcccgcagcaaggccactctgccacttacaataccccgtcgtgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 59533 - DNA, 496 bp, Glycine max
  Peptide Sequence Number=SeqID_176311
atgtctcgacatcaaagaggggccaagaaatctgggaagaaggtgcctggaaatgttcctgatgcaccattggacaacatctctttccactcaattggcaataccatggacctcattaaggctgctggactactgaagacagtcaccaagttgggagactgttatgaaggcctagtcagggaatttattgtcaacattccctctgacataactaacagaaagagtgatgagtatcaaaaggtgtttgtcagaggaaagtgtgttagattctcccctgctgtgattaacaagtacctgggcagacctactgaaggagtggtggatattgatgtttctgagcatcagattgccaaggagatcactgccaaacgagtccagcattggccaaagaaagggaagctttcagcagggaagctaagtgtgaagtatgcaattctgcacaggattggagctgcaaactgggttcccaccaatcatacttccactgttgccacag

SEQ ID NO: 59534 - DNA, 399 bp, Glycine max
  Peptide Sequence Number=SeqID_176312
gaaaacattgttgtgggaggaaattgtagtgctgtgattcaaaagatccttccacccaagcataaagaccctgagagtgtaaccattccttgttcaattggagaagtcactgtggtaaaggctcttattgatctgggagccaatatcaacttaatgccactctctatgtgtagaaggttgggagagttagagatcatgcctactaggatgactttacaacttgttgaccactccattaccagaccatatgaagtaattgaagatgtgttggtcagagtaaaacattttatcttcccaacagactttgtgaagctggagctgggctttgaagatcagaaaattgattttgatttatttgttgaagacaaccctgctccaaaacaaaatgtttgcttacag

SEQ ID NO: 59535 - DNA, 339 bp, Glycine max
  Peptide Sequence Number=SeqID_176313
atgattccacttaaactgttacaagaacacaataagggtaagggaaacttcactaaggagaagaagcacagagttgtcatgatgcttgagttaaatatgagataccctagccatgagaagaagcacagacttctgacgatgctcgagtgcgacgaacacgattgcgaaggagacgaaacatacctaggtatggtggcgaaggagaagaagcagagacttgtgacgatgctcgagtgcgacgaagacgatgctcgagtgccacgaacacgatgctcagatgcagacagagaccttgaaggtagacggagattagaagaagaagagagcgcgaaagcttag

SEQ ID NO: 59536 - DNA, 428 bp, Glycine max
  Peptide Sequence Number=SeqID_176314
atgggggaaaggtctatgttccttgacctaaagccacttgaaagagaggaagttgcctttggaggcataggaaatggaaaaatcactagtataggtaaaattggtattccttctctagcctccatagacaatgtcttatatgttgaagatcagattattggtgatcagactaaaggagttaaaaccaaatcatcactcaaagatcttgcatcttatgctctcgtctcaaagatagaacccaaaacaatagatgaggcattgacaaacaatgattatattatttctatggaagaggaacttcatcaattcaccagaaatgacgtttggacactttttcccaaacctgaaaacaaaaggatcattggaataagatggatattcagaaacaaactggatgaacacggaaaagtagtaaggaacaaagctag

SEQ ID NO: 59537 - DNA, 201 bp, Glycine max
  Peptide Sequence Number=SeqID_176315
atgtccaaggtagtagccttgacaagtaggagggtgatgagtttgtcaagcccccaaccatggatgaatgtttgtccaatgccaggtggggcaacctcgataggatgcgctggccattatgtctattcctcggcgagtgatcccctcgctgccttagacggtattatgggtgactttccttggaggtcactcgtgaagtag

SEQ ID NO: 59538 - DNA, 744 bp, Glycine max
  Peptide Sequence Number=SeqID_176316
atggaggaggccgacaaggaggagcaggatgctgaggagcaagaatatgatgctatcatgatggtaagtgtggaatctttgatgatgcaggaagcaagaccttgtcgatgtagagataggatgatggtggtcttgtcacccatctggtgggacttccttttgctttgtagagcttatcccctaatgcttgtgaggagtatgtttgacttgcctttggttgatggttatgagggtctagtggtagttcgtttcgttgaacttggacctttgacgatggtcgtcgtagttgctgtgaatgagcgcaccaaggagatgccttggactggggacgtgtttgccttaggttttgataagcctttaaagctgtgtcgaggcttactaagggtggacctttggtttgatgaaactatgagactcaccaagactcaccaagggcggaccttaggttttgtgagtcctttggaggatcgattagggaattgtccaacctgggttttgggtgtcgtgctcttgcattcatgtcacttgccatgggtggcacgtactagagacttaatggcatgctcttgcatatgtgtcactcatggagtggaacatactagagacttagtgtcgtgctcttgcatacattggcgtgctcttgcatacatgtcactcattgtgggtggcatgtacatgagacgtaatggtgtgctcttgcttacatgtcactcgttgtgggtggcatatactagagacttagtg

SEQ ID NO: 59539 - DNA, 504 bp, Glycine max
  Peptide Sequence Number=SeqID_176317
atggccagagaagaggaggaactaaactggatgaccccttacaggaatttcctaatccagggggtgttgccatcagacgagaatggaacccgatgcctaaaacgaaaggccagctactacgccatcctcgatggcgaactattcaaaagaggattgacaaaacccttgttaaaatgcctgaacaaccagcagatagattatataaaagcaagaccaccgcaggagattacagccagtgacgtggagatattcacctggaaacacctcatatgtaggtacgacctcctatgtgtcattgtcatagataacaacactcaattcaaagctaagacttacgaagaatttttggcaaggctaggcatcaagcaccttgtcacctctgtggaccatcctcagaccaacgatcaggtaaaggcagccaatatagttatccttagggccctgggtactagacttgacaagtctaaggatctatggaaagaggagctccccaatatactctag

SEQ ID NO: 59540 - DNA, 748 bp, Glycine max
  Peptide Sequence Number=SeqID_176318
atggctccaagctcgttaagtgtcttcctgtcgatcaaagcaaaatatgatgaatttgcattgacaacctgcaaagccaaggagtggaccggcgtgaaggtggacagtgtcaagggagacctcgagcctctagaaaaggttgtcgctcatgcctttgttactagtgtctatgtctaccttgtggttcctatgctacttctcttgttgtccttcagcctgggaggcttcgtcggggctagcctgatgagtacctccatgttgaaagcttcctccagaattgtagttcaattggccattatgatgagaatcctgaaactggccaaatataggctaaaggcccaagtggagaagggcgaaggcccaagtaattcttgtggcgtctaccctgacttatcttccttcactggaagtggcgtcatccaaatctccatagcctgtatcaaacgatccgctcctactcaggttcacatcacattagggtgtgacatgtttaactccgttcctgaatttggacatttcttccatctagatgcagcctttggctcgtttgcgcaactcgtccatgctactgggggggttttgtacagactgttcgtgaacttgtcgggtcatagggcgaggagcatggaatgcaatgctacctctggaggtcatgcgatgagacctgctggttacgtactatgcactgaagcattcgacgagggtttcgaagctgtctatggatcttggtgggagttcattgtactag

SEQ ID NO: 59541 - DNA, 705 bp, Glycine max
  Peptide Sequence Number=SeqID_176319
gctttgaagttgagcttgaaggctcgctctagagtgacattttcagggccttcgaggactgttcttgcctcgcttccctttacgcttctgcaaaacttgtttaatggggtaatttgtcttgactaccactcggtgactctggaagtatggcctaaggcgttgagccgagcacttctcagtgtcatggatggggagctgataaagtatatggggagttggtgcttcccttcctcttgtatgagggttaagctaagggccttatcagctactaagagatacaggagtaggggtactcctggcttgggtctactcaaaactggtggtgtggttatggtcttcttgaaagctaggaaagcttattcgcaagtctcgtcccataggaagggctcaattttcttgaacaacttcttggacattggtcgggttgcacatctccagtatgacagtgcatttcttttagaggaacatgactttgccttccctgaaagtacatttttcagggttgagacacaactcatatttgcggagttccctgaaaacttcttccaggtctgccacatgataggctatgctttgagactcgacgactatgtcgtccacatatacctcgacgttttgtctgatctgttgtttaaagactcggtccatcagtcattgcctgcattcgaatctggttgtacccggagtaggcgtccaggagcttag

SEQ ID NO: 59542 - DNA, 207 bp, Glycine max
  Peptide Sequence Number=SeqID_176320
atggttcataactttcaatttcgttcaggttttgcatctagaaggttctcctccggcgtgagctctgacgttgtgagcaatgagcgtgacagagtggcattttttgaactaagccccttcgtcggaaagttggttcttgaagaaggtggtgttacagaagaagaggatggagacttatggatgagagacaaaggaaaaaagatctaa

SEQ ID NO: 59543 - DNA, 279 bp, Glycine max
  Peptide Sequence Number=SeqID_176321
atgacgtcggctttttctagggttttgcgatgtgttgtggcgatagagactttgtcgaggacgacattggtgaggcgcttctgctcaattaggggggtaagtgttgtcagaccacgtgggtttcttcatggactagaatttgtcgaaggccttgaggcggaattcaatcatccactggggatcccttttcttctcagggacgacattagagtgagatcaagcatgttcaacaatgatgggtttcacgaccacggtgggttcgacaaccgcggcggatga

SEQ ID NO: 59544 - DNA, 228 bp, Glycine max
  Peptide Sequence Number=SeqID_176322
atgccctcctttcgcgatttggagcagaaatgggcaccaaaggttgaagctttgtttggagcttcaatggagaatgagggagaaagaaaggcaaccatacccactattaccacccatcaggtcctcaacaaggtttgcaagaaggaggaatccttctttgggttgttcaccttgcctcacaaggtggcacgaggaggaggagaagaagaagaaggaggaggaggatga

SEQ ID NO: 59545 - DNA, 183 bp, Glycine max
  Peptide Sequence Number=SeqID_176323
atggtcgatcactacaacaagctggttaaactagcggcgagggctttctacgatgatctaacgagtaaaggagagaatcaacccaaatcgggaaggagtgataacagaggaatcgctgtggtgattctcgacgctctcacaagaataacttatagcaaaggaatgattaatgaatggaaatga

SEQ ID NO: 59546 - DNA, 711 bp, Glycine max
  Peptide Sequence Number=SeqID_176324
atgattctcaaggataaagtggttacagaacttgggatccgatcacctgccgtcaagttcttcaatgcttatgcaaagcaactacacaatctgccaaacgttattgacacagtgcatgataatgagttgcatgaagttgtattatccgtttatatgcacggcgatcccatccctggctcattgccctcactttcttcttcgccaaagcttggtcttcagcgaggcgcttcttgcgccgacgattccctcggtgtcggagagggcggggggaattttcttgccactggtgaaggtggtgtgcgagagcaacgccgccgacaggacgaagcacaggttggggaatgtccacgacgagcttgtggaggtcactgcagggtgaaggacgagaatgagatgtgcgaggtcacaataggggtgaaaggcgagagtgagatgtgctcacggcatggtgaaaggcgagtgggagatggaaaggatgacaccttgactgtgatggtcttcttgacactggttgttgttgccataattatcactatgttagaagagccctcaaggcagttagcaccgtacaatgggcagcaagctttctatgatggtggtcacgtcaacaccgacatagaaggcaagttttctagaatggatggtgctcaagtaagcaccgtcctagaaagcaagctgtctaagacgatgctcacatcagcaccgatataa

SEQ ID NO: 59547 - DNA, 189 bp, Glycine max
  Peptide Sequence Number=SeqID_176325
atggataaatggctacaactaccattaaacccatacaagttgaagtgtgataaagaacccttgaactctagcttatgttttttcttggaggaggaaggtactatccacatttggaaggtaacctctaatgttgaccctacaactgagttttgtacatttaggactctcagagctgcggtacttggttag

SEQ ID NO: 59548 - DNA, 714 bp, Glycine max
  Peptide Sequence Number=SeqID_176326
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaaactggacagttccaaataagatttcattcttga

SEQ ID NO: 59549 - DNA, 741 bp, Glycine max
  Peptide Sequence Number=SeqID_176327
atgtcgccgagcaacgcgctggtatacatcgagaacatccgcaaagcgctggtggagcacgatccggccaacgcggcaacctataaccgcaatgccaaagcctacgcagagaaaatcggcgcgctggacgccccgctgcgcgaacgcctggcgcgcattccggccgcacagcgctggctggtgaccagcgaaggcgccttcagctacctggcgcaggactatcagctgaaagaagtctatctgtggccgatcaacgccgatgagcaaggctcgccgcagcaggtgcgccgggtgatcgacgcagtgcgcgcccaccatattccggtggtgttcagcgagagcaccatttccgacaagccggccaaacaggtggcgaaagaaaccggtgccaaatacggcggcgtgctgtacgtagactcgctgtccacccgcgacgttgaacgtggacgacgtcaccgtgacctacaacaacggacacaccgccattcacaacgccagctttaccctgagcggtggttcgatctgcgcgctggtcggcgtcaacggcagcggcaagtcgacgttgttcaaaagcattatgggcctggtcaggcccaccgccggccgggtatcgctgagcgacaaaccggtggcggaggcgctgaaaaagaatctgatcgcctacgtgccgcagaccgaagacgtcgactggaacttcccggtgctggtggaagacgtggtgatgatgggccgctacggtaa

SEQ ID NO: 59550 - DNA, 327 bp, Glycine max
  Peptide Sequence Number=SeqID_176328
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgaaacagaaaatatctattctagttttatcatcagctatgggttcgaatttaagcgaaattctagagaatgtttgttatcctga

SEQ ID NO: 59551 - DNA, 142 bp, Glycine max
  Peptide Sequence Number=SeqID_176329
gcgacaatgggtccgagaagaagacttggcaaaagatctcaaattacacacaaaacagcttcgccgaactctccggttttttgaagaggagaagatcattactcgagaatataggagagagcatagtagtgttgtccagtaa

SEQ ID NO: 59552 - DNA, 171 bp, Glycine max
  Peptide Sequence Number=SeqID_176330
atgagtgttaagcatctcaatgtggtcaaccaagaagtagcccaaacaacacttgtccaagctggaaggcttgacaagccacacaaacctgcaactcttgcacttgtcgaggttaccactctcggcactagacaactcttgtccatacttgggggctcgataaactcgtga

SEQ ID NO: 59553 - DNA, 813 bp, Glycine max
  Peptide Sequence Number=SeqID_176331
gcacagctgaagcctttgatggaccaactcagccgggtgaaagatttgcctgttccagaatttggcagtcttctagcgtgggaagctcgagctagtgctatggggcgtgcagccaacggagatatgtctggtgattctaaaatgtctcagcttggatataatggagcaccaatgccttatagtggagatactaaggttgtggtggacttcaatgggactgaagacataaaggatgttaagtctgaaactggaagtgcatctctaaaggttttgccaccatggatgattaaatcagggatggttcttacaaaggaacaacgtggagaggcgaaggaggaaataaagatggatgggacttcaacttcctcatcagcacagtacttggacgacaagaaatcaacagatgagtatattaaagcttattatgctgctttgcttaaacaacaacatgaattggaagctgctagtaaacaagaattgccaaatacactcactgcaaatgatccttctagcagtgcttctaatcgtcaagttggcatgaaatcaaaacttgaggaagatgatgatggtactgaatgggaggaggctccagttgcagttatcaaagtgacattgccagttgcaacattggcatggtgtaatggcaatgatggctatggtggcaagacagttgtagtggtagctacggatgatgattgcagtagagttgacaacaactgtattggaaatgaaaattacaaggtcgatttgaatgttgaagctgatgatactccagctgatgacgatgaagaagtggactgggaggaaggttga

SEQ ID NO: 59554 - DNA, 564 bp, Glycine max
  Peptide Sequence Number=SeqID_176332
atgtatcgtctgaaaatacaaacgcaaagaaataagtacaacaaaatttgtagattgaggaaaaccagagagatctgggactcattgagtatcaactatgaaggtataaacgatgttcaactaacaaaagttgtcactttgacaagacattatgagagcttcaccatgaaggacgaaacgtctgtggatgaaatgtttggaagacttcaagttcttctaaatggacttcaagttcttctgaatgggcttcaagctctaagacacactttcaccaaagctctgataaatctgaagattttagacaacttttcggagatgttgaacaagaaaagaaaactccagcactcctccaaaagaaaatctgaaacttcttccattacttcatcaaacgatgaagaagagatgtcttatgatgttcttcttcagaactctcaaatgatttctcttctgtgcaaaaagtataaagaaaaggtcaaagcatttatttgtgaaaatattgagctaaagaaatcaaatgaagttctgaaaaagaaaatccaaactctggaagagaatctgagctaa

SEQ ID NO: 59555 - DNA, 375 bp, Glycine max
  Peptide Sequence Number=SeqID_176333
atggatttccgctccttaccatgtgtgcttttagggtacaacacttcacataagggaatatacatctaccgtcacgttattttcaatgaaaccgtctttccctatgccacccaaccgccacctgtacactctactacaccaccaattcaccttgccacgaccctacatctccttgaacaagtcacagtagttcccactataactactccaccgaccccaccactttcaccctctccctctactgtacctaacacacaaacacctatcactccttcataccaacaacccacaactaactcacgtgcaaaacacactcaaccttcacaatctcactttcggcctgctgaaaacacaaccaatcctatggtcacatga

SEQ ID NO: 59556 - DNA, 780 bp, Glycine max
  Peptide Sequence Number=SeqID_176334
atggagttcagtgggagaatgcatgaactggcaaacccgatttacaacgtaggcaatatctgggcgagtgatggtgacatattggatagaaccaactatttgttgaaaaagggttggatcatgacatggggttccttgacatgtaagatgagaacctggaacagaagttgcaccatccttagtccttcaaatttggatagccaaaaagtagtgcaggttaccaaggatgtagagaagacaacctctagaagagtgaacaaagagggaagtatcaaatttgcatgcagtaaagccgtgggtgacaaggaagtgcttgagtttattgaaccatgcactttcagtcaagtcgccattgaggaatgtgttgttgatgtcaagttgtctcatacaccaaccattggaaagggcaataggaatgttgcatggcttgttgatacatgcggggccgaaagtgagattgtgaagggagagggtgaaagtggtggggtcggtggagtagttatagtgggaactactgtgacttgttcaaggagatgtagggtcgtggcaaggtggcggttgggtggcatagggaaagacggtttcattgaaaataacgtgacggtaggttgggttttaaaaacatgttcccagaaagtgaaaggaagagatgattgggataagaggatgcaacatgagatgttgggagatgagaatggtgacttttcccttgttcgcaagtctcatgtggatgagccaaacgttgatgccaaccatggagtgtggtacgcacaacagtga

SEQ ID NO: 59557 - DNA, 1351 bp, Glycine max
  Peptide Sequence Number=SeqID_176335
atggtgatggacggtaatgactctgagggttcgattcaacaacccctggtggaccgagaggtcattcctattggcggttcctcattagaggagactctccatggggtttctgattgcgaatcctcttcctcaaagaggttgacggtttcacactgtgttggtggagtcaccatgattctccccccttctgcttctggggaagccagaagaagtggtggtggagatgttagggtgcccccccgtgtgcaacatggccacagtgttgggtcactgtcatccctccctgttattgcttgctttgaatggcatttgaatgtagcaccctttcaacttcacgctaatagtttggctatggagaaggccttcaaggtcctggccccttcttcaacattcgaccaagagttgtttgagtttgactcgaacatgtttccctatttcaaagaccatttcttcaaggtcctagctacggacgtcatggctgatgggttacaactaatgttcaaccgagacggggagccctgctctagttctactagcagtcagaccctaccaggatctactagcagacagaccctaccaggcctcgttggatgcgtgagccattttgtctcttcctcgatggatgatcctcttgctaccttcgatgtgaagcaggttggtcctactggtagaactatggcaccatctgttgtcattcctcctactggagaagggggcctccccagcatacctttctctgttttggctaagcatgatgacaacgctggggtgttaggctgcaagaagtcgagggatattgctcttgctactgctattgttgttgttgcttctccacctcctcctgcttcgtctgtcgaggagatttctgcttcttctgctgctgaagttagtgcactagctactttaactggttctatcgtggctccttcatccattatcgttgtacccttgctgagtgttggtgctgcaaccatgagtgctcccaagatgccacctcctccttctttagctccaccagttccctccttgactgtgttggtgggagcatcaccttccacctcttctcacccagagaatgaacggtggcaccaagaacctctgaccaaggacctcatttctgaatttggatatctccttcatttggatgtatcctttggctcattcctgcaactcatccatgctactagagtggcagacacaaagccaatcggggtaaggaatgcatccaaatgttcatctggattagtggttccatcgtatcgctctatgttgagtggtttccaacctagaggtgtgattccccttgagtgcactcagacattgtgtgagcagagtactcattgccctgggg

SEQ ID NO: 59558 - DNA, 333 bp, Glycine max
  Peptide Sequence Number=SeqID_176336
atggctttgagaaagcttcccgcgaagaggtcccagaagggcaccactgaaaagggttccagtgtggccccccaagcgaacacagacttcgaaaggcaccgattccggagcgccgaacatcagcagtgcttcgagaccatcaagggatggcattgggcaccacttgtgtcacccatggctaaattcgacccggagatagtcatggagttctatgccaatgcccgacctactaggaggggatgccctcagccaattcctgggccaccccctgatcttagaggagggccaacagtgcgagtacggccagaagaggaggcaggtctccggctttga

SEQ ID NO: 59559 - DNA, 810 bp, Glycine max
  Peptide Sequence Number=SeqID_176337
atggccaactcaagctcttctctcttgacacttgctaataacaacacctccaacctaagccttcaacatccacccattaccataaaattagacagagacaactattcacggtggagatccacaataatttctgctcttgagacctttgaacttgagtctttcatcctttctcttgcacctccgagtgagacacgcatcactacaaccttcgatggtttcacactgtctgagagggctctctccatcatggtccgtgcatcatcttctcacatggaatggactgccattgataaaacctttcaagcccaaaccagagctcatcgtatggctctaaaagctcaactccaaacccttaacaaaggttctctttcgatgattgagtatattaagcataaactctccattgcagattcccttgctgaaaatcttcaccccatatcagatgaggatcttgttggttatctcttgagtggcctagactcttcttatggtcatttttccattgcctttatgatgaaggatgcttatgcctcagttgatgatcttgctggcctgcttcttcaagaagaggcccgcttggaacaagaccatgcacgtcacgctacacccgtaaccctaccctctcaagtccctcctcttttacctactcccactgcatacactgccacacattgttcgaccagacctgcaccaaacaacactcagtccaacaactctggttcatttcaaaaccattcctatgacaatcgccacaggcgtcctacatgccaaatatgtaacaaaccaggacatgaagccattgattgctag

SEQ ID NO: 59560 - DNA, 369 bp, Glycine max
  Peptide Sequence Number=SeqID_176338
atggagtacccgttgcttccagcaaggtcatcaggccccctattaatcagaccttcattgagaagtactacacccccaggtaggcacagggcgaggcaccacaacagcctggggacggccaacagcaggcagcagacacactgccaccacctccagagtccacctcagctcgtctacagaggttggaatgctatatgcaacatggggctagccaagaaatttgaggttgcagtagcatggcctgaagattggcctgattctcagacaggggaaggacttgtggggacctccggagaagcggataaggcccaggaagatgaggatatggctgacttgttcgacttcttgggagggagtgaagccatatga

SEQ ID NO: 59561 - DNA, 102 bp, Glycine max
  Peptide Sequence Number=SeqID_176339
tcttacagcgagcatgtaactacggttttcaatgcagtgggcactcagcgatgcggtgggcaagggagtaagggtttaggtacagtaggctcgagggagtga

SEQ ID NO: 59562 - DNA, 180 bp, Glycine max
  Peptide Sequence Number=SeqID_176340
atgtctagccgtgtcagtaccggccgatgtctctcctcctcgaaccaccgcagccagtggcgtacctatgtttgtttgagggcgggtggcatgaactctgactcaatccggtccaccgatgcaaccacgacagaggctccgaccaacgtcaccaagaccaaatgtgggcgccacttgtga

SEQ ID NO: 59563 - DNA, 768 bp, Glycine max
  Peptide Sequence Number=SeqID_176341
atggctacatcctcagagacaaaacctaagtcatttaaagaagcttcccaatcagacaaatggatcaaagcaatgaatgctgaaattgaggctttagaggctaatcatacttggattttgactaacctccctcctaacaaatcttctattggatctgctgttaacaactggcatttaaagcaattagatgtgaataatgtctttttgcatggagacctcaatgaagaagtttacatgactttgcctcctgacatgttaggaagcaaacctgtctctgctccaattgattatgctgtaagactacaccaacaatttggaattccacttgatgatataatagcttcatcatatcgtaggctcattggtcgccttatttacctcacctatacaaggctcgatatcacatatgcagtgcaacacttaagtcaatttgtagctcatccttcttcagctcatcaacaagtagcctataggattcttagatacttgaaagcagcactaggttctggtatatttttctctgcttccagcatattgcagctcaaagcatttagtgactctgactgggtaggatgcattgataccaggcgatctatcactggctactcagtttatcttggtaattcgtttatttcttggaaatccaaaaggcaagccatggtctctagaagttcttctgaggttgagcattgggcactagctagtgctacatgtgaattacaatggttaacccacttgcttaatgattttgggattgtttacacttga

SEQ ID NO: 59564 - DNA, 261 bp, Glycine max
  Peptide Sequence Number=SeqID_176342
atgatgaagattgaaaaagaatcagaggaaatgtttaaccttgttcatgttattgatcagaataatacaggaggggttcttaaagatgatcaagcagaagcaaataatattgaagctaggggggctggctttggggttgcatgcaaggaaaagaagaaggcgttgatgggatcaattctcaacctagaatccaaggacaaagaaatgatggaaataaagggcactggaaaaattgacagagttggagagggagatcaataa

SEQ ID NO: 59565 - DNA, 201 bp, Glycine max
  Peptide Sequence Number=SeqID_176343
atgagtagaacaaagaaagaagaagaagacgaggtgtacaaagaacctcaagaaatcatcatccatccaatgaaatcaatgactagtccaaagtgggaacgctactcagattatgttcatgagctcactgaggaattcaaggcattgcttggattatacaacacagggttgctcttactcttgaagaagcacaaaggatga

SEQ ID NO: 59566 - DNA, 162 bp, Glycine max
  Peptide Sequence Number=SeqID_176344
atgtgtggtctccattcgtctacatcactaatgtccctgttgcacccttcaacttcgttggcctcagtcaagaccagaccaacgacaacgtcgtcaccagttcatgttcaatggaccgaatttgagaaaagtgcgaaaggtggagaattgagagaagggtaa

SEQ ID NO: 59567 - DNA, 111 bp, Glycine max
  Peptide Sequence Number=SeqID_176345
atggctaacagtcttaatgtttttgaagcattatcatcagggaagattgtttctttaaaccagccttacctccccttgttcgatcatgacgagtttgtggaaggccaatag

SEQ ID NO: 59568 - DNA, 339 bp, Glycine max
  Peptide Sequence Number=SeqID_176346
atggcaacaccgccaaggtcccctttgcattcagatgctcatttggagtctacgtccaggaggactcaagaaaagattcctattttccattgcaattggaaagatgcaccagaatctctaaagaacctaatatgggatgacattttgggcaaatttgatatcccagaagcatcaaatgccaagaagaaggaaatcaggaaaaaggttcaggaaattcaaaaattcaatgactatccccacttactatctcatgagggttatgatttgcttgagaagaacctcatggaggagaaacgaaagaaaaaacaacaagaagcaatgaatactgagaatccataa

SEQ ID NO: 59569 - DNA, 1224 bp, Glycine max
  Peptide Sequence Number=SeqID_176347
atggctcagattcccaacctagacaatgctcctgtcaatctcacatccattagggagcattcgcaaaaagagctcctcaacatcctcaagaatgtcacgctgaattacaaacaggagcatggagttgaattgcggcatctttccggggacccaattcaaactgactgcagcaaagtagtttacattgtgcatgctcagcccaagttgatgagattcatatgttctaatattcataatgatgtatcgaaaggactgcaaagagaatatcatgtttattttgtccctcgccgcactgttgtttgtgagaaagttcttgaggaagagaaattacataacatggttacaataggggaatatcccttgtatagtgtaccaatggatgaggatgtattatcatttgaacttgatctctcttacaaagaatgccaagttgatggtgatacaagctcactttggcacattgctaaagccattcacaaacttgagttttcttttggagtgataccaaatgtgagggcaaaaggaaaagcatctgtgcgtgttgcagacatcctaaaccgaatgcaagctgaggaaccagttaactcatctgattttctgcacatcaacaatggttctgtagagcttgatgcatctattatgggtcttcagcaagaagggaagaaaactaaagttccacttaattcaaggagagaactactccacagctatggatttgagcacatagcaatgctaaacaatttagagaaagctggactttttaaaaagcaggagtcaaaaagcaattggcttactataaaacgtgctctacagcttgtggttgaagacactgatacggccaagcgtcctgttgaagaaattttgaagctactgcctggacctcatttggaaatgaagaggggtggattctcaaatagcccatcatttgacactttatcagggattcaatccagcatagccaagttacaagctttggctctcaagaagagatcaaccaaaggatggagtattaaatatggatctcatatgatccataattccaagtctgatgtgggaggagttataatgggccagcataatgaaaggcctgccatttggatggcttattctagtaggaataggcaggatcccggtgtagggtgtgcacatgaggacggggttaacggggaagaaatcagtctaggtcatttggttgggcagagagaattaccactttgtggaggg

SEQ ID NO: 59570 - DNA, 1737 bp, Glycine max
  Peptide Sequence Number=SeqID_176348
atgcttaaccacccaaagcagaagctgctcacatcatcaacgcttaaccatcaagggcaaaagcaaataatgtccaaatacacattaccaaattttcaagacttgtcattatacgcaacggctttgcggaggaatgatacagcagataagttccaaaaagtaactgaaaaaattgaagctgtgctcagtgaaattccttacaataaacttgacatatcggatgaagttcgagaacagattgaactggtgcatgctcaattcaaaagagccaaagctcaaacagaatttgctgatatacaactagacctggatatggcagtggcacaaaaagaaaaggaccctggtcctgctgtactgaagagactttctgaaaagttgcatctaaggacaataaatgacctaaggaaagagtctagtgaattgcatgaattgttcatcacaagtggtggagaactcggcgattcttttgaaatgatcacatcccttctcagcaaactgagggaatgtgtgctcacagaaaatcctgaagttgattccagtgaatgtgaaaaattgtcagttaagcacaggtctcccatgatcccagatgattttcgatgtcctatatctcttgaactaatgaaagatcctgtaattgtctccactggtcagacatatgaaagatcttgcattcaaaaatggcttgatgctggtcacaaaacctgccccaagacacagcagacacttgtgcatacagcccttacccctaactatgttttgaagagtttgattgctttgtggtgtgaaagcaacggtattgagctaccaaagaaacaagggaactgtagaacaaagaaatgtggtggcagcagtctttcagattgtgatcgaactgctattagtgctttattggataaactaacgagtaacgatatagaacagcaaagggcagctgctggtgagctccggttgctggctaaaaggaatgcagacaaccgagtatgcattgctgaggcaggagcaataccacctcttgtagatctgttgtcttcttcagaccctcgaactcaggagcatgctgttacagcgcttctcaatctttccatcaacgagagtaacaaaggaactatagtaaatgctggagccataccggatattgtagatgtactgaaaaatggcagcatggaggctagagaaaatgcagctgcaactctctttagtttatcggttctagacgagaacaaggtgcaaataggtgcagctggagctatccctgctctaataaagttactttgtgaaggtactcctagaggtaagaaggatgctgctactgctatcttcaacctatctatttatcagggaaataaagcaagagctgtaaaagctggtatagtagccccactgatacaatttctgacggatgctgggggtggaatggtagatgaagcactagctattatggcaatccttgcaagccaccatgaaggcagggtagcgatcggtcaggccgagccaattcatattcttgttgaggttatacgaaccggctctccacgcaatcgagagaatgctgctgctgtcttgtggtcactatgcaccggagatccactgcaattaaaactagcgaaagaacatggtgcagaagcagcactgcaggagttgtcagaaaatggaactgatagagctaagagaaaagctggaagcatattggaactcttgcagcgaatggaaggggttgataatctgcagagttcatag

SEQ ID NO: 59571 - DNA, 831 bp, Glycine max
  Peptide Sequence Number=SeqID_176349
atgtccgtccgtccacgtgattcaacacctcaaacagaaggttgtcatcgaaatgcaccagcccctccatgcgttccacgttgtcgtcattttccactgccttcgccttcttcatcttcttgtcctcgacatcactgccactcgctgatggtggcagtggacacttcatcattgagatcacttaatgcgaatgcaagcacccttttgtcgtttgggtctggtggtggcagaaagttagggtggagtcaaactccgttgtgggcgagccctggtgcagcggtaaagttgtgccttggtgacttgttggtcatgggttcgaatccggaaacagcctctttgcatatgcaaggctgtattgttctacgatttgttcgtggtcagtttgatccaacatctaaggtaactgttggagcttcttttttgtcgcaaacaatagctctgcaagactctacaacagtcaagtttgaaatatgggatactgctggtcaagagaggtatgctgcgttagcaccgctatattaccgtggtgcagcagttgcagttattgtttatgatataacaagcccagaatctttcagcaaagcacagtactgggttaaggagctacaaaaacatggaagccctgatatagtgatggcactggtcggtaataaagctgatcttcttgagaagcgggaagttgctgtccaggatggcactgactatgcagagaagaatggtatgtttttcatagagacatctgcaaagacagcagataatataaatgaactgtttgaggacattgttgactatgctactagcaagcttcccaatgatgttcttgctgcttga

SEQ ID NO: 59572 - DNA, 231 bp, Glycine max
  Peptide Sequence Number=SeqID_176350
gaagacgaaggaaccgattttggtttggaacatgcttggcgactcttgaaagatcaaccaaaatggttagagcagtttactgaaagttgctttaaaaggacgaagatttcggcatatggagcatattcttcatcatctaatccagaaacaccggttgaagctgatacaccgtctccaattatccgtcgaatggggaaaaagacagtcaaaagaaagagcaaggggaaatga

SEQ ID NO: 59573 - DNA, 475 bp, Glycine max
  Peptide Sequence Number=SeqID_176351
atggattcagttataacagtgttgtatttcaatggaagggtatatgaagataatgatggtgtaatatttgaaggcagtaaaaatgcgattcagattaaacgaaaatatattgccttgcaaatttgcgatgacgaagacgttgaaacgatggtggaaagttttaaacaacaacaagaaatgtcagttctagaattgtacatagaaaaggatgtggctggtggttcaatgtttcagtctacaaattcgcttacatcatgtggaaattatttatctaatgatgagacacaaccgccaacaaatatgagcaatttacatcttgacgaagatgatgatcataatgatgatgattatcttgtttctaactcatacgttgaagagtctttagacgaagatgacagtgttgacgatatatctgatacagacaatgaagtccccgacatgattccactagtaagaattgttcacccaacagaag

SEQ ID NO: 59574 - DNA, 378 bp, Glycine max
  Peptide Sequence Number=SeqID_176352
gatttgatgaatccaatgggaactaatactctaaacaaagaggaactcaaagagattgagaatctcataaggaaggacattgaagaggctccaattgtgcttgaggatttgatcctcacaactaggttagtccccaatctcaatgtcttaactactctccttgaatttttgttcattagagcttggactaaggtttttgcaaaggccaagattgtttcgacctcgttcactagacaggagaacaccataacccagacttgggttggtatagaggagaataatcctggtagtaccaaggagcctagaattggatggatgacaacctttctctttatgaccagctttgttggattgttggcattggttcccattagaaag

SEQ ID NO: 59575 - DNA, 1146 bp, Glycine max
  Peptide Sequence Number=SeqID_176353
atggccctcaccttcgagctctgccgcgccaccacccaccacctccgccgcatcctcaactctatctcccaaacctcaaacctcaaagcaatagtcttggacttcataaactacagcgccgcacgtgtcactaacacgcttcagatccccacttacttctactacacttccggcgcctccaccctcgccgttttcctttatcaaactatctttcatgaaaactacacaaagtctctcaaggacctcaacatgcacgtcgaaatcccagggttaccgaagatccacaccgatgacatgccggagacggtgcaggatcgtgcgaaagaagtttaccaggttttcatcgacatcgccacgtgcatgagggacagtgacggggttatagtaaacacgtgtgaagccatggaagagagggttgtggaagctttttccgaagggttaatggaaggaaccacgccgaaagtgttttgcattggacccgtcattgcttctgcttcttgtagaaaggatgataacgagtgtttgagttggctcgattcacaaccgagtcatagtgttttgtttctgagtttcggaagcatggggagattctcgaggactcagttgggagagattgctattgggttggagaagagtgagcaaaggttcttgtgggttgtgaggagcgagttcgaaaatggtgactcggttgaaccaccaagtttggacgagttgttgccggaagggtttttggagaggaccaaggagaagggaatggtggtgagggactgggccccacaggcggcgatactgagtcatgactcggtgggtgggttcgtgactcactgcgggtggaactcggtgttggaggcggtttgtgaagctgtgccaatggtggcgtggcctctctacgcggagcagaagatgaataaggtgatcttggtggaggaaatgaaggtgggtttggcggtgaagcaaaacaaagacggcttagtgagttctaccgagttgagggaccgagtcatggaactcatggactcggacagagggaaagaaattagacagaggatttttaaaatgaaaatcagtgccaccgaagcaatgacaaaaggtggatcttcaatcatggctttgaataggttagtggaaatgtggagggagcactag

SEQ ID NO: 59576 - DNA, 162 bp, Glycine max
  Peptide Sequence Number=SeqID_176354
atggagggggtggcggcgctgacggcggcgatatatttggaggtggcgtcgcaggtgaaggcggtgggggaggtggggagaattgctgggcgtaaaggagaagagtttcttgctctatttatggccagcgtagagtccgcaagctgcgtaatatttatttaa

SEQ ID NO: 59577 - DNA, 222 bp, Glycine max
  Peptide Sequence Number=SeqID_176355
ggggagatcggtattgcggtcgtcgggtggaatgttgctaagcagcaacgtcatccatatctgtgcatgagtggtcatgttgcggcatgggtgaaatcttgccccggtatgcatagtagctgcgtgatagcctccctctctggatgtgttcgcacaattggtcaccctccgatatcagggggtggaccagaaactgataaaaggaaactattggccccttaa

SEQ ID NO: 59578 - DNA, 150 bp, Glycine max
  Peptide Sequence Number=SeqID_176356
atgccaggaagccacattataaacaaaacctcgaagggagttgggcttcatcctcaaaaggaaacaacaccggaatatttagccttccatagattcaaacagaaaaccctaacagaatcgctttgcacgaatcccaaggttgctatttaa

SEQ ID NO: 59579 - DNA, 201 bp, Glycine max
  Peptide Sequence Number=SeqID_176357
atgggtgatttcgcgaagattttccaccgttcttcatcgttcttcgttcgttcttcatcgttcttcggtcttcaaccggctaaaatcaactcacaaaatcaagcttcgtccgcaaaaatcactgaaaaccattttaaggtccaacgccttaaacgatcctctttgcttttatcggttaacatggaccgttcaaaagcgtaa

SEQ ID NO: 59580 - DNA, 1104 bp, Glycine max
  Peptide Sequence Number=SeqID_176358
atggtggacttcgtcaatctggtgtcgggcaagtgggcgatacccatcctgtaccgactgataatgatcgacggcccggtgtttcccgaagtgccgccgcgggtggagtatcaggtcaccgcgctcgctgatcggcggctagtcgccgatgcccggcgggttgatggcggagcgctcgaccttttcatcgccttcgccccagcgctccagcacctgcgcgtattcgccgctgacgatgacgccgttgatggcggcgttgacggcgttcaccaaaccgttgccttttttggtggtgaccgcgacgtaggccacgttggggccgatgccgaccattttggtcttgccggtcagcgccgccttgtaggcgccggtggagtgggggccgaagaacgcatcggcgcgcccggactgaatgctcaggttggtggcggcgtcgtcggtcacgtagatcggctgcacgggcggcaacccggcggcgcggttttgcttatcccatcccaacagtatgttttcctgattggtgccggatccgacgatgatccgcagcccggcgacgtcctgcggccggttgatcgaggtgatgtggctggtggatttgacgtaaaagcccagcgtgtccacccgataagtggcgaagtcgaatttggtcttgcgcagtttggtgacggcgatgttgaagatcgccgcgtcgtatttgccggcgctgatgcccagcggccaatcttcccacgaggtaggcaccagattcagctccagcccaaggctgtcggccaccaggcgggcgatgtccggatcgctgccgatcagcgttttattgtcctcggcgaacagcgccagcggcggagagttctcgaaagccaccgccaccgtcagcttgccgggcaccgcgaagtgaaagtttgccggaatcagtgcgatagcggccgggtttttctccgcgcgtatcggctctcggttagcctgcagatcgataccgcccgccgtggccgcctgcacggcggcgctcagcaacagcgcgcacagcgccgaaatcctcagtggcatagcaccctctatcctttgttaatcatggggttactattggcggcggcgcggggcaagtaa

SEQ ID NO: 59581 - DNA, 2379 bp, Glycine max
  Peptide Sequence Number=SeqID_176359
atgttcaagaacgcatttgcaaacctgcaaaaagtaggtaaatcgctcatgctgccggtgtccgtgttgcctatcgcaggtatcctgctgggcgtcggctccgccaactttagctggctacctgcggtagtctcccacgtgatggcggaagcgggcggttcggtcttcgccaacatgccgctgattttcgccatcggcgtcgctttgggcttcaccaacaacgacggcgtttccgcgctggcggcggtggtggcctacggcatcatggtgaaaaccatggcggtggttgcgccgctggtgctgcacctgccggctgaagagattgcggccaaacacctggcggataccggtgtgctcggggggattatctccggcgccatcgcggcctatatgttcaaccgcttcttccgcattcaactgccggaatacctgggcttctttgccggtaagcgtttcgtgccgatcatttccggtctggcggcgatcgttctgggcgtagtgctgtccttcatctggccgccgatcggtacggctatccagaccttctcgcagtgggcggcttatcagaacccggtcgtggccttcggcatttacggcgtggttgaacgtgctctggtgccattcggtctgcaccacatttggaacgtaccgttccaaatgcaaatcggtgaattcaccaacgcggcgggccaggtattccacggcgacatccctcgctacatggcgggcgaccctaccgcgggcaaactgtccggcggcttcctgttcaaaatgtacggtctgcctgctgcggccatcgccatctggcactcggccaagccggaaaaccgcgcgaaagtcggcggcatcatgatctccgccgcgctgacctcgttcctgaccggtatcaccgagccgatcgagttctccttcatgttcgtcgcgccgatcctgtacgtgatccacgctatcctggctggcctggcgttcccaatctgcatcctgttgggcatgcgtgacggcaccagcttctcgcacggcctgatcgactttatcgtactgagcggcaacagcagcaaaatctggctgttcccaatcgtcggcatcgtctacggtctggtgtactacaccatcttccgcgtgctgatcgccaagctggatctgaaaactccgggccgtgaagacaccgctgccgagcagactgcgcagggcggttccgaaatgtcagcggcgctggttcaggccttcggcggtaaagaaaatatcactaacctggatgcttgtatcacccgtctgcgcgtcagcgtggccgacgtgtccaaagttgaccaggcgggcctgaacaaactgggcgcagccggcgtaatcgtcgctggctccggcgtgcaggccatcttcggcaccaagtccgacaacctgaaaaccgatatggacgaatacatccgcgccaaggcgctgttcgagttcggcgagagaagggaggaactagacctgttcgccgcggttggcttcacgcacgaaatcttgcagcgcattgctttgcgccagccagggggagatatcgcccagcagcgcaacgcgcaggcggtagttgatgaatttctgcaatacggcgccggccacgccgcttctgagctggaaaaaggcggcgtcgaggcggttgacggggagggcaatcatcccggcatcgtgttcaaaggcgggcgcgataaacaggctgacgtaatgctcgaacaccgccagcgtttcgtccgagatatggtgctcaatcccttcgctgtccagctcggcggtttcgctcggcaccccgacgcacatcagcagatcgaccacgatgcggtgacggcggcgcaccttctgcgccagcagctcgccttcctcgcggcgcgcgatatcggtggttctggcttcgcgggtgctttgcagcaaatcggcgatcagctcaacgtaatcttcgatcagcgcattggactgcgcttcgcgggcgcggctaaaacgcagggcgtgctcggcctcgtccggcatgtcggtctgggcgtggcggtcggcgttatctggcgcgcgggtaaccatagcgtggggcgtcctgtaagcataaaaatggcgtctcccggcaatgcggggagggttgccctaaggtacttcatgcgtgatgcggcaaccactccatcgttaaccgaacggaccaacatcgcgattggcgccgcccttgccggacgcaagcgcggcgcctttacgccgttgctgttcgccggcccggcgcctgctgtgggtggtggtgatggccaacctgatcgccatgctgttccaggcgctgtcggccaagctgggcatcgtcaccaaccgcaatctggcggagatgtgccgcgaccagttttcacggccggtggtgatcggcat

SEQ ID NO: 59582 - DNA, 627 bp, Glycine max
  Peptide Sequence Number=SeqID_176360
atgccagggcagcagctcgattttaccatcgataacccgggcggtagtaaagcagccatcgccgaactgcaggccgcgatcgctcggcgccagcgcatcgtggcgttgtccgttaatccagtacatgctccctcctgttgccgggtgatttcattacgctcgcagaatagcaggcgacgaggcgatacgcagccctgttggtgtccagacgataggcgtaaaaaagcccggttaaaaaaccgggcttttatcagctatccacagcgcgagttacactcggcggaagatcagcgagccattggtgccgccgaagccgaaggagttacacaggctgaactccatatcgctgacctggcgcgcttcgtgaggcacgaagtccagatcgcaaccttcatccgggttatccaggttgatggttggcggtaccgcctgatcgcgcagcgccagcacggtgaagatagactcgatcgcgcctgccgcacccaacaggtggccagtcatcgatttggtcgagctcaccagcacgcgctctgcatcggcgccgaagacggatttcaccgcctgcgcttccgcctggtcgcccgccggcgtagaggtgccgtgcgcgttgatgtagccgatttgtga

SEQ ID NO: 59583 - DNA, 603 bp, Glycine max
  Peptide Sequence Number=SeqID_176361
atgatgatgaagatgtggaactggtaccagaatagcctttctgttcatccagtaaagacccaagctattagttctgccattctctggggtgttggagacctttcagctcagtacattactcattcagctgctccaaaaaaactacttcaactatctcaatttgccttgctggattcagatgctaaatttacgatcaactggaaccgcttggctgttacaagtatgtttggattcggttttgttggatcagttgggcacttctgtttgttacaacatgagattgcgtccaattttttagaaggtggcgtgtggccagttgtgcagcttctctatgtaaacttctacttgctggattgtgcttttctgtcatggttggagcaacagaaggatgcaccctggaaaaaattgtttgcatcatttcattctacgaacgaaaaaggaggtcatcgatgtggagaaggcagtagcttaaaggagattgacgttcttagtgaagatgaggcacagagtctaaatagagtgaggcacataaattgcatttctattttgcttgaacataaagttgaggatacaccgttggaagatgctctcccgattaagtag

SEQ ID NO: 59584 - DNA, 432 bp, Glycine max
  Peptide Sequence Number=SeqID_176362
atggccgtgtccttgtcagggttgggcctggggctccaaaattctggaagagtcaagtttaaagcctttgtggacgatagtgttcagcattgtcactgtttgtgccaatgtttttttattgggcttgggcccatcacatgggtctattcgtcagagatttttccgttaaggcttcgagcccaagggtcgagtcttgtgatttctgggaaagggttggtgagtggggtggtgtctatgacattcttgactatttcgaagaagataacgtttggaggggtgttttttgtgatgatgatgactacgactttcttttatgtgtttatgccggagaccaaaggcaaaacattggaagaaatggaaacactatttgaggatagtgattgcctggtggaagttgttttggatagtgatttgcctagttcagccgtataa

SEQ ID NO: 59585 - DNA, 1707 bp, Glycine max
  Peptide Sequence Number=SeqID_176363
atgaatgctttgattggaaaagggaagccacatgaagctcaggccgtcttccacaatttgactgaagaagggcataagccaactctcataacatacacaactcttgtggctgccctaacccgccaaaagcgtttcaagtctattcctgcacttctttctaaagtcgcagacaatgggatgaagcctgattcaatacttctcaatgccatgatcaatgccttttctgattctggcaaggtagatgaggccatgaaaatctttcagaaaatgaaggagtatggatgtaaaccaacaactagtacttataatacactcattaaaggatttgggattgttggtaggccttatgagtctatgaaattgctagagatgatgggtcaggatgaaaatgtgaaacccaatgatagaacatataatattctcatccaagcctggtgtaccaagaagaaactggaagaagcatggaatgtcttgcataaaatggtggcttctggcattcagcctgatgtcgtaacatacaacacgatggcaagggcatatgctcagaatggtgagacagagaaggctgaaagactaatattgaaaatgcagtacaacaaagtgaaacctaatgaacgaacttgtggtatcataataagtggttattgcaaggaaggcaatatgacagaagccttgaggtttctatacagaatgaaggagcttggtgtgcatccaaatccagtagttttcaactctcttatcaaaggatatctagacgctacagacacaaatggagtagatgagatgaaaattgttcaggcactgacattgatggaagaatttgggatcaaaccagatgtagtaacctttagcaccatcatgaatgcatggagttcagcagggcttatggacaattgtgaggagatattcaacgacatggtgaaggccggtatagaacctgacatccacgcatatagcatccttgcaaaaggctatgtgcgtgcgggacagccacgaaaagccgagtctcttctgacttctatgagcaaatatggtgtacaaacaaacgtggtgatcttcactaccatcatcagtggatggtgtgccgcaggcaaaatggatcgtgcatttagcctttgtgagaaaatgcatgaaatgggaacttccccaaatttgaaaacttatgaaacattaatatggggatatggagaagcaaaacaaccatggaaagcagaagagatacttagtactatggaagagagaggtgttgtccctgaaatgtcaactatgcaactggtggctgatgcttggcgtgccattggtttattcaaagaagccaacagaattcttaatggttcagaagaagaatctgagctagatcaagaatttgatagtgacaagatgccagtgcaaagcttggagagtatttataagaaacagaaactcagtgcttctccctctaatctgcttcaaatacgtgatgtagtggtggctcatccagaaagaacaaccaatggaaacataagaagccgaatggtagtcaaactgtctgacaacatgcggaatgttactacttccatgttttttgttcgcacaagaagttcatatggagtgcaaccactgattcacaccatgccaatgagttcaggtggaaaaaactgtagataccattcatggacttcagaaatcagaacatacgcttacaattttgacaaaatgctggtgtaa

SEQ ID NO: 59586 - DNA, 183 bp, Glycine max
  Peptide Sequence Number=SeqID_176364
atgggtggtgatatagcaggatggtcggcaaggccgagaatactgaaagcagcgaaggaaattggatcgcagaggaagacggaaaccctagcctcaacaaccggcaatcacatgttggttaggtacatagagagtgcttataaagaggagaattgtgaactagggttttgggtgactcggtga

SEQ ID NO: 59587 - DNA, 183 bp, Glycine max
  Peptide Sequence Number=SeqID_176365
atggctttgaatgtctatccagcatattatattgacatcattatctctaacttgttacctccaaagagtttccctttagcaataagggacgcggttatcatatttcagttgatggagaccaagtatcagatgctacttggtgcaatatttcttcccaaggtgttcaggtttgcacccacctga

SEQ ID NO: 59588 - DNA, 201 bp, Glycine max
  Peptide Sequence Number=SeqID_176366
atgctcttgtttattattacctacgggctaccggtttctaaccttgtttcggctttggatcaccaattgaagatgtcattcacgatgctcgcctacgagctatgcttatccagtgagagtaatcgtgcaaacaaggtcacatcacagcccaagagagaaggagaagtgtcaagtcatcataagaactcgtccagtgagtaa

SEQ ID NO: 59589 - DNA, 704 bp, Glycine max
  Peptide Sequence Number=SeqID_176367
gatcttatcttgcatcgatcaacaattccttcaaggcttcaaagttaattattaaccagcccgtgatggagattcaagaattcaatgaacaatattttttgcttgcagagttgggcattgaggcccggtcaggttttaaatcccatggtgaagggagtacacagctttcaggttctatccaattatcatcaaaagaatcattctttggcaagactgaggcaaagactattgttgagattaacaccatctctgaagaaattgtttgtgtcactgttggcacaattactaggattgttctggacaatcattcatggtgttatacagcttgcattcagtgccataaaaaaagtgatgcagagatggcgccctttacatgtgcatgcggcaaatacaataaggaagttgtgcttaggtataggcttgaggtgatgatcaaccagggaaatgaaagcacaaaattcctgctttgggaccgtgaatgcagtgaattaattggccaatcaactgatgcagttaataagcttaaaattgaagatggtgatgttgatttgaatgcttcaccccaagcacttgataagctgctgggtcatgaacttgctttcaagataaaggtgcaacccaagttcaggaattttgctgttttgaagtgttcagctgactcgagcttgataaatgctgtgatggatatgctagctgatgctgag

SEQ ID NO: 59590 - DNA, 315 bp, Glycine max
  Peptide Sequence Number=SeqID_176368
atggcgagggcgtgcagtcctctgatggcgaggatgtgtagtcctctgaaggtgagggcgtgcagccctctgatggcgaggacgtgtagtcctatgatggcgaggacgtgtagtcctctgaaggtgagggcgtgcagccctctgatggcaaggacgtgtagtcctctaaaggtgaaggcgtgtagccctatgcaggcgaggatactagtacccaagggttcacttgaggctcatgcacggtgcccttcattgccccagtgtaaggctttgaggtttatgcacggtgcccctcattaccctagtgtaaggctttga

SEQ ID NO: 59591 - DNA, 753 bp, Glycine max
  Peptide Sequence Number=SeqID_176369
atgcgtcagaatgttgcagaatttccagatagcgccagtgagattgcccgctatttcagcagagcgacagcacctactcagcaggaaacgctggggcagattgtcgttgagatcctgcgcgcaggaaaaaacctcaaccgtaaggcgatctgcaccaaactgctgagacgccttgagggtcagccacttgtccgaaagggcacagtcccgcagggggtgggcatgcagagaagtcaaattgaacgtttaaccgaaatcgttctgggcgaggcggtggtcaggctgctcgataataatgaacgaatcaatgtggcgaccgtttcagcccggctccggtcaatggccgcagaggaatttaatcccgaccgtctggaggcgatcaggatcgccatcagggaactgcagatgcagtcagcagcccgggaaaatcgtgaaaagccgatggctgctctgggcgggatgtcacaacccagggctgtgtggcaggacgcccggcataacacggccatctcaggatggccgatttttttggcgaccaccgggctcggcggtgagcgctatgcagccgaagccgcggcactggatgccgtgattcgcgacatcgtcatccatggccaaaaagtgacgagcaaaaccatcatcttgtatctaatcgcagagcttgagatgaccaccgatattgtcaaactggatgtactgcgcaacgtgcttgaaatcgtggtcggcagaacgccggatgatgaagggttctga

SEQ ID NO: 59592 - DNA, 684 bp, Glycine max
  Peptide Sequence Number=SeqID_176370
atgggcgacatcgtctcgctggtcgaaaaggccgccgaaaacatcgatgcggaaaaagcccgcgccatggccgagaagatggccaagggcaagttcgacctcaacgatctcgccgaccagcttgcccagatgaaaaagatgggcggcatgggcggcatcatgggtctgatgcccggcatggccggcatgaaggacaagatggcttcagcgggcatgaacgacaagatgttcgaccgccagattgccatcatctcctccatgaccaaggcggagcgcgccaatccggatattctgaaacacagccgcaagaagcgcatcgccgccggttccggcaccgatgccgccgaaatcaacaagcttctgaagatgcatcgcggcatggccgacatgatgaaagccatgggcggcaagggcaaaggcggcatcatgaagcagatgatgggcggccttgccggcaagatgggtctcggtggcatgatgggcggcggcatgcctgatttgtccaacatcgatccgaagcagcttgaagcgctccagaagcaggcggaagccgccggcctcggcaagccgggtggaatgcccggccttggcggtctgccgggcggattgccgggcctcggaggcacaaagctgccgggtcttggcggcatgccgggccttcccggctttccgaaaaagaagtga

SEQ ID NO: 59593 - DNA, 189 bp, Glycine max
  Peptide Sequence Number=SeqID_176371
atgggtgatcagaccaagagcatctctgaaaccgcaacgttgcgcataacgccacctttgcgcttagcacgaattcttcgtcgcgctaagcgcgctgaagctgcgcttagcaatagatgcgcgttgagcccaaatggtgagctgagcgcaactactacttttagaaattcaagatttagcctcatttaa

SEQ ID NO: 59594 - DNA, 171 bp, Glycine max
  Peptide Sequence Number=SeqID_176372
atgccttttaaaggcttgaagagtgcgagaaaacgggctgtgttttctggaaaacgcgatgaacttgctaagcgagcatgttgcactaagcgagttcatcaatactcattgtatccgcgcgctatgccaagcattcctgagccaagcgcatttggttgcggcatccgctga

SEQ ID NO: 59595 - DNA, 366 bp, Glycine max
  Peptide Sequence Number=SeqID_176373
atggttaaggaggagtgtaaggaggtaagtgtctcctccaagaggttagctaagaaggaaagtcattttgtaataaagataaacattaaagaaacttcccctcttagacaacctccacatcttctcctttgtaaaaagacacttgttagcactgtcacatctattgggcttaatgttattcctcaagtaaaggagttgttggatgagggtttggtttgtaggagcttaaatcctcgtgctttgttggtgcccaaaataggtgccgagggaagaagcccagagtatcaagaacctttggatttgaggtcaaatcctttccaagggggaggggatgatgcaatcctactcccaaaggatattggataa

SEQ ID NO: 59596 - DNA, 346 bp, Glycine max
  Peptide Sequence Number=SeqID_176374
acttatcttccttcattggaagtggcgtctacccagacttatcttccttaaccggaagtggcgtctacccagacttatcttccttcattggaagtggcgtctaccctgacttatcttccttcaccggaagtggcgtctaccctgacttatcttccttcaccggaagtggcgtcatccaaaccttcgtagtctgtatcaaacgatccgctcctagtcagattcacatcatctggccttcgtctttctccacttgggcctttagcctgtatttggccagtttcatgattctcatcattccctccttcttggaaaacatttgtcctcaaatgtccaggatcatcaccgg

SEQ ID NO: 59597 - DNA, 204 bp, Glycine max
  Peptide Sequence Number=SeqID_176375
atggatgagccatatttgggtgcagatccaagcaatgttgatgtcttggttcattttgtgggagtgaaaggtgaaccatgtgaaatccgcaatgtagatcctgacaacttcattggagcatgcaggccttggatcttcttcatcaatggagtcctttgcttcttgaagatgaatgacagcggaatggagaaggaagaaagatga

SEQ ID NO: 59598 - DNA, 574 bp, Glycine max
  Peptide Sequence Number=SeqID_176376
ggaatatctaagctctgattccgttgataaatcagaaaccaatgaagattcgtatttccaatcaattactactaaattccttaattcattgaacacatccggtttgccaactcattctatcaaacttaaaattggaagtcctataatgctgttaaggaacctcgaccaaaatcaaggtctatgtaatggtattagattagtggtaacaaagatgacaaaacatgtaattgcagctgaaattatctctggtaaaaacattgacctcgccgtttatattccaagaatgtcaatgtcgccttcacaatcaccctggccgtttaaactattgaaaagacaatttccgattatgctatcttatgcaatggcaattaacaagtcacagggactattgctatccatggttggactttatttgccaaaacctgtattcactcatggccaattatatgttgcattgttaagggtcaactcaacaaaaggattaaaaatcctgattcatgatgatgagcagaaaagcatgaattccactaccaatgtagtattcaaagaagtgttcagaaacattaaaagataa

SEQ ID NO: 59599 - DNA, 312 bp, Glycine max
  Peptide Sequence Number=SeqID_176377
ggttcttctcggtgtggggtttcaacggagaactatggtggtttgtggtggctaatggtggttgtgggtgatggagaaagtgcttgggacgttagaaatggctttggaagaaataaagaagaagaaatggtgtttttcctaagctacacgaaagcaaaggctaaaaacgctcaagtgagaaatgctctcggaaacggaagcttcgcgcacactccagacatcttctcaaagatcccaacgacagctcatgtagcttcctcaagaagcttcattaagatgcttcctcaagaagcttcttggtggcttctttga

SEQ ID NO: 59600 - DNA, 321 bp, Glycine max
  Peptide Sequence Number=SeqID_176378
atgggccgagacccaattaaacaggcccaattgtgtaaaaaatgctccgatccctggccctgctccttcctctacagaaagaaaaatggaagaagacctggacggcgtcgttctgtgctcctccctcaccgtcgaggctatgattcgtttcggagcggtaacaacatcgcctattctaccttgcttgaatcgcaaaataatagacctaatgaaagaaactttaaattgttcttcagaccggtgcaatctggggcttgtgtgctgactcgtcaacaaggtcttacaggctctgctaaagcttcttttttgataaatgattag

SEQ ID NO: 59601 - DNA, 189 bp, Glycine max
  Peptide Sequence Number=SeqID_176379
atgtctttgttagcttcaaactgtaaaaattatagggacttgggttcgagtcccgttgttaaatttaaccctattcaagtagacattgtacgttcagggtggctcattaaggagagcaacaatgaggattctacacaagatcctgatgagggcatatgtaatgtttcctcacaggagtctcgttgttag

SEQ ID NO: 59602 - DNA, 351 bp, Glycine max
  Peptide Sequence Number=SeqID_176380
acccagcctacgtcgtcttactatcgctttgtgatgcttgtgcctgaggtggtcattccatccgagtcgctttcatcgtctgctgacgttgcaatatctcattttgattttgactcctcatccaaggatactaatgccacttccccttctctggtgtctccccgttcgattttgccaaaggcttggataccacttggggtagatatggtggatcttgtgtcggaggatgagggagagaaccaggaggaggatatgtcatatgaggaggatcagtctatggacaaggaggaccttgctccagagatcatagaggaggattcctcacaggattcgtctaaggagtcctactag

SEQ ID NO: 59603 - DNA, 270 bp, Glycine max
  Peptide Sequence Number=SeqID_176381
atgtggtgttatgagtggaaaaagagtgagactttgagggttggaaggctaagtctgaattctgtgcttgtgctgtttgaatgttgttttgcttggatgttgtggaagcttgggaggattgatggggacccggtattgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 59604 - DNA, 210 bp, Glycine max
  Peptide Sequence Number=SeqID_176382
atgggaacagcatgtggttatggaggaggcatggttgatgccctaaatgctaatttctatggaaatggcactcaaactttggtgctggtttttgatttggctttcgccccaaatgtaaggccttcttctctttatgacccaaagaagtattcaacttttgatggatatgctgaggacgcttggtctgccttcttgatgagctcaatttga

SEQ ID NO: 59605 - DNA, 324 bp, Glycine max
  Peptide Sequence Number=SeqID_176383
atggtggcccaggtgatgttggggaatggttacgagcccagaatgggtttaggcaaggacaacggcgacaaaactatcctgctaagcgctagaggaaaccgtgggaattttgggaagaaagagcgggaagtcaaggctcgcgattgggacgagaagtcgagctttctaagcgcgggtcaaggacacgaaggccaagtcgttgcgatatgcgaagatgattctccgagtgggtcggatttggtacgaccatgccctcctggtttccgactaggaaattggcgagtggaggagcgcccggacatttacgagacaagcataatgtaa

SEQ ID NO: 59606 - DNA, 333 bp, Glycine max
  Peptide Sequence Number=SeqID_176384
atgaatatgccgcgcgcgctcgaaaaccttgccctccctcttctctttgtcatcctcctgcctgaaatcgctcttctctttctcctacccacattgtcctcgctcaaacccacagaaccccctacactgttcttggaagtctggctcgaagaaaacccaacatacactgttgctactagggtgctgaaacagtcgtgggtgctcaaagctcaaagctttctccgcgagtattgccgattgaggtacgaggaaagcttaaagtttcgtgccattttgttagatctcactaccattgtcactgtttgggttcgagattgcttggagcaccagtag

SEQ ID NO: 59607 - DNA, 516 bp, Glycine max
  Peptide Sequence Number=SeqID_176385
atgtgggatgctactgtgtttggggtgtttaatgacaacttccccttatacataaagcatgaagatgtgtctgaaatagcacacggtggtcaatgtctcaacatctctattttacagttatgggttctgcatatgactgagacaaaaagttacactaagaactggatgcagaattctaaacgggatgtgtacctaggagcctatttgaatgggccagacaactacctcaaaggaataattaacagatcagtgttgttttttaatacatttgcattagcattagtcgggaacatcaatattttaattgtacaatacacatccatgttagtattcagcagtgctttaaaaggacttgatgatactccacaaagtaaatccaaggccgttgttaggtggattgttgttaaatgtaatagacaaaaaggaagcattgagtgtgggtattacgtcatgcactggatgtcaactataatcttagacagtttcaagaataattgggaaacggtaattgtttaa

SEQ ID NO: 59608 - DNA, 309 bp, Glycine max
  Peptide Sequence Number=SeqID_176386
atgctggtgcagatgatggatcctgagaaagaggcaggattaggaagaactagagttgctggagctggagggaaaggagaggtagaaggagttgatgtagaaggagctaaggtaaggggagttgaagtagatggtgcctcagatcctctagccctagatttgcgggttccccaaaaagtgactgaagggtcatccagggattcaaaggtcagagaatcagatgtgactcctcgggccttgcataaagcaataataagggctggaatatctagcctcgaggagtcatgctgtgcgatcagagaaatctga

SEQ ID NO: 59609 - DNA, 171 bp, Glycine max
  Peptide Sequence Number=SeqID_176387
atggccggtgtcggtcgttatatggccccgactgatatctttcagccgacattgcgcaatttcttttacaaacgctggccgataatgacggctaggtttttccgtgcgagctcaaccgagggttcgttccgaccgacactggcatgttgttcttctcatttaggtggataa

SEQ ID NO: 59610 - DNA, 184 bp, Glycine max
  Peptide Sequence Number=SeqID_176388
gctcttccttctgttgtcacaagtcttgttgactcagccaggagtggatgatgattcgacgttctctagagtcagtatccgtagcggggacagctcttgtttttcctgggctattgaatcaactgagaacggaataacagctgttagagtgagcgctgctagtcttagcaagtctgggacttaa

SEQ ID NO: 59611 - DNA, 411 bp, Glycine max
  Peptide Sequence Number=SeqID_176389
atggatctaagcttcgatacagtggttataggctttaatgcagtggatctaagagctttggattcgcaccagttcccgttcgagttggtgttcgagttcgagttcatgttggagttcgagttcgagttcgcagcagttcccattcgagttcgtgttcatcactgtcacgacttagtgaccttggacctcagctgcactgtgcctttgtgggtttgtgtttatagtgaccctggagctcacctatcaatgaagtttccatcaaaggaattgctcgagaagtgtgggtggaacgatgttgtggaggttaaagaggcaaagggagagggagacgtgtttgatttgttgaatccaaattgtgacaatgttgtttccttgctcgatcgagttgcttcctttatggaccatagttaa

SEQ ID NO: 59612 - DNA, 291 bp, Glycine max
  Peptide Sequence Number=SeqID_176390
atgggttttttggaggtgccaagttggcatttgacactaatgttgccttgtctgcctttcaccctagctttcttgtttgcaaaggaggcctcactctatctagcttcacctctccatgtggagcttgtaggccttagatcttcttcatcaatgaaagtcatttacttcttgaagatgaatggtagcggaatggagaaggaagaaagatggttggagaggagacgccacttcaaggagaagatgagtcaagaagaagctcaccaccataggaagtcatggataagaccttga

SEQ ID NO: 59613 - DNA, 330 bp, Glycine max
  Peptide Sequence Number=SeqID_176391
atggggaaacctaggcgaggtcgtcgctctccctccggtttcttttctggctcctcctctcgctcctcttcccctccgactctcgttcctcctctcgcccacgctccctttttcggtcctgttctccctcgcactccaaatcctcttccccatcattctcctcttcctcccgaagctcctgcagccgcagccctcccccgcagaggcaccaaaggtaccgctaatttcctcaatcggagcgccgaagatgctatgcttgaagtttttgagtgcggtgtgattgggagacatgtggaaattgaatcttatcatgcctgcaacattgattga

SEQ ID NO: 59614 - DNA, 318 bp, Glycine max
  Peptide Sequence Number=SeqID_176392
atgtcgttcctcgagttcgagttcggctcaatcgagtcagagctctcaactaaggtttcgttttcggtctcagtctcatgctctttggagagagcggtggcgagaggttgccggagcttatcgagctcatcgctgagggcaaggatagagggtttggagcgtagaacctcttcatgctccttgttcacgttatgtgaggcttttgggctccctcatctcctgcagcgccacgatgaagcagctgaggcgacaacgaatgtgagaatgagagagagagcggcatgtacactgcccgataaagagagaaagagaaagtga

SEQ ID NO: 59615 - DNA, 225 bp, Glycine max
  Peptide Sequence Number=SeqID_176393
atggcaagaaatgtggtgcctaagaaggatgtggttgaaaccattcaaaggtttaatatacaagtcaataatttgactcaatttcaattcaaggttctaccttttcttcaggttttgttaaggtctcagcatcagggacataggattgatatttggtcagctggagtcactctactctacatggtgagcgggaagactcctttcactggcgacccaaaacagtaa

SEQ ID NO: 59616 - DNA, 813 bp, Glycine max
  Peptide Sequence Number=SeqID_176394
atgatgcttaccaaaacgcatgagcgtggctgctgcttgacctatgactacgtcaccaacgacgacaccgatctgctcggcgagaaggacttggactcgatctctagactaagagggttgctcgtttcgcggcccgcggattcgagcttttcacacaagaacgcgctgcaccgctgcgtggaacatgccaagctgtggcttgctaagtcggagcagcccattgggcctaatgctgatgttacttatgctgcattaagggagaagttgaacaatattatgtcttcggagtactttactaccacacctgagatgaaggctccggttgaagttgatgtggcggctgctgggggcaattacgtttccttccatgtgccggtgcatgggtttgtggttccggttgaagtggagcagcctgtttttcaatctcaggagaaggtgatttctgtttatggttgcacagaatgttgttgggaagaaagcttgcttgatgatgctattgcagacttcattatcaatcttctctttgcgggaaatgaaacaaccaccaaaacaatgctctttgcagtctatttccttactcaatgtcctagagccatgaagcaactgctggatgaacatgattgctttgtggttccatttctttcagcagtccatttagatgagaatgtatacagtggagctctaaatattaatccttggagatggatggaacctgaaaacgaggaaaagagaaattggagaactagtccattctatgcaccctttggaggaggggctagattctatccaggagcagagttggcttgcctataa

SEQ ID NO: 59617 - DNA, 567 bp, Glycine max
  Peptide Sequence Number=SeqID_176395
atggtggatgtcatggtaatgaaggagatcaaggacacggcgctgcatcttggcgtcgatctctccactctcgatctcgacgccattcgcctcccacctggcgaaaaatgcggcatcgtcagtttgagaagctcgaagaagtggtctctggatggcctctggatgccggttgatcctgaaactgagaaaaccctaggttactacttcattgagtacaatacccctcaggaagctgagcttgctaaagagaagactcatggcatgtttgatgactttgacagattcatgaaggtgcctaatgagtgggctcctcctgaaactaagccatatgctccaggggtaagattttggtctagaaccttgtaccttattgatatttctgatgctctttggtgttggtatctcttacaagaaaatcttcaacactggctcactgatgcaaaggccagggaccagtttgtgattcatgctggttcagatactaagttttggacagagagttttgtgcaatggtctcctttggggacatacttggccactgttcatacacagggggcagcagtctag

SEQ ID NO: 59618 - DNA, 234 bp, Glycine max
  Peptide Sequence Number=SeqID_176396
atgagttttgtgagtgattatgaggttctagaggtggaggagacacctactacttgtatttcttcaatccttcatctttccattctctttgtcgtaaaggaagcttcccagatatggagagctaaatcctttattggttcttcctttacgtcatttcagtgtgcttttgccttgatgacgttgatgcacgcgttgttaggatcattcaacagtggaaactggtctgattcttaa

SEQ ID NO: 59619 - DNA, 876 bp, Glycine max
  Peptide Sequence Number=SeqID_176397
atggccggcggctggcgcccaaccgtacgcccgccgcgcctcggcggtaatgcccgcatgggcgtatttgccacccgctcgacctttcgccccaatcctatcggcatgtcgctggttgagctcaaaggcattcgctgcgagcagcaacaggtgattctgcaattaggcagcctcgatttggtggacggcacccctgtggtggatatcaagccttacctgcccttcgccgaagcgctgcctgaggcgcgcgcgggtttcgcccagagcgcgcccgacgccagcatgccggtgcgtttctccgcgcaggcgcagcagcagttgcaacagcagcaacgccattacccgcagctggcacgttttatcactgaagtgctggcgcaggatccgcgtccggcttatcgcaaaggtgaaagccctggccgtgaatatgccgcctggctgctcgactttaatgtgcgctggcgcattgacgcggcgggaaccgaggagacgccttccgatgctgaagtgatcagccaccagctgatgctgcgcgccggtatgatccgcaaactggcttccggtctctatacctggctgccgaccggtattcgcgtgctgcgaaaagttgaaaacatcgtgcgcgaagagatgaacaacgccggtgcgattgagatctccatgccggtggttcagccagccgatctgtgggaagagagcggtcgctgggagcagtacggcccggagctgctgcgcattaaagaccgccacgaacgtccgtttgtgctgggtccgacccatgaagaagtggtcaccgacctgatccgcaacgagctgagctcctataagcagctgccgctcaacgtctatcagatccagaccaaattccgtgatgaa

SEQ ID NO: 59620 - DNA, 246 bp, Glycine max
  Peptide Sequence Number=SeqID_176398
atggaacacaacatcatcgtcaacaacaacgtgatcgcaccgtttgtcataaaaacctacaatatggtgaacgatcccaccaccgataaactcatcacgtggggcccagccaacaacagcttcatcgtcctcgatcccctcgacttctcccactccctcctccctactttcttcaagcacaacaacttctccagcttcgttcgccaactcaacacctatgttttattccaatatgccaacttctaa

SEQ ID NO: 59621 - DNA, 1711 bp, Glycine max
  Peptide Sequence Number=SeqID_176399
atgcacgctgagcgtaagcgtcgtccggcggcgctgcgcgacatcctcgcgctgccgtgcgatctgacccacgtggacagcgaagccgaatttggccgcaagctgggccgctactcgctggttaacaacggcttcgccattcgcggcctgcgctgtgaagcggtgaacggcagcctcaaccagtttgagctgcgtctgattgatgccattgccggcctgaagccggagagcgagcgtctggccgcgctgtcacgcgcgctgaaaacccgctttaacgatgagatcgaaagcagcagcatcactgaaggcgtgttgcacattaccgcttacggtcaggcagcagactatctggcaaaaatctttaccgcgctgccttcgctgccgctggaagagatccagccggcgcacgaaatcacccgtaccttcgcctcaggcgccatgagccacggcgcgctggtcgcgccggcgcacgaagcggtggcgcacggtaccaatatggtgggcggaatgagtaactgtggtgaaggtggcgaacactattcacgccacggcaccattcgcgcatcgcgcatcaaacagctggcgtccggtcgcttcggcgtatgggcggcttatctggccgacccgatgctggaagagctggagatcaaaatcggtcagggcgctaaaccgggcgaaggcggtcagctgcctgcaccgaaagtgacggtggagattgcggccgcacgtggcggtacgccgggcgttgagctggtatcaccgccgccgcatcacgatacttattctatcgaggatttggcgcagctgatccacgactgtaaagcggcacgcgtgcgcgttatcgtcaaactggtgtcgtctgaaggcatcggcactatcgcagtcggcgtggcaaaagccggcgcagacgtcatcaacgtcgccggtaacaccggcggcaccggcgcggcgtcggtcaccagtctgaaatacaccgggcgcgtggcggaaatcggtatcgccgaagtacaccaggcgctgtgcgcgaacgggctgcgtgacaaagtgcagctgcgctgctccggcgcacagcagaccggcagcgacgtgatcaaatcggccctgctcggcggcgacagcttcgagtttggcaccaccgcgctgatgatgctgaaatgcgtgatggcgaaaaactgtaacgtcaaatgcccggctggcctcaccactaacgctgaagccttcgatggcgatccgcgtcagctggcgcagtacttcatcaacgtggcgcaggaagtgcgtgagttcctcgcacgcctcggtctgcgttcgctgcgtgaagcacgcggccgctctgacctgctgcacctgatggatcatccgctggaagtgggcaaactcgatctgcgcgccatgctgaccgtggtgccggagcagaagatcgctcagccagtgtatctggaaaaagatttcgagctggacgatggctgggtagaagagctgaaagcgcagctggttgatgccgcccgccgcgagattacgctgggtaacggcgtgacgctgaacaaccgtaacaagagcgttggcggtcagctggcgatcgatattgagcgcatgctgaaccacgagctgtcggcgcagcagctggccgcactgccagcggtactgcaggatgaccgtggccggaaatatctggcaccgcgcacagtgcagattgatacccgcgggtcagccg

SEQ ID NO: 59622 - DNA, 270 bp, Glycine max
  Peptide Sequence Number=SeqID_176400
atgattatgaggggtcaagacatttatagtagccaagatgaggctactacttcaccttcctctagtgaaagtgaagaagcaaaaaacgaagaatctagtgaagaaatctacccccaagaagaaggacaaccattagtggttaaagagaagtgtaaggaggtaaagtgtctcctccaggagaaattcgaatctaggcccttccagaacattttggaagttgggttgcttaaggaggaagcaactgggtggcaagctcctccacgttgttga

SEQ ID NO: 59623 - DNA, 273 bp, Glycine max
  Peptide Sequence Number=SeqID_176401
gggtggtgtttggtcttggatatgcagcgggtggattttgtggctgatttaggggtggcctttgtggttgattgggtgttcttggttggtagggtgacgggggctagtggaaagtttggccacacgggaagtgcagccataaatgaggttctccctccttcttcctctcgccactcctcccgggaccccattaccaggattcgcagaagcaacataattaaatttccttttgttagacaagtggcctcagatatcttaagtagggggggttga

SEQ ID NO: 59624 - DNA, 855 bp, Glycine max
  Peptide Sequence Number=SeqID_176402
atggctgttgccctttgggacaaacatgggagagggctacacgccctcgccatcagtggactgcacgccctcgccttcagaggactacacgtcctcacattcagaggactacacatcctcacctttagaggactacacgtcctcgccttcaaagtgctacatgccctcacctttagggggctacaggccctcaccttcagagtactacacgtcctcaccatcagagggctggacgccctcgccatcagaggactacacgtccttaccttcagagggctacgcgccctcaccttcagaggactacatgtcctcgccttcagaggactgcatgtcctcttcttcagaggactacatgtcctcaccttgagagggatgcacgccctcgccttcagaggactaaacgtcctcaccttcagaggactacacaggacaacatgtcctcaccttcaaagtgctacatgccctcaccttcagagggctaacaccctcaccttcaggggagtacacatcctcgccatcagagggcttcacgccctcgccatcagaggactacgcgccctcaccttagaggacaacatgttcttgccttcagagggctacactccctcagcttcagaggactacatgtcctcgccttcaaagggctacatgcccccaccttcagaggggtacacgccctcaccttcaaaggattacacgtcctcgccatcagagggctgcacgccctcgccatcagaggactacacgtcctcaccttcagagggctacgcgccctcaccttcaaaggactacatgtcctcgccttcagaggactgcacgtcctcttcttcagaggactacatgtcctcgccttga

SEQ ID NO: 59625 - DNA, 1366 bp, Glycine max
  Peptide Sequence Number=SeqID_176403
ggctacacgtcctcaacttcagaggactacacctcctcacctcagagggctacatgccctcacaatcagacgactacacctcctcaccttcagaggtctacacgtcctccacttcagaggactacacgtcctcgccttcagcggtctacacgtcctccacttcagaggactacacgtcctcgccttcagagggctacatgccctcaccttcagagggttacacgccctcaccttcaaaggactacgcgtctttgccatcagaggactgcacaccctggccatcagaggactacatgtcctcgccatcaaaggcctacacgtcttcgccttcagaggactacacatcatccccttcagaggactacacgtcctcaccctagagggctgcacactctctccttcagaggactacacgtcctcaccttcagaggactacacctcctcacctcagagggctacatgccttcaccttcagaggactacacatcctcagcttcagaggactacatgtcctcccctttagaatactacacatcctcgccttcagaggaggactgcacgccctggccatcagaggactacacatccaccccgtcagaggagtacaattcctcacctagagaggactacatgtcctcaccttcagggactacatctcctcacctcagagggctgcccgatctcgtcttcagaggactacacgtcctcactttcggaggactacacgtcctcgcctttagagggctgcacaccttcgccttcagaagactacacgtcctcaccatcagaggactacacgtcctcaccttcaaagtgctacatgccatgactatcagagggttacacgccctcaccttcaggggactacatgtcctcgccatcaggggactacacgtcttccccattagagggcttcacaccctcgccattagaggactacacgtcctcgccatcctagggctgcacaccctcaccttcagaggactacaaatcatcgccatcagtggactccacgtcctctccatcagagggctgcacgccttcaccttcagaggacaacacgtcctcgccttcagagggctacacgttctcccattcagagaactacacgtcctcgccttcagagagctacacgtcctcaccttcagaggactacacgtcctaaccttcagagggctgaacgtcctcaccttgagagagctgcactccctcatcttcttagagctagatgccatcatctttagggagctacataccctcgctttcagaggactacatgtcctaaactttagagggctacacggtctcaccttcagaggactacacatccccactttcagaggactacacgtccccactttcagag

SEQ ID NO: 59626 - DNA, 213 bp, Glycine max
  Peptide Sequence Number=SeqID_176404
atggcacaaggtctgactaaggatcgtctaggattaaaccttgatggaaattcggaaatgactaaggaaaggatggaaaataaggtggctaatttcgtgggtcttaataaggtggttcttggcattaaatggatgaatgggatgttatggccacgagataattctgggcagaggtggattttctggaattgtggtttgaaagaacaagggtga

SEQ ID NO: 59627 - DNA, 903 bp, Glycine max
  Peptide Sequence Number=SeqID_176405
gcgtcggcgccgaacaccacgctgtggccgccgttgatcggcaggcggtagcgcaggctggccaggttctcttccagcttctggttgcgcagcgtgtcgccgaggccgtcgtacgacaggccgttgagcttcttctcgcgggtcgacgcatcggcgtacagcgtgccgacgccgagttgctgctcgacctgcaggccgaaggtggtggtggtggtcttgacgttgtcgatcttgttcttggcgccgcgcgggtcgctttcgaactggttttcgcccgtggtcgggttgatcaggcgcgggcccggcaggtccagcttctgcgtggtggtgttgccatacaggcggatcgagccgttgtcgtggcggaaggtgatgccgccgccgccgccctcgcggcgttcgccgctgtgctcgcggtagccgtcgctgtgcagcgactgcatgtaggcgtccacgcccaccttctggttgttcagggccacggcggcgtcgtactggcgcaggccgtagctgccgaaggtggcggtggcgcgggccgtgaccggctccttggcgaactccttgcgcgtgatgatgttgatcacgccgccggtggtgccgccgccgtattgcaccgagccgctgccgcgcacgatttcgatgcgctcgacctggtccagcggcaccacgcccaggctgggggcggacaggtcgttggtgttctgcttgacgccgtcgatcatgatcagcgtgttgctggcgccggtgatgccgaagccgcgcaggtcgacgatggcgttgtcgctggcgctggtggtgttgaccaggtggacgccggcctgcgtcgacagcaggtcctgcatggtgcgggcgctgctggcggcgatgtcctcggcggtgatgacggagatcgacaccggcaag

SEQ ID NO: 59628 - DNA, 303 bp, Glycine max
  Peptide Sequence Number=SeqID_176406
atggagttggatgagttcaaggctgaattagagaggcataacttccataagcgcttcaccaatttagctgacaacagcatcgacctagccttgttgaaagagttttatgccaacctctatagccccgaggggccttcaccaaaacaagtcagaatccgaggccacttgataagaattgatgcagacaacctcaacaccttcctggagacacctgtggtactggctgagggagaatccttgcccgcttactccagatattgcaggatgcccactgatttcagagagattgaggctgctttgtga

SEQ ID NO: 59629 - DNA, 657 bp, Glycine max
  Peptide Sequence Number=SeqID_176407
atggctcggcactacagggggttgcgcggcgtggatctagagccagcggccgtcgaccaccacgcggcgctccagcggcaccgcagccacggccgccgggccgtggtcggcgcgcaccgccacgaacgtagccggcaggccttcggcaataccgtagcgcggcaggccgatcacctgcgcggcatgggtggtgaccatgtccagcgccagcatcaggtcggcataggtgtagaagccggaacggtagcccagcagcatcgcccgctgcagcaggtcgccattgccatacggccaccagcagtcacggatgttgtcgttgcctgcgaacacgcgcacaccggcatcatgcagggcgcgcagcggcgggaacggatgatcccccggcgcgttgctcatgatcgccacacccgcagtggccaatgcttcgcccacctgcagcgcgcgcgccagcggcacctcgcccagcgaataggcatggctgaccgcaacgcgcccctgcaggccggcggcccgggtacgcgcagcgatgcgcagcagctgcgccagaccggtttcgccgggctcgtgcagatggatgtccagctgcacaccgtagcgctcggccagagcgaacaacagcgccagctggccttcggcatcaccatcgagcgtggtggg

SEQ ID NO: 59630 - DNA, 702 bp, Glycine max
  Peptide Sequence Number=SeqID_176408
atgggcgatgtcgatgatctcgccctgctcgacgcgcttgagcagcagcgtgctggcgccgatctgcaggctgctgtcggcatagcgcagcaccgcgtcgatgccccaggcatcggtcacctgcatccaggccaggcccggcacgcgctgggccagcgtgtcaccgaacgcaacgcccagtgcttcccagccgtcgccgtcgccacgatcgatcagctcggcatcgaccacgcgctgcagtgtggtggccgccagcggccactgcaccggcaacgtcggaaagccggcggccacgcgcgcggcgatcagcgaacgctggtgctgcagatgcgtctgcagggcagcgggcaggggatcgaaacgggtggggatttcgtcggacatggcaaggcgccgtggggcacggaaacatcaggcactctacgagccgatgttgccggccgtgcggccggattgaccatgtttcgatgcgtgatgcgcgaaattcatccacgcatggcgtggatctactgtgttgtcgatcaccggcagctcacgctcgccatcgatgatgcggtgctcgcggctgaccgcgcggcgcggcagcaggctgatgccgatgccatcggccacggcgccctggatgccactgagcgacgaactggtgaaggcgatgcgccagcgcaggcccagcgcttccacggcgtggatcatctcgtcgcg

SEQ ID NO: 59631 - DNA, 225 bp, Glycine max
  Peptide Sequence Number=SeqID_176409
atgggggagatgcttgccacccagctcacctgggtgagctcagctcacccaagcgagcaagaatgttacggaaccccacgaattgtgcaacgatgcttccttttaagttccggcatgtcacggaacttcacgaattgtgcaacgatgcttccttttgagttccggcatgtcacgaaacttcacaaattgcctgacgatgggtgccaagtacctcaaaatggttaa

SEQ ID NO: 59632 - DNA, 1053 bp, Glycine max
  Peptide Sequence Number=SeqID_176410
atgccatgcttcacaccacaccattctcttctcctcctccttctctctattttcttcttctctctctccgtcaccgctgcaagaacctcttctttccattccttacgtattcaagatggaattgagggtggtggcgagggagagcactaccacgaggtgctaccgtggaaaacgaggagatccatggctgaagaagaggccacgagcaacgcctctctgatattggctcagaaaagaaccacaaggaaggaccctttggataacttcaaccgttacaccggtggttggaacatcagcaatcgccactacattgcttcagttgttttcaccgcggttcccttctttgttgttgctgcggtctggtttgtggtttttggactcagtttatccttaatctgcttgtgttactgctgttgtccaagagagccttatggttattcacgtttggcctatgctttgtccttgatcttcctcattctcttcacccttgcagcaatagtcggatgtgttcttctatacactgctcaggggaagtttcatgggagcaccacaagcacacttaaatatgtggtgagtcaggctgacttcactgctgaaaacctcaggaatgtttcacattatcttgatgcagctcagaagattggagtcgatgcggtttttttaccaggtgatgttcagaagaacattgatgaagttcagacaaagattaattcttctgctgcagaactttccagcaagactaaagaaaattcagagacaattaaagatgtcatagatgcaatgcgactggctctggttattgttgctgctgttatgctctttcttgcatttctcggattcttattttcaatatttgggctgcaaggtcttgtatacttatttatcctgttaaatgtccagtcagtaaatattgttccttcaatggctgcagtttggttattgtcgggtggattcttgttgctggcacatttatactttgtggtgtatttctctttcttcacaaatattatttttgaaggaagcaggaaatttgaagctgtaagaaataattga

SEQ ID NO: 59633 - DNA, 525 bp, Glycine max
  Peptide Sequence Number=SeqID_176411
atggcgaacaccagtactaccccttatgaaatcacttttggtcgccgaccattcaactttccggactatcttgcaggttcctcgaagagcaagatgaaactttatgctgaccaacatcgtagggatgtccaatttacacctggtgactgggttctggtcgcaactaagataggaccagtggcataccgtctggactttccggagggagttcgcatacaccctgtgtttcattgttcgaacctcaaaccttttcggggtgagcccgaatccatctccccaactcctctaccacccacttttcatgagaaccagcctctcatagcacctcttgccattctgggttctcgtcgtgcgacctctgaccctcacagcccaaggcaagttttggagcagcttcatcaggactatcaccttgaggacaaggtgatcctgcaaggaccgggggatgatacgagtacagagaatgaagaagaaggtgctgaggaagaagaagaccagagcccaactcaagaggagaaaaaaggg

SEQ ID NO: 59634 - DNA, 746 bp, Glycine max
  Peptide Sequence Number=SeqID_176412
atgaagaccaacaaggaggccatgaaagagcaaatgatcacaatgatggaagccatgatgagtatgagaaaaatgatggaggtcaacacggctacattcgttgccgtaagtatcgccattgaggtggacctgactcacccatctggcctcaaccaagtccagagcaagcattccttcccaccatatggcttgcctcccaactatacacaacccaatgttgcacacgttcccaatgagaatgtcgacaactccacacccatacccattgagagccaacaaccccaatctgatcatacacttgtctctcaacccatgtgggagatacatgaagcacctcgagaccagaatctagttgacttcgaacctcacctcggatatgccactgaggggcaagcagttggtggtgtacccctgccaaacactttggggggccctcaattttgcccacaaccacaacccttgcattttatagtgggaagagttcctcctgctatggtggaaaggggaaaatttgatcatatagaggaaaggctggcggccattgctgacatggtacagttttgcctagtgcctaacgtcgtcatcccttcgaagttcaaggtgttgaatttcggtaagtacaaggggactacttaccctaagaatcacctgaagatgtattgcaggaaaatgggggcatacgtgaaagatgaaaaattattgatgcatttcttccaggaaagtctttctggggcaaccgtcacctg

SEQ ID NO: 59635 - DNA, 375 bp, Glycine max
  Peptide Sequence Number=SeqID_176413
atgtatttcaagaccgcacaactctttgctattagagatcgacaaactcagacagtgatcaactccggctcacagtattctgaagttgtctctgatgcaatgaataacggtcaacaagaatctaatacacatattgctaaacacttatcgtgttctcacgtcattgctgcctgtaaatctgtcaatcttgatcccatgaactatgtgtcgatgttattcactttacaatacactttgcacatctatgaaaactcctttggtttactgccacacgaatcagtgtggcaagaatatgaacgagatcagtgggatcctgatccaaggagaaagaggactgcaaaggatcgttccatttcaactcgcattcctacttag

SEQ ID NO: 59636 - DNA, 288 bp, Glycine max
  Peptide Sequence Number=SeqID_176414
atggccaccctgtgggataccagcaactttgtgctgcaacaacttcacccgaatggaacaaagagtatgttgtggcaaagttttgattatcctggtgatgatttgctccctaggatgaagttaggtgtcaatttcaaaactgttcgaaattggtctatagtttcgtggatgggttctcttaaccctagtcttgggacattcaggatggaattgggaacacagaagaagagaattggtcatcaagcaacaaagacaatagtgttggacaagtggagagctaaaaaataa

SEQ ID NO: 59637 - DNA, 675 bp, Glycine max
  Peptide Sequence Number=SeqID_176415
atggggactgagcttatgagaatatgtgttaaagaagataatgatgattttccatcagttccaccaggttttgagtcatatacatctttctcattgaagaaggtagaaaacaatgaaaaacaagatgataaaaatatgaccagttgttcggcctctactagtgcttctgaatcaccatcaactcaggcggaaaatgatgttcaagttggtgatactgcaaaggttcctagatcccttcgacgaagaccatggattaattatggacaatatgagaacatttcagatgaagaccctgactgtgagcggcatgatcaaaatttctcctcaagaccttgtcttcctcgaggagtcatccgtggatgtccagattgcagtaattgccaaaaggttgttgccaggtggcgaccagaagatgctcgtaagccaaatattgaggatgctcctgttttctaccctactgaagaggtctcattcaattcctatgacacatttgaattcacttctgtccatgagtttcaagatactttgaaatatatatcaagcattcgctccaaggctgagccatatggaatttgtcgcattgttccgccatcttcttggaaacccccttgtcctctcaaggaaaaaagtatatgggagggttctaaattttctacctcgtgttcagaggattga

SEQ ID NO: 59638 - DNA, 1155 bp, Glycine max
  Peptide Sequence Number=SeqID_176416
atgtcaaagattcaaactaatatgaagaggaaaaggagaagatgcacaaggatgggggtggataatagcactagaacaggacctaatgcaggattttgtgaagttgaaaggtttgggtttgaacctggtccagaatttaccctggaaacatttcagagatatgcagaagattttcagctcaaatacttcagaaaaaatgagaatgtatctcatttgggtgctaatacaacaattttaaatggtacctcagagccttccgtagagaacattgaaggtgaatattggcggatggtcgagagtcctactgaagaaattgaggtgctttatggagctgatctggaaactgggatttttgggagtggtttccctagcaaatctagtcaagtaggttctgcttcacatgaacagtacataaaatctggctggaatttaaataactttgcaaggctacctggctctctgctctcttatgaaagcagtgatatatctggtgttctagtgccatggttgtatgtaggaatgtgcttttcctccttttgttggcatgtggaagatcatcatttatattcattgaattacttgcattggggagctccaaaaatgtggtatggtgtccctggaaaagatgcctgcaaattggaagaggccatgcgaaagcatttaccagagctttttgaagaacagcctgacttgcttcataagctggtcactcagctttctccatctatccttaagtctaaaggagtaccagtttataggtgtatccaaaaccctggggactttgttctgacatttcctagagcctaccactctgggttcaactgcggcttcaactgtgctgaggctgttaatgtagctcctgttgactggctgccccatgggcatattgctatagagctgtaccaggagcaggggcgcaagacttctatatcacatgataagctgttgcttggggctgcaagggaagcagtacaagcccaatgggagcttgatttgctgaagaagaatactttggataatctacgatggaaggatgtctgtggaaaggatggccttttggcaaaagcactcaagttattagagaatcttatgattcacaatacaaatcctatgataaaacctatcgatttctattctaagatgaatctcaaatga

SEQ ID NO: 59639 - DNA, 234 bp, Glycine max
  Peptide Sequence Number=SeqID_176417
atgacctgggcaaacgagcctgttgacatgcagagactaacgtcgtctgctgcaccttttgtcacccagagacagcaagttcgatggcatgcagagatacccaagcggttatccgtacaaacgatttgtgttaaccctgactcgggaagtcaggtggcaggcaggggtatcgtatggttatccgcacctttcgtcaaccaggggcaaaccagcccgttgacgcccagagactaa

SEQ ID NO: 59640 - DNA, 357 bp, Glycine max
  Peptide Sequence Number=SeqID_176418
atgttgcaaaaccttacggattacgcaaaaatgctcgttttcctttcggaatgttgcgaaactttatggattacgcaacgatgcttgttttcgggggttctgaaggaagcaaacaagggaactaaagacaagacactaatttcgtttgagcggaacatcacttggccgatgaatatcccaaccagcggaacctgtcatttagaaaaaaaaaatcgtcaggggcgtcagcaaaacttcagtgcctcgaaagcgataaaacgggataaccacaacgtttccacatgctgtcgaactcgattgtccctgcctagcagagaagaatctcgtgcattgtcgggcttgaatgtctccaaatga

SEQ ID NO: 59641 - DNA, 1962 bp, Glycine max
  Peptide Sequence Number=SeqID_176419
atggagcgagcaagaagggaatttctctgcagtccttcacaggcattaaaaatggagagtacttttgatgctacaaatgaaagggagtgcaacatttgcttttttgatttacacctatctgctgctggttgtcgctgttccccagatagatatgcttgcttggatcatgcaaagcagttttgttcatgctcttgggattccaaatttttcctctttcggtatgatattagtgaactaaatattcttgtggaggcattggaaggaaaattaagtgcaatatacagatgggcaaaatcagatcttgggctggcgttatcttcttttgtgtcagcaagcaaggaaacaatacataaggaattgaaatcgtattcatccaatttatctcattcttccagggccactgtgcataaagagatggctttgcatccattaaataaatatattgacaattctcaattgattgatgtccctacagagaatcaagcaaatagcaaagatcagagctattttcaacagaggaaatcggttgaatctatttcatctttgagatccatgaaggaattgctaacatttaaaagctcacaacctacatctgaggcggctaatcataagatctgtgttaataaagaagaatcggttatatgcagatcaaatatgagaacccctggttggcaattgtctcaagatgatacatcatatgctttatccgtgcctctagctcaacatggaggtgaaaaaagttcacttaacagacataataacagtattatacttcttagtgacgatgaagatgatgaaaagatgtccggttcaaatagaaggaaggaactttcttcgatgcttacatgtcctagagataagacaagtccatgtaatgatatagaaaatacaaagttgaccatttctgtgtcagattctgctgtgataggtgaaaaggatgctattacattgccccgtgaaaatatgagttctgattcaactcgacttttgcatgtgaaacaagaatgtcatgaacacactggaacagttctagcctctacccctgtagatctttcttgtcatatgggtcttacaagtacagaatctattagaaatattccagctccttcaaaagtagaggccagtgattattgtttggaaagtttggaggtttgtcctctgaacccacaactttctggcattaaggttaagactgaagataatcatgaaaaccttggaggatgtgccacttctaatgtagcagacaatgcaagagctgttaatgggaacatttcttgtgctccaaacaattaccgtcagaaaggtcctcggattgcaaaggttgtccggcgcatcaactgcaatgttgaaccattagaatttggagtagtgctttctggaaagtcttggtgcagtagtcaggctatatttccaaaggaaatagttgatgctggacgtggttggcctctatttatggtttccttggaaaattgtgcaagtgaggtcttcattcatatgtcagctgcaagatgctgggaactgatcagagagaaagtgaatcaagaaattgcaaagcaacataagctgggaagaaagggtcttcctcctttacagcctcctggcagccttgatggctttgaaatgtttgggttttcttcaccagcaatagtgcaggctattgaggcgctggatcgaactagattatgtaatgaatattgggactcacggccctactctcgtcctcagggacagatttctcaatcaagccaaaccaatgtcaatggtggaaatggtcaaggggttctcttgaataagcacatgcccgttgaagttgttgcagtgctaaggagcctatttaaaaagtctaatgcagaagaattgaacttattgtacagcattcttagtaacaataggccagaggctgacaggaacctagttgcgcaacttctcaatgaagagattcacaaatcacaaccgccctag

SEQ ID NO: 59642 - DNA, 336 bp, Glycine max
  Peptide Sequence Number=SeqID_176420
atgatttctgttaatcctgacccgataagtcaggtggcaggtggggtggcaagcgagcccgttgacacgcagagactaatgtcatcttctgcaccttttgtcatccagagacggcgggggtaccttatggttatccacacctttcgtcaaccaggggcaagcgagcccgctgacgcgcagagactagcatcgtcttctgcaccttttgtcgtccagagacgacgagttttacttttgtcgtccagagatggtgattccgatgacatgcgggggtaccttatggttatccgcaccttttgtcaaccaaggcgaacgagttcgatggtatcaggatga

SEQ ID NO: 59643 - DNA, 783 bp, Glycine max
  Peptide Sequence Number=SeqID_176421
atggctgaggaccaaggtgctgaatttgtatcatatgataccattaaaggagagtggaagatcaaggtcaaacacttcagcatctacaagctgataccctcatttatggacataatcactgacctcgccatgttcattactccgctatggattgcggttatcgtcggcgtcgtcgtgggctgggcgtggaagcccaaatgggcctttcaccccaaagacgctcttctcaagtttcgctctcctcgccctcccaatccccaaaacgacaccgcttttacctactccgccaccagttcctccgcgcgtgagaaagacgcgagtgggagtcctgtggtgacggaagacgatttgctgcatctgtggaagttggttgaggaaaaagacggagggcgggcatggattcagatgatggaccgttctaccccgaccatgacctatcaagcgtggcgtagggatcctgagagtggaccgccgcagtaccggagcagaacggtgttcgaagacgcgagtcctgagttggtgagggatttcttttgggatgatgagttcaggttgaagtgggatgacatgcttatacatgcttccaccatacaagagtgtgtcctcactggaacaatgatggtgcactgggtgcgcaagtctcatgttgatcttgtgcaattctgcctgcagtttcccttcttttgcagtgacagagagtatataattgggaggcgaatttgggacgcaggacgaatttactactgtgtcactaaggttcgaatgaaattaattgctaattaa

SEQ ID NO: 59644 - DNA, 1899 bp, Glycine max
  Peptide Sequence Number=SeqID_176422
atggcaacagtgtcttatgcggtgtcaggaagcgcgtgccagagccaccgtggcgcgtcgagaacagaggccaaagtgaattattcggctcaggtaagtctcaactgccagggattgagatccttgaacaagctgcacgtgcgaaccacccgtgcggccaaaaccaaaaccttgctgtctgcgaaaagtaacaagagtgggcgtgagggagttttggggaggattgagtgtgggatgaacttgatctttgtggggactgaggtggcaccttggagcaaaactggggggcttggtgatgttcttggaggacttccaccagctttggctggaaatggacaccgtgtcatgacagtgtcaccgcgttacgaccaatacaaggatgcatgggacactagtgtgacggtggaggtcaaaattggagatagaatagaaactgtccgtttctttcactgctataagcgaggagtggatcgtgtttttgtggaccacccatgtttccttgagaaggtatggggcaagactgggtcaaaactctatggccctagtgctggagtagattatgaagacaaccaacttagattcagcttgttatgccagtatttgataactgaaaattacaacacatttatattgattgactctggaaatgacattatcaatatgttgagcaactttcaggcagcacttgaggcaccaagggttttgaacttaaacagcagcaaatatttctcaggaccatatggcgaagatgtaatttttattgccaatgattggcacactgcccttcttccatgctacttgaaatcaatgtaccagaccaaggggatttacaaaaacgcaaaggttgcatattgtattcataacatagcctaccagggtaggcattcctttgcagacttctctcttctcaatttacctaacaaattcaagagctcttttgactttactgatgggcatgttaagcctgtcaagggaaggaaacttaactggatgaaggctgcaatattagaatcagaccgagtactcactgtaagtccatactatgcccaggaacttgttaccggagaggaaagaggtgtagaactggacaacgtaattcgttcacgtggcatcactggtatcgtgaatggcatggataatagggagtggagtccaaaaactgataagttcattgatctacactatgatgcaacaactgtcaccgaagcaaaatcactgctgaaagaggcacttcaagcagaggttggcttgcctgttgacaggaatatccctctgataggtttcattggtaggcttgaagagcagaaaggttcagatattcttgtggaagctattccaaagttcattgaccagaatgttcagattatgattcttggaacaggtaaaaagataatggagaagcaaattgagcaactagagaaaatctatcctgacaaggccagaggagtagcaaaatttaacggtcccttggctcacaagattattgctggagctgactttatagtgatcccaagtagatttgaaccctgtggtcttgttcagttgcatgccatgccatatggaacggtgcccattgtttcctccactggtggacttgttgacaccgttcaagaagggtatactggattccacatgggagcattcaacgttgaatgtgaagctgttgatccagttgatgtggaaaagttagcaactactgtaaagagagcccttggaacctatggtaccccagccatgacacagatgatccagaactgcatgtcccaagacttttcatggaagggaccagccaaacattgggaaaaggtgctgttgagcctagaggttgctggcagtgaacctggaattgatggtgatgagattgctcctcttgcaaaggaaaacgttgccactccttga

SEQ ID NO: 59645 - DNA, 1110 bp, Glycine max
  Peptide Sequence Number=SeqID_176423
atgaaggctggagacaggaagctctttgggaccccgttggttacttatttggtagaagatcctcaatttggagccaacattgaggcatctgtacataaaatgttggaacctttaagaaaagcatattcctcaagtaagtctcatgatgggaaggaaaatggtttcatctcagctggcagtgatgagcaatcaaacatctccaatactcaaagtgaatctcagagtttaacaactggcaacaaagaacaagagggaacatcctgtggggagtcatctttccaacttgttttaactaacgaatgctgtttgagttgtgaacccattgagaaggcttcttttataaaacccaaccaagttgtaagagtctttcttgactggactgacaaagaacatgaattatatgatgctagctacctgagggatctcccggaagttcacaaaactggattcactgtgaaaaaaacccggcaagaagctatttctttgttttcttgcttggaggcattcttgactgaagaacctcttggaccagatgacatgtggtactgccctagatgcaaggaacacagacaagctacaaagaagcttgacttgtggaaattgccggagattcttgtttttcacttgaaacggttctcatacagtagatacctgaaaaacaaacttgacacttttgtgaattttcccattcacaatctggatttaactaaatatgtgaaaagcaaggatggaccgtcttatgtgtatgacctttatgcaatcagcaaccattatggtggtctaggtggtgggcattacactgcgtattgtaagttgatcgatgaaaataaatggttccatttcgacgatagtcatgtctcttctgttactgaagctgaaattaaatcttcagctgcatatgtgttattttatcagagaaatagaattaaaggccagatggaaggggagacatctcagcagttagcacaaagcggagcttttgtcctggatagttattttacttcgcagtgcaagactgccagggcgacgcttgtgtttgtgaaaggaatcgtgccctcctgttattatgttgttaggattccagtacccagtatcatgtggaaaagatga

SEQ ID NO: 59646 - DNA, 303 bp, Glycine max
  Peptide Sequence Number=SeqID_176424
atgggagcaacgaaggtgaagctctacgacgcagatgtgaaattaatggtaggcctgggaaacgagtacttttctagaatgaaagatccaaagcaagcccaggcatggatcaaatccaacctccaagcctacccctccagtaacctccactacgataacatgctttttgcgcagatcgatgctgtgtattccgcgttggactcgttggctttccaaggggcatctggacgaagccgcacgaagcagaatccaaaggaagacaccggggcatggcaatggggagaagagcaaaggcagaattag

SEQ ID NO: 59647 - DNA, 1701 bp, Glycine max
  Peptide Sequence Number=SeqID_176425
atggctgctattttgagccctaaatcctcattaatgatcaaggcgtctggagattggccagagattgtaacagatgcgggatgccgaagattggctagaaaagaggtgtgcagaagtcagaacagagctacggctcggaggtattcagatgcgtctaacccagtcgctcccatgacgcctgcaaaatggcatgatcttggccgtgaattgcgctgctctagttgtgatggccaggggtggttttcaaggtggcagagttatgttgggccttgtgttggtatgctttcagtcgacaagcaatcttctgatggccataatgccaacatgactcacccaaagattgcagatagacctgggcctattgataattctgacattatttctaagggaaatagctgtgacaacaataatttagatattcatcgaatgttggaagagggtacagactatgttttagttcctgaaaaagtgtgggaaaggctgttggaatggtacaaaggtggacctgctttaccaaggaagttaatttctcagggtcatgaacataagcaatacaatgttgaggtttacccacttagtctaaaggcgaccattggtgaacttcatgagctggtgtgcaaaattaaaggagtagaacaaaacaaggcctgtatttgggattacttcaatttgaacaaacaatcattgctgacagtctcagacccgaagacattagaggatgcaaacttgataatggaccaagatattcttctagaagtatcacttgatagagatggctcttctcattctggcatggattcaatgggaaatgaattagctttggtgccattagaaccttcaaggtcatctatgtccattgctgggggacctaccatgtcaaatggtcactcgactgggtctagttttagtttgtatcagggaagttctgtaagttcatcgttgaccaatatggatgatagatatgatgtctataaaggtgaaaggggtggtttggcagggctgcagaacttggggaatacctgcttcatgaacagttctattcaatgtttagtccacactccaccactttctgaatatttcttacaagattacagtgatgaaatcaacatggacaatcctttaggaatgtgtggtgagttagcacttgcatttggtgacttgttgaggaaattgtggtcttcagggcgaactgctattgcaccccgtgcattcaagagcaaattggcccgatttgctccacaattcagtggttataaccagcatgattctcaggaattgcttgcctttttattggatggattgcatgaagatttgaatcgtgtgaaacaaaagccttacattgaaatgaaggactcggatggtaggccagatgaggaagttgcatctgagtgttggaaaaatcatatggctcggaatgattcattgattgttgatgtatgccagggtcaatacaagtcaacattggtttgtccagtatgtggcaaaatttcaattactttcgatccattcatgtacttatcattaccactgccttccactgtcactcgcacaatgacaataactgtcttttattgtgatgggagtggtcttcccatgccatacaccgtgacagttctgaagcatggtagctgtagagatctttgccaagcattaggcattgcatgctgcttgaagagtgatgaaatgcttttgcttgcagag

SEQ ID NO: 59648 - DNA, 462 bp, Glycine max
  Peptide Sequence Number=SeqID_176426
atgctgggacaaaagacctggtatccttaccgtgagcagcagattagcgccctgacagccttggccaaagagatcatccggcgctatggcatcacgccggataacgtgctcggccacagtgacatcgcaccactacgtaaacaggatccaggcagacttttcccgtggaaggcgcttgcggctcagggtgtgggagcctggcctgagccacaacgtgtgcaaaagtatctggccggacgtgcaatgaatgcccctgcggatgtcctgagcgtccagacgttgcttaagcgatacggttacgatcagatcccgctcagcggcttcctggatgaagacacccgaaaaaccatcagcgcatttcagatgcatttcaggccggaaaacactgacggcacacccgatgcagaaaccgaggcgattgcacaggcgctcaatgagcagtaccgtgctacttctgtctga

SEQ ID NO: 59649 - DNA, 579 bp, Glycine max
  Peptide Sequence Number=SeqID_176427
atgtgtcaggaacttcaaattggagtggcatgtttcgtagcttgtttaatcaatgatataatgagcaaaggcaggcgtatgacatatgaggaactctgtaatgctgtgctaccgcactggcataacttgaggaaacataatggagagcgttatgcttactcaagtcactctcaggctgttcttgattgtttgaggaaccggcatgaatgggcaaggttggttgatcgtggtccaaagacaaattctaataggaaaaggcgtaagctggatgctgaagagtctgatgataatggatatggcaagggaagaactgcaaaagatgttgaagggaagaactttgagttgcaaaaagaagagttccctaaaggcaagcgtaaagctcgaaaacgcaggcgccttgctcttcagggaagagcagtgaaggatgtcagaaggagacagaaagctgactcgctaacggatgaggatctcggtccattctccaattctagtgaagagagcatgttcagtgaagatgaaattcaggctggcagaatacgtccagcaggaagttcatcagatgaggcaggtagtgcctaa

SEQ ID NO: 59650 - DNA, 3249 bp, Glycine max
  Peptide Sequence Number=SeqID_176428
atggatgagagcagcgtggattcgaatgatggacccgtaactttcgggtcggactcaacgggatccgattcatacgagtccgatccaagtcgaaatgtgatatacaacaatacccaaccccgaatatccccttcatttccagcttcaccatctccctctgtgttccctgctgctaccgagagcggagattcttctcccccttctgtcaccttccccactccgaaccaattacaaaaccctcaccgtctgaagtccttgctcatttccgtgccctcagttacagcgagaatgaaaggggggcgatcgcaccgccctcggagctcggacccgccggacgagtgggtggacgggtcctggacggtggactgcatctgcggcgtcaccttcgacgacggcgaggagatggtgaaatgcgacgagtgcggcgtgtgggtccacacgcgctgctcgcgctacgtgaagggcgacgacaccttctcctgcgacaagtgcaaggccaggcacaacaaaaacaacaccaccaccaacaacagcaacaacaacagcaacagcactaccaaccccatggagaccgaggtcgcgcagttcctcgtcgaactccccacaaaaaccatctccatggacaataaaaaagccctcccctccaggcccaggctctggaccgacaagcccatcgaggagcgggtccacgtccagggcccaccgggcggcgacccctccatcttcgccggccaaagcgcctcctcgattttcacgccccagctctggaaggcatgcgggtatgtccccaagaagttcaattttaagtacaacgagttccctttctggaataataacaacgataaggagggtgtgccagcaaaagatggtaataataacgataatggggttggggtgtctaaagaggctaataacactgctgctgctccccctgttgcgccttcggttgaaacgagatctggtcacgccaaggacgcggacacgggcaagtttgggagccaggatgtgccgccacgtgtccacggtgacgtcaagaaggagcggactctgctgaggcctccggttgttcataacagtaaacgcagtaaaggggatttggggaattcgagttccaaggagaggattgggaagaaacgccttaggacttctgacagggaggtagattccaggaagagaacgctgcattcctccaaatcagcgtttacgcccaccggtgatggaaaacaattggacttttatgaggacagaggatcaaagatgttcaaggctgatgctcggagcataaagaataaaaacttaaaagacatggtggttcaagagcatgtgtctgatgatcctgttgctgtggatactatcatggaggagtcaaataacaacttaaccactactgaggactcctcagaaccgttatatcctgacatgactaaacatggtgtttctgttggagatgttgtagcagaagagaaggctagtcgtaaaactcctactttggttgagatgtcttctaagactgatgatgctgttacatcagctttaaagcagaattatgttggaaatgcttcagttaaagaaaagagatgctctgtttctgtccattccatgtttaatatggctgcattgagattggttatggtctgccaggatggagattgcttggtagctgataatgcagatgatgctttagtagtaagaagcgctgctagtcctcgcacagaaggtcattgtgtttctgcaccagaacttgtggataaccaagtttctcaagatcttggccgtaacatgcgtcctagctctgcaaaatgcaaagttaagatggggagagatgataatgttgataattttcggaagccctcaaattttcattcttctcctatcagtgatcataaaaacaatgaaaaaccatctgatcacacatctgatattgttaaagtgaatgatgctccagttcccagtttaccatcatgtgaaagtaaggtgggtggtgttgacatttcatcagaactaatccctgctgatcataccaataaaccaattgaattatctggtgatttttgtcaaagaaaactagaaccggtggggtctgaaggttccttggaaacacaaaagggattttcagaaacaaaagatggtttggatgctgctaaagatccatcaaaatctgaagcacttggatgttcgcctaaagttggaaagtcatctccgacttcatcaaccatgaactccaaatcattgggtcatgactgcagatctgaagatactgaaatccctaattcttttacgaagcatggagtgatggctgatagtaacattcacacaaagaatgaaaattgtccaagtgttgctgccagggatgaaaattcaaagaagtctgtaaaagagcgaccaaaatcctctttgaattccaattcaaaaggattgcattcaagcaggagtgtgcaaaattctgtctcaaagcaagtgaactcagatgcgagagattctgttcatgttttgtcttctaaacctttgatacatcagactgcaagtattttaggctctagtgagtctaaccatcagaaggttttacaagtgcagagtaagatttcttcttcagcgccccagaaagttgaaaaacttaaccaaacaaacatccacacttcctccaagttgaaccaaagtcatgttccatcagtgaatccttctttaatatcgaattcttcaatgctgagtgatgaagagcttgctctgctattgcatcaagaactgaatagttctcctcgtgtacctcgtgtaccccgagcacgccatgctggtagcttgccccagttgacttccgctagtgctacaagcatgctgatgaagcgaacatcgggtggaggaaaggatcattattttgcatctagacgaaaacacaaggatgcatctagagatgggtctggcagttctcgtgaacttgaatacgaagctaaaaggatagagaaggagaagggtccatcctcgtctgatcagaggaaacaggatatgtcatacgcggaagatgctcctgcaagggaagaaggccttgcatctatggcagcagcaaactccatcaccaacaatactgtttcttccacctctggaattgcaaacagtgatgcatccactcctcctgaggatcagaatttgtcatctatgcgtaactcacctaggaatgtatctgatgatgatacagcaactgctggaaggccagttcatcgcaccttacctggtagctccctgtcagggaaataa

SEQ ID NO: 59651 - DNA, 219 bp, Glycine max
  Peptide Sequence Number=SeqID_176429
atggcgttcaaagacacgaacaaccaacttaataaatcagtttccgtgcttaatgctttcgtacacttgttcttgttcgtgtttttcttccgttcgttggggtcaggacgttcttgcttgaagggttcttttgccacactcacaatgcggcatggcataccctacacaacattatatgtggaaccgcagggaaaattggatcttatttggacgctgtga

SEQ ID NO: 59652 - DNA, 156 bp, Glycine max
  Peptide Sequence Number=SeqID_176430
atggatcagatggaaaacgaggagccgatgctccatctcgaggttgagtgtgcttgggggaggtggatatctgacatggtcagaggtgtggataacttcctagggtatctttgctatacactgatgattgtagacaaccttgaggagcatatttag

SEQ ID NO: 59653 - DNA, 492 bp, Glycine max
  Peptide Sequence Number=SeqID_176431
atgacctgcggagtagattccagggtgctcttctgggagctcgagaatgccccaggcgatacctatgaaaataacgggactgtctattacagaatgctggggaatacgccttgtgcggagcacggtgtcagttcagaaagacaccttgttgagttccgtaagctactgaaaatattttctgaaatgtccggtgttccgttcacaacctggagctatgacgaatttcagtcaattccacaggtcagaaaaataattcttgaactgatcgacagggaaactgatctgccccattgctgtgtccctctgagaaacgtttcaaggtccgttttttctgcccggcctgtcactttgctgaaaagcagggaggccattttgccggactcacggccgatggcggcagggtataccagtgtcagtgtcccgcccacggcagttatgagggtgtcttgtcagtcaataacggtgacctgtttgacatcaatacgcctgtaa

SEQ ID NO: 59654 - DNA, 735 bp, Glycine max
  Peptide Sequence Number=SeqID_176432
atggccgcacgcgtacgtatcggacaggtgccgctgcagcagtcgctgatgctgatggccatgaaggattcgccgcaggctgcgcagaaccgccatattgcgaaggacgccggcagggcgtcacgtcgcctcatcctgatctcccagctggccgcctggatcgacgcggccgatgcgcggctgcagcatacgcttccgctggggctgtttgccggtttcccggcgctgcagctgccggatgacgtcagggcccgcctcgcccggagcttttcccgcgagctgggagactggcgccgcggagtcagggtaatagttatctgtgaaaccgagccgccggaaacggtttttatccggagggagggccgcaacctgccgcgcagcagctgcaggataatcgattcggcgctgatgaccgtaagcccgcgctacattcccttggactcacgctatgaggaaatggttgaggaacgtctgtggcaggaaaagcgcgcctttatcaagccgctgcgctacgacggtgaagaggatgttttcccggacttcgtgctgatggatgtcgccggcatggaagccctgccgatggaggtgtttggcatgaacaccccggactatctgcagcgtaaacaggtcaaatcagccctgtacgacagagagtacggggccggccagtggtggcagtgggatgcatcagaagacccggaagggatggacatgccgggctttccaccacgctga

SEQ ID NO: 59655 - DNA, 426 bp, Glycine max
  Peptide Sequence Number=SeqID_176433
cccagttgctcggcggcacgcattaccttcgagcgggttttatctgcaacggatgcaccgggcgtgaaggttctggacaccgccgaacgggaaactcccgccagtcgcgccacgtcctctgcctttacccagtttttccctttgtcattcatccgttgtccaccctgccgattcatatgcactaattacacagggaaagcttaccgcagggctataactttttcaggagtggtgaccagaaaggaaatcatgttgattgcaggacatggttcttgcggctcagtcgtaaaggatttaacttcgtcagggatagctcagtggagcgaagactcaagttgggcaataatttttttctccgactccgactcctcttctaatggccgcagatgtcctctggtcaccggttctgccagcgtaaaggaataa

SEQ ID NO: 59656 - DNA, 2158 bp, Glycine max
  Peptide Sequence Number=SeqID_176434
atgaataccggcagcagcaactttatcggcatcgtgaccgccggattcgataatccgtttcgcagcaagctgctctctcccctggtccaccagcttgcccttcacggttttatgccgctattgatgaatgccgacgaccccgaacagctggccccttcgctgcggcaactactgagctaccacgtcgcgggcgtcatcatcacctctggtgcgccgccgctgtcgctggctgaagagtatctggcgcgtaaaattccggtcacgctgattaaccgccacgctgaactcccaggttgcgatcgcgtggccagtgataacgcgcagggtatggcgctgatggccgactactgccgccagcagggctggcggaatatcggttttgtcggcgaacacattaccaatttcagcacgcaacaacgctatgaggcgctgatggactccgcgccagatcttgttgttacttcacgttttattgctggcggtggctatgctgcaggccgggcggcggcacaggagctcagcagatgccaggtactgctttgcgccacggacatgctggcattgggggcaatagacggcctgcgggcgctgaactccggtgactttgttcctgcagtcatcgggtttgatgacattccgcaggccagctgggatccttaccatctcaccactgttcagcaggatacggacggactggcacaacaggctgtcgatcttctcatcacccggattgcacagtttgatcttcctgcacgagaagttatggctacccatgaagttgattcgcttctggcgcgttatcgttttgcctgcagtcttgcggagtccgggggaaagatggcctatgagttgtatcgtcagcgcgatagcctgctcaccgaacacaagggaaatgacctgcaggacgtagtcagccgcgccgactgcgaggtggagtcttacgtaaaatcacgcattgcagaagctttccccggagatggatttctcggtgaagagagcggtaccgtggatgcgcagcagcgcgtgctgtgggtcgtcgatccgattgatggcacaagctgctttcttaacggactgcacacatggtgcctttcactggcgattgtggcagacggagagccggtcattggtgtggtgtatgaccctaatcatcacgaactcttccacgctctgctcggccaaggcgcctggctcaatgaccggcggatcacaccgcatgccgcgctcaccgtggcaggcggcgtgatgggcgtggggacctcgcaccgcgtatcctccgcggatttcctgccgtttctggatgaactgctgcagcacggcggcatgttcgttcgtaacggctcgggagcactgatgagcgcctgggctgctgcaggtcgactgattggttactacgaaccgcatatgaacccctgggatggtctgcccggcatcgtgctgatgcgcgaggctggaggctcaacaaacgactatctggctgacgatggcatcacgcgtggcaacccggttttgctggcaatcagggatgatacacagcaatcagcaacgcctccgcctttcggagacaacatgatgtctggattactcagctatttccgcgccagcccggagaaacacgccggtgcttttaatgaacagcgctttcgcttcgtccggtggcagacgtttctggcgatgacgctggcttatgtgactttttacgtatgccggctatcatttaccgtcgccaaaagcgccctggtggacctcggtatatccccctctgagctgggcatgatcggctctgcgctgtttttcagctatgccatcggcaagctggtgaacgggtttatcgccgatcacgcaaacgtggtgcgctttatgagcctgggcctgctgctcagcgcaggcatgaacctgatgatgggcatgaccaccaatgccatactgctggccatattctggggcatcaacggctgggcgcagtcaatgggcgtggggccgtgcgcggtatcgctggcgcgctggtacggtaccaaagaacgtggcaccttctattcgatctggtcaactgcgcataacatcggtgaggccatgacctacatggtgatcgccgcagtcattgccggttacggctggcacatgggctatctctccactgccgcgctgggtgcagcag

SEQ ID NO: 59657 - DNA, 1842 bp, Glycine max
  Peptide Sequence Number=SeqID_176435
gccgcagtgacagctgatgagcctgagaatacagccagggtgcatttcctccttaacactgtgagcgaccgggatggccctgataagagcaaaggggcggtggcgacagagcagattttcgccgggcgtcaccatgtcaatgccggcttcctgcacagttccataaggtccgggtgccccgctgatttttcacccgtgagagcggtcctggctttcgattcgtatcactcctgccttttttatgcgactccgcttcaccacatccatgaattcggtgaacacttcactgccggcgttcagccccggcatgcgctgagtccactgtcttcacagattccgccttcttcagaattcacgacaatgccttactactccccggagaacagccatctcgcgcagcgttccgcacgctttgttcgtcgtatgttcatgatgcgacagttaggcaccacactatgttttttcccgattctttctgtattaatggaaatggatcgtggcctgacgtttaccatcctgctgtcagtgaacgcttttatctggccatggctggcctatcgccgcgcgctgcgcgccaatgatgccaccactacggaaaagcagaacctgatccttgacgctgcgtttggtggcatctgggtagccctgatggcgctgagccctttcccctcgtttatcataatggcggtgctggcgtccgatcgatacgccgccggcggttcagcgcaactcatcgcctctgtgcgggcatttgtttgtgcttctggtgtggtgtggctgatgaatggtctggagctgaatatgaccttcagtatgcgcactgtctggctgagcattccgctgtcgacatgctacttactggcgctaagcgtaacctcgtacaatcttaccttgcgcctgcgtcagcgtaaccgcgagctggagcgtatcgcgttgatggatcccgggctggaaattcccaacaggcgcatgttcgaacgctgccttgagaaagcctttctcagttcgcgccgcggcgatagctccggatacctgatgctgctggatattgataatttcaaggcagttaacgataactggggccatgaagcaggagacttcctgttagctgagatctccgccgttctgcggcagcacgcgggcatgcaggacacgccggcacgctttggcggagatgaactgggcgtcattttgcatcatgccagcaacgaatgtgcagtggcgatggccagaagcttacaggacaaaatcctgcagatacgtttacccgcttcggatgattttcgttgtacggtaagcattggcatcgcttcagctactgaggctgaaaccataaaccagtggtttcacaatgcggatgaggctctttatgaagtaaaacggtccgggcgcaatggcggtaagagcccttttaatcccatatccgcaatatgctgcgcagctgacttaaccgccccgtgctgcacctcagccctccctcccgtgatatcaggcaggacagccgcagttttccttgacggatcatcagcaacgactactatggagaaatactctaacaagaccagcgttttagagccgttcgtcttcaatgtcagcgatcagcctgcgcccgctacagacggcctgacgtattgtgctgcagcgtcaatcaatgccatcggtaagaaaattaaatgcagatttgatcgcccctttgcaataactggcgttgcagaattcctcgcccagggctgtatgaggcacagtagcggcctcatgtgtcatcaatacatactcagcgccattcagcaacagcacgggggtcagccgctttggtatggggcttccgttaagacgctctga

SEQ ID NO: 59658 - DNA, 522 bp, Glycine max
  Peptide Sequence Number=SeqID_176436
gtaagcatttcggatctttcgggccatgatgcgccgggcgatgacgcgctcgaccagagaattgccgaagcgaagagcaacctcgctgaggaaggccgtttttatcggtcagttattacagctatcgttgtttgtgcgctgctgcttgttcttaaccactttacgaacccggccagcactgatcagccgctggcaacagaagcggctacggcagatgctgcggcggggcagcgacgcactttacacagctctggggcggccttagctccggggaaaggccgaaatgagccagccgcggcagctactcgccagaacgtgaacttatctattgataaagagttacttaacaaagcgcgcgatgcggggatgaatctttcacgtaccctgtccatggctattgatgaagagttacgtcgttatgctgcctcacgctggcaggaagaaaatgccgaagggatcaatacgctgaaccgtatcggtgaagaaacgggatgcttttcagataactacaggaatttctga

SEQ ID NO: 59659 - DNA, 610 bp, Glycine max
  Peptide Sequence Number=SeqID_176437
atgggtgtgatgggcaaggcaagatccgttgcggcaatgggtgggagaatattgaacgaggcagtgagcttcgttgctttctgtgttctggaccttgtcgattttctgttatgttttgttttcaaagctgtggacttgtgggttgaggcagagttgagaccctgctattgctcctccgcgaaggaagcaatcacgagcagtgggaagatcttggtttctgagcaaggtggagaatccaagatcgtttctcttcttagctcaaccaagcttcagttggaggacatctctgacaccctctactctcgaccctctttggtctcggaggtctcgaggttaaccatcaatgagctcaagaggttcaagctggaggaccccgttttgcagtccaagagaggcaccaactcgcgctgttccacgttcactgtcaacaccaccattgtagaaatgcttcagggaaaaattgcaaggcaccttactcatcccattcctagatggtccgactgtgattgcaaactatgcacaagttggatctcctcttcttcctctcctcataacgataacaccaatgccaaagccactctctttctgaagtcccaatgccccaccacag

SEQ ID NO: 59660 - DNA, 369 bp, Glycine max
  Peptide Sequence Number=SeqID_176438
ggtgagcttgacagtggtgataatggtgacaatagtggtagtatcgatgataatggtggtgggggtggaatagtggcgacgataatgcggtgtaatggtcacgacgatgatgtggtggtggtggtgaatagggcaaagtcaagttgcagtggtagtgacgatggtggtggaatggtggaagcgataatggtggtggtggcacaacgaggtgtgatagtggtgacaatgacagtaacagtggtggttgtggtggaatggtggcagcggagaattgacgatgtaataatgacaaggtgtggtgatggtagcgatgacggtagtggttgtagtggaatggtggcggttaaggcaacaatgatgggatggtag

SEQ ID NO: 59661 - DNA, 543 bp, Glycine max
  Peptide Sequence Number=SeqID_176439
atgccaacaccaacatcaacgacaacgtttgctggtgtagaaactcctaatggagactcttctaacaccaatcctcatcccaaacacacccgtcaagaatcgcgtgacctctctccttttttgtcttgttcttaccccatcactcttaagcttcttcttcttcattatgcgacggtgaagcatgttcttctccggcgtggatacccacacctcattctcttatatcgggacactgacatgggctgcggcgggtccaaggtggaggacttccccgcggtggttctgtgcagagagcgaaaggcgttcctcaaagccgcatcagagcaacgctacgctctcaccgctgcacacgtggcgtatttccattcgctgagtgaaatcggcgacgcccttcacaagttcaccgaacaagacctcaccaccaccaccggttcctcctctctggttctcacattaccctcggaaaccaaaagcatcaacaataacaaactctcatcctcttccccttctatagcatctaatgaaaaaaactatgaaaaataa

SEQ ID NO: 59662 - DNA, 843 bp, Glycine max
  Peptide Sequence Number=SeqID_176440
atgcccgaaccggaatcgcaaaacggacacgagcaagacccggagccgcagccagaaacagaaccagtgccaacagagcaaacacaaccacaattggagccgaaatcgaaatccacgcccgaaccagaaccaaatccgcagccagaatcggagccagtgccaacagagcaaacgcaagcacaattggagccgaaatcgggatcagaagctgatccagcggtaaacgacgcagatctcagggaaacgacgattcattccaatgaaacgtatgccaatccttctcccactcctcagctacgtaaagacgaaggaagccgaacgttcaccatgagagaattgctgaacggattgaaaaacgattccgaaccggagagagaagatggcaactccccctacagcccagaacaacagcaacagcaggcagaccagaacaacgctgcaatggatttgataaacagcgttgtaggtgtcgacgaggaaggccggtcccgacagaggattcttacattcgctgccaggagatatgctactgcaattgagaggaaccctgaagattatgatgcattgtacaattgggcattggtactccaggaaagtgcagataatgttagcccagattccacttcaccctctaaagatgctttgcttgaggaggcttgtaagaagtatgatgaggccactcgtctttgtcccacactgcatgatatgggaggatctaggggctcttcaagtttgtcaagaatgaagaaacactttcttaacattcttgaagaaatgaggatagagatagaaagtttcagactttcagtagggaactcaaggaagaatgagaattgttggtga

SEQ ID NO: 59663 - DNA, 543 bp, Glycine max
  Peptide Sequence Number=SeqID_176441
atgaagcactggtctggcatggctacaaaacttggtatctcaggttgtccagtcaagatattgccacaaaagccaccagatttgtgttcttccatggagcgggatggtcactgtctaagatggatctctggtctcccatgtgggctgacccagcctccacggtttgattgtgacactcctgccatcatcaaaacctctggatcaaggtcttcacaaggaaaggacgacgaagggagagtgaccgacaaagcaggagaaaataaatttctgaatttaatgggccaaacccaaaccactaaggacagtgagtaccaagacaaaagttgtcatattacaacccaggaacttccatcatgtgcagcagtgcagttcaccagggagccgggagatctcattacaactatagcagtggtgatgatgctctgtttcatggctaaaaatacagaagaaaacagagcactagggaagcatgggagtgctcacatatttgtgtttgacacaggagaagtgaaagttaattttgggatgcagtggtctggttga

SEQ ID NO: 59664 - DNA, 2136 bp, Glycine max
  Peptide Sequence Number=SeqID_176442
atgtacaaccagcaagtcaaggaaagtaagggtccctttagaagggatgaaagtagaaggaaaagaaatcgacagaaaaataaaacaggccttatagctgctactacagatagagagatcatgatctccccatcaagtggccttaacatggaagaagagaagaaagaagaaatagttgaaagagatgaggacttggaggagcaggtacctgctgctgctgaagtcgagcctcagccatggacagaacagataacagtgagaggattatttgtgagcatgattattggaatcacattcagcataatagtcatgaagctcaacctcacaactggaatggttcctaactgtaatgtctcggccgcacttctagcctttgtgtttatccgaacctggaccaaactgcttcacaaggccggctttgtagccaagccattcagtcgccaggagaacaccatcatacagacttgtgcagttgcgtgctatagcattgctgttggaggaggatttgcttcttatctgttgggattaaacaggacaacttatgagttgtcaggagtggaaaacgagggtaacaacccaggtgctattaaagaacctggatttggttggatgactggcttcctttttgtggtttgttttgttggtctctttgtcttgattccactcagaaagatcatgatagttgacctcaaattaacttatccaagtggcttggcaacagcggttctcatcaatggtttccatacacagggtgacaaaatggccaagaagcaagtacgaggcttcacgaagtatttttgtaccagtttcttgtggggtttatttaagtggttcttctcagggatagaggactgtggattcgaacagttccctaccttcggattgcaagcttggaagcaaacattctacttcgattttagtatgacttttgtgggagcagggatgatttgctcccatcttgtgaactgttctttgctccttggagctgtgctctcttttggggtcatgtatccgctcattgatcggcttaaaggagactggttccctgacaatttagaagaaactaacatgaagggcttatacggttacaaggtttttgtttccattgctcttatcctgggtgatggcatatacaatttcaccaagattctaatttctacagtcctcaatgttaatgaaagaatgaggagcaagaataataaaaatgtagctgctgatcggcacgagaatcctaccgaggaccttaaacaaactgatgaatttctaagggagaccattcccctgcggattggagtcattggatacgttgttttcacaatgatttccataattataattccacgcatgtttcctcagctgaaatggtactacgtggtggtagcttatatatttgctccatctctggcattctgcaatgctttcggagcaggtctcactgacataaacatggcatataattatgggaaggttgcactctttacgctggcagctgttacaggaaaagaaaatggtgtggtggctggacttgtgggttgtggtctcattaaatccgtgatctcagtgtcttgcattctgatgcaagatttcaaaactgcacattacacacgtacctctcctagagcaatgttcatatgccaagtaattggcattgcaatgggttgtgtgacagctcctctcagcttcttcctatactacaaggcatttgatgtgggaaacccgcatggagaattcaaagctccatatgcgttaatttatagaaacatggcaatcatcggggtccaaggtttctcagcattgccacagcattgtttgcagctatgctttgggttctttgcttttgccataggagtaaacatgataagagattttgcaccccaaaagattgggaaatggatgccattaccaatggtcatggccgtaccgtttctggttggagcatactttgcaatcgatatgttcataggtactgtggttgtgtttgcttggcagaagcttgactccaagaaggcagagttgatggttccagcagctgcctctggactaatttgtggggaaggactatggactctaccagctgcgattctagctcttgcaagaattaaacctcctatctgcatgaaattcgttcctacctag

SEQ ID NO: 59665 - DNA, 2061 bp, Glycine max
  Peptide Sequence Number=SeqID_176443
atggcatctcctcatcctgaatatgctacttctcatggaaccaatattcaagctaacttggctgccaaagaaatccttccagttgaaggaaaaaattatattccaatacccagacttggggaaaaaagtttgaagatctggagctcacaggtattgttgccttatactgctaacaaccattcttatgccttcttaggtcctttcttaccatacttgaaactagaacaacttgaccaatttttaccaagattagatgaagaatggcctcttgtacaccttcccattataaggactgattttaccaataaagatcatgccaggatatttagagccacccctccagttgataggaacaattttttcaaatggatggaccgagtggaaaatgtatatggtaaccattggaaaaaattagggatttatgagttcatgcaactatgcagacttgacttgacatcccttgatatccctcttctaatggcttcatttatcttgtggaatcgaagcacacatgctttcgatctgccttgtggaccagctagtccaacccttctcgatatcgcagctataacagggttacgaccaataggtgaaagatatgcaatgggtctgatcaaagatgaaatcaatgtagagacagttggggttaacttcagatattcaacctacagaagatacatcaaagaacatcaaggagaagcagcattgaaagttacaaaaaatgttttcaatcttgcccaagctctccatcttggtaaagatatatgcctaagtaaattcctcctggcatccctctacaaagccatggatgaagcggttgacatcttcaaagctccttatctactcagaaatttttctggccctctttggcttatgcagttatggctaaatgcaatttttgagaagaaactaaacctgaagggagaagctaccatgcaaaaagttgaaggggctcgtttgacctatcttactcggaaaaaggaatatacggtggaagcttttaaagaatacataagcacattcctaagtttcgaggagtttactgatgatttggctcctttcctaagaccaagtttgatagggccaaagtggcttaagttaagatttccgtgtgaaaatagaggtgaacaatctgagttgataaatatatggtcagcatttcttactggggatattatcttcactgggacaatggaaagagatattcgattttatgcttatcagccacaactatttgctcgacaatttgggctttctcagttgttacctgtacctgttatgaagcagaggctaaaacctgatcatatcctcaacaaaaagttcattccggatttgatcaacacagcaatatcaaaacctcaaccttcttttactccagtctctttcgagaataatttttatggtattcaaccttttttcgattggtggaaatcttattactccaagaagcccatcattattaatcaaatctttgaaaaattgactaattctatcacctttccggaactagatctcaaagcagctgaaccacttactttacccaaaaggaatgaggattgggagagtgctgaagaggaagaggatcagctcattacccccaaggcttctcgaataagaaaaggtacctcattgtcagaaacaagcaatagatcttcgaaaaagtcctttgtgaaaaataaagaggtaaaaacttcaaagaagggaaccttgacgcctattactcaagaaaagatcactggtcctgccaaagaagcctccaaaggtaaagctttggccacagaagatcgacgaccaagtaaacaaattcaaagcactatgcctaagttgatggcatcaggaattgtctctgccagggtcgaggtcacacaagaactcaattttcaatcagatgacttagacttaggcaaatctttggtgtcaactaaattcgcttttcccttacctgactgggagaagacttctatcaaccctggtatcgacgaagagtatatatgtcggactccatcacctctcatacctgtgggcgatgaacaacatcccatccggaaaatagtgcgttaa

SEQ ID NO: 59666 - DNA, 255 bp, Glycine max
  Peptide Sequence Number=SeqID_176444
atggaatatcagttagatcttttactgaacctttatgctcctattgctgcactagaagtaggatatgtagatgaaggtggtgagcagcataatgaccaagtggttgaggtcattaatgtggagcagcataaagataattggtttgaacaagaaatatgttctgaagtcaaatggtgccgggctttagacagttcatcatcaatatttggtgccacagtgtgtagcttcgaggggctagtgagttccaaaatctaa

SEQ ID NO: 59667 - DNA, 213 bp, Glycine max
  Peptide Sequence Number=SeqID_176445
atgacaaaaaggaaggctaaagcgaaatctaaagaaacaaatttcgacctcgtagagattaaggcaatgcaagagtcattgagtcagtatataatgataatcaatttcgatgaaggttttgaatgcgaagacatgtattcctacgcattttcaaaagagttagcaacaatgacgagtatttccaattgcggaatgatgctattgggagaataa

SEQ ID NO: 59668 - DNA, 1488 bp, Glycine max
  Peptide Sequence Number=SeqID_176446
atggctcgtggcaacgaagtggtgaaagaagtagaatggagaatcaaggtagaagaagatgagacactgcagaaaacagttgttggttgcatttgggcagttacagcaggtgtggctttgaagttgtgcaagtttgtgaagaaagcatgggaattgggggtgaatgaccctagaaaattcatccattgcttgaaagtaggcattgcactttcagcagtttcgctcttctactattggaagcctttgtatgatggagttggaggaaatgctatgtgggctgtcatgactgtggttgtagtttttgagtacacagccggtgcaacgatatgtaaaactgttaacagaatgtttggaacttcccttgctggatttctaggcattggtgtacattgggtagctagtagggcaggagagcaatgggaacccgtaattgttggagtctctctctttcttttagcatctgcagcaacattctccagattcatccccaccttaaaggctcgttttgattatggtattttgatattcatcctcacattcagcttggtgtcagtatcgggttatcgggtagatgaattgttggtcatggcacagtacagaatatgcacgattataattggcagcatattgtgcataattattagcgtgatcattcgtcccatctgggctggtttcgaactctttgttttagtcacagggaacctcgacaaactggccaactccttgcaatgttgtgtggctcagtacttcggtggtagtgaagcctcagaagatagtgatgagatgtctgataaaaaattgctaggctacaagtgtgtgctaagttccaaagcaacagaagaaactatggcaaattttgctagatgggaacctgcccatggccgcttcaacttccgccacccgtggaggcaatatgttaaaattggagcatcaatgcgtagttgtgcttcctgtttagatgctcttattggatgcataaattcagacaaccaggcttcggatgacatgaagaagaatatgagcagcatctccatgaaactgggcgcaaactgtgcgagtgtcataagagagctagcaactacaataaggaaaatggcaaaatcatctaaacttgatattctggttacagatatgaatagtgctgcacaagagcttcgaagtttattaaattcttatccaaacttggttaacgcaccttcacataatgccaaaattagtacacaaacagaaacagcttcacctgatgatcaggctgcaaaaatagaaatcccacttatggaaatcattcaagttgtaactgtagcttctttgctcattgaaattgtggctcgtgtggaaggcattgtggaaaatgttgaagaactatcagttttggctaatttccaagcagaaatgtgtgtcaaatccaaacaacatacatctgacagcaaggtctcccctgaccaacagaatgatgatgaacccgttagaacactccaaatggtctga

SEQ ID NO: 59669 - DNA, 2030 bp, Glycine max
  Peptide Sequence Number=SeqID_176447
agaaagtggaatttttggagcaaacacaaagcgtactcacagagatggatgatgatatgggtatgtttgacatgccgggaaatgcagttttaccactggattgtgaaaataatgatttaaatgggttcttggattccatttcttctgcaagtcccaacaattccttcccttcccaatataacacttatgaagaatcagtggctacattgcaaggagattcttcttatcttggtgaccaattgaaaggtaccatggaagctctagttgtattatcagatagggatagtgctgatgtgcttttgaagcctaactcttctacgaacaatttaattgccgaaaacccatattttggcgtatgtggtaacgaattatcttcttttgatttgttggagcaacaattggtatcctgtgtaagtgcacaagaagatgcagatgtgtgttttacaaatgaaaatgcatttgctaccagcgaacttctaggtcaggatttggcattgacctcattgtgcagtatggacagagggtcatttcaaggcaaattacaaaattcactcgataaccaatattcaactcagtccagtgttgtgacagatgttgatttttcctcgagtttaaatgcattgcatggactctctgagaacttagagcgagttgatatgtcagaagaaattttgaaattcagctccatggaagatctttgccagtggtttggtccttctcccaaggatagtatctgcaaagcagtaattgcattggataataccttttctgaatcaacagaatttaatcccacttcctttgatctggttggatctagttctttaaatgatatttcagtgacatgcctaactggacagaattccaactcagaggggaaagaaacatctgtagttatgcatagcactgaaaacgctctcttggataacctgaaacttgattttagctatgaccaagctgatgaatggtgggggaatatgcttacaccagtggtgagtggtgttactgatactggcttctctgaatgcatttcagagttgaatactgatatcccaactggcacccgaaagagattattctcagagttaggaattgatgagcttttgaggggtgaagcaaattacaatccttttaatagttcagaacttgagcatgagttattattacccaataagaggcagacagtagaatcttcatcagtgaatagaaattcaatacctttcaccaaccttcattggcctggtgtggctagagcagacttgacgcagacattttgtgacttagacagcgcaaacaatcttccgacaaagaaagataaattcccaaaattacaaacaggcatgtggaatgatgatagtcatagcattaatattgggaaggctgttccagtacaccctcaaaagccagaggaacccgcaaagccacccaagaagagggctagggcgggggagagtactcgaccacggccaaaagatcgtcagcagatccaagactgtattaaagagttgagaagactcattcccaatgatggaaagtgtagcattgattctttgttagaccgcaccatcagatacatgcttttcttacaaagtgtcgtcaagtattcagacaagctacaggaaccaaatgagcctaaggcaaataaagtggttctaaaagacagtggtgcagcggatggcaaaaactgtggcattacatgggcatatgaagtagcacaccaaccaatgctatgcccaattatagttgaggacatgagtctacctggccaaatgcttatagagatgctttgtgaggagcaaggtttcttccttgagataattgacattattcggcatttcgggctgaatatcttgaaagccaagatggaaagaaggaggaacaaactatgggcacgctttattgttgaggcaaacaacagacacgtgacaaggatagatgtgtttttgtccctaatccgttttctacagcaaacaaacacctctggcattgattcttctaataagaattgcgacgttattgatgccaatatttag

SEQ ID NO: 59670 - DNA, 240 bp, Glycine max
  Peptide Sequence Number=SeqID_176448
atgtcttggcaggaggaactagagagaaatcaaaaggcatcaggttccaagtctgatggatgtgcaagacaggttgcttcgtatgagtttaccaccttaacttgcatcccaggtgtcatcacatatcgtggagctaaaatccagatattctgcttgtgggttgataagcctgggatgcctaaagctgatttagttgtactttttctgataatagttgagagaagattaaatgatatgtga

SEQ ID NO: 59671 - DNA, 150 bp, Glycine max
  Peptide Sequence Number=SeqID_176449
atgaggacgagagaggcacttgcagagatagataccaaacaaatacagagtgagtggtcgaagaaagagagaggaatggactgcgacggaggtgcagcggaggacggaggtgacggcgagcagagaactaaagatgcgagactgcaatga

SEQ ID NO: 59672 - DNA, 1521 bp, Glycine max
  Peptide Sequence Number=SeqID_176450
atgggaagcggtagttcttgttctcactctactaagggaagtggtatctctcattcccactctactaagagaagtggtaatccccattctcattctaacctcaaaattcttttcattgagacagagagagaactcattggcatagattttaagcaactcctactccaccctgaatggactacaatacaagatcctattgttgtccccatctatttcaaaataaacctattgaattttttcaatggaaaaagtattgtgggaatgaagcatatcacagtggattctaatgtctatttgattggaggtgaaagcttagggtctggagccattccaaataaaagttatgtgtccaaccatccagactcatatcttggttcttctaatcgggtattacatttatcattcgagaaaaatgcatttagcctaaagcgcacttcgcgtatcaagagatttctatatgggaaatgttctccaatggtagaaaacattgaaggtaaaatttttgtgctagagggaaagccatatcttcacgatcatcatcttaatgggccttttgaagtttacgatccaaatgaagaatatcctcaaatactaaataatcctcctccttatacaaggtaccctcaaggcaaaatagatggtcattttgttttgggtcacaaattcatcgtgtttgagaaaaaaacttgtgagacaatagatggctatttctatgatactcgtacacatagtggttgggaaaaattagatccgtatgtgatttctttttttacgcaaattggcctacctattaatggaatatgtgtgccatatttcccccaacttgaagattataaacttgagctcattcttgctcgaaaaggaatagaagaagcttatgctttgctcattaatgcatcatccggtggactcttatattatcaatctctcagggaggttttccaaaatcgttttccccttacagaaacgggacaacgtgtccatttgaacaatgggaggaacttcttcttcatgctacccaacaatcaaatttgtgctatttgggttgcctttgatcatcataaaacgcttcgccttttcacaacaatatttgctctacgagcgtgcttcaatttcaatgccgagcgtttactcctctgcccttctcatccaatagagaggaggttcttagaagtttttgatattcataattgggattgtgtggtgaagaataatggaacatattcaaatcatatctgttcctcacctgaagccaatccaaatgcaaatcagcaaacaccgcgatacaaatctgctccttcaacaacgactgcaagcgtgctcctccatgtcgatccagttcaagatatgctcctcgcccaaagccaagtgaccctcctcttctactacttgatctgctacatggttggcaaagaagaaggaccatcaccggaagggggatcaacggtggattgtgtacaccggcagcttgggcaagtcggtgaaggagaatgtggttttacccacattttggaaatctag

SEQ ID NO: 59673 - DNA, 300 bp, Glycine max
  Peptide Sequence Number=SeqID_176451
atgtgggtaaaaccacattctccttcaccgacttgcccaagctgccggtgtacacaatccaccgttgatcccccttccggtgatggtccttcttcctccataacaatacacttaacaggactgatgaaagagattataactttggattgcgaggtttttgcggggaaacatactttgccaaccatggtcttgatgcttgttctgaagattttctatgcacattggtgcgatggtcctgtggtgtgcaaaggagatgctgaagggtatcgtgttattctgaattggggttccttttactga

SEQ ID NO: 59674 - DNA, 510 bp, Glycine max
  Peptide Sequence Number=SeqID_176452
atgagggaaaaactgaaatcgacatggaaattggaagatgggttcaatctaatggatatcacacatggttacattctagttaatttttatatggataaagatcgagacaaagacattagtggagggctatggatgatcttcgatccctatctcattgttaggccttggactctagactttttagccatgaacatgaaggtagataaaaccttggtgtgggtccacttcccaagcctaggtatggtattttatgaggagaatgtcttgttggcattggaatcaacaattggtagacccatcatagatcttaacacgttgaatatggctaggggacgttttgcacaagtttgcatagaaattgacttggatgtgccggtgaaactacattgttttggtgatggaggaacaactgaaggaggttggtgtggttgcgacctagctagacatgggttccacagagtcaaccaaggaattaacccctatgaaccttatgtcactatcatcgcataa

SEQ ID NO: 59675 - DNA, 525 bp, Glycine max
  Peptide Sequence Number=SeqID_176453
atgctacctgctcactctggcgaccctactcactctcaccgccctcgctattactctcgcgagcctgctctctgtcataaccctcactctcactcttatgaccatgttttagtcggtggtgtcgttgcctattgtcattgttctcgtgcccatggtcgtcgtgggatgtggagtttaacttcaagcacaacagcgattgggttcgacaaggaagctagccaatcctcgttgtcctccttctccacctctcttttcaatttctcttatggaaaccgtagaatcaaggagactcgtggcctcatgcatctcttcccagacgacactcctttgactcttgtagatttggatgttgttgaggcggttattcaaggtcttgtgctattccaaggaggcattctcatgcaagtgagtcatgatgagcacctcatctctggaagcatggaggaactatgggttgtatttgaaggaagagtgacaccattccatgacacatttcaagaatataagatactccaatcatcctag

SEQ ID NO: 59676 - DNA, 180 bp, Glycine max
  Peptide Sequence Number=SeqID_176454
atgacacttccagatcttcaaaccatccaatcagcccttgttaaaactggtttaggcaatcagcagagtgctcaagtaccttctgatggtgacttcaggcaagacatccatgatctcatggtgcagactgtcaagttcttgagccagaacaatctatatcctttcatcagcctctactga

SEQ ID NO: 59677 - DNA, 201 bp, Glycine max
  Peptide Sequence Number=SeqID_176455
atggctgattcagaaatcggtaaacagatttacactccacaacaataccataaagaaattaggatgaaaaggcctcagtacagacctcccaatagacaaccctctaggaaaaagaatccaactcgtaggacattactccagagattgttcgaacaaaaccaatatgtttacaagagaagcataactgataaaaagctgtag

SEQ ID NO: 59678 - DNA, 471 bp, Glycine max
  Peptide Sequence Number=SeqID_176456
atgcccacaattgtaggtgaagctgggtggcctgcggatagagacagaaatgcaaaccttcaatacgcacaacggtctaaccaaagctttatgtcgcgttacattgctggaaaggggacaccaatgaggcctgtgttaaatagacatggcaagaaaatccgtatccgtgggtacccgtccgaatccgtcccgactttgacgggtaatacccgagttgaccgggtatgggtacgggttcgggtttttcccgataaccaaaagtcgggtacggtgttaaatagacatggcaagaaaacccgtacccgtgggtacccgtccgaatccgtcccgactttgacgggtaatacccgagttgaccgggtatgggtacgggttcgggtttttcccgataaccaaaagtcgggtacgggtactagtatgggattactagaccggtcccgacctcgaacccgaacccgccctgccacttaa

SEQ ID NO: 59679 - DNA, 828 bp, Glycine max
  Peptide Sequence Number=SeqID_176457
atggatgaagacgaatctattgagctttttagttggcatgcatttaagcaagcaagtccaagagaagattttattgaactttctagaaatgtagttgcttattctgcgggattgccactagctcttgaagtccttgggtcctatttgtttgatatggaggtaacagagtggaagaatgtattggagaaacttaagaaaattcctaatgatgaagtacaagagaaattaaaaataagctatgatggtttaactgatgatacagagaaaggaatattccttgatatagcttgtttctttataggaatggaccggaatgatgttatacatatattaaatggttgtgggctttgtgcagaaaatggaatacgtgtcttggtagaaagaagccttgtaactgtagattataagaacaagcttggaatgcatgatttgctgcgagacatgggaagagaaatcattcgttcaaaaacaccaatggagcttgaggagcgtagtaggttatggtttcatgaagatgcgcttgatgtattatcaaaagaaactggaacaaaagctattgagggactggctttgaagttaccaagaactaatactaaatgtttgagcactaaagcttttaaggagatgaaaaaactcaggttgcttcaacttgctggtgtacaattggttggagatttcaagtatctttccaaagatcttagatggctttgttggcatggatttcctttagcatgcataccaacaaacctttatcaaggaagtctagtttccattgagctagaaaacagcaatgttaatcttttgtggaaagaagcccagaatatttaa

SEQ ID NO: 59680 - DNA, 2313 bp, Glycine max
  Peptide Sequence Number=SeqID_176458
gtgggattatgggcatggatatctcaacgacgtatctgggggatgacatggtcctagtattcggactgaacattgaaagagctaaacaactgatgaatgagtttggccacaccagagccggggaagtgccagccatcaagaagatcctgggggtaatgggggacgtagtggagattgacgaggaagtggaggaacgacggcggatggacagagtaagggtgctcctcaaaacaccatggaagctatttattcagtacaccgtcaacgtgcatatcggcacagaggtgtacgaagttcaaataatggaagaaagagccccatacgtcgacttgtggcaaggagcgagaaggagtgggatgctgtcgttggaagatatagattccgacaggagcctaatggaatctccggcatcggcgaggtcacagggacgaacttttgaaatcgcgacagcggacaatgaggagcggccaaacaccaccgctccgcaccagacgggctcgcgctcccacgacgacgacgacacccagcaagtagaggtaatgtcctgcggtcacatggaaaaagctagaaagaaggtgcagtggaggccatggggggggctgcagatctggacagcgacactgaagaggaaagtgggtcagtggggaggaaagggaaaatggcaaacgaatgtagtgagctgcagaggaggtcacctacaccctggaaggtgtattcccgaaccagggggtgccacaagcaagcgaaggaaggcaaggaaattaaagaagcccaagctcctgatgccacaagaccaacaagagaatgggcaaagtggaaatacagagaagcagtatgttgaggagcacacaaccttaggagaaaatatgaggcacgaagcagctaccatttgggatttagcaaaaaaattggggggggtgaaatgggcagcaataaggaggctgatcaaaaaagagaatgtagatttgatatgcatccaagagatcaagaaggagataatagagaaatcaacgtgccaggcactatggggggatccagcgatgtcctgggagttgcagccggcagtcaactcagctggggaatcctatgcatgtgggcagtggattaaagaggcagtgcaagttcacattgtaaccgtatattcgccatgtgacatacagaagaaaagaatcttatgggatgccatcaaacaaatgaaatcagcaaaccatggggacctatggtgcatttcgggagatttcaacaacattagagatcctgtggaaagggtaggagtttgccaaaggacgatagaagagagtagtataaaagaatttaatgattggatagatgagctggaggtggtggaagcgccatggactggctcacaaaatggctcggaagcatacaacaacctttggaccggaatttttctgatcactgcccagtgttgcttcggtccaagggtgctggcaaacccaccagcaaagaggatggggcggatttgtgttgaaagaaaaaataaagagattgaaggcaagaaagaaagagccagatgggtgaaagaaagggattgcaactctcgctatttccatctgttggttaatgcaaaccgaagaggcaattctctgcatggactgtggattgatggagaatgggttgaagaatcggcaagagtaaaagaggcagcctgcctatttctcctacacaagttccaagaagaagaccataatagatcccacttagatggtattgaattcaaggccattgaccatcaccacaatgacatgttaataaggagatttttggaggaggaaataagggatgcagtttggggatgtaggagcgagaaaagctcgggcccagatggaattaatttcaaattcatcaagagattttggcacttacttaaaccggatgttctgcagttcttggatgaattctacgtaactgggatttttccaaagggatgtaacgcatccttcattgtcttaatccctaagatagttgccaagctgttggccaacatattgaagaaggttatgccattcataatagatgaaggccaatctgcatttatagaggggaggcatttgctacaaagtccaaacgaggtggtggatgaggccaggagaagtcagaagccgtgtttagttttcaaagtggactatgagaaggcatacgatttggtatcatgggattttctggagaatgttagggcgattaaggcaattcttaggatctttgaacttgcatcaggccttaagattaattttgcaaaaagttgttttggtgcatttggtgtgcaggagttatggaagtctgaagtagcca

SEQ ID NO: 59681 - DNA, 393 bp, Glycine max
  Peptide Sequence Number=SeqID_176459
atggtggaaattaagggagatcctggtttgtctagaaccttagtctctcctcacacattacttaaaatgacacaggtggaagagatttctatgatatgggtattggaagttgaggaaaattctgaggcagtaccaattcagaatggaatgattgtgagagaatatgctcaggtcttttcagaaccacaagggttgcccccaagcagagaggtggatcacataattccaataaaagttggggtggatccagtcaaggtgcgaccccacaggcacccctacttacaaaagcatgagatagaaaaacaagtagttgatatgataaaattgggtattattagacctagtaacagcccatactctagtcttgtaatacttgttaaaaaagaaagatga

SEQ ID NO: 59682 - DNA, 261 bp, Glycine max
  Peptide Sequence Number=SeqID_176460
atgcagtatttgagggaagtgttggaaacacttgtaaagaaattattttttgataatcttaaggtggaatatctaggtcacttaatatctcaacaaggggttgcaatggacactaagaaggtggaagccatattgaaatggtcaattcccaaatctgttatggctttaaggggtttcttaggtcttgcagggaaaggaataggggttgtgctatctcaaaatcgtaaggctattacattttctagtaaacctctatcttaa

SEQ ID NO: 59683 - DNA, 1560 bp, Glycine max
  Peptide Sequence Number=SeqID_176461
atggtgtgtggaaagcttagggggtgccttgttcttgtgttctttgctgcactgttggtgggtttagtgaatggaattggtgttaattggggcacacaattaacacaccctttgccagcatccactatagtgaaaatgctaaaggacaatggtattcagaaagttaagctttttgatgctgaccctgatattcttaatgctcttaagaagtctgggattcaggtgatggtgggtataccaaatgacatgctttacacactggctaacaatatgcaagcagctgaaaaatgggtttctaagaatgtttcagcacatgtctcatctgggggagtggacatcagccgagagtttggaggttttgttaaggactgtggtatctgcttcaatgcttttgagaagaaatggtacagaacaattttagaagaaatcatcgtaactggaagtggaatactccacataatcattaaaatgggaaatgaacctttcttgtcaacttacaatggaacctttgaagccataacacttccagctcttcaaaacatccaatcagctcttgtgaaagctggtttaggcaatcaggttaaggtcactgttcccctaaacgccgatgtgtatcagagcacacaagtaccttctgatggagacttcaggcaaaacatccatgatctcatggtgcagattgttaagttcttgagccagaacaacgctccatttaccgtgaacatctatcctttcatcagcctctattcagactccaattttcctgttgactatgccttcttcaatggctttcagtctcctataaatgacaacggaaggatctatgacaatgtctttgatgccaaccatgatactctagtgtgggcactgcagaagaatggtttcggaaacatgcctataattgtgggagaagttgggtggcctacagatggagacagaaacgcaaaccttcaatacgcgcaacgcttcaaccaaggcttcatgtcgcgctacattgccggaaaagggacaccaatgaggcctggtcctatggatgcttacttgtttagtctcatagatgaagatttcaaaagcattcagccgggtaattttgaaagacattgggggttgttttactatgatggacaacccaagtacatgcttaacataggatcaagagccaatggcttagtagctgctactggggtggcatatctacccaaaaagtggtgcattttgaaaacctcagcaaacctcaatagtgatcaagtggcaccaagtgtgtcttatgcttgtcaaaatgcagattgcacaagtcttggatatcaaacttcatgtggtggtttagatgctcgtggtaatctttcttatgcattcaatagttacttccaagtgaatgaccagattgacagtgcatgcaaattccccggtctttctgttgtcactgacaaagatccttcaactggagattgcaagttcaaaatcatgattcagacagattctgctggtctacatgggaatgggagaatttggtctctcagaatagtactctttgtacttttgtttttcactcttatgtga

SEQ ID NO: 59684 - DNA, 378 bp, Glycine max
  Peptide Sequence Number=SeqID_176462
atgtttggtgtaactgaaaacttgagaggcagttttgggctggcctgtcatattggagttgaggccaatctcccaacaattgggattggaaagaatctgtataagttacagttgcatcatgtggatggtcttactcattctagagtgagagaacttcttggagctgaagaaaactgttctgaagattttattaatttggtgggttgttctgggcatatatggggagtggccatgagatctacccagggttccataaaaccaatatttatatcaattggtcacaagatatcacttcagactgccattatgattgttcaaatgacatgcaagtaccgtgtgcctgagccaattaggcaggtgaaactatctgccatttaa

SEQ ID NO: 59685 - DNA, 327 bp, Glycine max
  Peptide Sequence Number=SeqID_176463
atggtggttccaaagtcagaaaagatgcaaagacaagttgaaactaacaaggaacaagcatataatcatggttacctcaaggaaaaccacgaaggtcagaccggggcttcgttcttaatcgaaatcgcgaggcaaatttggaagattccgtttcggttgaagggttcctctcggtgtggggtttcaaaggagaacaatggtggtccgtggtggccactggtggctgtgggtggtggagaagaagcttgggacattggaaatggttttggaagaaagaaggagaaggaaatggcgtttttccaaggcttcacgaaaagcaaattctga

SEQ ID NO: 59686 - DNA, 687 bp, Glycine max
  Peptide Sequence Number=SeqID_176464
atgtgtaaggttcgtgagttggccgaaaaggagcctgaaaatggtgtcttcagactactccgaagtgatgttactcggttccttacaacaatacttattggcacaacagtggtcaatattggggcaactgctttggtcactgaagcagcaactgctatgtttggtgaagctggtatcagtgcagcaataggagcgatgactgttgccattttgcttctcactgaaatcactccaaaaagcatagctgttcataatgccacaaaagtgtctcggtttgtgtgtgattgtcattcttttttattgatctgtgaaagaaaatacggtcttgatgataacactatacacttcattggtcatgctttggcacttcatagtgatgatcgctacttggttgagccagcactgaacactgtgaagagaatgaaggttgtggagatcactaaaggaagcaaggttaagtatgaacttgacaaaaggactggattgattaaggttgatcgggttttgtattcatcagttgtttatccacataactatgattttatccctcgcacactgtgtgaagacaacgatccaattgatattttggttcttatgcagaatataagcactttaccagctatagagaacttgcacctcatcgcatctccaagatttgacgcttctttgaagacgcgacacgcctaa

SEQ ID NO: 59687 - DNA, 342 bp, Glycine max
  Peptide Sequence Number=SeqID_176465
atggtgctatacacactaagaggctggggaaagcttctatctattcttgtagttccaagggacatactttcaccctctagtgtaagtgtgacaagccaagacttggaaaacagactaaatgctttcaatctagcttttgatgaaaggtacaagaagcaatctaattgggtaatatccgatgagatcttgagggaaaatgtatgcaagcatttggtggaagaaaatgatgctaaggttgacaagtatatgaaatatatggcacaaagtttggagaacaagattgggtctctgtttcagccaaagcagaggaaagttacagacttgactctagctgctctataa

SEQ ID NO: 59688 - DNA, 209 bp, Glycine max
  Peptide Sequence Number=SeqID_176466
agttctacggagttgctgtcacctccagcaagggcatcaggccccttactaatcgagctttcatcaagaagtgttgcgtctccaggcaggcgcagggcgaaacaccacagcagcctggggatggccggcagcgggcaacagacgcaccgccatcacctctagagttcacctcagctcatccacaaaaagtcatagcaggacacacctag

SEQ ID NO: 59689 - DNA, 816 bp, Glycine max
  Peptide Sequence Number=SeqID_176467
atgcatcccggtgctggtgcacccttgggacatgatgaccgacggccgcatgaagcgctggatgctgccgtggctggtcgccatgcccgccgaaacgcagctgggcatcctgtcgctgatcctgtcgggcgcgttcgagcgcattccgcgcagcctgaagctgtgtttcgcccacggcggcggcagcttcgccttcctgctggggcgcgtggacaacgcctggcgccaccgcgacatcgtgcgtcaggactgtccgcagccgccctcgtcgtacaccgaccgcttctacgtcgactgcgccgtgttcgatccgcgctcgctgcggctgttgatcgacgtgatgggcgaggaccgcgtgctgctgggctccgattatccgtacccgctgggcgaacaggaggtcggccggctggtgtcgaattccgacctgttgcccgcggtgcagcacaagatcctggcggccaacacgcagacgttcttcgggctggatcgctgagccgcccgccaaccatgaccgtgacacacggcaacgcaaggggattcaccatgaaacgcatccatctgctggccgccgcggcggccgtggccctggctcccggggccgccacctgggccgacgtcaagatcggactgctgaccacgttgaccggccccggctcggtgctggggcaggaccagctcgacggcttcatgctggccgtggaacatggcggcggcaagctgggcggcgtgccggtgcaggtcatcaaggaagacgaccagttcaagcccgagatcggcgtgcaagccgcgcgcaagctggtgcagagcgacgag

SEQ ID NO: 59690 - DNA, 433 bp, Glycine max
  Peptide Sequence Number=SeqID_176468
atgtatgaattctcgagaagagaggagccgtggtggtcccccccggatcgcccggatcccacgagtgaagagaaagttggatctacattgggatctcacctgaatcgccccatctatcctcctgaggataagtttggtttcaaaccccagattcaaacaggagaagtacgccatgctaatgtgccttggatgatccacatctcagggtcaggcgccgatgagcacattaaactatccatgtggctgagagccctcacagtccaggcacaacgacgcaattatcagagagcgcgctctaccactgagctaatagcccgtctacggctaccttgttacgacttcactccagtcactagccctgccttcggcatccccctccttgcggttaaggtaacgacttcgggcatggccagctcccatagtgtgacgggcg

SEQ ID NO: 59691 - DNA, 626 bp, Glycine max
  Peptide Sequence Number=SeqID_176469
cggaaccagttgccggagtcgtcgcgccactcgtaggcatagcgcaccgcgatgcggaaggcgcgcgcctcatcgcgattgcggacgaattcggcgcggttgcgccagcgcgtgtccaggctgtaggccagcgccaccttgtcggggtcgcggctgttccagccgtcttcggccaggcggaccttctgcaccgcgctggcgtgggtgaagggaggaagaggagggcgggaagcggcgggggatgtcatgggggatacctcacggcaggggcacggaaaggcgtcgcggcgaaccgggacggaaagggcaagcggggcgccacgcgccaccgcgatcgcgccatcgatgagcaccagcaactgcgcggcggcctcgtcggggtccggcaatgcggcggcgcgggtcagcgtccgcacgtactccagcaggcgggccttgtgctcgcgcgccaccgccaggatcgggctggcctcgtcaccgatctctccggccgcgttcaggaaagcgcagccacgaaaatcgtcggtgccgaactattcccgcaaggcgtcgaacatcgccagcagccgggcgcgaggggcctgcgcccgctagctggccgcgacgaaccattgcatccaccgctc

SEQ ID NO: 59692 - DNA, 780 bp, Glycine max
  Peptide Sequence Number=SeqID_176470
atgttactgccacaggctgcgagggccgccgttagcggccggacgcaggattacagcacagtcgggggcggggggcaaaccccgggccaacccgagggcgtagccgcccagatcgcggctgtacgccgtcaagtatcgggcgatatcactattttggggcgattttccggatttcaagggccggatcgaggcgctcccgttggagcaggggggaccggcgcgcgcgccgggcgccggcggccgtgcccgatgccgtcaatgatgatggtgatgatgcccgccatcggcgggttgttgcttctggcattgcgggcacagcgcgcggatttcggtctcgtgggtggccagcgtgtagccggtctgggcaacgcgttcggccaattgccggctcatggcgggatcggatacctcggccaccgcgccgcaactggtacagaccaccagcaggtcgtggggagcgccgccgacgtcgtggcaggcgctccaggcgttgacggcgtccagtcggtggatcaggccttcgtccatcaggaagtcgagggcgcggtacaccgtcgggggcgcggcgcccggatgcacttcacgcatggcgtcgagcaactcgtaggctttcaggctgcggccatggcgcagcagcagttccagcaccttgcggcggatgggggtcaggcgccggccgcgttgttcgcacagcgcctcggcgacgctgagttgggcgcctacggtgtcactgcggggggaacggggccggagcgggcatggcgggcttcatctgaatag

SEQ ID NO: 59693 - DNA, 150 bp, Glycine max
  Peptide Sequence Number=SeqID_176471
atgaagcttaatgaggagaggcgcaggaacactcaagaaaaagatttactactgcggcaggaggaactggacaatttgttgttcagaatttctcaaatttctccattgggtgttcattcatggctttttggaagatgcaataagcaataa

SEQ ID NO: 59694 - DNA, 2364 bp, Glycine max
  Peptide Sequence Number=SeqID_176472
atggcgcaggaatatagccggaatgtgcctttaaccgccgctatccagcgccattccggccaggcggcgccagtaaccgttgctgtcgctgccgcgcgccatcatcagcggcgcttcacccgcttcgttagcgcggaagcgatcaacctgtgccagcgtgctctcatcctgcggcgccaggcgcacaatatcgatccagccatgcataccggcgagatcgttgccaaggttgtaacagtagccgctcatggtctgaatgccgttcaggacaaacacctgctggccctcctgcgacagcacgcggcgtccggtgggataatcaatacagcagcgccagcggcagatggccatagccgagcacttcaacctcaaaccgatcgcgcaggccagcgtcatggcactgctgcaacagctgaatcagccagtcgcgtgacatctccaccggcatgcaccagcgcgtcatgccctcctgcagcagcagctggagcgtctgcgcaactcaccgttttcaacatagcggcgcagctctttgacttcggaaggcgactgcagcagcgccagcgtgctcagcaccacttgtttgccgctggccgccagcgtgcggcccatctccatccactgaatgaacgcagtggcgcggcgtttgctgcacaccgcttcgccgaggtagacaatctatgcgctgctttctgcggcgcgctggtaaaactgctccagcgtggcggttggccagtaccacagcaccgggccgatggcgtatttcatacggtctccttattgccagtcgcggtgataggcgccgagggtggtctggctgccttcagaaagttcaccgagcgcgcgcatccacggctcctgcaccgtgaactgttgcggatcggccatgcagcgatcgatcgcctgacgccacactttagccacctgcgccacataggccgggctgcgctggcgtccctcaattttcaccgaggcgatattggcgcgcagcagctctggcagcagcgccagggtattgaggctgcacgtgatagcgctggttatccacctcgtagcgccctttacacagcgtcggatagcccgcgctctcatcggcggcgtaacggcacccgcgctgttcggcgactcgccggtcagccacgacgagagatagcagcggccttcggccatgatgcacaggctgccaaaggcgaatacttcgagcggcaccggcgtttcgcgcgccagctgcttcacttggtgcatcgacagcacgcgcggcagcaccacgcggctcagcgcaaagtggcggtgacgttcaacctgcggatagcggctggcggcgtactccagcgtggcgatatcggccagaatcagcgcatcggcaccgttctgtgcggcgacgtcaatggcgctttgccagcggttaaggccgtcgggatgggcgaaggtgttgatcgccacgtgcagtttacgccggtgctgatgcaggaagcgcgcggcttctgccagtttcttatcggccgacgtacaccgcgtcagcgccgtgctccaccgccgatttcagcgcaggcagtgaaagcgggattgccagggcggaatggagaattttcgcacagacacggggcgatttccttgatcccggttgaggcgaaagccgacggatggccggaattcctcgctttaccggtgtcgctaacaccattcgccgtgaaaaaaacggttttgcaacaactcctaaactggcaatttcgtcatgctttggctgaaggtgagttagactttctgcaagggcgctatctcggcattgagatcgcggacgtcaatctgcgctggatcaccacgctgcaggacgggcgcctgaccgtttcgcgcgacgccgaagcagatgtctggtttcgtggcgaagccaacgatctgctgctgatagcagcacgcaaagccgaccccgatatgttgttctttcagcgccgtctggtgattgagggcgacacggagctgggactggaggtgaagaatctgatggatgccatagaactggacgccatgcccacgccattgcgcacggggttgctgcagctggctgcttttgttgaggcaggaatgacacaggacgcgaaggccgctgaggcgcgcgcggggatctcatgcatcgacagcctgttaaagcgcagttttgccaccgcagccgaagcggaactggtacagcagctgcgtgaagatggtttactcacgctgggcgtggtggccaccgatgacgaaggccaggtgctgggttatgccgccttcagtccggtgacgttgcagggcgaggatcgtaactgggtggcgctggcgccactggcggttgatgcctcggtgcgcagtcagggcattgctaaacagctg

SEQ ID NO: 59695 - DNA, 291 bp, Glycine max
  Peptide Sequence Number=SeqID_176473
atggaagagtttgaagaaatcttgggatgtccgctaggaggaagaaagccatatcttttttctgggttctatccctccatggcgagaatagccaaggtggtcaaaatctcggtgcaagaattggaccaagtaaaacaaaatagaaatggggtggtcggaatactgaggaagcacttggaggggaaagcagaggctttggcgaatcaagatctagcggtgatcgacgacttccttgcttaccaccatagcaaagaaagctcggtcgttgttgtgttggccgatgccttatga

SEQ ID NO: 59696 - DNA, 732 bp, Glycine max
  Peptide Sequence Number=SeqID_176474
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtgggcgaaatcagaccattcaccgtgcagatattcggtgacagtctcaaggtattgcgggacatcagccagactggcgatttttacggtatcagtgggagagggggaaccaatttgcggattccccctgcgagtgtcaagccgcagactcacattcactcgctatcaggcatcgatagtcaaaatggtgggctacttgcggctgataatgatctgatctgctatacgcggattttcataggtcgccagtacattctcggctatctccagcgcaatatttgcactatcgactttaaacagcccaagattgggatcaagaaaatagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 59697 - DNA, 366 bp, Glycine max
  Peptide Sequence Number=SeqID_176475
atgtgtgttgttctgatcggtttggggataagtaaagaggggcaactatcagaccctaatttcgtctgggaactattattcactgttgttttgattcttgctaaccaaaaggtattattcgacaccaatttctgcacaaggcgtgagatcgttcaacgttttggtcaaggatgcggaaaatacccaagggaagggcaaaagggtcatttcaagcaattttatgggccctggctcggccaggctatcttctggatcacttgggcccccaaattgtttagggctgaaggaaccagctcacctgggcgagctgcagctctcttgagcgagccagtttcttctggactaagcaacaactcgcttgggtga

SEQ ID NO: 59698 - DNA, 984 bp, Glycine max
  Peptide Sequence Number=SeqID_176476
ttggaactcttacgtgccgatcaacgtctcattttcgccaaaagttggccccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagcactgaaactttctcacaaacagattcgtcctataagtgagattgcactaagcgcatcaaatcaaatgttggcttgtggatacaaaagatcgagctttagcactgctgtttcagccaagcgtgtcagttctaatattgatgacagtataactttgcggagcatgagcagcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 59699 - DNA, 1143 bp, Glycine max
  Peptide Sequence Number=SeqID_176477
atgaaaatgcgtgctttcactctcagcgcagtggctgcgttacttgttgctgcacctctcgccagtcaggcggaaatcaccctgctgaagcaggatccgcaggccggcgatccgcttagccgtctcgatttcaaagtgggcggcagtattcgtccgcagtatctgcatcagaacggggttaacgataaatcttataagcgtaacggctacgacggcggttcacgtttccgcttcagcgccaactactacctgtttgacgatgtcagctgggtgggttactacgagctgggcgttaacttccctgcctggtggggctgggataaccactatgcggacggcgcccataacaccacgcgtcgccagctgtataccggtttcaaaagcgcatcgctgggcgagctctattttggccagcagaacagcgtttattacgatgtcgtcggcgctaaaaccgatatctgggactacgatatgctggcccaggcaccgggcaacggcatcaacggtgactacgacggatcttaccgctcgcgcaagatgctgaagtataaaaacacctttggcgatgcggatgtctatgccgcttatctgtttgaagatgacgactatctgccgggcaacggcctgcgctacaagcgtaagggcggcggttcgctgggtgtgaactatcacatcaccaaagatctggcgtggggcaccgcgtggaactacacccgcgcggatatccgcaatccgggcaatggcgacagcaagcgttacgaccagaatatctacggcaccgcgctgagctggacgccggataactggacgctgtccgccggtgcaggctggtatgagaacttctcgccaaccaaacgcaacaccgttaacaactacttcgcggatgatgcgtggggcgttgaatacttcgccggttataaattcccgatcggccagtatgctgtgaagagcatccagccgtacttcatgggcaatcgcctggagttcgtcaacggacgtaactacaagcgtatcgataacggcgtgggcgtcagcgcgcagctcgactacggtttccgcgtcgactacgagtacgtgatcacctccagtaccgataaatcactgggcaacgttaatctggtgcgcctgcgctacgatttctga

SEQ ID NO: 59700 - DNA, 816 bp, Glycine max
  Peptide Sequence Number=SeqID_176478
atgagtgaaatccgcattgctattgttggtgcgccgggtcgcatgggacgcaatctgattcaggccgcacagcaggcggaaggcgtggtgttaggcgcggcgctggcgcgcggcggttcctcgctgctgggggcggatgccggtgaactggcgggaatcggcaaaaccggcgtacgggtgaccgacgatctgcggcaggtggtgaatgatttcgatgtgctgatcgatttcacccgtccggaaggcacgctggaatatctggcgttctgccgtcagcatcaaaaagcgatggtgattggcaccaccggttttgatgaagccggtaaggcagccatccgtgaagcagctgaagagattggcatcgtgtttgccgctaacttcagcgtaggcgtcaatctggtgcttaacctgttacagcaggcggcaaaagtgatgggcgactatgcggatatcgagattgtggaagcgcatcaccgccacaaagtggatgcgccatcaggcacagcgctggcgatgggagaggcgattgccgacgccatgcactggaagctggatgagcacgcggtttacgcgcgcgaaggccataccggcgagcgcaaggcgcaaaccatcggctttgccaccgtgcgcgcgggcgatattgtcggtgagcacaccgcgatgtttgcggatatcggcgagcgcgtagagattacgcacaaggcttccagccgcatgaccttcgccaacggggccgttaaagccgccgcatggttgaaagataaaaaatccggtctttatgatatgcgtgatgtgctggatttaacgatgttgtga

SEQ ID NO: 59701 - DNA, 252 bp, Glycine max
  Peptide Sequence Number=SeqID_176479
atgtcaggatttacatgcaattctcctcaaatttcagctagcccgcatcaattagaccttgcaccttacgcttcagagccctataatgctcaatggaacgccccggggcttctccgtgacaagcacacgttgcgttcgagtcgtattctcggagaaatggaggttgatgaaccttggctagggttatggctaccattgaattatcaagtggtgttcatcattggaagtgcggtagacagactttgtggttga

SEQ ID NO: 59702 - DNA, 855 bp, Glycine max
  Peptide Sequence Number=SeqID_176480
atgccgccaggctgtgatcctgatggtgcacgatgcgctcgtgcacatattctgtcaggtgggtcggcagcggaccgttggggccaaacaggccaaagctgtaaatcgccacgtcatggcgcgcgtcctctgcgcgcggctgcacgctggccagcgttgccggggcaaacgccagcgacggtttctgaccaatgcgcagcgcttcgaacttcggcagcggcgcacgtcccagcggatagcgctggccgccctgcgcatccagccggcgcagcagctgaaacagatcgtagcgccacgcgccttcctgcccatgcgcggcggccagtagcccacctcgccgcgctgctggctgttgagggtgaattcggtaaagctattcagcgccaccagccgactgcagacgcgttccagcacgctgccgagcagccacgggctggcaccggagaacgcctgttcgtcgacctccagcgtgatgctgacgccgcgcgcaaacaccaccgggcccggttccggcacccggcgattgaccgcgctaagctggcagtggcgaataccgtcaatctggcgcgccaccgccgcttcggcgagattagcgtacaggctcagcagctggcgcagcgcggcggcgccctggccgtcgctgctgtccatcaggctcaggtagttcatctgcaggtggctgatcagacgccacgcggagagcccttcggccagcgccggacgcggcgtcgtcgggcctttacacaacttcagctgaccgaccgggatcgaatccggcatgacgaaattgccctgctcctgctgcaacagcatcagcggcaggtcgcggctggtgcagagcacgtctgccgacag

SEQ ID NO: 59703 - DNA, 243 bp, Glycine max
  Peptide Sequence Number=SeqID_176481
atgacgctgcaggttaagccagaattcaatcgaggtggcgaaaacccgtgccagccggtaggccatctcagtgctgagtttacggttgttattcaccagcgcgctgacggtgttgcgatgcacattcagcatctccgccagatcattcactttgaggttgagcggttcgagaaattcatactgcaggacgtcccccacgctggtgggtttgcgcattgcttgtttcataaggtgctctctttg

SEQ ID NO: 59704 - DNA, 177 bp, Glycine max
  Peptide Sequence Number=SeqID_176482
atgagtgaagtcgccaccaacatttattcaaggaaaacgttagaaaaatcaaaaagaggtctacgaattttgaaaagaaggattcgggagttgtttacgcctggggaagggtcgacaacggggctgcccttgctcctacatatcctcaggtgtgatgaggaattcaaacctacgtag

SEQ ID NO: 59705 - DNA, 420 bp, Glycine max
  Peptide Sequence Number=SeqID_176483
atgacagatcttgtgagcgcggaagatgacgtaaatctccgcgtgtcaacgggcttgtcggccgcgattgacaaagggcgcagaagacgacatagcaaaaaggttgtttatacggataaccactcgggtatctccgcccgtcagcgtgactcaaaagtcagtatgacagatcttgtgagcgcggaagatgacgtaaatctccgcgtgtcaacgggcttgtcggccgcgattgacgaagggcgcaaaagacgacatagcaaaaaggttgtttatacggataaccactcgggtatctccgcccgtcagcgtgactcaaaagtcagtatgatagatcttgtgagcgcggaagatgacgtaaatctccacgtgtcaacgggcttgtcggccgcgattgacgaagggcacagaagacgacgttag

SEQ ID NO: 59706 - DNA, 297 bp, Glycine max
  Peptide Sequence Number=SeqID_176484
atgttgccggtgtcctactacgagaagatggtggtttacatgccttcaagctttgccgatttagtgttcgccggtgaaaggatcgaagtgggtctgagaagaggaaaatttgattgtctcgcattgacaagtaaaaagcctggggcaaatagagagaatgagaagggggaaggaacctgtgttctgactgccattcctacatggccaaattttctacctgctcaacaatttcattactcagccaacgttagcccttttcattacccaccacccaatcatccacgaggccatcactaa

SEQ ID NO: 59707 - DNA, 236 bp, Glycine max
  Peptide Sequence Number=SeqID_176485
gagttgtgatatatcatcctcatgctacaatcattgctgcaattcgttccctgatacacaccaattggaatctcactctcaatcaaacgctaaggcaaggaaacacagttgctaactatttggctaaggaaggagcaaaatctatagctcaattctcgtccttgcatgcttgtcctgctggtctttatcatagtgttgctacagatgtagtgggaacaatgtaccctaggcaataa

SEQ ID NO: 59708 - DNA, 285 bp, Glycine max
  Peptide Sequence Number=SeqID_176486
atgacaggacatgcctcacaatggggagaccagtcagggtcacgctgttttacgagaatgccccaaccatgtgggatcagcacaggcttaaaaaagcactcaaaccggatgacccccaaggcttacactccgaagagtccgtcagggcctcttgatgaggacataaccaagggcaaggaccatgaagcacttgaagggcccatgaccagaggcagacttaaacaagcccaacatgtcatagagacaaagttggtcatttgtatagctgccattgatgatgattga

SEQ ID NO: 59709 - DNA, 156 bp, Glycine max
  Peptide Sequence Number=SeqID_176487
atggaattttctaatccccgagttgcaccatgttttggctaccgaaatttttttcaaccttccagcagtcttggtcagcctccgttgtggctgctgattcattcattaaagcgagtacgcattggtgggtttagacttccaccagaccttgggtaa

SEQ ID NO: 59710 - DNA, 213 bp, Glycine max
  Peptide Sequence Number=SeqID_176488
atggtgaagattcgccataacaaagctacaccttgccatatcaaatctccaaagttgaagaccttggagataacaaaaactagtcacaacaagtcaacctctcaccctagtgagcaaggagtgatcaacctagcttttagggatttggactatgtggaaacaagttcaaatcctagatctgaattgacattgtgcaaggatttgatcgtatga

SEQ ID NO: 59711 - DNA, 1485 bp, Glycine max
  Peptide Sequence Number=SeqID_176489
atggcaagcaaaaatcgtgcagaaaagagggaagagtctggcaaagaagtacaccctgatctgccatcaatttcaaagccactgaaagaaaaaaatacaaagggtgagagacgagcattgcaggaggcacaaagagctgcaaaagctgcttctaaagttgtcctacatccagctgatggaaacacaacagttgctgaaactaggagggcagcccccagtaaaagaatgtggcagtcttcacaaaagaaagatggtcctcttgttatgtcaccagtggctactgacaagaaatcaggagatcgtcctttggagaaagagaggaaaaaagatgctcctcctccacgaatgcaatttgatgataaaaacagagtggaaaaggccaaaaggcgtgctgtagttgatcagaatgaagctagaaacagagttgaattatttcgccatttgcctcaatatgaacgttggactcagcttcctaaacttgaatcaaagtttttccaactggattcagtgcatcctgctgtgttcaaggttggaatgcgttatttggcaggagatatatctgggagtaatgcccgatgtattgaaatgcttagagcatttcaggaagccattatagactactccacaccgcctgggaaagtccttgtcagggatttaactgcaaaaatcagtagttatgtttcattttttagtgaatgcagaccactttctattagcatgggaaatgcaattaggtttgtaaagagttgtgttgccaagttgcctttaagtcatactgaatctgaagcaaaagcagctctttgttcagatattaatcaattcatcaacgaaaaaataattcttgctgataaggtgattgttggacatgctgcttcgaaagttagggatggagacgttcttcttacatatggatcatcatgtgttgttgagatgattcttttatatgcccatgatcttgggaaacagttccgtgttgtggtggtagactcacgaccaaagtttgaaagccgggccttacttcgtagactggtggctaggggcctgagttgtacatatacccatataaatgctgtttcttatgtcatgcatgaggtcacacgagtttttcttggagcatcttccattctgtgtaatggaactgcatatgcaaaggttgggactgcatgtgttgcaatggtagctcatacatttcgtgttcctgtattgatctgttgtgaagcttataagtttcatgaaagggtgcaacttgattcaatatgttctaatgaactaggtgacccagatgctgttgccgtggttcctggaagaatggatgtcaattatctggacaattggactaatcaagacaatttgcagcttctgaatttgttctatgatgctactccttcagattatgtatcggccattgttacagaccatggaatgatccctcctacaagtgtggccgtaattgtgcgcgagtatggacgagagcacttgatctag

SEQ ID NO: 59712 - DNA, 2008 bp, Glycine max
  Peptide Sequence Number=SeqID_176490
tctccctcgtatcactttcactatcagagacttcaagggtatcaaccctattaaccaagacgaccccatggttatctctaccataatcgtcaacttcatggtgtccaaggcccttattatcctaggaagctccacggacatattgtattggaaaatatttcagaggctcgaactctcatctgatacagtccatcctcactctggacctctcctcgaatttgaaggagaaaaatgctacactggaagcctaagggtggcaccttatcatcccactagggaacatgacagtccttaccccataacaggtggtggcacccaagtcatgagcgtgaatgaagggtctccaatccgagcactgaccatctacgaagcgagcttggatggcatatttgatgtagatccgcatgtcgacaccgctgacagaggcccaaagcttattgaagaactcatcaaccatctgaaatgtcgggtatccattccaacattatatgccacaagctttccatctgtccccaggccaaaccagtatcacaaaagaagaggaagatgggataagagcgaggccaacagcaaatggcggatgtgcaccgactatatcgatctcaatagggcatgccccaaggatgcatatcctttgcccaacatcgattggctagtcaatgaagcatctaagttccaagtctacgtcaatgacatggttgtcaaatctcaaagcatagcccaacacgtggcagatctggaagacgtatttggagaaatctacaagtattacatgcgcctcaactcggaaaaatgcactttcggggtcaacggaggcaagttcctagggttcatgatcacacatcgggaaattaaagccaaccttgacaaatgcacaaccttactaaagatgtacaatcctactagtgtccaagaaatccagaagttgaatagtaaactagcatccctatccaggttcctcctaaagcttaccaaaaaagtgaagccattctacaagctgctcaggaaaactgagcctttcctatgggatgaagcctgcaagcaagccttcttggtcttcaagaagaccattaccacaccgtcgatcctgagtaaacctaggccaggagcaccgttactcctatatctcacagtagctgacaaggtcgttagctccacccttgtacaagaagaagggcttgaacctacttcatgggaaacaccagcccaacgcctcaggccatacattcaaagtcaccaagtgatagtcaagacgaactaccccatcaaacagcgacaagcaaggacggctcgtggtggctactggtggttgtgggtggtggaggaggagtttctagggttgtttcacgttgaagaacgtatttataatctgcagatcttgtttaatgagctcgtctcgctaaccaaaaatccatttttggcattgagcgtgacattttgcgttgagcataattcctctcaggttgggattttcgctaagcgtgacatttcgcatttagcgcaattcctctctggtgatcgaatggttaacaagtgcaagactatggttttaccggaacaagtaggtctgtccttggtgagccctgacaaaacccaagataaacgcattcttggtcgcaggtccacaagctcgtcaaacccaaggtctgcccttgtctcacaggctcgtcaaacccaaagtccacccttggtgaatctcgcttctccaaaggctcgtcaaacccaaggtccatccttggtgagtctcacaggctcctcaaacccaaggtccacccttggtgattctcacttctccaaaggctcatcaaacccaaggactatccttggtgagtctcacaggcttgtcaaacccaaggttcgcccttgtctcacaggctcatcaaacccaatgtctgcccttgatgagtctcaaaggctcatcaaacccaagtctcgtcaaacccaaggtccatcattgatgagttcgcttctcctaaggctcgtcaaactcaaggctcatccttggtga

SEQ ID NO: 59713 - DNA, 372 bp, Glycine max
  Peptide Sequence Number=SeqID_176491
atggggttgtcccatgtcaggatggatatggccaaggtaggctccaagatctcgcaggtcagactgagagtagtctttgttaagaggacaagagggggggcctgcaaaacaaaggactctgatgctcaacaaagccttgttgaacacaatagtgactctaaatcccaggcctccgtgccctttacatttagtgagttttccccatttgagtcaatgaattttcctatcatccatagatcctccccagaaaaatcttgcagtcatcctgtcaatatcatcacaaagagtttttggcagtttaaagcatcccattatgcagtccaaggtatttgtcatgactctccactgcctttacatccaacaaccttgtga

SEQ ID NO: 59714 - DNA, 255 bp, Glycine max
  Peptide Sequence Number=SeqID_176492
atggcccattcccataatagcataggcagcattttcaactgcagagtatttgcaatcaagcagcctcatgtgtcaccagtgaggcccatgatatctgcagtgtctgtgctagacagttcaaccaacatggatttttctcaaattgatctttctagattacaagtccctcgtacccctccacaaaaaattccataccgaatctgtcctaacccatctgcaattatttggagatcaaggaagtctaggagaaggtga

SEQ ID NO: 59715 - DNA, 359 bp, Glycine max
  Peptide Sequence Number=SeqID_176493
ttgtgcaagagcctcagcaagttgtctctaccatcccaagcttgtttggctcatctgatcttgctgacaaagcagagggatcatacgatgtgttagtatgtggaggcactctggggatcttcattgccacggccttgtgtgctaggggtcttcgagttgccattgtggaaagaaatgtgctaaaagggagagatcaggaatggaatatatcaactaaggagcttttggaacttgtagaagttggggtcctggaagaagatgacattgaaagagccacagcagtaaaattcaatcctgtaattcctgaacttcttcagtttagtttccaatctatatatagcaagaatcatctcaattag

SEQ ID NO: 59716 - DNA, 1284 bp, Glycine max
  Peptide Sequence Number=SeqID_176494
atgaatattctattgacattttggtgtgcattattaataacaagcattcctctatcccactctgctaccatactcagcatcccactatacaatagggcaatgctgaaatatgacacattcaagccacatgcaagatttcattattatcctaacacgaaagtcatatcagatatatattctgcagatgatgcctacgcaatgttcttgtgggtgggtaccccagtgcaaattgtgttcgttatgattgacacagggagccccatcacatggttccaatgcgacccttgcagcaactgctaccccatgcaacgccctcccttcaacacacgtgcatcaacctccttcaaagaacttggctgctactccgacacgtgcctcatccctatgatgaggggcatttttggaaactgcactggatggacttgtaggtacaacatgcaatatgaatatgattatgccaacatgtctcaatctcgctcctttggtatgatggtaactgaaaccctcaattttgagcactccaacattcaagtcaaggactttataatggggtgtggggactcatatgagggaccctttaggactcaattttcaggagtttttggccttggacgtggtccactttcagtgcaaagtcaacttcatgcaaaggccttttcattttgcgtagtgagtcttggatcagagaaaccctcttctcttgagttttatgacacacaaccacctaaaacaaaccaaaatggtaacaccaatggttctattatggttcccttgagtgagaacaataggtacccttactattactttgtgcaatttgtgggaataagcattaacgggttcatgttggatattcaatctagagtttggggttatggcttgaactatgatggtgggattgttatagatatgggaactgtgttaacctatttgccaggggaagcgtatagtgtgttcaggtcagagatacttaaaacaaatggtaaccttactaagaagtcggggtttgaagagttagagttttgctacaaagaagatccaaccaacgtgtatccaaccattgaatttttctttcaaaatggtgatattgcgggtctaaattttgtgtccttcaagttggacaacaaccaattgctcttacaagttgaagagggaacagtttgtctatcgtttgctgaaggaaaagattctgcacttactgtgattggcagtaacaacctccaaggaaccctgttaacctatgatttggttaatgagatccttgttttcacttacaataagtgttag

SEQ ID NO: 59717 - DNA, 888 bp, Glycine max
  Peptide Sequence Number=SeqID_176495
atgcatgagttctccattgttgatggttttgtggagataagtgaatgcatggcagagatgaccaagtacgtggctaatgaaccatccgttgggcttttctttatccaacagcatgctcaaaatgcagtacccaatatcatcaaagttaagaaaaatgttgttgagaagtctcatgaaacaactttgcacacagaagatttggaggactctgtcacaatggttcaatcaatgaaagagtgtggatttcccatagctgataagatgatcagagagattaaaaaatctctgataactatggaaacaaaacaaccgaaaagagggttaatccatccagcatcaagttctcattcagaaagagctagtttcttgggtaacgctgcattttatgctcaggagggcaatgaaaaaaggagtaactatttctcaaatgttttgaagtcagcaaaagagaaggctggcagcttcaagtggcggcagcttgatactcggggatcaatagattccacggatgagaagccaccaatgtaccctaatttgccgttgttggtcacatctgcaagcattacttcatcttttcgggctgccgaaactgatgagttgcctgtatcaagccaggttgaagacgagtctcagcacaaacagaccgatgttagtgatatcagcattaatttattgtcagtatcagaaagattcgacgacttcaaagctaataaagaagctaaactagcggagtggctggacggaactggcaaccttgatgataattgcggcacaggtgatgagaaaagtatgactgcaatcaaccatggcaaactagatgatgaaaacatacccaaagaaatgtatgggataagcggacgtgaacttttcaacgtggctgctccatga

SEQ ID NO: 59718 - DNA, 456 bp, Glycine max
  Peptide Sequence Number=SeqID_176496
atgacgcgcctcagaaaactcggcaccgtcgccacggccattgccaccgcgtacggtggcgccctcatcctgcacgagcctctcgtctccgccagcgatcacggaggcggttcccgcctcgaggcactccggaagaaggtgcacgactccgacgccgtcgtgccggccaggaaggcgcagctttcagcgctcgaggccgccggaaagtcgaatccgctcgacgttctcgtcatcggcggcggcgccaccggttccggcgccacactcgacgccgtgactcgaggactccgcgtcgggctcgtggagagggaggatttcgccgccggaacttcgtcgcgatccacgaagctccttcatggagggatttgcattactgttgcggccatagtcgcggttgccatacacaccttgacatggcggcgcgtggcggaccgttttttgaaaccttggttataa

SEQ ID NO: 59719 - DNA, 243 bp, Glycine max
  Peptide Sequence Number=SeqID_176497
atggaactatacccgcagcatgtggctaaccagcaggcggccaatcataggggccatgtgcagttgaatgagagcttttatcagtataccctgcatcaatcgcgccaggatcccaatccttactcgtggcttactctcgaacccagttttcaggcaggggcaagacccacatgggtcccaggagatgaagatggagctcaggaagatgatgacatggccgatgtgatggacttcttcctttga

SEQ ID NO: 59720 - DNA, 1584 bp, Glycine max
  Peptide Sequence Number=SeqID_176498
atggccgaagcagaacacaacgatcccacctcgccggagcgcgaggaccaaaccaaaagcaacaaaaagaagctccgaaagagaaaaagacctcaaaagaccgagcagaaacaagaggaggagaagaacgatgcgaacattgatagcgcccaaacacaaactgaagatgaaggagagaatcaagaagacacaaatgtgaacaacaacgtctcatctggaatcatgagcaccgagtctttctcctctctgggcttgtccgaacccacttccaaagccattgcagacatgagcttccaccgtatgactcagattcaagcgaaggcaattccgacgcttctgaccgggaatgacgtgcttggtgcggcgagaacgggtgctgggaaaaccctagcgtttttggttccggcggtggagttgttgtacaacgttcagtttacgccgcggaacgggacgggtgttgttgtcatatgcccgacgagggagctggcgattcagacgcacgccgtggcgaaggagctgctgaagtatcactcgctgacgcttgggttggtgattgggggttccgggaggaagggagaggcggagcgcattatgaaaggggtgaacctgttggtggcgacgccgggaaggcttctcgatcacctccagaatacgaacgggtttgtatataaaaacttgaagtgcctcatgattgatgaagctgacaggatattggaagcaaactttgaggaggagatgaagcagattattaacatacttccaaagaaaaggcaaacagctttgttctcagctacacaaacaaagaaggttaaggatcttgctcgcttatcatttcagacaactcctatctatattgatgtagatgatgggagaaaaaaggtcacaaatgaaggattgcagcagggctatgttgttgttcactgtgctaaacgttttgttgttctctattcattcttgaggagataccaatcaaaaaaagtgatggtctttttctcttcatgcaactctgtcaaattccatgcagatcttctcaagtgcactgggttggactgcttaaatattcatggaaaacaaaagcaacatgcccgcactactacgttcttcaacttttgcaaagcagaaaaggggatcttgctctgtactgatgttgctgctcggggacttgacataccggatgtgaatccaatggaagatgcaggcgcaccaaatttagtagggtacccaagaaccctccaagaaagaaacgactggattgtgcagtttgatccacctgatgaaccaaaggaatatatccatagggttggtagaacagctcgtggggaaggtggaaaaggaaatgctttacttttcctgattcctgaagaattgcaatttcttcactatttgaaggccgcaaaggttcctgtgaaagaatatgcatttgatcataagaagcttgcaaatgtacaatctcaattggagaagttggtggctggcatttatcatttgaatgttatggctaaagatgcatataggtcatatatattagcatataattcacactccatgaaagatatattcaatgttcaccgccttgatttacag

SEQ ID NO: 59721 - DNA, 180 bp, Glycine max
  Peptide Sequence Number=SeqID_176499
atggtcgctgctgtagaggtggtgatggtgcatctgcggctggctgctggtggtcctaccccgactactgtgcttgcctcggcatgcaatgagcttcgtgggcgtaaccagcagcccatagaactagcaaatgttggatcaagtggcctcagaataattaagaatggggggttgaattaa

SEQ ID NO: 59722 - DNA, 705 bp, Glycine max
  Peptide Sequence Number=SeqID_176500
atgtatggtgaaattgaaaggttcatcaaagtatggatttcagccatcttaggtttatgttattgttattacatagctgcaagaataccaaagggcttcttgagacttctctcccttctccctattctctacctcttcatcatccttcccttgaacatctcttcacctaacttagttggatacacttccttcttccttgttcaacttggcattttcaagcttctacttttttccttcaacaaaggccctcttgccctatcacccccaaacattgtccatttcatttccatagcttccctccccatcaccccaaaacaacatccaccaaccaataaaaataacaccaccaacacccaaaagccaaaatggctattgcccttaaaattgcttatttttgcaatgatcgcacgtttttatgagtacaatgaatacttccaccctcatttcatattagtcctctattgtcttcacttgtaccttagcttagagcttgtttttgctcttattgcaaccccggttcaaaccctttttggcttagagatagaaccacacttcaacgaaccctacctttcatcctcacttcaagatttttggtgtcatagatggaaccttatggttagacatgacaagaaaactcataccggtgggtatccgcccgaatccatcctgactttaatggataatacccgagttaaccggatatag

SEQ ID NO: 59723 - DNA, 1200 bp, Glycine max
  Peptide Sequence Number=SeqID_176501
atggccatgctgccactcacaaaccccactccaattcgctacaacgcactgccttcctcctctttcgttcaaagaaactgcgtttccctgaaccctagaagcagaaggtgcgccttcgaaccccagcgacgtcgtttcgcgtccgtgacatgctgctccttctcgacagtcgacagcgctaagattaaggttgtcggtgttggcggcggcggcaacaatgctgttaaccgcatgatcggttgcggattgcacggtgtagaattttatgctataaatactgatgctcaagcactgttgcattctgctgctgagaaccctatcaaaattggagagcttctgactcgtggattaggtactggtgggaatccacttttgggggaacaagctgctgaggaatcaaaagaagctattgccaatgctcttcaaggatcagatttagtgtttgtaactgctggcatgggtgggggaactgggtctggtgctgccccagtagtggcccgaatagctaaagaggcaggttacttgacagcactggaagccattgaaaagctgcagaaaaatgtggatacacttatagtgattccaaatgaccgcctgcttgacatggctgatgagcagacacctcttcaggatgctttccgtctagcagatgatgttctacgacaaggagtacagggaatatcagacatcataacaatacctgggcttgtaaatgtggattttgctgatgtaaaagctgtgatgaaagactctggaactgcaatgcttggtgtgggtgtttcctccagtaaaaaccgtgcagaagaagctgcagaacaggctactttggctcctttaattggctcttctattcagtcagctactggagtagtgtataacattactggggggagagacataactctgcaagaagtgaacagagtgtctcaggtggtgacaagtttagccgacccttctgccaatattatatttggtgccgttgttgatgatcgctacaatggggagattcatgtgactatcattgcaactggcttctcacagtccttccagaagacactactaacagatccaagggcagctaagttgcttgacagagagcttgggggtcaagaaagcaaggcagtgtctcctcctctcaagtcctcaaactatccatcaacggttgcatctagagcatccccacgaaagttcttcttttag

SEQ ID NO: 59724 - DNA, 510 bp, Glycine max
  Peptide Sequence Number=SeqID_176502
atggcatcggatgcaacagttaattcggttagtgatgtgaacaatgctcccaatcctacaaaatcagtaggtccttcctatactccgtctcccacagcttcccttcttctccccgccgccactagcactgcttgtggcgccctcaccggctcccttttcggctatggtgctggattgattaagaagaaaggctttaaaggatcctttatagaagcaggatctaatgctaagacatttgcaattttatccggagttgatagtgtggttgtctgcatattgggaagacttcgaggaaaggatgatgccattaatgctggggtagctggatgctgcgctggtcttgctacaagttttcctggtacaccccaatcacttctacagtgctgcattgcttatggggcactttcttttatcattgaagggttaaccaagcaacgatctgcacttgcatgtcccatgtccaagaaaacaagtgtacgcaaccagggaataattcctacatctcattga

SEQ ID NO: 59725 - DNA, 672 bp, Glycine max
  Peptide Sequence Number=SeqID_176503
atgagtttcgtgccaaaggagacaatcgaagtcattgcacagagcatcggcatcaccaatttgtcctccgatgttgccctctctctcgctcccgatctcgaatatcgcattcgcgaaatcatgcaggagtcggtaaaatgcatgcgccattcaaagagaacttttcttactacagaggatgtggatactgcacttgcattgagaaatttggagccaatatatgggttcacatctaatgatcctccacgattcaaaagagctgctggacacaaggatttgttctacattgacgacaaagatgtggatatcaaagatattgttgaagctcctttaccaaaagcaccccttgatacatcaattactagtcactggttggctattgaaggtgtgcaacctgcaattcctgaaaatgctccagttgaagctccgtctgagataagaaaatctgaatttaaggaagacgggcttcctgttgatgttaaattacctgttaaacatttaataacaagggagcttcagctttactacgagaaaataactgacctaactttaaagaagcctggatccattccttttagaagagcattggttagcttgtcagcagactcgggactccatcccttagttccttatttcacattttttgttgctgatgaggtggcacggaattaa

SEQ ID NO: 59726 - DNA, 858 bp, Glycine max
  Peptide Sequence Number=SeqID_176504
atggccctcggcctttcctctatgagatcaaatttctccctttcttctatggcaggaggtagtctctccactgagaggattgaagccaacattgacaaatgcacttccatactagagatgcaaaacccgaccaatgtccaagaagtccagaaactgaatggtaggctagcatccttgtccaggttcctcccgaagctcgccaaaaaggcaaagctgttttacacactactcaagaaaacagagcccttcctatggggtgagacctatgaacaagccttcctggctttcaagaagaccagaactacatcaccgatcttgagtcggcccaggccaagagtacccttactcctatacctttcggtagctgacgaagccgttagctcgacccttgtgcaagaggaagggaaacatcaactccttatctatttcactagttgcatacttcatgatgccaagaagcgctaccaaatgggaagcgggggaggaattatccttgaaggccctgacaatgtcactctagagcaagccttcaagctcaactttagagccttaaacaaccaggcaaagtatgaggcgctcattgcaggtctgaaactagcaacaaaagttgaggccaagaagctacgatgctatacaaaattgcagctcgtccagggacaagttgccaacagataccaaaccaaggaaatagtgctactcaagtactaccagattgccaaaactctcatcgataatttcaaatgcttgaaaatgtactacatacccagagagaacaacaccagaaaagacttactttctaagctagccatcaccaaaaaggcgaggcacctcaagactatcatccaggagatgctctaa

SEQ ID NO: 59727 - DNA, 945 bp, Glycine max
  Peptide Sequence Number=SeqID_176505
atggcaccctcgtccaccgtcgttgcacttttattgagtgtcgatgtggtgaccaccagttcccctgtggcacctcctccttcctcttcggctctaatagtcccttcctccacctcctctcagccccgtgtttcactggatcacatctacacttccaatgatgttgatttcttgttaggcatgggggtgactgcttgcactgtctggagagtggagcgtcctaaggtagttggtgccactattgcttttgttaaggctgtgaggtcgaaccaccaactatcttttaaagttggtagtgtgttggccaagttgttgcacactaggttggatgaattgttcaaacgttgcaaggacttgcaggaagagaaaaataacttggctggtagggtagaggatgttgtagcagagaaaggtaagcttgctaagaaggtggcggatcttgaggcccgggcgaaggagtcagagtccatgctaaaggagaccgagctacaggctactgcagagagggaggctatcaagaagcttgaagatgagttgctaattttcaagagggaggccatggagcaccatgaaaagggcttcaacaaggtcgaccttgacttgggtctctttgaccctttcaaggacgtgaaggatggtgttttgcttgacgaatacgatattgccgctgaaaaggaggccgacaaggaggagcagggtattatggggcaaggccatattgaggataaatgtggaatctttaacagtgtaggaagtcttgtcacccatctagtggggcttccttctgctttgcggagcttctcccctgatgcttgtgaggagagtaagcatgagtttcacctgattgaaggtcttgtcactcaatctaatgatggtctcgtggtgatttatgttgttcaacttggacctttgaatgtggtcgtcgtagttgttatgagtgagtag

SEQ ID NO: 59728 - DNA, 198 bp, Glycine max
  Peptide Sequence Number=SeqID_176506
atggtagtagttggttcagatttgcgctattggagacacggggatgaggggccttacaacttagatcaaaagtttgtaatggaaatgcttgctatgttggcttcatgtctggtacaaaccgttctgaaagttaataactttaggtttgcccatattggtgaaggtggtaaaattgaaggatctatggtactggattaa

SEQ ID NO: 59729 - DNA, 300 bp, Glycine max
  Peptide Sequence Number=SeqID_176507
atggagaaatttaataagaccgtgtttgatcagaatcccgtcgcaatttttggggtttccaaggttctcttgccgagggagatttttgggagaaatccgatagtttctgctaagcctcttgataatgctcctccaccggatgatgatgctttgtcacaggagaattcaccgggatttgatggacaaacctcacacctatcgtccccgccaggctttcgcgaagatgtgaggtctcatgctggtggttccttgaactttgttgttcttctttgctgtataggcttgtattttgtggtatag

SEQ ID NO: 59730 - DNA, 1296 bp, Glycine max
  Peptide Sequence Number=SeqID_176508
atggcaccctcaattgttttgtctctactaccccttcttctggtttcaacttgttgttatgcgcaaccccttgaagagggttttatctctggggtcatatctgacaagggtcttgaatatgccaaggagttgttgatagagaaaggtattgcctccattgttatgcttcagctgccagagattgagaattctgcccaagtccctttggttggaaatgctaaagtggttctttctgacatcacaatcaaggatgttgaagtcaattcttcatctgttaagactggggagagtggcattgttctagtgatttcaggtgccattgctaatatgagtatgaggtggaggtacactgtcagctcttggttaatcccatttggaatttcagatagtgggaatgcttcagtgaaggttacaggtatgcaagtgggactcacagtaaatataaggaaccaagaaggaactcttaaattggctctcttagattatggatgttatgtgggagacttatctataaagttggacggtggtgcatcttggctttaccaattgctggtagatgtttttgaaggggatataacatctgcagttgaagagggtatttcagagaaaataaaagaagggataatgaatcttgatcattttttgaaatctcttccagagcagatctcactagacaaaactgctgcactaaatgtttcttttgttggcaatcctgtgttgagtaactcctctattgctattgcaattaatggtttattcacagggaaaaatgaagttttagtacctcaacgttactaccagaaaggaatgaagatttctgctgcctgtggtggtttacaaaagatgataaaggtttcaatacatgaaaatgtgttcaaatctgcttccctagtttactacaatgcaggtaaaatgcaattgattattgatgaactgcctgatcaggacattttgaacactgctgaatggagattcatagttccccaattatacaagcgatatccaaatgatgacatgcaacttaatatctctatatcttctccaccagttatacaagtgacctaccaagacattggtgcaactatttttgtagatataacgattgatgttctggaagacggtgaagtcatacctgttgcatgcatctcagtggaaattagtgcttcatgtgctgtggaaattgaaggaaacaatattgctggttggctcagattacaaacattttctgcatacttgaagtggagcaaaatagggaaactgcacgtgcgtctgatccagggcccttggggtgcataa

SEQ ID NO: 59731 - DNA, 648 bp, Glycine max
  Peptide Sequence Number=SeqID_176509
atggcacacattgcaaacggaagagacacaggaaactgtgtatctctacttcgagtaaatagtgcaaattcgagccagagcaacatgttgatattacaagagagttgcaccaattcaacaggctcttttgtcatttatgctccggtggacattgttgcaatgaatgtggttctaaatggtggagacccagattacgtggcacttcttccttcagggtttgctattctccctgatggaaccacatcgcataatggaagtggtggcattggcgaaactggccctagtggttctctcttaactgttgcgtttcaaatattgaacctcagaacctcagaacttctggaaggagttctgcaagggaggaatggatcagttttctgttatggtgccagcggagccagaaaaacttacacaatgcttggtacagtggagagtccgggtgtgacggtgttggcaattaaggatttgttcagtaaaatcaggatgagaagttgtgatggaaatcatgctgttcatctgtcctatctggaggtttataacaaaactgtcggggattgctttcacctggaagacctctggttctcagagaagataaacaggtttataaaaaggaatttcaacaatgtaattaaagtcacgacatattag

SEQ ID NO: 59732 - DNA, 120 bp, Glycine max
  Peptide Sequence Number=SeqID_176510
atgtcttatgggtcattgattgtcgtcggtgatatctcgaccactccttttctggcacaaaggatgaagctctacaagaatcctgacgggatgaagctctacaagaatcttgacgggtga

SEQ ID NO: 59733 - DNA, 546 bp, Glycine max
  Peptide Sequence Number=SeqID_176511
atggtaataggaatagggcaggaggacaacatgggaatagataaagtgaaggggattgttgcagcaggtcttacacaataccgagcttattccaccgatgaagtgatggcattacttcaacaaggaaatcagaacagaaccacagaatcaacccgtgctaatgaaacatcttcacgctcccatgctattttgcaggttgtggttgagtaccaagttagagatgctgcaatgaatattattaaaaaaatgggcaagctctcagctattgatcttgcaggttcagagagagctcttgccacggatcaaagaacagttagatctcttgagggtgccaatcagtacaaactgcaaagaattgaagagtcgaagctatcgttttcggtcaccagtacaaactgcaaagaaacgagcttttgggacataactactgccaacagcccatcagttaccacattgaatgggagaaaaactagaagtcatgtcatttctgaaactacagcacatccatctgtgcttcttcaggtctcgtgttttttattctcctga

SEQ ID NO: 59734 - DNA, 315 bp, Glycine max
  Peptide Sequence Number=SeqID_176512
ggtggtggtgagtgcaagtatcacattccccattaccatccaagacagaaaaggaagaattggtctgaattggggtctggaggtggttctaaagatgttggtagagggtgggatctagtgttgtggagtagcatggaacacttcagaaagttggatggttgtttggtgttagcgtcaccgatgagggaagagataaagaaggtttttggaggtgaacttcctgaaagaaggcatgaggacggtggtggtgatcatgtgagggttagtagtggtggtgaagaaacaagtatctgggagacaataatcatcctctga

SEQ ID NO: 59735 - DNA, 321 bp, Glycine max
  Peptide Sequence Number=SeqID_176513
atgaaaagcttaattacatggctagtcaaaatcgccaaggttacaaccaaggcgataatcatgattatcatcaaggtggcaattacaatcaaaatcaaggccaaagttggaaatttcatcctaagaataatttcaacaaagattaaggagataaatcccaaggagcattacaaggttgtggttgcaaggagtaggcacaaggataatgttgcctatggtgttaagtgtgagggtgatgtagttagtgataatgagggggtgacagatgaagataagggagaaaaaaataaagaaaaagatttaagtgttgaaaaatgctag

SEQ ID NO: 59736 - DNA, 231 bp, Glycine max
  Peptide Sequence Number=SeqID_176514
atggatgatcagagttctatgtatggaatattatccataactcctcctaagtccaacaatcttatgcatgatgatacaaaggtggttgagatggtggtggatgatttggttatagtggtcgtggggtaccagaaatggatgaggagaggaagagtttgtggaatacttactggtggtggtggtggaaaggcggaggcggaagcagagcaagtgcaacaacaacaacattga

SEQ ID NO: 59737 - DNA, 555 bp, Glycine max
  Peptide Sequence Number=SeqID_176515
atgaagaatatcctaggcctacaagctccagtggagcttacatcacaaatggcggaagagaagccacctagcgttgtgaggttgattgtgcaagcagccaatgtatcttatccctcctcactcatccaattgatcagtgcaaatcaattccatggagatccttatactcatcttgcaacatccattgagatttgcaacacaatcaagcttgtgggagtgtcgaatgatgctaagcattggctcttttcattcaaaggaaatagcttgcatacttgggatgagatcgaattgaagactccagaggaagccacaaagcttattgaaaatatggcggctagtgatcatgtcataattcagaataggactcatggatgggtaactaagtggaaagtgttgtggtatcctcaacaaggcaagtttggcaagggttggtatggtttttgtagatggctagggctaaaggaaggtgatgaggtgatcttccacaagttccatggtgtgagcatggtctttatgttagtcaaaccaattgacatgttgtcaactatggagtga

SEQ ID NO: 59738 - DNA, 828 bp, Glycine max
  Peptide Sequence Number=SeqID_176516
atggtaccaaataggattttccctaggttgcctatttgtgatgaaggcaaaaagaagaacgtcaagctctacttcaacatggaaatgcctagcaaacaacaacatgttcaactggtcaactatctaagggactggaagactttgttcagaggtcagaagctgataagaaagctaaatgttgatgaagcaaagacctcttggaaccagactgtgtggattgacactcaacatgatgtttcttccaactttgacaaggtcccaatctcaaatcaaagagattttatacatgttttgcgtccaacatgggtgtatcattctgatgatacaaacagtctgaggaaattgtcaatcatcttcaaccacaacgtctttgacctttgcaaaatgagtcaagcaaagttcgtagcccgggtgaagcacttatgtgaaaagaaaaaacctgaaatgactcagtatgaacaaacatggaaggcaaggcttgcagttgaggtaaagcagaagattgaggtagaagctagaaggaaggtcattggcaagaggaaagttaaagcaaatgctactaaggatcaacctggaaaagaagtagatgcgttcattcctgccttaattgttgaagcaccaataaacaaagttgattcggatatgactaaaccccaacaatcagaaaccgcatatgaagctacgtccgaagatactattgttgtcacagttcatacaacaacctctgaatccattcctattaactatgcacctccagaagttgtgaccatgtatgaagttcaagagatgattggtcaagctatgaacactgttggagaaggtagataa

SEQ ID NO: 59739 - DNA, 723 bp, Glycine max
  Peptide Sequence Number=SeqID_176517
atgataatgatgtcccagcggcgaaggcctaccgcatctgcccgtaggcagcgacaagaggcgcgtattgttgaggatcctcgtacgatcgtagaggaattaaatgaagagcaacaacaaccacatgttgaaggtgttattgatgttgaaggttttctaggtggaccccatgacacatcaattttgagagattttgaaaatcacgttgctttgagaatttggaatggagagaaaactagtagtttccatttgctcataggagaggcgactatcaccttggatgatgtggcgttgttgctgcatttgctgatcataggggcattccatagcttcgagcagcttcatgtcgacgatgttgtctatatgttggttgaattactcaaggtcagcattgtagaggcaagagctgagacgattcaatgtcatggctcttatgttcgactatcctgcgtcaaagagcacagcgaggtagcttgcaggatatgtcacactctgttacagtgttggatctactggcatttctcatctgttgatttcgcaatagctattgaggattatgaccagcagagaccgcgtgcatgtcgatggacctcgagcaaggcgttacccgtgtcgacatatcataggcgtctgaatagactgacccctgatgttccaggggatcctcttagagtttcgccgattcggcaatatgacatatttgttgaaccagatgtgcattag

SEQ ID NO: 59740 - DNA, 860 bp, Glycine max
  Peptide Sequence Number=SeqID_176518
atgataaagagagtaacttaccttgaaggagaacaaaaatgcgtcaatgaacgaagaagaagaagcttgctgcgtgaatggaagcaagaaagaacatggaacgaggaagaagctaggaagaagaagaaccaaagaagaaggagtggcaacgaaggaagaagaaaaacaaggaagaagaagcaacaagaaaggagcaatatcagaagtgacttatactttcatgtgaacaaatataagagcaataggatagagtacttttttgtggggggccaaatggggaggtgtcagttcgagatgaacaaagtcacagctagaagctctcaagaaatgtcttccaagaggcaccactttcattggacaaataaggttgggactgaggatggcgaagttcccacttcagaatcattctcaacactcatcaaagaggagaaaaaacatgaagacaaggtttctattgttgctgctgctgccgaggcaacaaaagcaccagcatctcatgtaacaaggaagaagaagctgcaagcagtggcagtctcaagaatccggtctgtgctcaccgtgttcaacaacaacagcaacaacaaccgatcctcgaactcatctttaggcctcggctcgcgcgtggtcggaaccttattcggctatcgacgagggcacgtgcactttgcattccagaaggaccccacttcccagccagccttcctcatagagctggctacgccaataagtgttcttgttcgcgagatggcgtccgggttggtcagaattgcccttgaatgtgacaaggagaaagaaacagagaagaaacatgtgaggctgcttgaagagcctctgtggaggacttactgcaatggcaagaa

SEQ ID NO: 59741 - DNA, 468 bp, Glycine max
  Peptide Sequence Number=SeqID_176519
atgacgaaaattattaaagagatgttgcccccggacgtgcgtgtcgccagagatgcacaggatttattgatcgagtgttgtgtcgagtttataaaccttgtctcgtcagagtccaatgaagtctgtaacaaagaagaaagaaggacgattgcaccggagcacgtgttaaaggctttaggggtttacaatgtttgtagcacaatactattttatcttgggcagtggttcaattttctagttcttggatttggcgagtacattgaggaagtttatgcagcatatgaacaacacaagttggaaacaatgcaagattctttaaaaggtgcaaagtggagcaacagagctgagatgactgaggaagaagcattggctgaacagcaaaggatgtttgcagaggcacgtgcaagaatgaatggaggagccattcaatccaaggagccagaggctgaccaaagtttagagagctaa

SEQ ID NO: 59742 - DNA, 525 bp, Glycine max
  Peptide Sequence Number=SeqID_176520
atgaagcatatttctacttgcaaaaaagaagtttttttattaattggaaaatttgtttcactaggttttgctattggtaatgggttaacaaatcctgcaattcaatacccagaatacccagactttgcattagacaacaaaataattacaaaagctcaacatgatgatatcatcaagtcaatcccaggctgtgaagaagccacaaaaaattgcgaatctaaaggtggacaaagttgcgagactgcattaaatgtttgtcaaggcatattcgatagtatcttgtctatagccggagatattaattactacgacatcagaaagaagtgtgtgggacaattgtgttatgacttcaacaacgtggagaagttgttaaacctgcataaagtgaaaagagctttattagagaaagggattaatgttctagatccaacattttggtatccagagcctaatcgagcctgggatcgggaaacacgagtgaaatcagtgaggtttcaatttgcaatttgggaaacacgagtgtga

SEQ ID NO: 59743 - DNA, 783 bp, Glycine max
  Peptide Sequence Number=SeqID_176521
atggagaaggtgatgaacattctgaagccgaagccaaacccgcagcaactattgagggattggcagcgcaggcttcgccaacagtgtcgcaacattgagcgccaaattcgcggtactcctctctctcaaaaccctaattttaattctcttttttatatatacagagagaagaaaaaaaatgtgcagaaggcgattagagaagcagcaaagaggaatgacatgggctccgcaaagcattcctccaaaaacaaccttggtcaaggtcggccaaaagcagtcttggtcaaggcacttactaaggaacttgtgagatctaggaaaacggtgaaccgtctttatgaaaataaagcacaaatgaattcaatatcaatgcaccttggagagagtgttgcaattgctcgtacggtgggacatctatcaaagagtgctgaggtcatgaaacttgtcaacaacctcacgaaagctcctgaaatggctgtggcaatgcaagagttcagcaaagaaatgacaaaggcaggagttatcgaggagatagtaaatgatgccgttgacacagcactagattctgaggacatagaagatgagatagaagaagtcgataaagttctgaccacaatagctggcgagacagccacactacttcctgaagctgtgaggaaagaaagggtgaagcaacctgctcaaagtgttggagccgcagaggaagaggctattgctgagggtgttgatgatgaagaagaaatggaagaaataagggccagacttgctaaagttagatcatga

SEQ ID NO: 59744 - DNA, 243 bp, Glycine max
  Peptide Sequence Number=SeqID_176522
atgtggtataaagcacagagacgccagaatcagcagaacaacataacccagatgagaaagaaactcatgaaaacattgaaagatgttacgttactatgcgaagtgcaaggaaacataagtgtgtcagttacatactcaatggaaagtggaaactggcactacactcgagttggtgaagccaaaaattcagttcagaacattagtatttccctttttcatttctatcagagactttttcaatga

SEQ ID NO: 59745 - DNA, 2193 bp, Glycine max
  Peptide Sequence Number=SeqID_176523
atgtatagatcatttctgagatgtgatgatccaaaaggagtagtagaatgtgggacaatcaggaaatacaggactcgttctcacaaagtgaaggacaagacaagaatccagaagacgggtgaaaacttggagacatccttgtccttgatgaacaaaagatacaaagaagagaataaggtcccaaaaggatgtgatggaaatctcattgatccatcatcttatagagatattatgtgtgatgaaaagtctgaagatattgcagaaggtattgcaaaaggagctcttggtctgcaagattctctaatcatgattcgcaagttgcaagaagaggcttcaccacattcagcttcttttaggagaaaacagactatgaaacctgaaagagacagaattgaagcaaagatgattggtagaacgcaggctaatccatttggggaacaaagtaatccaaaggggtttcaaagaccacagccttcaactggtggttgtctaagtaattgccaagaggaacttaagaaggtgattaaggagagtttggttaggcaaaatatgtttccaaagacctctgaaagattcaactctggttcagaaactttctctacaagcacaagccaatattctgctgtcaggactaacagcctttttgatccttctttctcagcaatagctccaaagatggaaagagcacctagcctaattttcaagctgatgggtttagaagaagccccctcaaaatcatttccagctgttaagcagaaacagttggatagagagctagatatgtcaaaggtaagaaagaatgactctatagctgagaaacaaaaggccctgagggaaactcttgacaccacacatttcaaaggaattttgaaggagagttttgtcaaagagcccaagcttcatgtgcatcatttcaatgataccaattccaagcagtttggtgatttatctcacattgcacttatgaaacctcaatgtactctttaccaggaatcagtaaaaagtacctatatgtcagttcctccaaaaggttccagttccacaaacatgggaaaagaaatggaaaaaggtatatgcaaacgggtgaacaaagaggaaggacctaaatttctcaaagaggttatgaaacttgatgcaaaaggaattaatcctgttgaagaatcatcaggtaaggtaaagctgtattgtcacattggtcacacatcacagacaaatgagacaattgataaaaaatggaaggtgcagaccattagtagaaaactgctggaaaaggatatctcacaacctataattgcggcaacaagacctcaatatcaacgaggaatcccctccacaaaattgaggaagctaaaaagtgggtccagaatcgacatgaatgagatttcttacctaaagagaacaggtagaaagaatcagatgaagaaccaaagcccaattattgagcctgaaccagctaaactaactgttgaacaaatcaggaagggagaaaagaagaaaatttgcactgagattagtgcactagaagatgaactcctgatggtgtgtgaagcagatgcccacataaataagattggagaaaaatacaagcagaggaagagtttttcaggcgatgacattattatgctgctcaagtctgaacatgaaaataatgctatcactgcttatagcattaatgctgataaagaggggactgagctgaaacattttcttttaacctgtccatcattcattggacatgcaaagaagctcttcaatcttgaagtggattgtcccaacaccctacaaaaggatgaaactatttacaacatggcaaatctcaggctttatttggattgcgcgtatgaactcactgagcgtaaaagccttcaagagtcacaagtagttcgttctttcttgcttgcttgtggagggagctcaagattacacatctccgtaggcaggttggctgaagaaatatgtaatggcattgagaatctgaaattttacaaagaacattccggggaggaagtttttgcaggcaatgatgtctttgcaatgatggagaaagacatgaagtgcaatggagagataaatggtatgtgggagaagggttggaggagaggattttctgcagatgaggctgaactagttgtcaataaaatagagatcctgcttatgagtggattaattgaggagattattataaatttatga

SEQ ID NO: 59746 - DNA, 204 bp, Glycine max
  Peptide Sequence Number=SeqID_176524
atgtcagatgaaggatcctatgtcagtggtctcaagattacaattgatgaaaacatcaacatgagcctgccatcagatgaaaatgctaccttgcagcaactaactgcagacaaatgctgtcataaaggcatggaaatacctggtataacaagatttacatcaaacgtagctatttactcatgcaggctacttctctacttctaa

SEQ ID NO: 59747 - DNA, 432 bp, Glycine max
  Peptide Sequence Number=SeqID_176525
atgatgaaaggaaatattgcattgttacctaggcgctttgtcgcgtgtatcttccttggccttcaactcaatattcttcttcaccggaaaccgtcaccaagagagacaggaggggttctttcaaaccaaaagctagcactagcagcagttacaagaggtgatgttatgggggcattatccttatacgactcagcaatctcagagggtgtcaaactggggcagcatcattacactttgttgttgtttctttgttcttccgctgctgttggtgttgttcgaccagctaaaagtggaagtggtgctagaactttgaacgcacttgtttcctccaatgaagttcccaatgagggaacaaatggcacacattttgagttgaacggcaatgctgaattaaattctgatttgaatttcaccgagaaagatgggatataa

SEQ ID NO: 59748 - DNA, 1722 bp, Glycine max
  Peptide Sequence Number=SeqID_176526
atggagatgtcgtcgatggaacaaaagaaagctaccgaactggttgaaaggaaaaagggtggttacagaaccattccctttatcatagcaaacgagacctttgaaaaggttgcaaatgtgggactccatgtgaacatgattttgtacctgctacaagagtatcattttgaccctgcaacaggagctattataatattcctgtggaacgccttgtccaattttttccccatctttggtgcttttctttctgattcttggcttggacgatttcgtgttattgctctcggaatagtcatcgaccttgttggcttagttgtgttgtggctcactgctatttttaggcatgcaagacctcaatgtgatgtagaaccttgtgcgaatcctacaacactgcaactcctgtttcttttctcttcccttgctctcatggctcttggagctggtggcattaggccatgtaccttagcctttactgctgatcaaatcaacaaccctgaaaacccacataatgagaggaccatgaagagcttattcaattggtactatgcttcggttggcatttcagtaactgtttcaatgacatttatagtgtacattcaagttaaagcagggtgggttgtgggttttggtatccctgtggcgcttatgacattttctgctatcatgtttttcttgggttcttgcttatataagaaagtgaagccaaacaagagcttgctcactagcttagctcaagtgattgtagcagcctggaaaaacagacacttacccatgtctcccaagaactctgacatttggtatttccataatggctctaaccttgttcaacctacagggaaagcaaggttcttgaacaaggcttgcatgatgaagaatagagagaaagatttggacagtggtgagatgccaattgacccatggagtctgtgtacagtaagacaagtggaggagttaaaagccataattaaagtccttcccatttggtccaccggcatcatacttgctactagcataagccaacaatcattttctattgtccaagctcaaaccatgaacagagtggtgttccatatgaccatcccacccaccaatttcgctgcattcataatcctcactttgaccatatgggtggttgtgtatgatcgcattctagttcccttatttcctaaggagcgagtactcaccgttaagcaacgaatgggaattgggctattgatctcatgcctggccactctagtagcagcattggtagaaaggaagagaagaaatgaagcaataaaggaagggtttatagataaccccaaaggagtggtgaacatgtcagctatgtggttagtgccccagtactgcttgtatggtttagctgagggtttgaatatcatcggacaaatagagttctattactctcaatttcctaagacaatgtcaagcattgctgtttctctatgtgcccttggtattgggatgggaaacgtcttgggaagccttattgtcaaggttgtgaaagatgggaccaagagaggaggagaagctagttggttagcatcaaatatcaatagagggcactatgattactactatgccctccttttcattctgaatttggttaatttgttatgcttcttcatatggagtcggatttatgggagtacttgtgatataaaaaattgggaggaagaggttgacacgagagtattagagaaagagttggacacaaaatga

SEQ ID NO: 59749 - DNA, 1644 bp, Glycine max
  Peptide Sequence Number=SeqID_176527
atgggggaaggtgaagctgaggggagtgatggcgctcccaagaatattgtgtcaaacgacgtcgttgcgaatgccctgttgccgttcgatgttcccgccaagaagctcgcgcggcagctcgatttcaccgatttcggtgggatgccggcgccgccgcagccgccggtgattttgccactgccgccttctgcttctgtcagggttgggaaaccagaatctcctaaatcgagaccgaggcctggctttgaaattaaagaagctaccccgaagaagcagaagcagtgcaattgtaaacattcaaaatgcctgaagctcttgttggatgcaatgggaaactatgtggagctaatgtttgaaatacgagaagcagttgaagctactttagaacggaatccaaatgcatttaggccaaaaatagcgagtagccctcatggaacacgtgatagcagggaggatgctggggaagttttgatattgggaaagcataacaaagggtgccattgtaaaaaatctgggtgcctcaagaagtactgtgagtgcttccaagccaacattctttgttctgaaaattgtaaatgcatggattgcaaaaactttgagggaagtgaagagagacaggctttgttccatggagatcaaaataacaacatggtgtatattcagcaggcggccaatgctgccataactggagctatcggttcctctggctattcttcaccaccaatatcaaagaaaagaaaaggtcaagaactgttatttgggccaactgtcaaggatccatcagttggcaggcaggggcaacaggcaaacaatgtcagagttcctgcaccctcctcatccttgtcacctatcccaggtgctcgtgttggaccagcaacattaggtccttcaaaattaatgtacaggtctcttttagcagacatcatacaaccacagcacctgaaggaactttgctcagttctggtgctagtatctggacaagccgctaagatgtttacagaccacaaaaatttcatggataagcatgctgaagatcagacagaaacttctcgtgcttcttcaactcaggagcaattaccaagccaaaaggaggctaatgttgagaaagctatggctgatgatgattgttcaagtgcaaaccagacagataatatcagcccggataattcttgttcagatggtgctgatgtcccaaaagggaggccaatgtctcctggaactttagcattgatgtgcgatgagcaagatacaatgttcatgactgctgcctccactgtcgggtcaagggcacatgcttgcaacacatctttgcaaccgccttatggacaagtaatgacagaggtctatgcagagcaagaaaggattgtattgacgaaatttagagattttctcaatagagttatcactatgggagaaataaatgaaacaaagtgctcttcattagccagaagtgaattagagagtcaaaaggatccaaacatcaattgtactggaaacgccagtactgagacacagcatcagcagggagccactaataacggtgttgccaaaacggcgggcaactccagtaattctacatctttgtttcctggtggtagtcttgtttctgaaaatggtgaaacctatccgaaggttgaagaatag

SEQ ID NO: 59750 - DNA, 150 bp, Glycine max
  Peptide Sequence Number=SeqID_176528
atggaagaccaagtaactacgcattcctcatgcaaagcacattacatttacggcgttggtccttatctcctaatttccttttttgagtttgctcaagggatcaaaatggcaatgcttgtgcgtgtgaatctgcatgaagttccaaattaa

SEQ ID NO: 59751 - DNA, 217 bp, Glycine max
  Peptide Sequence Number=SeqID_176529
atgtggtcctgggaaagcatactgcatagtgatagtagcggcgggcgaaggtttgatactgagaagaagaatggcaatggcatcattgaaggtaatgtgttaccagtggaattgggatgcttggaatcaatgatgccgtttcatagcgttgtagcttcagctcgattagtgtcaagcttgtctattgagtctctcggttggggattagttcctcaag

SEQ ID NO: 59752 - DNA, 285 bp, Glycine max
  Peptide Sequence Number=SeqID_176530
atgagacataaagagagagagagagtcaaagtgtgttcacgtctcaaaggatgtggtcggtttcaacaggaggagctagaaattgaaggagagccaagagaaagttcaacattggtgattgtgcttcacttgtttgcgctgaagaaaccttctgattggagcaaggaacataagtggctcgcgatgatatgtagtgactccatcaaccatggtcgcgtaagaccagagtcatcgcatcgcacaatagaggatcaccaaccatgttgcgacaatatgtttttttga

SEQ ID NO: 59753 - DNA, 3648 bp, Glycine max
  Peptide Sequence Number=SeqID_176531
atggaaggtaatggtagaaggaggaggcgccacttcagcagaatccatgcattctcttgtggaaaagcttcattcaaaggggagcattcactcataggcggtcctggattctcaaggatagtgtactgcaacgaagcggaacgcggtgaggggagtcttgtgagctatggtgacaattatgtgagtactactaagtatacagtggccactttccttcccaagtccttgtttgagcaattcaggagggttgccaatttttacttccttatctgtgcaattctgtcttttttcccggtttctccttactcggctgtcagcaatgttgttcctcttgtggttgtggttgctgctacaatggggaaagaggctgttgaggattggaagaggaaaaagcagaattggtttttggaaaattctagtgagggttactgtggcgagggagttgtgaggggaaaagtggcctcttctgcggatattgatatgaataatagaaaggttaaagtgcaccgtggagatggtgtttttgactattctaaatggaaggatttgaaagtcggggacatagtaaaggttgaaaaggatgaatttttccctgctgatctcatcttactttcatcaagctatgacgatgcaatttgctatgtagagaccatgaatcttgatggagaaacaaatctaaaagttaaacaatcacttgaagaaacttcaaagttgcaagaagattcaagctttcaaaatttcaaggctattatcaaatgcgaagatccaaatgcaaatttgtactcgtttgtaggcagtttggagcttgaagatcaattgtatcctctttcacctctgcatctactgcttagggactcaaagctaaggaacaccgagttcatctacggtgtggtaatctttacaggccatgatacaaaggttatgcagaattcaacagaacctccatccaagagaagcacagttgagaagcggatggataagatcatctactttctgttcttagtcttatttttaatttcttttattggttcaattttcttcgggattgcaacgaggaaggaccttgaaaatggagttatgaagcgatggtacctcagaccagatgacaccacaatttactttgatccaaagaaagcaccagtcgcagccatgctgcacttcctgactgcacttatgttgtatagttacttgattccaatttctttgtacgtttccattgaagttgtgaaagttcttcaaagcattttcatcaaccaggatttgcacatgtattatgaggaagctgaccggccagcacatgctcgtacctcgaatttgaatgaagaacttggccaagttgatactatactttcagataaaacaggaactttgacttgcaactctatggaattcatcaagtgttctattgctgggattgcgtatggccaaggagttacagaagttgagagagctctagccaggagagaaggagtacctttaagtcaagagttgacagaagatggaaatgttccaaagtcttccattaaaggttttaactttatggatgaaaggatcatgaagggaaattggatcaacgaacctcacgccgatgtaatccagaactttctgcggttgttggcagtatgccatactgcaatacctgaagttgatgaagaaatcggtaaagtttcatatgaagctgagtcacctgatgaggcagcttttgtggttgcagccagagaacttggttttgagttctatgaaaggacacagacaaatatttcactgcatgagttcaatccgagatcaggccaaacaacagaaaggtcgtacaaacttttgaatatattagagtttagtagtacaagaaagcggatgtctgtaattgtaagagatgaggaggggaaactgctactatttagcaaaggagcagacagtgtcatgtttgaacgacttgcaaggaatggaagggagtttgaagagaagactaagcagcacattgatgaatatgctgatgctggtttgaggaccttgatacttgcgtatcgggaacttgatgaagaagagtacaatctattcaatgaagaatttatggaggccaaaaacttagtgagtgcagatcgagagcaaattgtggaggaaatatcagaaaagattgagaaggatttaattcttcttggtgctactgcagttgaagacaaacttcaaaatggggttcctgaatgcattgacaagctagcacaggcaggaattaagctatgggttctgactggtgataaaatggagacagcaatcaatattgggtttgcttgtagtttactcagacaaggaatgaagcaaattataattagttcagacactccagaaaccaaatcactggagaaagtggaggacaagtctgctgctgcagcggcagttaaggtaagtgttattcatcaattaacgaatggaaaggaattacttgctgaatctgatgaaaactctgaggcattagctcttatcattgatgggaagtctctcacttatgcactagaagatgatgtaaaggacttatttcttacacttgctgctggctgtgcatctgtcatatgctgtcgttcatctcccaagcagaaagcacttgttactagattggtaaaggttaaaactggcagtacaactctagcaattggtgatggagcaaatgatgttggaatgcttcaagaagcagacattgggatcggtatcagtggtgttgaaggaatgcaggctgtaatgtcgagtgatatcgcaattgcccaatttcggtttctagagcgtttacttcttgtgcatgggcattggtgttacagaagaatctcatcaatgatttgctacttcttttacaagaacattgccttcggcttcaccctcttcttctacgagatctatgcgtcgttctcggggcaagctgcatacaatgattggtacctctcactatataacgtattcttcacttctcttcctgtaattgccttgggagtgtttgaccaggatgtttctgctagactatgccacaagttcccattattatatcaagaaggtgtacaaaatgtcctattcagctggaaacggatcctcggttgggctttcaacggagtcttgagtgctaccataatattcttcttctgcatcaacggaatggagaatcaagcattccgtaaagccggggaagttgctgatcttgaagttcttggtgccaccatgtacacttgtgttgtgtgggtggtgaattcccaaatggcattgtccattagttacttcacttacatacaacatttattcatatggggtggcattcttttctggtacatattcctcttagtgtatggaaccatggacccttctctatcaaccactgcctataaggtcttgattgaagcttgtgcaccagcaccatcttactggctcatcactttgcttgtgcttgttgcttcactccttccatacttcgcctacgcttcgatccaaatgcggtttttccccacgttccatcaaatgatacagtggatacgaaatgatggccaaacaactgatccagaatatgttaatattgtgagacaaagatcaataagacacacaacggttgggttcacggctcggtttgaagcatcacatagttcaggagcatccaagagtattcaagtctga

SEQ ID NO: 59754 - DNA, 414 bp, Glycine max
  Peptide Sequence Number=SeqID_176532
atgtggaggagggagagatccttgaagatgaggttctcgacggcgaggttgggaaacaagagacggaatctgatgctgaacccgggacaccttactaaaatttcagtaactagaaatgaggacattagggatgataaatttattagtcctgcaatcaatgcacaagatgatgtctctcgtaattgttcaagttttgagactcgggatggaaagcatgctcaagcttgtacagatggcgtgggcaatggttttttggatcctaaatcttccaaaggggataagtggcacaatggggaacttggacattttaaaagtaatgagaaactaaaaggagactttgatgatgaaacactggaggctaatgtgaggaaagcacattacaataggaattcatcctctgaaagtggaggctaa

SEQ ID NO: 59755 - DNA, 1431 bp, Glycine max
  Peptide Sequence Number=SeqID_176533
atggctcagcagaaaagacccccaaatagcaggggctactacgttaagatgaaactccttcaaaaacatggcagacctcatcatcaccatcaccatcaccagcaagaaaaaaactgcttctacagatactacaaatgggttctctggctttctctttctctctatttcttcacttcctacctcatcagcaacaacaacaaccaccacaccaaaaaaccttctcacgtctccagagcactcatccaatcaaaccacaccacaactcctcaacatgctcttaactctccagaatctttgaagaagttgaaggtgtttgtctacgaccttcctccgaagtacaacacggattggttgacgaacgagaggtgcagcaaacatttgtttgcgtcggaggttgcaattcacagggctttgttgaccagcgaggttcgcacgtttgacccatacgacgctgactttttcttcgtccccgtttacgtgtcttgcaacttcagcaccgtgaatggcttccccgcgattggccacgcgcgctccctcatcgcgtccgcggtaaacctcatctcctcggagtaccccttctggaaccgaagcagaggctccgaccacgtcttcgtcgcgtcgcacgatttcggctcgtgtttccacaccctggaggacgtggcgatggctgatggcgtgccagagattgtgaggaactcgatcgtgttgcagacgtttggcgttgtgttcgatcacccgtgccagaaggtcgagcacgtagtgattccaccgtacgtttcgccggaaagtgtaagggacacgatggagaattttccggtggacggacggcgagatatttgggctttcttccgagggaaaatggaagtccatcccaagaacgttagtggacgattttacagcaagaaagtgcggacggtgatatggaggaagttcaacggtgaccggaggttttacctgcagaggcataggtttgccggttaccagtcagagattgcacgttcggtgttttgtttatgtcctctggggtgggccccatggagtccgaggctggtcgagtccgtcgccttgggttgcgtgccagttgtcatagcggacggtattcggttgccgtttgtctccgcggtgaagtggtcggagatatcggtgacggtggcggagaaagacgtggggaggctggctgagatactggagcgcgtggcggcgacaaacctgagcacaattcaaaggaacctgtgggacccagcaacgaggagggccctacttttcaacagccaggtccagctggaatttcttgagagatggaatttaatgactcatgttggggcccaaagtagcagcttcaagactttcttcgagtatattaatggtgacgtggttgtggtgatgatgacatggcaagaattcattcgttggttttgcggcttggactga

SEQ ID NO: 59756 - DNA, 264 bp, Glycine max
  Peptide Sequence Number=SeqID_176534
atgggaagcactgcagaagtggatgaaagcaaactaacaagcagtaaggttgaaccagatgacttagaggaggatacattgcaattgcctgagcaagaagaggaagatctcaacaggatcaaagaagagagtagaagaagaagggaaacaataatggagaaatacaagaagcagcatcaacaagtagaagcagtggttagaaacgaaggaaaagtgaagaaaagtggcaacaactgcaaagtatttgtagggaaagacacgtga

SEQ ID NO: 59757 - DNA, 309 bp, Glycine max
  Peptide Sequence Number=SeqID_176535
atgacgttggatcaagtgagggtccttttcctcggatacggttcaaatcacatgatcgtcctcggcggaaaacataaaaataaatcttcagaaaacggttacggcttgggttgtgtgggtgttttaggccgcgtgagtgagtgggttactgtgtttgcggtgttggtggttcacggtggctgtgttggctcggccgatggctgggctcggccgatggtggttttcggtggctgtgttggctcggccgatggctgggctcggccgatggtggtggttctcggaggaggaaaggggctgagtggtggctag

SEQ ID NO: 59758 - DNA, 399 bp, Glycine max
  Peptide Sequence Number=SeqID_176536
atggacaagactaggatgattgaagaagaggcaaaagataagaaacatacggtactagctcacaaatcaaccataccaactagtgatgacaatgaaggagaaaatgcagaaggatctatagctgaaaatctaactttgctcgaacaacaacatggaaagaagaaatctaggagttacaccaagaagaagaaggcatatatagcatgggaagaaaattcttcaagctcttcaagtggaaatagtgatgaagaggaagcaaatctctgcctcatggctaatgaaaaggttgataacaatgaagcacgaaagtcatctatttctaataatattccttcaaggtatgccttgaagccaaacaacttatgtggtatcttgacaatggatgctcaaggcatatga

SEQ ID NO: 59759 - DNA, 429 bp, Glycine max
  Peptide Sequence Number=SeqID_176537
atggaaaacgaacaattaaaaaggcaacctggtgcacaaggctcctacccagtgaggtctgagcagggtggatctgcacaacctctctcctgctatgcaaacagagctggagaatactgcctttgtgggaaagtgtctttagaatcactttatatggcttgggattgttttccgaattttcgtttgggacagcgagcagagattatgtcaactgtggatttgcttccgtgtattctgaagtctgattttccaaatgatgatacaagaatctccattcaagttccctctaattttgagaatatgagtacatcaaagcaagtacaaatcacaatttctgctgaagagtttggggccaaagaaaaatctccctatctttcatatgcaggcagtgaagtaccatcctcatcattatctcacatgatcgggtaa

SEQ ID NO: 59760 - DNA, 345 bp, Glycine max
  Peptide Sequence Number=SeqID_176538
atgtcatcgtcagtgaatgattcaaattcgtttttgatgctcgtcgttatcgtcgcaagtgacaaatcagagtcagattgcaaacttttggcgacggatttgtattggaaacctttttcatcagaactactcatcgtgggctttgccatcacatccaccgacgatgttgtgcgtggatatgatcttggttggttcaggacactggacacgacgtattggacaaaagtcctctatgagaaggctcccccactctcaaactcaccctttttgcgaattttgacgtgcctatcgtcgaggaatccccacggcttccgatgtgtgggggatcaacctaacttgaattaa

SEQ ID NO: 59761 - DNA, 459 bp, Glycine max
  Peptide Sequence Number=SeqID_176539
atgattcatgtaatcctttggcatcatcaaaactttcagcttgatcctttgtctacaggttggttctgcaattggtgtctagtctcactgaaccctacaagggagtggccaccctcatccgtcaaagtgatcccttgcctcagttttatcaagcacggtcgatgcttgttctcgaagaatccgacctcaagaaggtggctcagacctcatcctccgccatggtggctcgtgactcagatgaatcttaagagatgtctgatcattcatcagcacgccacacaaataatggtggaaaacggtattcaaaccatggaaattctagaaagaatcgcaacaacactggtggtcatgataactcaagcgctggcaagggaggctctggtggcgggggtaaaggtggcggtggcagcaatcgcgggggtggacagcagcagccctagaacaacccttggcctgtag

SEQ ID NO: 59762 - DNA, 438 bp, Glycine max
  Peptide Sequence Number=SeqID_176540
atgagcgtccacgtggcccaggtgattgctgacgccatctatttttttgcaggtatgccacccactaggcaccctctagacccggataagtctaacagggccctggggtttctggcattgatcacgggcctctgccagtcattcggggttcccatcacccctagtaaggtgatccgaccgccgatcacccgggccttcatcaagaagtattgcacgcctaggcaggtgcagggtgatgcacttgaggccgcagacgcaccgccaccacctcatcaggccaatcccgctggatcactaggcatggagcgttatctacaacacttggttcgccagcaggcggccaaccaccgggggcaggtgcagatacatgagttctaccagtttagcctcagtcagcaggggcagggtttcgctccttttgcgtgccttactccatag

SEQ ID NO: 59763 - DNA, 132 bp, Glycine max
  Peptide Sequence Number=SeqID_176541
atgtggaaattgattaaggaaaggatggaaaataaggtggttaatttcgtgggtcttaataaggttaagtggtggctggacagaaatatagaaatggcaataactgaagctacagggctccaaatgaggtga

SEQ ID NO: 59764 - DNA, 966 bp, Glycine max
  Peptide Sequence Number=SeqID_176542
atggcaagtggtagttcaagtgcgttgaactcaaattcaaaggtggcggagggtatatggaaagcagcggcatcactaaggtgcaggaaactattgtggcgtgcgtgcagggaaggattacccgtgagatctttgttgttacaaaagggcatcatcaaagacgatgacacgtgtccatgttgtggcacgtgcaaggaaacaaccacacacgctttgttgctatgtgaaggggttaagcccttttggttagggtctccattggggcttagagtggactcctggcacaatgtggccaatatcaccatgttacaatgggttgatcagtgtgtggatgttttggacaagagaggaatgggcatgttatgtgccatggtgtggggtttgtggaacaaacgcaatgcttgggttctaaaaaagaagaaattggatttcgcacaggttatggccaaggccttgtctgtctttgttactgatgagtgggtcccacctttggattccaaaattaaggccaactttgctgcttctgtgatagaggatgttgggaccggattgggagtggtttttagaaactctaaaggtgaacctatggcatcagatgaatgttatgattccgaaattgctgatacactctgctacaagtgggctattgagaaagcagaggagctctggtttcctgaagttattttcgaaaccgattgccaacagttgtacactcagtggaacatattaacacaaggaaacaacaacactagtgattacacttcctacctgaatgaaattctagatgagtgcataaacatgatgcagggcacagaatcatctctgacattggtggttcacaatgccaataaagtggcacagtgtttagcagcagtggcttatgattatggtgagagaatttgggttgaggatgtgcctaatgaggcatcagaatgcttgcaatctgatgctgcagaaatagccaat

SEQ ID NO: 59765 - DNA, 849 bp, Glycine max
  Peptide Sequence Number=SeqID_176543
atggacactcaaagaaaagatgccaaacagtcttctccacttggtgacacccaacgcgagactctctctctcccgccccgcctgcttttccgcttcttcttcctacggttttcttctcttcttcctcacagcctttccgcttcttcttcctgcattttcgtattgttgttgctcacgtcaccgacgtttccatttgtcgttgccgttaaaggaggttgcggaaagaggttcttcttcttcttcattgaggagcttgccaccattgttgccatgaataggaggttgtcgtggtgcattgaggaggcttccgcgaagagcaacgccgtcgtccaccgtcgagggagcttcgtcatcgtccaccgtcgaggtaagcgccatgaccatgtcgtttccaccattgttgtcggcaataggagagggtcatgcgggtttggatacacccagaccattcctgcttcgcctgtcgattcatgggtgtcgtatgatgatatacacgacaggtggatgcactatccggatcatatggttccaacaggtgaggtttgcactgtgtcaggtcagtgtgtcagcgactatatagactggttcttccacatttcgcatcctttcatgacaccaggccagtcatcagatcctctgccagatggtcatgctctgcagccccgagtcgtccctcaagtcccagagacagatatccctcaggtgtcagagccaacagcaccatcgacatctgtgaggctcgctgtggaggagcctagacatgcagtggaagtttgctatgagattgctaagaggttggagcgccatctgagcctaggggtggtcacgccaggctcatcgacacatgag

SEQ ID NO: 59766 - DNA, 858 bp, Glycine max
  Peptide Sequence Number=SeqID_176544
atggcgcttacctcgacggtggacgatgacgaagctccctcgacggtggacgacggcgttgctcttcgcggaagcctcctcaatgcaccacgacaacctcctattcatggcaacaatggtggcaagctcctcaatgaagaagaagaagaacctctttccgcaacctcctttaacggcaacgacaaatggaaacgtgatgcccatatccagggtccttggaagaccttttggaataagattcttcctcttaaagtcaagtggacaggagtacactctgctttgtatggagatataggcaaacaaatttatcaacttcaagggttgattggggctaaagcagtaggcccatggccaacaaattttggagcaggtgcaatttcaatcttggatatggattcatgcaaagaaggaggggaaaacatctctctgaagtacagtgtgggattctcgatgtggtacttgggggttttgttcttcaagttgccactaagtggtaggggtgtaggactgagttttgatggtttttacaaggttttgtggtgttcatgggacatagtagttcatgagtattgtgttgcattttttagtgtcacgagtccttgtatgaagactttcttcaaacatctggtggacaaggacatgaccaagagcaagggcaaggatccacttgaaggacttggaggacttatgacaagggctagagcaaggaaagccaaggaagctcttcaacaagtgctgtccctactatttgaatacaaacccaagtttcaaggagaaaagtccaaggttggcccaattggcaacttagacatcagccttttgggagaccaaatggtggctgacttgttggctgttggg

SEQ ID NO: 59767 - DNA, 414 bp, Glycine max
  Peptide Sequence Number=SeqID_176545
atgactccattgatgaagaagatcgaaggcctacaagctccacatggagctacatcaaaacccactactttctcaactcagatcacttgttacaaatgtgaccccttcttcgccatagctcaggctgaaaagacgtttctcccccatcttctcctcctcaccttgccactaaaagggtgtttggttcgtgtcattgctggtttgtgtcattgccgcaaaagaaacgacacagtgatggaaacttctgcttgggtcgctagccactcctcctatgtccttgttgactctgtaggaattgagaaagtggtgagcaccattgtgttggacgctttaaatttttgcttctggcctgacccccttaaggagggtgccaatggttcgtgtcaatcgtgggtccatgtgatatatccgtaa

SEQ ID NO: 59768 - DNA, 596 bp, Glycine max
  Peptide Sequence Number=SeqID_176546
atggttttatatgttggagcaaaaaatgttgttcacattgtgactgataatgctgcaaattatgttgctgctggtaggttattggaaaaagagtttccaaaaatatattggtctccttgtgctgttcactacatgaatttgatgttgcaagactttggaaaatttgaggaagatgccttaagggccatggtgacatctagcgattggataggctcaacttatgccaaagactccaaggctaaaaaatttgtggagcaaatcttggactctagtttttggaaatcgtgtgctgatattgtgaagcttacggagccattagttcgtgcgttacttattgctgatagtgaagacaaacccgccatgggttttctttaccaagctatgtataaggccagggaggagatggttaggagttttaagagaaataagaggaaagtggagccttatttggaggtccttgataggcgttgggattcacagcttcaaaaaaatctacatgtagctggttattggttaaatccgacttgtagattcaatgttgaagaatttgagaagcataggaacacacaatctgacattttggaactcattgacag

SEQ ID NO: 59769 - DNA, 1062 bp, Glycine max
  Peptide Sequence Number=SeqID_176547
atgggcgttgagaactaccacgtcatcgagctcgtcggcgagggttccttcgggaaggtatacaagggaaggcgcaagcacacgggacagaccgtcgcgatgaagttcataatgaagcacgggaagaccgagaaggatattcacaatttaagacaagaaatcgagatcttaagaaagttgaagcatggaaatattattcaaatgcttgattcctttgaaagcccgcaagaattttgtgttgttacagaatttgcacaaggtgagctatttgagattcttgaggatgataagtgccttccggaagagcaagttcaagcaattgcaaaacaattggtaaaagccttacattatttgcattccaatcggatcatccatcgcgatatgaagccccaaaatattctaattggtgctggatctgttgtcaagctttgtgattttgggtttgcacgtgcaatgtccacaaatacagttgttttgcgatctataaaaggcactccgttgtacatggctccagagcttgtacgggaacaaccatacaaccacactgtagatttatggtctcttggtgtcatactgtatgagttatttgtaggccaacctccattctacacaaattctgtgtatgctctcatcagacacattgttaaggatcctgttaaatatccagatcgcatgagtccaaatttcaaaagctttttaaagggtttgcttaacaaggcaccagaaagtcgactaacttggccggctcttcttgaacacccatttgttaaagaaagctatgatgaactcgaggccagggaattgcgagagataaatggttcacacatgcacagtgatgcagcacgggtggttgaaggaaaaaccattcaaactctgacaacaggcaaaaacaatcacatggcaggtatggaagcgcatattgcttcaccgcctcagagtgcagttcagttaaatagtcctatcttagatagagccaattcttcagtgcttgatgagtccccagtattttcaaatcaaaatgtaggagagtcagaaaaaagaatgcaggggatacctttgtaa

SEQ ID NO: 59770 - DNA, 2454 bp, Glycine max
  Peptide Sequence Number=SeqID_176548
atgtgcagtgatcaagatgttcctgaatcaaaccagtcattgaggattctctcaaacctagttgcagctggtgctttcagttctagtggactaatagatgaactaatacgagagctccttgtgtttactggatctgttattgccatgaaatcctccgaagttactgacttgatggcaaagagtttctccatcactaaaattttgctcgataatggtggaagttgcacttcaagctcttatctaagtcactgggttgaatttgttgagatctattctcaggttgtaacttcaaataatgatgcatctggaagagttctgtatgaatctagtgcttgcattacagtcatgctgtctagagttgctcaggtgcttagatcatctcctaaaatttcaggccaagagaaactgaatgaaactgctaaccgaattttagagcatgcaaaaacaacgggtttagtagacaatttgtgtctgtgtttagccacttcaggatcgagtcttattacaggttcttccaatatgctacgggctgcttctgaagcatgcagagctgtctggtgtttgattaatgcactggatatactttttatgaagaaaagtgccattctgtttcccattaatgctttacagagtcattctttgcataggatggaagttgtgcatcatgagcaagatctcttggataaagcagattcaactaaagttgttgatgcaatgaccagagcattcctgagatctaaagctgttctggttgctgtttactattgttttcaccaacaacttgagtctgcaatgaattgtggtcttcagcttttgtcaagatgctgtctacataacagaattgttcctgctctcctttgtggtcttcccagttcccttcccgtgactactgttgttagtggtggtggtgatggaactattgtttcagaagttttcactgtcttatcattatgcagttcccctgctaacaaagacacacaaagtgtagaaccaagtaatgccaagtgcaaattaacaaatccttctgctctggttcgtcattcatgtctccttgttgcagtaattgctcagtgtttgaagtcatctggaagaaattcagcaatttttatgctcactacctcaccaaagaagcagcttgctcgactatcagtgtttgctcaccaaatttcttctgatgataaaataaaagcctctattgagcctcaaagtgcatcagctatgttggctctggcatccattctatcccttgaatcaggggctttggttgagtctccaatatctgaaattgctttgcctttaattcctcgaacttctaaactaagtgaccatcttaaattttcatctggcaatgtaaatgaatcggacccttgcaacatcagtgggaagctctcatattggcaaggggtaagagatgggtgtgttggtcttttagattccagactcaagtggggaggaccattagctgttcagcagttgtgtgcaagtggtactcctctacttcttatgggcctattaggcaatgatgttttaaatgcttctcatggaaatgaccatgtaaatgatagagttggattgtctcctattggtgttgtatggacaatttcatcattatgtcattgtctttctggtggtgctttgacttatcgtcaaattttgattaggaatgaacatattaaactcttttccaacttgatatgcgacgttcatatcaatttggtaaaatgctggatcggacctggtggagggagagcaggagtcagagatctaataaatgcagtgatagatctcttagcatttccttttgttgctctgcaaaatgcacctggcttgccatcagccactgcttctgtcagcagtgggtttcttcttaatattggctctcctggtcagagagtatgcatggaagataagggtatagttaaggcaatcgaagaagacataggaaaatatattaagattcttgtagaggtgggtgtgcctggtattatccttcgatgcctagatcatatggatttgaatgatttgggcaggcctgttgcttttctggctaaaatggtatgccaccgacctttagcaatccaacttgttagtaaaggtcttctggatccaaataagatgagaaagttgtttgactgttcggccccaaaagaggtcacactggatgctcttatgattatttctgatcttgctcgcatggacaagggattttatgagtacattaaaggtgcttctgttttggagttcttgaaagattttcttttgcatgaggatcccaatatgcgtgccaaagcttgcagtgctcttggaaacatgtgtcgtcatagcgcctatttttatagttcacttgcaagacatcaaattgttggtatccttattgaaagatgttctgatccagacaaacgaacacggaaatttgcttgttttgctgttttagaagattgttgtggtatatga

SEQ ID NO: 59771 - DNA, 429 bp, Glycine max
  Peptide Sequence Number=SeqID_176549
atgttggagcaaagtgtaaaggtcacctattgttgggttatgaagcaggttgggggtgcagggccaaattcaaagtggggaagttcaatggaactgagaatttcggattgtggcagaggtcttctaaaggcgctgcacgaatcaaagcctaataatacggaggctttggattgggaggagttgcaagaaagggttgcggtaaccgttgcacttatgtctcactttcaacagagacaaaatgcaatgcggagtttgcaagacgatggtctgtatgtgaatgggaaacaggaacatggaagcacacaaaacaagggttttggtggtaggcagaggaagaagtccaagtctagaaaatacaagaaaacaatgcaggctgccatgcggaagagattcacacttaatggggagattgttggaatacaagtgtga

SEQ ID NO: 59772 - DNA, 459 bp, Glycine max
  Peptide Sequence Number=SeqID_176550
atgaggtcctttaatggtgattttccaccatggagatgcaacggaagacaaaggagaagaggtgagaggatgcgtcatccactagggaataagccatggaagaaggagcttcaccaccaagatgagccttggataagaagcttggagaggattacagaaacaagaaagaagattggcgctgaagtgaggaggcaatgggaaaagaggcgtggaaagaagatgaagcttctaggaaaggttgttggtcaagaaaagctgcagtggaattcttatgagacattggatgaacagctaaagcaggagtggttgatgagtgttgaacaaaggaaacaagtggcaaggacaccatctagcaaaagagcacccaggtcccctgaaaagagaaggaaaattacaaaagccattgctgccaaatgggctgatccttcatatgtggaggaaagcaagaagaacaagtaa

SEQ ID NO: 59773 - DNA, 336 bp, Glycine max
  Peptide Sequence Number=SeqID_176551
atggcacactactgtgcaaaaagagagtgtgaggaccacaaaaaccttctacaatgtagcttcagagaaagtgttcctcagaacacttcatttgaaaatcgatgtggaggtatacttatccaatatcccggtcccctacgtaggaataatcatgtcactcttactcatgatcttccctcgttgtggaatgctgacatcaacaaatccaagttcactcttactaacaaattgcttacaaaggttgactcggagatgatggactatgttggggccgacaatagtttggattctactgaagttttcctttataggtctactactactattcgccattaa

SEQ ID NO: 59774 - DNA, 513 bp, Glycine max
  Peptide Sequence Number=SeqID_176552
atgtaccctctcttgttctcagttacaacaacccaagtagatgtaccctctacttgtaccacaaaggatgtaccctccaatgtgttaagacaaagttctcaggcggaatctggtaatcaattaccagagagtaaaaactctgggacccattacaatgtattttctgtcacctattatgagtgtttggttacccataaaggaccttacactacccttgacttagtctatgatggctttgtgagacaacaacacccccgccaggcgacgatgacatgccatatgctcataatacatttttccaccaccttagatcctgtttattctgactatgaggattcctcttttgtaccattttaccatattgatgaggattatgattatccgtattttgtgtccaagattagcaatgtagggagctatactactaataagcaagcactcattggcgataatgatgaagaaatggtcaactctgacaatagtgatgacatggactcaagggattctcaatga

SEQ ID NO: 59775 - DNA, 621 bp, Glycine max
  Peptide Sequence Number=SeqID_176553
aacggaatttaccgcccgattggggctgcattcccaaacaacccgactcgccgacagcgcctcgtggtgcgacagggtccgggcacgacggggctctcaccctctctggcgcccccttccagagagacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 59776 - DNA, 917 bp, Glycine max
  Peptide Sequence Number=SeqID_176554
atgcccggcttttttacgccagattgttctcaaaaatcctcctctgcgtcccgacttctatacttatcattttgttcgacattttcaccggaggacgccgtgccgtggatcctgttgctgttgataagcctgtttagtgcgccatcgttcgccgttgcgatccccggcgtcaccaccggaacgaccgcgacgaaggcaaatacgccgccaccagagcccgatgtcgaacagaaaaaagccgcctacagcgcccttgccgacgtccttgagaacgatgcttcccgccaggagctcatcagccagctgcgaaaagtcgccgccacaccgtcacaggagccggttcctgacatcatccctccgcaggtggaggagcaaaaaacggtgctggaaaacgtcaccgacgtcagccgccactatggcgaagccctctcctcacgctttgcccagctctatcgtaatctgattggctcaccgcataagccctttaacccacaaacgtttaccgtcgccgccacgcagttcctgatgctggcgggcgcagtatttcttttttactggctggtgcgcctgagcgcgtggccgctgtaccgcaaaatggggcaatggggtcgcaggaagaatcagcagagaagcagctggctccacctgccgttgatgatcgcgtcagcgtttatcatcgatttactgctgctggcgctgacgctgtttttaggccagatgctggccgacaggctgaatgcgggtaacaaaaccatcgccttccagcaatcgctgttcctcaatgcgtttgccctgattgagttcttcaaggcactgctgcggctactgttttgcccccacgtgccggaactgcgtcctttttccatacgggatgagagcgcgaaatactgggcgctgcgtctgagcgtgctcagcgg

SEQ ID NO: 59777 - DNA, 567 bp, Glycine max
  Peptide Sequence Number=SeqID_176555
ggcgtggtcggcctggaagccgataccctggcgggctgtctggaagattacttcatgcgttccgagcagttgccaacccgcctgtgctgcccgcgcaggagcccaacctggatgacttcaaccatctggccacgttaaccgaaaccgtgaagagcgaagagctgattgagctgcccgctactgacgtactgtggcgtctctatcatcaggaagaagccacggtttacgatccggcgccggtcagcttcaaatgcacctgctcgcgcgaacgctgcggtgaagtgctgaagacgctgccgccagaggaagtggatgagattctggtcgaagacggcaaaattgatatgcactgcgactattgcggcacgcactatgtgtacgacgcagtggatattgctgctattcacctcgaaacgctcggaattagcggcaccaccgaggtggtgtacaaccctgattacgccacgttatttcaggaagaaacccgcccggagctggaaggttacgcgcgcggcaccctgacgcagagcggtgccattgccgtggataccggcatcttcaccggac

SEQ ID NO: 59778 - DNA, 189 bp, Glycine max
  Peptide Sequence Number=SeqID_176556
atgacaagtgacgatctacaaaaggatgcgaatgcggtcggtgcaggcagcgaagtcggtgttcttgttggttcagaggacgccggcggggatgagcgattcttgggtggcgttgagttatggcttggaagggaagggttaggaacgacgaagaagaagactagagagttttttttccattttttttaa

SEQ ID NO: 59779 - DNA, 171 bp, Glycine max
  misc_feature (8)..(8): n is a, c, g, or t
  Peptide Sequence Number=SeqID_176557
atggttancgaagaacctataataagagataatgttagcgacttcagtgatgacgagcaacaacacaattttcatgaacatggtgaaccaaacaatcaaatcaatatggtaatggatgtcattggagggctagagtatcgttcagcaaaatacgcaagaggtggaagttga

SEQ ID NO: 59780 - DNA, 325 bp, Glycine max
  Peptide Sequence Number=SeqID_176558
ttcatctttgtcgcaaactggcatgcgcttccgtgactgcaaccacattgtggagttcgtgtttgtggagttcgtctctgccacttatcgattgaggtcgaagaaatctaggaaaggaaagagtcccgaaaagggtgggaatcgattttggaagctgtgcttccgtgactgcaaccacattgtggagttggtctttgtggagttcatgtctgccacttatcgattgaggtcgaagaaaactacgaaaggaaagggtgggaagcgattttggaagtccattgtggttggctttaagactcccagggaagccatcgaagtatattga

SEQ ID NO: 59781 - DNA, 369 bp, Glycine max
  Peptide Sequence Number=SeqID_176559
atggttggtccatatggcgaacatggtgataacgacaccgatggaggtggcgtcagggcacatcggtggaactgtaaacgcatggcagtacatataaggatgatagtgaacctgttggagatgctaaaatcaacggaggtggtgtggttgccagagacaaaggaacatcccacatacaacccttcacctttgataaagatacaacagaggtttggaagaggactgaagaactggaatatcgcgctcagcataatagccttatttagcacatcaagatcgctcagcccaagaagcccgcttagcgcaataagccacattggaagccagttgtcacgtgcaagcatactaagtacgcatcctacgacttag

SEQ ID NO: 59782 - DNA, 519 bp, Glycine max
  Peptide Sequence Number=SeqID_176560
atggtgtgccttgtgtgttggaacgacaaatctgtttgcaacaagtacagatctattcttgaagcaaaaaaatgcgaggactatgtcgatgaaggtgaaattcgaaagggtttgggtttaagtcacgttgggaaaagtgggactaaggctggatttgccatctcaacagtggtacacccatcatgcggtggtcgttgtgttagtggaagggctactagagacataaagggaaaaaaaaactatatgccatcttcaaagtcgttagaaatcgctttcaaccatgacaaatggtggtcgaagggattagaggggagttacatagaggatgcacgaatctcgcggggatcatcctatggtaataagattcatcctacgattaggaataatgatctatatttagacttgggcaaacgggttcaggcctgtgggttacctgcaaaacccacagcccacatggtatacaagccttattcttttgagcatgttcaaaaagcgggctttttagcctgccccacataa

SEQ ID NO: 59783 - DNA, 396 bp, Glycine max
  Peptide Sequence Number=SeqID_176561
atggtttcctatggtgtggcgtctccattcatctttctccttctccattccgctgcaattagacctcaagaagaaaaggaatccattgatgaagaagatccaaggcctacaagcttcacatggagctatatcaatgaggagcctccagcagcagcaacagcagaggatgaggatgagctcactcctcctgagcctcttgattttgatgcaggtacacatacggctcaggaggaggaggctattccagagcagattccagagccatctccagcccctgcgtatgcacctgatgatgccacaccagtggttgagccgaagcagactattcaagattctttagtagctctagcactggatcttaatgaagaccaaccacaagaggagcaggacgtttaa

SEQ ID NO: 59784 - DNA, 235 bp, Glycine max
  Peptide Sequence Number=SeqID_176562
gtacacgatgaattcggttataacagtgttgtatttcaatggaaggatatatgaagataatgatgatgtaatatttgaaggcagtaaaaaagcgattcagattaaacgtggaattagtttcaatgctttgaagaaaaaaattggagacaaggaaaatatattgctttgcaaatttgcgatgacgaagacgttgaaacgatgctggaaagttttaaacaaccacaagaaatgttag

SEQ ID NO: 59785 - DNA, 150 bp, Glycine max
  Peptide Sequence Number=SeqID_176563
atgcatgaatatgttaagaaggtgatatggaccttccagcttcccgtgacaaaagacaagaccaacatacaacgcatgcgtgacaacatgatgcagatgcacaaaagcgcaacaggggggtgtacacaacatggcaatatcctcaaataa

SEQ ID NO: 59786 - DNA, 774 bp, Glycine max
  Peptide Sequence Number=SeqID_176564
atgtttcaccctcaaactgttttagattcaaatggctatccaatctatcgtagaagaaatgatgaccataccatttcaaagaatggagttattattgataatatatatatagtaccttacaatgcaaaattgctgaggaaataccaagcacatataaatgttgaatggtgtaatcaaaatacttccattaaatatctatttaaatatataaacaaaggttatgacagagtcactgctgttgttattcatgatgataatggtacacttgagaatgctatcagtcaaaatgatgagattaaagaatatgtggattgcagatatatttctccatgtgaagctacttggagaattttttgttttccaatacatgctagaaagcctgctgtggagagattacattttcatctgccaggacaacacaatgttttttatgaagatgatgatgatatagatgatatcctgtcaaagccatgtatttcagaatcaaaattcttagcctggatgaatagcaacaaatgttttcagagggctagatcatggaaccttagaaagaaagacaatacaattggcaggttaatatgggttccaccaaccactggtgaattgttttatcaaagaatgatgcttactgcatgtaaaggagctacttcatttaaagatattagaaccgttgaaaatgttctataccctacatatagagaagcatgctttgcaatgggttttttgcaagatgacagagaatttgtggaagcaatcaaagaagttaaggactag

SEQ ID NO: 59787 - DNA, 423 bp, Glycine max
  Peptide Sequence Number=SeqID_176565
atgggccaagagcttcaacattcaatttcgagcgtctcgatatgttccgggactcaatcagacatccgagtaaaaagttattgtcgtttgaattggctcagagattccacattcaatttcgagcgtctcgatatcttacgggactcaatcagacatccgagtaaaaagttattgtcgtttgtattggctcagagcttcaacattcaatttcgagcgtctcgatatgttacgggactcaatcagacatccgaaggttcaacattcaatttcgagcgtctcgatatattacgggactcaatcagacatccgagtaaaaagttattgtcgtttgaattagctaagaggttcaacattcaatttcgagcgtctcgatatattacgggactcaatcagacatccgagaaaaaagttattgtcgtttga

SEQ ID NO: 59788 - DNA, 462 bp, Glycine max
  Peptide Sequence Number=SeqID_176566
atgaaatggagaaaagcatcgggggtgttatgtgatgcaaagctaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagagaaatgggtttatgatcccaacatagttggctcatggtacctaacacatgcaactaagaatgcatcatga

SEQ ID NO: 59789 - DNA, 465 bp, Glycine max
  Peptide Sequence Number=SeqID_176567
atggaggccatgatgagcatgaaaaagataatggaaaccaatgcggttgcagttgccgctatcagcattgttgctaaggtgaactcgatgcccccatctggcctcaaccaaatgaatcatccaacctcagctatggtaggcaaagatttgggaagtacgagcggcccctattatgtgaaaattcaaaacaagcacgccttcccgccatatagcttgcctcccaactatacaccacccaatgtggtgtacactcttgatgaggatgtcaataacttcgctcccatactcattgagagccgacaacctcatcatgcacatgtctctcaacccatgggggagacacacgaaattccccaccacactctagtcgacttcgagccttgcctcgaatatgccactgaagggcaagtagttggtgatatacctctgcaaaacactttggagggccctcagtatcagccataa

SEQ ID NO: 59790 - DNA, 529 bp, Glycine max
  Peptide Sequence Number=SeqID_176568
agggctacacgccctcgccttcagaggactacacgtcctaacctttagaggactagacgtcttccactttagaggaccacacatccttcccttcagaggattacatgtcctcaccatcagagggctacacgtcgtcgccttcataggtctacatgtacaccccttaagaggactacaagtccttaccttcagaggaatacacgtcctcgccttcataaggctacaagtcctgcccttaagaggactttacgccctcaccttcagaggactacatgttctcgccctcagaaggctacatgtcctccgtttcagaggactgcatgtcctcgccttcagaggactccacgtcctcccattcagaggactccacgtcctcaccttcagaggactaccggtcctcgccttgagaggactacttgtcctcccctttagaggattacacgccctcgccttcgaaggactacacgccttcacattcagaggagttcacgtcctccaatttagagggctacgcatcctcgctttatga

SEQ ID NO: 59791 - DNA, 186 bp, Glycine max
  Peptide Sequence Number=SeqID_176569
atggacatgaagtcctatgaaggtgaggacgggaagacgtttagccctttgaaggcgaggacatgttgccctgtgatggtgacaacgtgtactcctctgaaggtgtgggagtgtagccctatgaaggcgagggcgtgtagccctcccaaggggaggacctttactcctcttaaggtgaggacatga

SEQ ID NO: 59792 - DNA, 189 bp, Glycine max
  Peptide Sequence Number=SeqID_176570
atggcgctaaacgaggtgattggctgcccgcaggtgatcctgacgcacatcagccatcagtttgacgtgtggatgatggataacccgctgcccgacggcattgaagcggggttttctccctctcccgtgggagagggttggggtgagggcaacaggccgcacttaacctcgatcgtaatcgtcttctaa

SEQ ID NO: 59793 - DNA, 225 bp, Glycine max
  Peptide Sequence Number=SeqID_176571
atggagcttgcatcaagcgtggtggtcatattcattaagagggagctgatttgtcagtacggactccctaggaagatcattactgaaaatgtgtcatacaaagattggcatgagatgttgccttttgccctgcatggatacaaaacttcggtacgaacttctactggggcgacaccgtactccttggtttatgggatggaagcggtactcccgtttgaggtagag

SEQ ID NO: 59794 - DNA, 522 bp, Glycine max
  Peptide Sequence Number=SeqID_176572
atgcaaaatacgctttatcactgggcggcggcggccgtaatcaccgtgtcactgtcgggtcaggcgctggcggcggagaaaattaccgtgttcgctgcggcctcgctcaccaacgcgatgcagcaggttgccacgcaatatcagcaaaaaagcggcgttgaagtggtatcctcgttcgcttcctcgtcgacgctggcgcggcaaatcgagcagggcgccccggcggatctgtttatctctgccgatcagcagtggatggacgatgcggtggcgaaaaacagcgtgatcggcagtacgcgctacacgctgctgggcaatgatctggtgttggtggcggcaaaaagcgctcacgcgcagccggtgaccatcaatgcgcagaccccatggcagaacctgcttaagggcgagcgcctggcggtgggcgatccggatcacgtgccggcaggcatttatgccaaagaagcgctgcaaaagctgggcgcgtgggacacgctgtcttcacggctcgcaccggctaacaac

SEQ ID NO: 59795 - DNA, 813 bp, Glycine max
  Peptide Sequence Number=SeqID_176573
atgaaaaagttttccctcgccctgatcgttttaatgaccaccctggctgccgaggcgcatgtcccgtttttaaaacctaaccagttcaatgtcacgcatcaccgcctgacgattgaatctgcgtttaccgagtttccgttccaggctgactttgccatggactcgccaaacttcacgatcacctcaccgtctggcgaggtcgcagccatccagccgatcgccaaaaccaaggctgcggtatatctggaacccacactcaaagaagaaggcacctaccgtatcagcacagggaaacgcgtcggtcccgtgtataaagccgtggaaacaccggataaaaaactctacttcgcagctgacatgaagcgcgtcagcggtaagccgaccaccatgaattattacagttatgccgatacctatatttttaaaggccagcaaaactatgtggctaaaccgtttaacaaaggtctggagattattccgttggcgtcacctaacggtttattactcggcggtgagttaagctttcaggtgttggagcatggtcaacccgtctccaatgcacgtattattgtggtgacggataatgagcactttatcaaacaccgcattgaagatttgtacgatgtagagaatgtcagggcgtccaacctgcatgctaaccagcaaggtgtatttagctttaaaccacagaaagccgggttgaactttctgtttgtgacggttcaccaccaacttaatccacaattgtgggagagcctgaacgcgtcgttgacattagaagttaatttaccagtaacacaaggcaaaccttaa

SEQ ID NO: 59796 - DNA, 519 bp, Glycine max
  Peptide Sequence Number=SeqID_176574
atggataacgaagagggagtgcaagaacagatgaaggccgacatgtcggctttaaaagatcagatggcttccatcacggaagccatgctaaaaattcaaaaatcaatagaagacaatgctacgacagttgcttccaatacaactagggaagcggaactggtgctacaacccgcaatgaacttgggccgggacaaaagcgcgacgggtttcaatcggaggtatagtcctcaagcctgcccttatggtttgcctccagacttcactccccgtaccgctccagacgatttgagccaatcccctaccttcaaggggcaactccttcctcatgccgactatcctctgcaggaagatgatgaaagagatgcccatctaggccctctacttcccctcaaggaaccgaccccccatgagttgccccatccatgcccatccatgccccgtctcaatccgcacccattaaggaactcgttcccatttcaaaggacaagggaaagatcgatctgcttggagaaaggttga

SEQ ID NO: 59797 - DNA, 357 bp, Glycine max
  Peptide Sequence Number=SeqID_176575
gaccgtgaatgtgctgaattgattggtgaaacagctgatgatgtgaatagggtcaagattgaactggtgaatttgtgttgtttttggcaagatggtgatcttgatttgaatgcttcccctcaagcacttgacaaattgttgggtcatgtgcttgcttttaaggtcaggattcaatcaaaattcaaaaatgcagttgtacttagatactcaaaagacctggatttgatcaatgttgttctcgagatgctgcctgatagtgagcaatctctgtctgtcacagctgaccatgatccggttgcgggattgcctttacacccaaaaagcggatgtcatatgatgaagccgatgatgagttag

SEQ ID NO: 59798 - DNA, 1285 bp, Glycine max
  Peptide Sequence Number=SeqID_176576
atggcgttgcgggcctggccgtcgagcacatgcgagcaccaccacgtgcaggcccgggatgcgttcggagacctgccaggcagcctcgaagaagggttcgccgaggcgcgagatttcgcccaggcggctgcccggcagcaccgccagcaccttggccgaagtcggcaggccaagcgcggcgcgcgcttcctcgcggttgccctgcagcggaatgtcgtcggccatcggatggccgacgaagcgcgcgtcgatgccgtgcttggcatagatgggcggctccatcgggaacaggcacagcaccaggtcggcgctgctgccgatcttctcggcacgcttctcacgccaggcccagaccgaggggctgacgtaatgcacggtgcgcacgccacgctgcttcagccagcgctcgatgcccaggttgaagtcgggggcgtcgatgccgatgaacacgtccggctgccagtccagcgcacgctggcggaacgccgagcgcagcttcagcaggcgcggcagatggcgcagtacttcggtcaggcccatcaccgccagttcgctggcatcgtgccaggtctggcagccggcgctgcgcatggcgtcgccaccgatgccggcgaattcggcatgcgggaagcgcgctttcagttcgcgaaccaggcccgcaccgagcagatcgccggagcctcaccggcgaccagggcgatccgcaacgggcgctcgctgagcacccgttgcgcggggacgctgccgcaagggcctctcggcgtgctcgatgaagtccagcatggccttcacgtcatcgctgtcacgcgcctgttcggtcagctgcaccttggcttcggccagcggcaggcccgccacgtacagggtgcggtaggcacgcttgatggcggaaatgcgctcggcatcgaaaccgcggcgcttcaggccttcgctgttgatgccgcgcgggcggcccagcgaatcggtgccgaccatggtgaacggcggaacgtcgccattggtcagcgcccccatgccgaggaaggcatgcgcgccgatccggcagaactggtgggcaccggcgaagccgctgatgatcacgtagtcgcccacggtcacatggccggccaggctggtgttgttggagaacacgcagaagttgccgacatggcagtcatgcgccacgtgcgtgtaggccagcatccagttgtcgtcgccgatgctggtgatgccgccgcctgcgccggtgccacggttcagcgtgacgaactcgcggaacacgttgcggtcgccgatcaccagctcg

SEQ ID NO: 59799 - DNA, 336 bp, Glycine max
  Peptide Sequence Number=SeqID_176577
atgcgtaaccatggatcaataggacttcttcggggatggtgtttcggtgaggaatttggctctgagtgttttggccttttccttttctgtttttgtttagtgcaaggcgaaaaagtcaccgacgcacaggattttggttggcaatcaaagggagaggaccacttcaggcgaggatgggcattctcactctgggtcaaggtttatggtgagttgggattttggctcaaggcttgtagaacggctggacatgatatatgtcagagtgttggtttggccagcgattcagggataaaggggatgtcccacattatttccatgacacacatgcaacaatga

SEQ ID NO: 59800 - DNA, 546 bp, Glycine max
  Peptide Sequence Number=SeqID_176578
atgtcaaataaaaagtatgaatctggttatgaaaaattgaagaaaaaacaaaaagttgaaaaactaattgaatctcaacgtggtgcccttgataaatttgttattattcataaaaatgatgcagaagcaagttcaataggtgaaaatgtgatagaacaaccactgataaatcatactgacaacgagaaaaatattatagaacaaccacctatagataataccgacaacgatgtagaacaaccacctataaataatactgacaacacaaatagtcataatttcaatcaagaactagaagacaatattttagaaataggagtagaagggaatgttgagcgtaataacacttctagtgaagtacctacaaatatttatgacccaggactatggaaaaatattgatggaaaatttagagatttaatgatagaaaatggtcctataagacatgacaattttcaatatccaaaagatgaaaataatagatatttttattcatcatgttatcaacgaacactgtcaaatggagaaaaacatgatagaagatga

SEQ ID NO: 59801 - DNA, 697 bp, Glycine max
  Peptide Sequence Number=SeqID_176579
atggccgccccgacgactggtgtccaactctttagcctagggtggatcgctgactggatcgacaagtcgatcaccacgatgcttaccgatgtcgtcacgccgctggtggcatcggtcaccgagaagataatgccggtcgtcgggttgggattgtcgatcgcgctgatctggtacggatggctcatcatgaacggcaccatccagacgccgattctgcaagccacccgaaagctcgtgagcattgctgtcatagtaggaatcgctggcgctggtgggctgtatcagaggcagatcgccggcgtcatgctcgaccttcccactgatgtggccaagatcttcactggaaccatcaagacaccagcacagatcatggacgatgcggcaaacaacggcaccgagatcagcacccggctacaggagcgcgcgcctaccggtttgaagaacatcggaaaggcctttgtcttcatgctgattgccctgatcatcacgatcatttcatccatcatgagcgccatcggcatgatcgttcttatcaccgtaaaactcgggatggggcttgtggtcgttcttggccccttatgcatccttgcgctcctgttcgaggtgaccaaggacttcttcaaatattggcttgcccaggccgcctattacgctatctatgcgggcctcttcatggtggtctttatgttcatcatgg

SEQ ID NO: 59802 - DNA, 289 bp, Glycine max
  Peptide Sequence Number=SeqID_176580
tcaaacccaagtagatgtaccctctacttgtaccacaaaggatttaccctccaatgtgttaagacaaagatctcaggctgttaaacctttgatactttgtgaatggggatacaaaagaattctcaggcgggagaatgggagacacaaaagaattcaggcgggagaagtgaatgaaaagatgaatagcacaagttccaaagttaggaaaaccaagaaacttcagaaagcttttggtccaaagaagaagaagaaggtcaaagagattcaaggcttgcaaaggattgattga

SEQ ID NO: 59803 - DNA, 366 bp, Glycine max
  Peptide Sequence Number=SeqID_176581
atgggtgatcaagaggagacacaggaacagatgaaagccgacatgtcggctctgaaagaacaaatggcttccatgatggaagccatgttaggaatgaggcagctcatggagaaaaatgtggccaccgctgccgctgtcagttcggctgccgaagcagacccgactctcttggcaactgcgcaccatcctccctcaaacatagtaggacggggaagggacacactggggcacgatggcaaccctcacctgggatacaaccgagcggcttacccttatggattgccgcccaactactcaccacccgtcttgcaagacgatgcgtgtggcgtccccaaaataatgactggtttaatagcaatgatttaa

SEQ ID NO: 59804 - DNA, 705 bp, Glycine max
  Peptide Sequence Number=SeqID_176582
atgggttcaagggttacagcctgcgacggcatctcggagattccccttctcagcggtttatgtgtgctgaacgccacactgagcaagcctgatacgatgccttttcaaccccaattcgcgcagcagcgccaagccattcgtcaactcatacgccaacgtcggcgcgagcttacgccgggccagcaacgctttgccgcagacaagatagccgagcgcctcgtcgcgcatacgcacattaaggcggcgcacagcatcgcggtatttctgtcgtttgacggtgaactcgacaccgggccgctgatcgagcaactgtggacgctcggcaaacgggtttacctgccggtgctgcacccgttcagcccgggccacctgctattcctgcgctatgcgccggaaacgccgctggtgcgcaatcgcttcaatattctcgaaccgcgcctcgatgtgcgccaggtgctgccgctgggcgagctggacgtcgtgctgacgccgctggtggcgttcgatcataccgggcagcgtctgggcatgggcggcggcttttacgatcgcaccctgcaaaactggcgcagcggcggcccctatcctatcggcctggcccatgattgccagcaggtggagcacctgccgaccgagcactgggatatcccgctgccggaaatcctcaccccgctctgcagctgggcgtggcacgagcccaaatag

SEQ ID NO: 59805 - DNA, 755 bp, Glycine max
  Peptide Sequence Number=SeqID_176583
atgccgggcaaattagccaaaccgctggtgagtatctgtgtgaccgatggctcacttcaatgcgggggaaatattgcggatttttggcccgctgcggacaatgaaacggcgttccgtcttcacgtgatgcaggccttgggcgccggttggcggttcgacactggagagattttcgctatgagcctgaaagccgtcgacgagaaagatgacaagaaagacaaaccgctgggcagccaaagcctgttccgcggtttgcagttgattgagatcctgagcaatttccccaatggatgcccactggcgcatctgtccgagctggccggcatgaacaagagcacggtgcaccgcttgctgcaggggttacacaccagcggctatgtgacccaggcgccgtcgccgggcagctaccgcctgaccaccaagttcatttccatcggccagaaggcgctgtcgtcactcaatatcattcacgtggccgcgccgcatttggaacagctgaacctggaagtgggtgagacggtcaacttctccagccgcgaagacgaccacgtcattctgatctacaagctggagccgactaccggcatgatgcgcacccgcgcctatatcggccagcatatgccgctgtactgttcggcgatgggtaaaatcttcatggcctacggcaacgacgattacccggcccactactggcagagccatcagcaggagattcagacgctgacgcgcaataccatcaccgagctgccgaaaat

SEQ ID NO: 59806 - DNA, 351 bp, Glycine max
  Peptide Sequence Number=SeqID_176584
atggataatgcggcacaacccatccttacccttagccacatcgtcaaacgatttggcggcaacgtggcggtcaacgacgtcagcctgcaggtaatgccgggcgaggttctggcgctactgggcgaaaacggcgccggcaaatcgacgctgatcaaagtgctggcgggcgtctacccgcgcgacggcggcgatattcgttttcagggcgcaagcatcgcctccgccgccgccataaaaagcgccagccgccagccgatcgcctttattcatcaggatctcggcctgattgaatggatgacggtggcggagaacatggcgctggtgatggggtttccccgccgctttgggtga

SEQ ID NO: 59807 - DNA, 765 bp, Glycine max
  Peptide Sequence Number=SeqID_176585
atggctccgaaaaagctttccacgaagagatctaggagggacgccgtggctgaagggactagtgccatccccgagtttgatagtcaccgtttccggagcgtcgtgcaccagcagcgctttgaggccatcaaaggatgggacgatgagtacaccgattttcaggaggagatagcttgcagacattggacgtcgctggctactcccatggctaagtttgaccctgagtggattccttttgacgcagatgccctcaaccaattcctgggtgacccgctagtgttggaggaaggccagaaggccgacgggtttgacgaggaggccattgcccagctattgtgcacaccggggcaggatttcgctcgaaccgttgccgggagacgggtgcggatcatgcgcaccagcatgaccaccttgacccagatgtggatgatgttgctgctcagcaatgtcttgcctagtgatcataactctgatctccctctgccaaagtgtccgctggtgtatgccatcctgacacggatgagcgttcacgtggctcaactgattgttgacgccatctatttgtttgcaggtatgccacccaccaggcaccctctagacccagataagtctaacagggccctggggtttccagcattgatcacgggcttctgccagtcgttcggggttcccgtcacccctaacgcaccaccggcacctcatcaggccgatcccgctgggtcactaggcatggagcgttatctacaacacttggttcgccagtag

SEQ ID NO: 59808 - DNA, 354 bp, Glycine max
  Peptide Sequence Number=SeqID_176586
atgcttgaatgcctagtaggtaaatctcactactgtttccttgatggttcttcttgttatatgaaaatcactattgctcctaaggatcaggaaaagaccatattcacttgccccttcagcacttttgcctataggaggatgcctttcggcctgtgcaatgcccctggtatagttttaggccacattatttccaataagggcattgtcgcaacctacccttcggcgggagggcgacgcgtgactcgcgggatgcgtgttccacgaaaggaatacgcgcggagtcgccaccaacgtttattcgaggaaaacgtcggaaaaaccggaaaagacgcgatctacgaacttttaagttga

SEQ ID NO: 59809 - DNA, 174 bp, Glycine max
  Peptide Sequence Number=SeqID_176587
atgtcaatggaaagcctcgtcgggcgtctaggagtacatgacaagacaaaccacatactaggagaccagtcagagtcacgttgttttgtgagaatgctccaaccatgtgggatcgacacatacttaaaggagcactcaaaccgggtgtatttaccccaaggcctacactcttga

SEQ ID NO: 59810 - DNA, 266 bp, Glycine max
  Peptide Sequence Number=SeqID_176588
agtggtacctggagatatgtcgcgggggtcaggagaccttggggacgtcaggcgagctcctggcagtcaacagataaaaggaacaaagaccacaaagcaaggaggcttgtgtggtggctggccagctgtgaactttgatttatatgtgagatatggcctctggcttcaaaaagggaactgggagattgtggaggcctctggtaatcgattaccagtctgtgtaattgattacacagaggaatgggtcactggtaatcgattaccag

SEQ ID NO: 59811 - DNA, 448 bp, Glycine max
  Peptide Sequence Number=SeqID_176589
atggcaaatttcaaggcagcaggtgtcattcccaaagacctcaattggcagcagagaaagaaattcttccatgatgtccgacattatatttgggatgatccacacttgttcaaagtaggatttttctggccagcactctttaaagacgcccatcaccatgtcttaaagtgtgaccaatgtcaaagaatgggaggaatttcccaaaggaatgagatgcctctgcaaaacattatggaagttgaagttttttattgttggggtattgatttcattggtccatttccttcatctgcaggaaataaatacattttggtagctattgattacgtgtctaaatgggtggaagctatggccacttcaagaaatgatgctaagactatggtgaagtttatcaaggagaatatttttgctcgatttggggtacctcgaatcttaatccgtgatggtg

SEQ ID NO: 59812 - DNA, 324 bp, Glycine max
  Peptide Sequence Number=SeqID_176590
atgacggaaatcaaaaggaagtattgttacgcaatccgcccatttgggccttccagattaggaagcaacctggctcgcctgagcgagctgggcggcaacctcctccccctttttcctataaataggctgaagggggctgttctaagggtcccggatccccctggtgatgtatttaagctgttttgggtgaacaaaaatggtttccgtgaagacaatccaagccgaggtgcttccgtaacgcttccgagatgttttcgtaagcaaatccgtgaaggttttcctccgttattcaccgttcttcaacgggtaagtttccaaatctaa

SEQ ID NO: 59813 - DNA, 141 bp, Glycine max
  Peptide Sequence Number=SeqID_176591
atggagcttacatcagacgctgacatcactaggaaaggtgcagatgacgattcttggtcgaaagatgctggcatctccggggaagctgcggatgacgacattagtcactgcatgctatcaggctttgagtcttacggatag

SEQ ID NO: 59814 - DNA, 207 bp, Glycine max
  Peptide Sequence Number=SeqID_176592
atgcctattttgggaaaagatctctggaggcagcaaggggagcagcttttgcagagatacctaggttttaacttgaatgaagtagaattgaaacatagtcttacaagagggatctgcggattaagttttggttttaagtatgctgttacaataatgttgtttggtctaagtctagtccaacaagatggatttaaggacaaagcttag

SEQ ID NO: 59815 - DNA, 186 bp, Glycine max
  Peptide Sequence Number=SeqID_176593
atgtggccatctgcgccctttccggagatgtcagcatcttccgatggagacttttcaagtctcacaagttatccagaactacgtagagccggcgggcccgatgatacgcggagataccttacggttatccgcacccttttgtcatccagagccggcagacccgatgacatgcagagactgacatag

SEQ ID NO: 59816 - DNA, 336 bp, Glycine max
  Peptide Sequence Number=SeqID_176594
atggaggccatgaaagagcaaatggccacaatgatggaggccatgataagcatgaagaagataatggaagccaatgcggttgcagttgccgctaccagtgctgttgctaaggtgaacctgatgcccccatctggcctcaaccaaatgaatcatccaaccttagctagggtaggcaaagatttggaaattacgggcggcccccattatgcgcaaattcaaaacaagcatgccttccttccatatggcttgccttccaactatacaccacccaatgtggcgtacactccaaatgagaatgttaataactccactccgatactcattgagagccaataa

SEQ ID NO: 59817 - DNA, 264 bp, Glycine max
  Peptide Sequence Number=SeqID_176595
atggcttctatggacacctctgctatggtcaactctaagatctttccatgcaatctaggaatgcgggggttcggggaatttgtccccttcttagatacggcgtctaggggtaacgaaatgccccaacgcacgtttttaagaaggcgacacggaccctccgttggtttgtttacagtagggatcaagacagaacccatatgcaatgcctatgcaaaagacacaatgcgggaatgtgcacagtatgacaatatttaccgaacataa

SEQ ID NO: 59818 - DNA, 226 bp, Glycine max
  Peptide Sequence Number=SeqID_176596
atgttgtctagaattcaattccgcacattgtcaccgttgggatttacgataaaatattcctggagagagaataaggaatcgcacgaagacagtaaaaatggaggcttcaatcccttctccgtttctatgacgtttaggaattctatcggaacagtcggaggaaaagctagaggaatcaatagagatgctattatcgctgtcagaagacacgtgatcccgcttagag

SEQ ID NO: 59819 - DNA, 270 bp, Glycine max
  Peptide Sequence Number=SeqID_176597
gctggagaggaaaggaagtttcaactaagtgagctagatgagatccatttagaagcctatgagaattccaaattctacaaggagatggccaaaaagttccatgacaacttgatagctaagaaggacttcgtgttgagatcgaaagtgaatccatataagagcttcatggtcaatggacaccggctgaaaccattcctcataaatccttccttggtggatgtagtggtggaggagacctccttacttcaccctacttctcttctgccatga

SEQ ID NO: 59820 - DNA, 270 bp, Glycine max
  Peptide Sequence Number=SeqID_176598
atggagggaaggccagtaaaggcgaatattcactcaacaagctcagatatgtcaaagtgtcaaacacaggaagaaaaggaaaggcaaagtctgaacagaaatgttgtcagggacaaaaccaacatctattacccgtactctcttctcttccctggcttccaatttccaacacagcttacgacatcaacttccccaccactggtcccactcactcaccccctacaaatattccccaacttcactttcattctttatgacatctacttataa

SEQ ID NO: 59821 - DNA, 297 bp, Glycine max
  Peptide Sequence Number=SeqID_176599
atgacaatgcctcttactctaaggaataagctcaagactctttgtacttgtggtgatggctggtcttatgctattttctggcgctttcatccacgaaattctttgttgctgactgtggaagaagcatactatgaagagcatctgggagaagagattgccaacatgcatccacaggatgattctgaattgcagcaacagttctcctcagggataaagactattgtggtcgtacctgtcaaagcatggggagtggtacagtttggatccagaaagaagcaaatgttcttgactatttga

SEQ ID NO: 59822 - DNA, 318 bp, Glycine max
  Peptide Sequence Number=SeqID_176600
atggctgaatcagacatgttggtgaaagcctctgctgatcacttttacgactccttgaagggtaagaaacagcatcgtgttcatgatgttgcacctgatcatatccataaggtggaagttcatcaaggtgagtgggcggagaaatctggcaatatcaaggagcttacatttgccgttgaaggtgatgagcacagccttgtgaagtggactttcttgtacgagaaggtggatcacactgcttcagagcctaccaaatacaaagatttggtggttaaactcgttaagaacgtcgaggcccttctcgttgaggcaggttaa

SEQ ID NO: 59823 - DNA, 294 bp, Glycine max
  Peptide Sequence Number=SeqID_176601
atgaagaaaggattttcaaaggatgaagttgatgaaagaaagagaaagagaaatgatggtaggctttgtaatttagttgaaacgcagaagcagaaaaagggaatgttagagaccttgggggctttggccaacattggaaccattcataaacaatgttctcattgccaacacttaaaatgcaacgtcaactctgcctctttcaaaggttcgccattaaaacatgaagttgatgccacaggacttgttgaatcaatgcactggcatggctccataatcttggtatctcagatgtaa

SEQ ID NO: 59824 - DNA, 147 bp, Glycine max
  Peptide Sequence Number=SeqID_176602
atgtgtcagaagcatctgcagaatttggctcgccctaaacagtgtagctatggcaatttccaattggagactcaaaaatttcccactgagaaaatattttttgtcaccaataacccttggctggcagatgccaaaaagacaatttga

SEQ ID NO: 59825 - DNA, 105 bp, Glycine max
  Peptide Sequence Number=SeqID_176603
atggagccaaagttttgtctatatggcttgccaactgcatccttagcaaaaatgggttctgcatatggagcccatgctagggcccggttcgtaatgcctgcagag

SEQ ID NO: 59826 - DNA, 201 bp, Glycine max
  Peptide Sequence Number=SeqID_176604
atggacagacacaggccttgccataatggagttaaacactatgaaagcttctccatgaaagaagaagaatttgtggacaacatgtttggaagacttcaagtgattttgaatagtcttgaagctttaggatacaccttcaccaaagctcagataaatagattctatacaactttcccaaggtgtgggaaccaaaaacaatag

SEQ ID NO: 59827 - DNA, 444 bp, Glycine max
  Peptide Sequence Number=SeqID_176605
gctgcagcatattattatcatggattgattcttgatgagggaaacacggagaaatctcaagggatggctgtagctgctttacaagcagcggatgagtatttcaaagaaagtaagaagttgtgtgaagcattcaatgcagcacctccattgtcaagaaatccaccactttgggggactatgaaatatctttacgagaaaattcctaaggatacctcaagcaaggtgcgaataaaccgtgatctgtactcctatgagaggactgataaaatcatgtgttttgttgtcaacgcttattacagaatcatggagacagcaccaacattgcctgattttgccttggctttgaaaccagatgaatatcagcttcctcaggtggatccctcttggagaacagaaaatgtgaaagggggacaaagtggtgccaccaaccatgtcaatggatga

SEQ ID NO: 59828 - DNA, 294 bp, Glycine max
  Peptide Sequence Number=SeqID_176606
atgcgggatgaacccggaaagctgggttacggtgcccaactgcgcgctaacctagaccccacaaagggtgttggtcgattaagacagcaggacggtggtcatggaagtcgaaatccgctaaggagtgtcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 59829 - DNA, 453 bp, Glycine max
  Peptide Sequence Number=SeqID_176607
atggcaactcgaagatatgagtttggaaggatgaatgaggctagccacccagactccatcagagctgccttggttgaattcctctccacttgcatctttgtctttgctggagaaggctctgcccttgctttgcgacaaatttacaaggaaccagggtcatcagcgggtgagttagtggtaattgcactagctcatgcctttgctctatttgctgctatttctgctagcatgcacgtgtctggtggacacgtcaaccctgccgtcacctttggtgctcttcttggtggaaggatctccgtccttagagccctttactattgggtggctcaacttctcggttctatagtggctgctctcttgttgaggcttgtcactaacaacatggtatatatgctacatcaaatcccactttttcctcttactccctttcttatcagagaaattattacatga

SEQ ID NO: 59830 - DNA, 249 bp, Glycine max
  Peptide Sequence Number=SeqID_176608
atgaaccctgctcgggcttttgggcctgccatggtgggttggagatggcactaccactggatcttctgggtgggcccattgattggggcagccctcgcagcactcctgtatgaatacgttatggtcccaattgagcctcctcatcatcaacctttagctgcgactaaagttgcaactgacatcttcagtgttaagtgcaagagattcaacgcgtttgaaaatttcaatgattctgcaaaatttcaatga

SEQ ID NO: 59831 - DNA, 600 bp, Glycine max
  Peptide Sequence Number=SeqID_176609
atggagcccagcaaacaccaccaacgccaccagaacaagaccaagaaaaagtggttcctcccactaatcctctccctcctcatatccaccttcctcatcctcctctccgtcatcgtttcctccaactcaccctcccagcggtggcaccaccatcaccgagccccagtcccaaaggaagtggtgccccgtttcgtcgagtccaagctgaagataagtcccacatcgacccacttggttccgagaatcgcgtatttaatctcgggctcaatgggagacggtgaaagtctcaaaaggacgctgaaggctttgtaccatcctttaaaccactacgcagtgcacttggacctcgaggcctcttccaaggagaggttggacctcgccaatttcgttaggaacgagcctctctttgagaagttcgggaatgttagaacggtggttaaggctaacttggtaacttatagaggccccactatggtgactaatacccttcacgctgcggccattttgttgaacgaagctcaggattgggattggttcattaatttgagtgcttctgattatcctttggtaacccaagatggtaggtacctctcttgttaa

SEQ ID NO: 59832 - DNA, 597 bp, Glycine max
  Peptide Sequence Number=SeqID_176610
atgactaacgctgcggccaggaaagaggaagagcatgcagagattgaaatacagcaagaaagcattcgtcaagttacctccatccatcatcaattaaccaatgaagaggaaaagcctgaagtctccagtactccagaatacccctacttggccattgttggctatgttggagggaaagataaaggtagattggaactcagcgtggaggatcaaaagatctcttttgacctctttgaggccatgaaacactcagatatgggtgattcctgtttcgaagaagaagaggtggagcaggaaatagcattgttagcctcaaccatgatactacagtctcccttggaaaaagaacatggctatgggagagattgcttagcttgtgatgaagagctcgatgattcaaaagacagttgtgttaaccaggtggtttttgaagaattggaaaaactgagaccagcagaaaagcccaaagcagaattaaagaccctttcggcacatttaaagtacgtattcctggaagaggatgagaccaaacctgttataattagcaactctttgaagaaagaagaagaagatcaactagtgcagattctaaaatga

SEQ ID NO: 59833 - DNA, 482 bp, Glycine max
  Peptide Sequence Number=SeqID_176611
tccaaactcaggagcacaggtcgcttgagcaaatggaccaatggcttacactcaattctggatttacatgcgattctcctcaaatttcagccagcccgcatcaattagaccttgcaccttacgcttcaggcccctacaatgctcaatggaatgccccagggcttctccatgacaagcacacgttgcgttcgagtcgtattctcggagaaatggaggttgatgaaccttggttagggttatggctaccattgaattatcaagtagatatgggagcaagtggtgtttgtcatcggaagtgcggtaggttggctttgtggttgattttagggatggcctttgtgaataactgggcggtgggtaaggagaaggtttgttattggctgagtaatgacattgttgggttggtgggaaacttggctgtattggaatggcagtcacagcacgggcttctccttcatcctcaccctcttcatttgccctag

SEQ ID NO: 59834 - DNA, 249 bp, Glycine max
  Peptide Sequence Number=SeqID_176612
atggcaaaccttcacggatttgcacaagaaaacatctcggaagcgttacggaagcaccttggcttggattttcttcacaaaaataatttttttcacccaaaacagcttaaatgcatagccagggggatgaaggatatttggaacaaccccgattcgcctatttatagcaaaaagggggaggaggttgccgcccagggaagcaaccctgcttcaaaaatattctggaagggcccagattcgaatatttga

SEQ ID NO: 59835 - DNA, 459 bp, Glycine max
  Peptide Sequence Number=SeqID_176613
atgtgggcttttcttaccagtcgtcagatcgactgggctcacttgcttcggtaccggatgcataaggcattacgggccaatgcacctctctcttatcctcacctcgtcaccctttttcttcatcatttcaaaattccttggaagatgaaccatttgttcaaggaaaaaggtcttttgctattggtgctgtgggttcgaaaacatgacttacctcagccaatccctgacgaacgtactctttctcctccaccgcaaagggttgattcctcttcacttctgaacgatgttctctctgaactccacagtcttcgagcttttgtgggtgaccgatttgatgctatggatactcccctggatgccatggatgctcacttcgatgggatggatacgaggattactcgacttgaggacgatatgagcttcattaggcgttgcttcgatccaccagccaacccttag

SEQ ID NO: 59836 - DNA, 165 bp, Glycine max
  Peptide Sequence Number=SeqID_176614
atggtgtcaaatggtcgtaatgatggttcagtgacaaggcaatacattaatggtgtcaaatggtcattggttgcaagtgtggttgtaggggatggagaaatagagataaaagataatacattaaggataaagatggttaagaaaatcaaatggagagtaacttaa

SEQ ID NO: 59837 - DNA, 795 bp, Glycine max
  Peptide Sequence Number=SeqID_176615
atggagtggaatagctggaatcattttggctgcgatgttaatgaaagtgtagttcgagaaacagctgatgcaatgatgtcaacggggctcgctgctttggggtaccaatatgtaaatatagatgactgttgggccgaacttaatcgagatactgagggcaatatggttcccaatgctgcatcatttccttcaggaattaaggctctggctgattatgttcacagcaaaggtctaaagttggggatctattcagatgctggaaatcaaacatgcagcaaacgtatgcctggatcactgggacatgaagaacaagatgcaaagacatttgcttcttggggagttgactatttgaagtacgataattgtgaaaataatggtataaaagccacagacaggtatccaccaatgagtgaagctttattaaaaactggaaggccagtcttcttctctatgtgtgaatggggatggcaagacccagcaacttgggccaaaactgtgggaaatagttggagaacaacaggagatattgaggataactggaatagcatgactaacatagcagatgcaaatgaccaatgggtatcttatgctggacctggaggatggaatgatccggacatgctggaagttggaaatggaggcatgaccacagaagaatatcgtgcccatttcagcatatgggctttagctaaggctcctttattggttggttgtgatattcgatcaatggacaagacaacatttgaactgataagcaacccggaagttattgcagtaaaccaaggcatgaactga

SEQ ID NO: 59838 - DNA, 267 bp, Glycine max
  Peptide Sequence Number=SeqID_176616
atgtacatcaatacaattcaaattaaaagtttgatctcaactaaagggaaaagaagcaattaccccatgggaggtgtttggccgaggccactttggaccaggtttctcctctccgtcaacacagacaatcttctgctaccgttcactaataagcgagcagttgaaggatttccatgcaaaagcacaaggatgcacaaggcaagcaccataatctccatgggtaacctgcggctccaactcgagaatgaatattgcattgccatatag

SEQ ID NO: 59839 - DNA, 582 bp, Glycine max
  Peptide Sequence Number=SeqID_176617
atggctgcaccaccgacgaagtacacccaccacaccaaactactcataccccccggccccgaagaagatccacccaaacacccctatccaaaactcctcagaataaccgtcacagacaccgacgcaaccgactcctccagcgacgaagaacaaaccaacttttccacgcgccaccgacacagaaagctcatcaacgagatttctatcgccagagcttcagacactcggcgcggccagaaattccgcggagtgagacagaggcctctgggaaaatggtccgcggagatacgagacccgtcgcaacgcggtgttcggttatggttgggtacctacaacactgcagaggaagctgctttggtctacgacaacgcggccattaagctgcgtggaccccacgcactcaccaatttcatcacgcctctgttgaacgaggatactcacaacaaattcctcttttctcccacttccgtgcttcacgtgtcggagaataaggtcaaagtccgaggttgttcgccggtgccggacagtgtgttgttctgcgatgatgattggtctagtgagtttctcactgcttctgagtga

SEQ ID NO: 59840 - DNA, 396 bp, Glycine max
  Peptide Sequence Number=SeqID_176618
atgggtctctctctccgtcttcgcttgggtcactctttctctaacaccgcagaaggaagcagtgggcgatgggagcatcaaggttcgtcggaatcgacctcattcactgcttttcgttctctcttcaagcttccctcgctgccgtttgccggaatcgacgacaataatctgccacaccaaccgtccaccgaaggagaagtggcccaaagaaatggtatgaatctgatgagtgatattgttgttgttgctggtggtgccattgttgttcatggagtgatctttgaagaggggttacaggaagtaacgccgttactttgtaggcagaggcgtcaaaataaattcaaactcaatgtgtcaattaggttacacgtgcatcaccaggttgggtcagattga

SEQ ID NO: 59841 - DNA, 432 bp, Glycine max
  Peptide Sequence Number=SeqID_176619
atgcataaggcattgcgattaaatgctccattgccatattcacacctagtcaccctctttcttcaacacttcaacatccctcttgattctaaactttatgttccaatcaagagatcctttctaattggcgctgcagtgattgcatcctttggttaccgtaaagagcatgatggctcttgggataaaaagggtgctcaacccattgatgaagaaggacacttacatggtggagaagattcctttctttttcaaaagattttggacaggtttgatggtcttcaatcctttgttggtgaaaggtttgatactttggagttacaagtggacatgcgattcaatgagatggattcaaggatcaccaaggtcgaagaagatgtctcttacatacgtacaagctttgatctaccaccaccactgccaccatcatcttag

SEQ ID NO: 59842 - DNA, 186 bp, Glycine max
  Peptide Sequence Number=SeqID_176620
atggtgtgcctaaaagcaagggattcaatgtggtatttggatagtggctgctttgggcacatgatggataacaagtccaaactcgctaactttgtgtcaaaagatggaggatgcgtcacatttggagacaataacaaaggaaaaataatgggagaaggaaatatagggaatcaacacaaaacttag

SEQ ID NO: 59843 - DNA, 327 bp, Glycine max
  Peptide Sequence Number=SeqID_176621
atggcaaagaagaatgaaagctatgtcaagcaagccaataagaacaggaaggaagtggtacttgaaccaggtgatgatgttgaacatttgaaggcaaatgctttccaagaagaagggaatgataagaatcttgaaactgcccaaatacaaggacctatgaccaagagtaggactaaacagtcagtggatgccctccaacaaatggtagcagacatacttaacaaggcccaagtggagaaggatgaaggcccaaaggcagaggcactacaaagcatattaatcgttgctgaaggcccatgccaaatatgttctattttttatttataa

SEQ ID NO: 59844 - DNA, 381 bp, Glycine max
  Peptide Sequence Number=SeqID_176622
atggccgctgatggatggtgctgtggtgccgtcggatctgttcatacagtcgccatggtggcgcaacctgttcgagaacccgaaaacggtccagttcgtgcaccgcatgttcgcctatacagttcttgttctggctgtgctgcattcgctgcaggctgttatcggtattgcaacgcttctgatgagcgttccgctgcatctgggcctgacgcatcagttcttcgcgttgatcgttctggctttcgcggttgcgcactggcgcgcaacaaagggcgcttacgaggggtagctggtccgacgcaagtgcctgagcgcggaggcgatcttcagttcccgcgcttcatcctcgtcgttaccgtcttcgcgatgccacgcggctga

SEQ ID NO: 59845 - DNA, 294 bp, Glycine max
  Peptide Sequence Number=SeqID_176623
atgccgccgcgtttttaccctttcactgtcaccgttcaccggttagtgaagaaacgggaaaaggagaactgcgccatgcccgttcggctgaagaaactgatcggcacttttttgctggttgcactggttatcatctacgcggtattcgcgaccattatcgccgtggcgcatctggcccagtcaagcgcgtgggtacatctcctttatttcttcgtgaccggcattctgtgggttctgccagccatgggcatcatctggtggatggcgcagcccccacgcaagaaacaacattaa

SEQ ID NO: 59846 - DNA, 651 bp, Glycine max
  Peptide Sequence Number=SeqID_176624
atgcagcccggccacgagcccacccaggtaaatctgcacgagcacggcgaacacgatccaacccgcaaagcgctggaccgaccgttccgccggtcgttcgctataggtgacaaggccccgcgcaatgtagaataccgccgttatgatgacgcaggccgtcgtcagatggatcgccaggcgatactggctgacgctcgtcagctcgctcaggccggaggccaccatccaccagccgatggcgccctgcaggccgccgagcgcgagcagacccagcatgcgatatttgaggccaccgcggaggcgtcccgtcacccagaagaaggccagcggaacggcgaccagaaacccgacaaaacgcgcaagcaggcgatgcgcccattcccaccagaaaatgtactggaattcctccagcgacatgcccttgttgatctgctgatactggggaatctggcgatacttgtcgaattcctccacccattcggcgtggttgagcggcgggatgacgccgtgaatgggcttccattcggttatggaaaggccagaacccgtcatgcgtgtggcaccgccgaccatgacgatggcaatcagcacgacgaaaactgcataaagccagtaacgcacgaggcgacggtcgcggtcctctttggatga

SEQ ID NO: 59847 - DNA, 168 bp, Glycine max
  Peptide Sequence Number=SeqID_176625
atggtggctcaaacagtgatggtgtccggagggtttaagaaaaggggttggtcgaagggacggtttgaggagagctttgccagctcgagcaggcctggtcaagcttaccatgttgtcgatgtcactgttcagcagtgtgtggtgtttggggtcgtcgtcaccatgtaa

SEQ ID NO: 59848 - DNA, 234 bp, Glycine max
  Peptide Sequence Number=SeqID_176626
atggagtctgtcgcaacctaccctccggcggaagggcgagctagactcaaggcaaacgatgacgacatcaatgttgtcattcaaggaaagcagctatgcgagcaagaatctaccgtaaaggggacacttgtcgtgggtacctttgaaaatggaaacccaacaaatgtggcgagtcccttgcatgagaaacttgatgatcacttgttgatcatcgccctacaaagagagatgtag

SEQ ID NO: 59849 - DNA, 276 bp, Glycine max
  Peptide Sequence Number=SeqID_176627
atgagatggtgtgggaggaaaaagagaagcaaattgatctctccttggaggcatcctcgaactccattgtccaatggagaactcaccaagggggccctaaaatgcaatgttgatgcctccatctttacggatacaactaagtttcgaatggaagccactgtccgcgatgttgatggcctctttatatccgctcaaacttccactaaagttggaatcctctcaattgccgagtttgaggcttcagctcttctagaggaaatttttgttgtagtttga

SEQ ID NO: 59850 - DNA, 168 bp, Glycine max
  Peptide Sequence Number=SeqID_176628
atggcgtttcctgttgtggtgaggactgaggagtggaacactcgcattgacactcttaaggtgcaaaaagccaccatgttgtacatagtgtttgttggaattctccagcgtgaagtgcacgagggacaaggtggggagaatggcgtttcctgttgtggtgaggactga

SEQ ID NO: 59851 - DNA, 624 bp, Glycine max
  Peptide Sequence Number=SeqID_176629
atgaagtgcaaggcaaaaaataaggttggtgaattttctctaaagattgacataagcaaggtgtttgataaagttgaatgggaatatttatttgctttattgttgaaaatgggttttgataccaagtggataagctggataagattatgcatagagacagttgattttaatgttatgattaatggtgacacaattggtcatattctccctagaagaggtcttagacaaagagatccattatctccttatctctttgttatatgtatggaggtctcacctcactcactcacaccatcaaccttgtgttgttctgtctcgtttgctcactccgcctctagcaactcccccttcctcaccaccaccatcttcgccttctccccactcccacacttcctcgccttccttgccccttcccttactgccaagctcctcctactcacccttgcctccgccctcgaggtctaccttatggtcatcataagtgtcgcccttgttgtctctgtcgccaaagagaggttcaacatggatgccactcaggttggatccactctcagggagggaagcggggtccgtggaagaatagattcaacgccgacaaaaaccaagctgagctggatgctatga

SEQ ID NO: 59852 - DNA, 723 bp, Glycine max
  Peptide Sequence Number=SeqID_176630
atggtgaacaacccctcaagagctcagaagaaagccaagactttgaagaggaagcaaggtgaatgctttcaggttgctctcaacaggttggacacatggttcactgatgaaagtaagaagaatgattacaagatgatttatgatgcgaagaacgtgagaatacccaagtatttgaacttggaatggttctctcagcaagggttcaactttcctaatctgttggaggcacaaggtttgtctaaattggtgcagttgaaaggaacattctatccggaactggacaaggttttctacacctgtgcacttgttgacctagaaagtaacctcttttttattgttaatggagtagaaatggtcattcacattgaagtatggaaggaagtagtcggtctggacatgggtggagtccacaagttcgatgaaacagctgatgggtacaacaagatgcagacctataggggaatgcttcttgacccagcaaggaacttgaggaatctcctaactgtctatggtctaaaatcaggtatcaagatgaattgggtacttttgatagaagacatcatgttaaaaagtcatcagttagtggactacaaatttccttatgttgtacttgcctcaagattcattgactacttcaatatcgatgtctccaatgagatagtggattttaccaaaacatctagtgagatttaccaaaaggcatctcaagaagcttggaatgag

SEQ ID NO: 59853 - DNA, 345 bp, Glycine max
  Peptide Sequence Number=SeqID_176631
atgcatgtgagtgagagcaccatgatcggtgttggaaagcgtgattttgtggtggtgggttatgtgttcttcgtagatctgggtttgggtgttgggccacatgttcgcaaatctggatatgggtggtggttgcaaatctcagtttgtggtgacttgtggtggtgcaatggtggcgcaacggtggtgatttggagatctagtgttcatgttattcatttgtatgttggcaaactgcgctgcatagactccacagtccctgtcgagccattgtttgaaagtgaagtcaacaagttgaaggctgatcagtccaaaccattcgagcaagtgatccttggaaccgtttga

SEQ ID NO: 59854 - DNA, 1005 bp, Glycine max
  Peptide Sequence Number=SeqID_176632
atggctgagaagtttcaagctgctatttatggtgaaatagctgatgcaggaaactacaacacttggcaaagtattactgatttcgtggatttgaagggaacaaggtcttgtgttgaggagactaatattaacttggtttcttctgatacttctatgagttttctttatgccgagaagccacaccagagtggaattggcagcatcttgatcgattccatcttacaaatgatgggttttggcatgtcatcttcaacttcaccgaattggagtcaatctttattgaacttcattatcatatcaagcatatccttatcttttgtgaacttctttctctgcatagggagcaattttgattctgtgcttcaaaaagaaacaaacgtagttggtggtggttcttccaatgattcacaaattcaaaaggattggagtccaaacaatttctcatctagtggtggtggcgtgcaagtttccaccattgatgctttcaagccaatgaaccaagaattttccttggatcagcagagtctaaattctgttgttacaagcacaaatggatcattatctagtggtaatttcctagttttttcaacctcctatggttgcctttcaacattgatacaaatattatatgagcatcaaccacaaccgcagaactcacttttcaccaacccctccatgtcctatgggacatgttccaatgaattgtcaccaacttggtccaaagtctcttcccttctcaaaccctcaatgccaaagcaacaacttagtggattgcgcttttccaacaacactacttatttatggaattcttcaaccgaagcgcttaatgacctaagagcaagtgtttttgcttcatcacaagcgcaatatcaaactccaaaatttgaagagaaacccaattgcctccgtactccattaaagaagctcaagagagaagaatcactagacgcaatgaagaaaaattctcctgagcctgctgcattcaagacacttggtgatgagtaa

SEQ ID NO: 59855 - DNA, 1113 bp, Glycine max
  Peptide Sequence Number=SeqID_176633
atggtcagagaagtgggtgtaaacagatgctatgtgcaaggctcaaggactttcaagattaatgatattgtgatgcatgattggaagcttggtgagcaatttagggatgtgagaggttacgatgtcccaggcggcttcatcaactgcgatggtgtggatgtagcaagccagaacggagccagaagcgaagacccaattggtgcccttgttgcgggagagggtagctttggcgacagcgacgacgaggtcgaagtcttccttagtaggatgcgagaggcggagcctagagcagcgctaaagtggttgcttgagaaccctagagggagagtggaaaaggaagtcgtgagagacttggacaatgttgcagaagaattgagtgagtctaacaaggtggtggcagcacaatgccacaacgagaggaaggaaggagatgttggtcgttggcgagtggcagtagcacggcgtcatgacgagaggaaggaaggggagggcactatggctgccacggtgaaacaaatgtctttgatcgtgtcactgttcggcgtggtgtccttcattttgggtgttgttgctgaaaacaagaagcctgcggcaggaacacccgtgcctggtttggatggtgtctctgtcacctgcaagtacccagctgatccaactgttgcattggggtatctttctacagcatttcttgttgcatccactgtgactggatatctgtctttgttttacccttacaaaggaaagtctattccacaaggggttctgtttaagcacaccactttcacagtgttcttcaacatttctttgttcaccactggattagctgcagctatgctgttatggccaacaatcaccgaacacattcacctgacacgcaatgtgcaccgcaatatcaactatgaatgtcctacagctaaaactggtctacttggaggtggtgcctttctatcacttgattcatctctcctttggttgattgcccttatgctagctgacaatgctcgcgaggacttctttgaagaagaaggagaagatggtgacaagggtgaatttggcacagcctcctctgatgcttattatgatgctgattcaggaccgaaggctagttcctga

SEQ ID NO: 59856 - DNA, 363 bp, Glycine max
  Peptide Sequence Number=SeqID_176634
atgaagttgtctagcaagattggacgggtctccttgaacagcatgtccaagaagcagtttaagtttgattcaaacggacgggaagccccacttcctgttctactggcaatcagaccccaccagaggccactcatgaggcaagtcggacctataggtgggattgtgccaccgtctactactactctggctgtgggagaagggggtcaacctgctggtgaggctgcaaggttgatgcctagtgcgggttacactttgactacgcaagatgtgcctccaactccaccaaccatcgaggctcctgctgatgctactactactgctactacttctgctttttcacctcttcctgttgttgttgtttag

SEQ ID NO: 59857 - DNA, 465 bp, Glycine max
  Peptide Sequence Number=SeqID_176635
atgacacaaaacttcaaaggcctgcatcatcgcccaactgtttcgatgaagttgggaaggggctacattcaagcgcttcagcaaagcacactaaaaagcggtcaaggaagaagggcggacgagcatgcacccccctcaaaaatgggaaatcataatttccgcaagcctgaacagccatcttacaagagtcctcaggcaacacctggggtggatgacggcgacccaacactttgggtacgttgcacatggggagacgccctcacatctccactgccactacctcttatcataccccaagaagccgaagaggggagaatcacagtgccaggactggctccccagcagcagcaaaaggtcatgcccttccatgaggacgagaaacaccccaaccagcacgacgtgaggccctcaccctctcggaagaagaggactcaccatcggaggcacctcggtgagtatccttag

SEQ ID NO: 59858 - DNA, 1284 bp, Glycine max
  Peptide Sequence Number=SeqID_176636
atgcgggttgtacgtcaaagaaaatcctccctgcctggttatctaggaagacttcataagggatccacaaccattcacaacatttctttgctacatgatcaagtcaaggttggtgttgaggaggttagagatgcagatgctcccattcttgtacccactgaagagggagctgtgggacctgcaaaacctgttatgtgggatgctaccgtgtttggggtgtttaatgagaacttccccttgtacataaagcatgaagatctatatgaaatagcacatggtggtcaatgtctaaacatctctgttatacagttgtggattgtgcatatgactgagacaagtatgggagcggggaatgccgatgtgtatggattcctcgagccacagccagacaactacctcaaaggaataattaacagtgctttgaaaggacttgacaatactccacaaagtaaatccaaggctactgccaagtggattgttgttaaagtggacgtggttgagtggggtcccgaacttcacacgtcagcttggaagggtgcctttgacaggaggggcatccgtgttcctgtagcagggctaaaatggagggtggacacgttgtccagtgttaaaggaagattgtctcatgttgaaggagtttgtcccggcgaggagtttgtcgagcccctaagtatggatgaacattgtccaatgtcagactgcttttgtcatgttgtttatgatggatgtgtctttggcgtgtcaggcatgtgcaacgcacgcgtattagtcttgcatacatgtcactcatggagtaggcacgtaccggagttgcggttcgtgcgtgagtggggaagcatcgtggtgcaaaattttagagcaccacttcaacttccaccaattaccgaagatttacctttcttctttgttcgatttctcgaggcactcccatcttccagaatgtcttcttttttgtctgattctgccatcggtctgggtgacagtgattctagaggcttgattgagcaacccatcatggatcagaaggttatctcgataggtggttccttatctaaggatactcaccgaggtgcctccgatggtgagtcctcttcttccgagaggggcatgaccttttgctgctgctggggagccagtcctggcactgtgattctcccctcttcggcttcttggggtatgataagaggtagtggcagtggagatgtgagggcgtctccccatgtgcaacgtacccaaagtgttgggtcgccgtcatccaccccaggtgttgctggctatgagtag

SEQ ID NO: 59859 - DNA, 264 bp, Glycine max
  Peptide Sequence Number=SeqID_176637
atggatgttatggactggtgtgagacttccagtaaaattttggagtcgatccaacggttaacgtcatccgaggaagaccctgaggaggacctggaggagctacctcctgagcctgctgtggatgcccttgactttctagagggtgatgaagatccacttcttgaggtggattctcccgaggaagtcatgtcggcatctgaggcagactctacggaggatagtggcccgagggagatggcgatcagcggaggctcttcatcctag

SEQ ID NO: 59860 - DNA, 243 bp, Glycine max
  Peptide Sequence Number=SeqID_176638
atgatgcacaagctgttcattaaagaaattgccacttggcggagagagggtgacacctttggatcagacccattggggatgacactcggggaaatagaagatttgatggaacaagattggaccggtaagatggaaagtgacccgacgtcgcatcacaaacacttggcaatcttcaatggggatgatgccaccagggtgtatcaaaatagtgacggggtaaagcccggcgtatgcagcaactga

SEQ ID NO: 59861 - DNA, 333 bp, Glycine max
  Peptide Sequence Number=SeqID_176639
atggtcattctgcgtcttgtatcaaccgagaggaacaagttcgacagtattgggatgatgttccgctggcaggaaggttccctggctgaaaggtgtttcactcgaacgaaattagtgtcttatctttacttcccttttatctccaataaaagacaagtaaagaggggcaactgtcatatcctaatttcgtccggggaccatccgttgttgggatgcaaccctcgtttgaccactttgaggtacttggcacccatcgttaggcgatccgtcaaattctgtgacatgccggaagtcaagagaaagcattgtagcacaatccgtgaaattccgtga

SEQ ID NO: 59862 - DNA, 1072 bp, Glycine max
  Peptide Sequence Number=SeqID_176640
gtcgactctagaggatcccaccaatcagcttgccatcctggccgagaaccttgaccgcctggttcggcttgatcgaaccggaagcgatacggccggtgatgatgcggccgaggaagttgttggcttcgaggatcgtgccgatcatgcggaacggaccttcttcgaccttgggctccggcacgtgcttgacgacgagatcgaggagcggcgcaagaccttcatcagtcgggccttccggattgacgttcatccagccggaacggcccgagccgtagaggatcgggaagtcgagctgctcgtcggttgcatccagagccgcgaaaaggtcgaagacttcgttgacgacttcctcatggcgggcatccggacggtcgatcttgttgatggcgacgatcgggcgaaggccgaccttcagcgccttgccaaccacgaacttcgtctgcggcatagggccttcggcagcgtcaacgagaacgatggcgccgtccaccatcgacagcatacgctcgacttcaccgccgaagtcggcgtggccgggggtgtcgacgatgttgatccggttcttgatgccggtcttcttgtcttcccaggtgatggcggtgttcttggccaggatggtgatgccgcgttccttttcctggtcgttgctgtccatcacgcgctcggcgaggacggtgcgctcggacagggtgccggactgcttcagcagctggtcgaccagggtggtcttgccatggtcgacgtgggcgacgatggcgatgttgcgaagattttcgatggacatacgaaagggggccagtcggcgccggatttggaaaaagaagtccaacattatacgtcgaacttgacgattcgcgaaaaggtggattttcacgccggtcatggggcccattcagctggctgtccgcagcggcggccgaggccgccaggaccgtcgtggctagacgcgttccccttctgcatcaaggatcttcatgtccctcatcgccacttttcgacaccaccccagggcccgatcaaggtcgagctggtcgccgacaaaggcgccgctgaccgtggccaacttcgatga

SEQ ID NO: 59863 - DNA, 426 bp, Glycine max
  Peptide Sequence Number=SeqID_176641
atgtctccttatcgggttgtctttggaaaggcatgtcatcttccagttgagattgagcacaaagcatactgggcagtgaagacctgcaacttctctatggatcaagctggtgaggaaagaaagttgcaactgagtgagttagatgagatccgcctagaagcgtatgagaatgccaagttctacaaagtaaagaccaagaagttccatgatagcatgataattaagaaggacttcatggttgggcaaaaagtgttattgtataattctaagcttggactcatgagtgttgagatcaaaagcgactccataaacaagagcttcaaggtcaatggacaccgacttaagtcattcctcacaaacccttctttagtggacgtagtggtggaagagacttgcttactccgccctactcttcctctaccatga

SEQ ID NO: 59864 - DNA, 2016 bp, Glycine max
  Peptide Sequence Number=SeqID_176642
atggtggaagagtgggaagttgttttaaaggccacaagttcaaggcaacttatctcaggtttggagattgaagatccctccaaagttgttttaaaggccacaagttcaaggcaacttatctcaggtttggagattgaagatccctccaaaggccggaatccaatgggtaggtgggctgacattcatggagccctggaaaatgtcaggcatggcatggtcatcaaagctgggatggtttcaaatacacagactcatcaaattgctgctaggaaggaaaagcagatggaagcattgaaggctgctcttggcatagtctcgtctgaagccaatgaaagaaatgcagatgggactgatgagcttggaaatgatgggggaaatggttctaatgtggagggtaattcaaagcctgaacatgcctttttggacagagatttcagtaagaaacaaatggttgaagatcaaaaggatgaaaatactaagaagaagagtgttaaagatacaaggcaccacaagaaggttgaaactcttaagaaaaagtatgaggatgattcatctgattcagacagcagtttgtctgatgagaagagaggtacaaggaagcgtggtaaagagtacacaagcagtagtgatgaatctgattctgatagtgatgctaagaggaaggtcaaggctgaaaagaagcggaagatacctaagcaccacaagaaaggtagggtggaggatagtgatgataccaattcttatgattctgatgacagcgatattgcaaaaaaaagttataagaagacagataagtctcataggaggcatttttcggatgatgattctgatgatcatgaagatgtctccaagcataagacttgggaagggaagcaacattcaaaaatgagaaaacctcatgattctgcggtggaatctgatgttgatagggaggaaaaaaaatatggtagacgtgagaagcagaagacaaagaggcatagttctgatgatgaggactcttatagagatggtgttaagcatgcatcaggtcaagacagatatgttagaagggggtcatacacttcctctaatgacagtagcagtgacagtgattcagacagcgattctagtgatcacagatatgaaaaaacaaaaaaaggtgggcctgttgtagcaaagaaaggtaaaggatatggcagggaagaaaataaattcagagatgaagccagagatagtggtgcagagaaagggaagaatactgctaatattgatgcattggactctcttaaaaagtcatatgggacagattttgcaaagggatcaaatagtagaagtcgagaaatgacacaaggtagcagcaggaaaattgatggagacagagataggggggccgtcacattgggcatgaaagatgatagttctgagcaaagaggaagaaattataacaaggatgttgaatcacattttgttggtcgaactgctcgctatggtgaagatcatgaaacaagaaggcatataagagatgatgataatcatagggagcatgagcatagaagggataatgataaccgtggagaaagaaagcatggaagggatgaagatgatcacacaggaagaaagcttgcaagggaagaggatgttggagaaaaaaagcatgtgaaggatgaggacgattctaaagaaaagcacagaaggcatgaggatggccatggagattatcgtataggaagaaagcactcaagggatgaggatgatcttggagaaagaaagcatgcaagggatgaggatgattccaaagggaagcacagaaggtatgaggatgaccgtggagagagaaagaacttgagggatgaagatgacggtgcagagagaaagcgtggaagggatgaagattaccgaacaggaagaaagcagacaagggatgagaatgaacatatagaaagaaagttcataagggatgaggatgatcgggaaggaagaaagttcataagggatgaggatgtttatggagaaagaaagaacttaagggatgaggat

SEQ ID NO: 59865 - DNA, 1236 bp, Glycine max
  Peptide Sequence Number=SeqID_176643
atggtgttaggcgtgcattgggtcaagacagatatgttagtaggggggtcatacacttcctctaacaagagtagcagtgacagtgattcagacagcgattctagtgatcacagacatgaaaaaacaaaaaaaggtgggtctgttgctgcaaagaaagttaaaggatatggcatggaagaaaatagattcagagatgaagccagagatagtggtgcagataaagggaagtatggtgctaatgttgatgcattgggctctcttacaaagtcatatgggagagatattacaaagggatcaaatagtagaagtcgagagatgacacacggtaacaggaaaattgatggagacagagagagggagcctgtcacagtggtcaagcatgatgaagatgatagaaaaatggagtctgaatctaaatcagctaggtttgaagggcctgatgatgatagctctgagcagagaggaagaaattataacaaggatgttgaatcacattttgttggtcgaactgctcggtatggtgaggatcatgaaaccagaaggcgtagaaaagatgatgataatcatagggagcatgagcgcatacaagggataatgatgaccatggagaaagaaagcatggaagggatgaagatgatcgtacaggaagaaagcatgcaagggaagaggatgtcagagaaaaaaagcatggaaaggatgaggatgatcctaaagaaaagcacagaaggcatgacgatggccttggagactatcgtatgggaagaaagcatgcaagggatgaggatgattccaaagaagggaagcacagaagagagaaagcgtggaagggatgaagattaccgaactggaagaaaacaggcaagggatgaggatgaacatagagaaagaaaattcagaaggaatgaggatgatcgggaaggaagaaagttcagaagggacaatgatgtttatggagaaagaaagaacttaagggatggggatgtgcatggagaacgaaagaacttaagggagaatgatgatagggaaagaaagcattcgaaggatgaagatggccgtggagaaagaaagcacagaagggatgatgatgatcctgaagaaagcagcacagcagggatgatgatggtcgtggagatagaaagcacagaagggaggaggaagagcggggaaacaaaggttatgagagggaaagccggagatctccaagagagccagatactaaggttctccttcgagtga

SEQ ID NO: 59866 - DNA, 356 bp, Glycine max
  Peptide Sequence Number=SeqID_176644
cgagaattcgctaagcgcaaccttcagtggctaagcgcgaggaagactccagaagaagatgagttgttaagttcgctaagcgcaccactccaggtcatcaagcgcaccgcttcatctcatccgctaagcgaaacaaacgcgctaagccaaaatccacttatgtgcgctaaagcgatccagatctgcgctaagcgcacgagcacgaacaaggccacctatttaagcctgaaatcagatttgcaaaggggaatctgcagagacgcgagttcaaagcagaagccgtttggagagcttgagatgagtttgaggtttccggactatagaaagctaaatcctctgttggatcttccctatag

SEQ ID NO: 59867 - DNA, 832 bp, Glycine max
  Peptide Sequence Number=SeqID_176645
cgggtgcacgcgcgagggggagagaacgatgccgaacgactccgtgacagactcccgggtccgcgacggttacagcgcgcgtgcagcggagtacacggagctgttcggcgacatcgctcagatggacacggtcgaccgggagcgcatcgcggcatgggccgaccgggtcgaaggtcgcatcctcgatgtcggttgcggaccagggcactggagcgcgtacctcgccgagcgcggctgtgagatcgagggcctggatctggtgccggagttcatcgcgacggcgcgggcccggttcccgcacgtgccgtatcgagtcggatccgtggccgatggcggcatcgagccggggccgctcgggggtgtgctcgcctggtactcgttgatccatgccggcccggacgaacttccgtctctgctcgccgctgttcggcggggacttcgttccggcggtcggctgctggtcgggtacttcgacggaccagacggcgagccgttcccgcacgccgtgacgaccgcacactactggtccatcaccgggctgaccgcgctattgcacgacgcgggcttcgccgtgatcgacaccgaagcccgcatccaggacgggccggacgcggaccgtgcggccctcgaaggagaccaggtcgccgtcgcggagctgacggccgcggcggcggtccacctcaccgttgacactcacgtagccgtcgatgatgacctctttcgcgtcgccgcccgagtcgagcaggccggcgaacttcaggaactgcccgaggcggatcacgtcgccaccgatggagatgtcgtcgatgcggccggaactgctcatgggtga

SEQ ID NO: 59868 - DNA, 234 bp, Glycine max
  Peptide Sequence Number=SeqID_176646
atgttgtgcataacctcacaacacaacaccactaataacacgacacaacaccaccatagtacacgccacccgaaaagcaaacgggtacaagtcggatattacgaaactgcccctgatcctcgttcgccgccgttcttgttggcaattacggtaatttccgagagagaagcggcgaggaaaaaacgcgagaagggaacggaacggaagttacggaaggcgttcacggcggagatg

SEQ ID NO: 59869 - DNA, 279 bp, Glycine max
  Peptide Sequence Number=SeqID_176647
atgggttgttgcggttttgcgagtgtggccctcgtagccgtcgatggaggtggcggtggtccaggtgaggggagtggtgggggtgtcccgggcgccgctgatggggagccttggggtgcggcgctggcggtggacccagcggcggatgacggagggtcggtggtggtggtggtgacggaggaggaggagctggttggcgacgagggtgtcgtcggccatgaccattgtaacccattggtcattgaccttagacatgataatggcagaagagttggttga

SEQ ID NO: 59870 - DNA, 237 bp, Glycine max
  Peptide Sequence Number=SeqID_176648
atgaggacgcgtagccctctacaggcgaggacatatagtcctctaaaggttataggtactagtacccaagggtccacctttatgagaaagcaagagatcgactcatcgagagggccggtcatccaaaaagattggacacgagatctgggaacctattgggtgaaaacttctaatctgcccctaggttcgcttgaggtttttgcatggtgcctttcgttgccccagtgtagggcttag

SEQ ID NO: 59871 - DNA, 699 bp, Glycine max
  Peptide Sequence Number=SeqID_176649
atggatgaaatagagaaggtgcaagagcagatgaaggccgacccggaggccttgaaagagaaaatggccacaatggtagaggccatgatgagcataaaggagatagtggtggtcagtgcggcttaccaaacccgtgctagaactaaaataatgggtgaagtagagaaggtgcaagagcatatgaaagccgacatggaggccatgaaagagcaaatggccacaatgatggaggccataataagcatgaaaaagataagggaagtcgatacggttgcagttgccactaccagcgctgttgctaaggtgaacccgatgcccccatctggcctcaaccaaatgaatcatccaacctcaaatatggcacatgtctctcaaaccatgggggagacacatgaaattccccaccacaatctagctgactttgagcattggattggacatgccactgaagggcaagcagttggtagtataccctttgaaaacactttggagggccctcagtttcgcccacaaccacaacccttgcattttgcggtgggaagagcccctcatgctatggctgaaaagggaaaggtggatcatctaaaggaaaggctcagggccattgaaggaggtgaagattatgcctttgctaacctagaagagttgttcctaatacccaaacatgttcattcccaagttcaaggtgccggactttga

SEQ ID NO: 59872 - DNA, 240 bp, Glycine max
  Peptide Sequence Number=SeqID_176650
atgtggctgcaaggggtgaagatccctatggttctgtctggaaatcgcaatgaacacgctaagcacgcctgtgcgcttagcccgttcatcgcaactgtcaaaattttggatttcctaatgaacgcgctaagcgaaccatgtcgtgctaagcgcgctaagcaccactttgcttttgtgagttttcctttgcataaggctaagcgcgtgtgtgcgctaagcccttattgtgtgttgagctaa

SEQ ID NO: 59873 - DNA, 507 bp, Glycine max
  Peptide Sequence Number=SeqID_176651
atgcctgggaccgctatgcagataatgtccttggccggaagatccttccggaaaggaatgtgaagctgtatatcacaaaatttgatgaatttaggagagaaattgagaggatgaactggcataaggagcttactaacttctcaaagggaagcattgatgttgctattgttaaagaattttatgctaacctctatgaccctgaagacaaatcacctaagcaggtgagggtgcgagggcacctaattaaatttgatgctgacgccttcaacaccttcttgaagacaccagtggtcatagaggaaggggaaagcttgcctgcatactccaggcgagctgcctttgaagattttgaggaagaactagactactctggcccagacctggagtgttctatctattctaacttagccctgacatctcacacttcagatattactttggatagggctaagttaatctacgggcttgtaatgatgatggatatgaacttggggtccctcatcttag

SEQ ID NO: 59874 - DNA, 255 bp, Glycine max
  Peptide Sequence Number=SeqID_176652
atgcgatcagagaagaaatcatgttcgccactcctctatgacgaactcatcaaggaaatcttgtcttgtcttcccgtgaaaactttgatccaattcaagtgtgtgtacaagggatggaactccctgatgtcagatccctatttcatcaaattgcaccttaacaaatctgctgcgaaggacgatttggaacaccttcaactgatgaaaaatgccagcctcggatccatcccagaaatccacatggaatcgtgtgat

SEQ ID NO: 59875 - DNA, 1128 bp, Glycine max
  Peptide Sequence Number=SeqID_176653
atgggatatgcccatgcgctaaccgcagcgcaacgccagcggctcggtgatgtcgctgagctgtatcagttaccggatttacgcgcggcaccgctcgacggcacgctgcgcttcgggctgctggccgatccgcaatatgctgacgttgaggcggatgtcccggcgaatctctactatcgtcatgcgctgcataagctgccgcaggcgataaccgcgctcaatcagcagccgctggattttgtcgttacgctcggcgatctggtggatcgccactgggccagctatgccacgctgctgccgctctacgatcggctactccatccacatgccgtggtgctggggaatcacgacgcccagaccatcgcgcagcacctcgatgacgcgctgccgctgccaaaaagttactatgcctttcagctgccgggctggcgctttattgtctacgacggcaacgatatcagcctgtactgcaatcaacacaacggcgacgatcgccagcgcgcggccgcactgctggctgatttacaggcgcgccagcaaccgcaggcgcagccgtggaatggcgcggtcggtgcgactcagctggcgtggctggaaacgcagcttatcgaggcccgcgcctgcggccagcaggtagtggtgttcggccattatccgctggcaccgggctacagccacagtcttctcaacggtgcgcagctggcagagctgttctgccgctatgacgtgcgcgcctgttttgccggccacgatcaccgtggcggctatcaccgccgtgcggataccgtgtttataaccctgcaggggatgctggatggcccgtcgcgcgtgccctttgcggtggtggaactgacgggcgagacgttgcggctgagcggatggggcggcgaaatcagccgcgaagaggtatacggtgccgcgccgatggctagccggccagcccgggaaatatacctcgccatcgaccagcgaagcgatcgtctgcggcgagactttaatattgacgatttcaatcaggctatcatccggtcggcccagcttgctgctgtgaatcgtcaacagcgcgccgaaccacttttgattatctttgcggcgaaagatggcgttttcaggaaagcgcggccataa

SEQ ID NO: 59876 - DNA, 186 bp, Glycine max
  Peptide Sequence Number=SeqID_176654
atggaggagaaagtaaagctgaaaattagtggaggtttaaggagcacctacttgaagctcttgtgctctgataccacttgttggaagcttgcttatgaagcttctatggaggctggatctttgagcttcaataagcaaaagataaaggagaagaggttagaggagacgtcatccactagagaataa

SEQ ID NO: 59877 - DNA, 213 bp, Glycine max
  Peptide Sequence Number=SeqID_176655
atggtgaaacttttcctgtcgcccattgttaagcttatgttctttgacgaaatgagtggacaaatgaatgacgattccatgtcaaggacacgtattgtgcccccgatgctagaatctcttatggcagaaatggtgaagatgaggagacaagccaaggagtctatgaggatagcaaataaggcattaagaggtcaagacgacttacatctctaa

SEQ ID NO: 59878 - DNA, 756 bp, Glycine max
  Peptide Sequence Number=SeqID_176656
atgaggaagcctagttgtgatatcaaagacttgaacaaaggagcttggtccaaacaagaagaccagaaacttattgattatatcaagaaacatggtgaagtttgttggcgtacactacctcaggctgcaggtttacatcggtgtggtaagagttgtaggctgagatggataaactatctacgcccagaccttaaaagaggcaactttgctgaagatgaagaagatctcatcatcaagcttcatgcgctgctaggcaaccggtggtcactaatagctgggagattgcctggacgtacagataatgaagtgaagaactattggaattctcatataagaagaaagcttattagcaaaggcattgacccaaataatcatagattgaaacatacaatcccttcttcccttcagaattcactcatgtctgatgatagttcaaaagcctttagtatgaaagacactaataagaacgagacaagtaaattacctcgtgtctacaaccatgttgaagtttcagatgctgcaagtggtgaggctgagtcaccgtgtgcattgcccgatttaaaccttgatctctctattaccaatccttcagcttcacaaagtatttctggaaacaatttggcaaacattaattgctgctatcttgcaaccgatcagtactcacaaattcttgagagtgaaaatgagaagggtgatttctgggattcaagtgcagttcacaactatccactgaacggtaaatatgagacggaataa

SEQ ID NO: 59879 - DNA, 180 bp, Glycine max
  Peptide Sequence Number=SeqID_176657
atggagtatagtcctgatagctcaacattgatgcttagaagaagaaaagatggatttgagaaaagaatggaaggtaaggtactaatcataagagggtgggcgcttcaagtgttgattcttgaacacgaagcgattggcgcgtttgtgactcatgatggaattcaacgttggaagcagtga

SEQ ID NO: 59880 - DNA, 295 bp, Glycine max
  Peptide Sequence Number=SeqID_176658
tgatagtagcaatgattgtggtggtagtgggggtggagacaatggaaataatgaaggtgcggtgatggtggtggtgacaatatcagtgttagtagtggtgacagtgttgtggagcaacaatggtgacaataacggtgacaatgcatgtggtagcaaagtcaatggtgatagtagtagtggtagaggctgtgtcaatagcaatgatagttgcaacgataatgaccatgatagtggtggtggtggtgactatgttgtgtcggtaatggcgatggtggtggtcatgttgtattgctga

SEQ ID NO: 59881 - DNA, 1965 bp, Glycine max
  Peptide Sequence Number=SeqID_176659
atggccggcgacgacctcgccggagaccacacgccggagcttctgtgcctggtccacgaaatcgccggaatgtgctcggcggggtcctcctccggcgccgacgccatgttccgcaaggactgcaccgatctggttcgccggatctccctcctcacccacctcttcgaggagattaaggaactcaaaaacaacaacgatgtcggtggttccgcttcttcttcttcttcttactcgtcctcttcttcctcggcgtcttcaaagtggtcttctgatctggtcctcgcgcttcactccgctagacgcttgctttccgtcgctagaaacttccgttcctattgctcctctgatggagctgcaaagaccattgtcttccaatttcagtgtgtgacatggaaattggagaaactgttgagcaatttgccgtatgacgatttggacatctcagaggaagtcaaggagcaggtggatttggtgagaacacaattgagacgagccacggataaatatgggtttatgatttcaaagatgccatctcatgaattatcccagccactggctgaagaaattagtcaggttcttggcaaatctgtgagtaggttgcacaaacaacacagctgccctgaaaatttatcagaactagacagcattcctatcaactatgaagagaaaaggtgcagcaaaaatcccgctggaactcgcttggaaagaacaaggagcatccctactgaagttgaagtttccttaaatgcaactgatcctgaaagtcaagaaatttctgagacaaagattctacctgaggttaaaaagcctgaagcaattgtgattcctgaagattttctttgccctatatccttggaactaatgagggatcctgttattgtagccactggtcagacatatgagagatcttacatacagagatggatagattgtggaaatacaacatgtccgaaaactcagcagaagctccagcatttgacccttacaccaaattatgttttaaggagccttatttctcagtggtgtatagagcacaacattgagcagccaacaggactaaccaatggaaaattaaagaaaagtgatggatcgttcagagatgttacaggtgacatagcagcaatcgaagctctggtccggaagctctcctgccgatctgttgaggagcgtagagcagctgttactgaacttcgatcgctatccaaacgaagtactgataatagaatactaattgctgaagctggagcaattccagttctagtcaaccttctaacatcagaagatgtattgacacaagacaatgcagttacttcaattctcaacctttccatatatgaaaacaacaagggacttataatgcttgctggtgccattccatccattgtccaagtcctccgggctggaaccatggaagcaagagaaaatgccgcagcgacccttttcagcttgtcacttgcagatgagaacaagataataattggcgcctcaggagctataccggctttggtggaattgctccaaaatgggagtcctagaggaaagaaggatgcagctacagcattgttcaatctttgcatttatcaagggaacaagggcagggccattagggcagggatcatcacagcactgttgaaaatgcttacagattcaagcaaatcaatggtcgacgaagccctaacaataatgtcagttcttgccagccaccaagaggcaaaagttgccatagtaaaagccagcactataccagttttgatagatcttttgaggaccggattgcctcgcaataaagagaatgcagctgctattcttcttgccttgtgcaagagggatgcagataatcttgcttgtataagtagacttggtgttgtcatacctctctctgaacttgctcgaaatggcacagagagggccaaacggaaggctacttcattattggaacatattcgtaagttgcagcaactttga

SEQ ID NO: 59882 - DNA, 408 bp, Glycine max
  Peptide Sequence Number=SeqID_176660
atggatccaaacatcgatttagatgaagttttagatcaaatgattgatgaggaattgcaagacaacaccgatgaagaaatcattaggttgatacttgagagccaacaacaactacatggcaacaccattaggcatagccaaagaagaagagtggtacatcgtaatcgtgaagaagacgcgctcaacaaccatgatgaatactttcaaatgagggtcgatgcattacatcgaaaaggcctatctccattacagaagtgcacatctgctattcgtatattggcttatggatcacctgttaacagtgtggatgaatacgttcgaattggtaaacaaccaatggaatgcttggagcgatttgtatcaggcatttgcaccatatttgtgaatgtacttgagaagaccaaataa

SEQ ID NO: 59883 - DNA, 927 bp, Glycine max
  Peptide Sequence Number=SeqID_176661
atggtttgcctcacctatgggattgagagtggattcagacacacatttgcgaaggccaggatcccctgcagctgcaggcccatttgcaactgcgcaccacccccaacatttgtttatcttcatcatgccccattgttcaaccaacctccaattttctcctcactcttgcatcaattctcaaacacctttatccacgtcaagtccatccacgcacagattatcaagaattgggtgtccactgaaaactttctggctgcaaaactcgttacggtctattctgatttgggttttcttggccatgcccgtaagatgtttgatcaatgttctctaccggaaactgccgtttgcaatgccatgatggccgggttcctgaggaaccagcagcacacggaggttcccaagttgttcagaatgatggggtcttgtaatatagaaatcgatacttatacgtgtatgttttctctgaaggcatgcgccagcttgttggatgatgaaattggcatggaaattgttaggacagctgttagaaaggggtttcgtttgcatccctatgtcggtagttcgatggttaattttttggtgaagtgtggctatcttgatgatgcacaaaaagtctttgatgggatgccggaaaaggatgctgtatgctggaattcgatcattggtggttatgtgaagaagggcctcttcacggaggcaattcaaatgttccctgagatgattggtggtgggttaaggccgagtccagttacaatggtgagctcactcaaagcgtgtggagagagtggacttaaaaaagttggaatgtgtgctcatggttgtgtccttgctttaggcatgggcaatgatgtatttgtgcttacttcgaggatgttctcaaacatcagacttggaaaacggaagaatcctccatgcttgtatcattag

SEQ ID NO: 59884 - DNA, 225 bp, Glycine max
  Peptide Sequence Number=SeqID_176662
atgtcgttccgaccaactttgaacatagtgggttgcacatgccggtggtggtgcaatgaggggacgcaacgatgttggaggatggggtgggctggcttgatgagaagtttaaggaaaatgaagagatggtgggtggggtggggtggcattggaaattactcaaaggagtgggaggggaaggttttggagaaaagagagactgcagagaaaggtcaatgcaagtag

SEQ ID NO: 59885 - DNA, 195 bp, Glycine max
  Peptide Sequence Number=SeqID_176663
atggatcttgaagaacggtcgagaatctttcgcgtaattactcacggaaacgttacggaaaatgggagaagctttgctgcccagctcgcccaggcgagcaaggttgcttcctccagaagcaacagcctttctggaggaatctttctggagggcccaagggggcctggttgctatttgcaacctcctttttactaa

SEQ ID NO: 59886 - DNA, 675 bp, Glycine max
  Peptide Sequence Number=SeqID_176664
atgggtaacacatttggtgctaagaaaaccacaaaggttatgaagattgatggtgagacattcaagttgaagaccccagtgaaagttagggaagtgcttaaggaccaccctggtctagttttgctagattctgaggcggtgaagcactatggtgtgagagcaaagcctttggaagcacacaaggaattgcagccaaagaggctttattttctcgtggagcttccgaaggagacgaagccgagaagggttcgttccggcatcaatatgagtgccaaggatcgcctagagagccttgtgctcactaggaggtctgcctctgatctttcaataatgaaacaaagcaacaacatggataataatgagaataatggtggtggtgtgaggttgaaaatgaggcttccaaaagctgaggtggagaagttgatccaaggttgcaaagatgaggctgaggctgctgagaggatcatgaagctttatatggctaatggaagcagagaaaatgagggtggaactaaggaaaatggtgaaaagatggttgtgttggaacaacaaagagttaaggagagtacaaaggtgaatgttcaaacaactatgatcgacgaacaaactatagaagacacaaattctgatgcagaggaggtgggtctcgagagtgtagatggagattttgattaa

SEQ ID NO: 59887 - DNA, 1145 bp, Glycine max
  Peptide Sequence Number=SeqID_176665
ttacttgcggctgattgccaatgaagatgatgacccggcatttatccgtgccgcgacgacgcccaaaaaaggcataggcaacaccacgctcgagcgtttgggcgaatacgccagcgcgcacaagatgtcactattcgccgccgcttttgaaggtggcttccagcacgaaattggtgccaagcaacttgatgatctcctgaccttttgccgttatatccagacattacagggccgggctgtgaaagatccggccaatgaagtgctcaatgacctgttaaccgccattcagtacgaaacttacttatacgatggtgaggaaggccgcgcagccgaaacgcgctggggcaatgtacaagagttcgttgcttggctcagtaaaaaaggcgaagcctcaacagaatacggcaatgagtcagaaggtaaaaacctgcttgagctgacgcagctcgtctcgctcatcaccatgctggaaggccgtgaagatagcgaacccgacgccgtcaaactctccacgctccacgcctccaaaggtcttgagtacggccacgttttcctcatcggttgcgaagaaggcatcttgccgcacaccaactccatcgacagcgaccagatcgaagaagaacgccgcctgatgtacgtaggcatcacgcgcgcgcaaaaatcactcaacatcacctggtgcaaaaagcgcaaacgcgctggtgaaatgcaagcctgcgaacccagccgatttattgctgaattgccgaaagacgacgtcaagcacttcggaaatccgtttaatggaccggatcaagtgctcagtaaagattatggaaagagtaagatggcgaatattaaggcgatgctggcgagtcaagatggtgcttacctcgccgagcttttgttaaataaaggttatgtggtacatggcgttaaacgtagagcttcattgtttaacactgacagaattgaccatttgtatcaagaccctcacattgagcaccaaaacttcatcctgcattatggcgacctgacagactctaccaatctgatcagaattattcagcaagtccaaccagatgaaatctataacctcgcggccatgagtcatgtcgcagtcagctttgaaacacctgaatacaccgcgaacgctgatggcatag

SEQ ID NO: 59888 - DNA, 768 bp, Glycine max
  Peptide Sequence Number=SeqID_176666
atggcaaatgacacgtaccccgctgagtttatccatgaaaacttggccattcagaccaatgtgatacatcaatcctacctgaatggtgtgaagcgtttgctgtttttagggtcaagctgcatttaccccaaggattcaccgcaaccaattaaagaagaatacttacttactggtcctctcgagcctaccaatcgcccatatgcactagctaaaattgcaggcattgagatgtgttggagttataaccgccaatatggcacacattttttggctgccatgccaacgaatctttatggccctggcgataactaccacccagaaaacagtcatgtgattccagcattgattcgaaggtttcatgaagcaaaagtaaatagtcaagccgaggttgtgatttggggaacaggcacccccaagcgtgagttcttatatagcgaagatatggctgaagcatgcacacatattttaggcttatcggatcgcaactttgcaagtctcatagccgctgacagaaatgatggtagccctcctattttaaatatcggctataacgcagacatttcaatcgctgaattagccgaaaccattaaagaagtaacagcatacgaaggaaaagttgtgtttgataccagcaaaccagacggcactatgcgcaaactaatggattccagcagaattaaccacatggggtgggcagctaaaactgaactaaaaaatggcttaaaggctgcttacactgactttatcaactcgaaaatcgccttgtaa

SEQ ID NO: 59889 - DNA, 630 bp, Glycine max
  Peptide Sequence Number=SeqID_176667
atgcgatcagagaagaaaccatggtcgccactcctctgtgaggaactcatcgaggaaatcttgtctcgtcttcccgtgaaacctttgatccaattcaagtgtgtgtgcaagggatggaactccctgatgtcagatccctatttcatcaaattgcacctaagcaaatctgctgcaaaggacgatttggaacaccttcaactgatgaaaaatgtctgcctcggatccatccctgaaatccacatggaatcgtgtgatgtaagttcgttattccattccctacaaattgaaacgttcatgttcaatttcgcaaacatgccaggttaccatctggtcggttcatgtaatgggttgcactgtggggttagcgaaatactagaagaataccgtgtttgtttctggaacaaggcgacaagggtgatatccagagaatcgccaacgctgtctttttccccaggcattggtcgtagaacaatgtttgggtttggctatgatccgtcaagtgacaaatacaaggttgtagcaattgcattgactatgctctcacttgacgtatttgaaaagactgagatgaaagtttatggcgcgggtgacagtagttggagaaaccttaaaggttgtgggatcctctag

SEQ ID NO: 59890 - DNA, 402 bp, Glycine max
  Peptide Sequence Number=SeqID_176668
atgaatggcataggctcaattaatgaaccaccggatgacaatgacagtaatgctccaaatgttacaaaggttttctttagagataaaatgatggaaaatataaacgtagtggtaaccatacctcgggtggatcttcttcaacaaaatttggcacaaattgaatatgaggatgacaatcctctcaagcatatggtgatcttggatgagtctctatttaacggattgtgcaccctttggcaagatgccctagtaatcaaacttctaggaacgaatattggctttaatattatgagggagaaacttcaaggttgtggaaactcaaattgggcttcaaattgcttgatgttgggaatgaatacttcatggttacgtttgacattcaagaggatcatgctaaagtaa

SEQ ID NO: 59891 - DNA, 333 bp, Glycine max
  Peptide Sequence Number=SeqID_176669
atgagggagatagaggaaaggcttagggccattgaaggaggtggagatcatgcttttgctgacatggcagagttgtacctagtacccgacgtggtcattccttcgaagttcaaggtaccggacttcgataaatacaaggggacaacttgccccaagaatcacctgaaggtgtattacaagaaaatggaagcatatgcgaaagatgaaaaattgttgatgcatttcttccaggaaagtcttactggggcagccgtcacctggtacactaacctggaatcttcccgagtccattcttggaaggacctaatggtttccttcattaggcagtattag

SEQ ID NO: 59892 - DNA, 459 bp, Glycine max
  Peptide Sequence Number=SeqID_176670
atggtgggttacgcgccttcaggctttgccgatttagtttttgttggcgaaaggatcgaagtgggtctggaaagaggaaaatttgatcatcctgctttgacaaataaaaggcctggggtaaatagagaggatgagaaggaggaaggaatccatgttgtgactgtcattcctacatggccaaagtttccaccagctcaacaatgtcattactcagccaatatcagcccttctcattacccaccatccaatcatccacaaaggccatccccaaatcagccacaaagccggcctgccgcacatccaatgccaaacaccgcccttaacacaaaccaaaacaccaaccagagagggaattttccagcaaaacaacctgtagaattcacctcaattctagtgtcctatgctaacttgctctcatatctactcgataagtcaatggtagccataaccccagacaag

SEQ ID NO: 59893 - DNA, 4104 bp, Glycine max
  Peptide Sequence Number=SeqID_176671
atgtcttgtgagggtcagaagaagtgcagtgagaaagtgcacccttctgtctctccacaagagagtccaagacaaagtcctgagccaccttctccatgctttagtgttgagagtgatagactcggttctcctctcaaagctgaattgaatcagggaactcaatttgatcgctgtttccatgatcatgattatggatattatccttgttctgtggtcaataagagtgtgaactcatctggtactcacccttcttcggtatctactcatccatctaccttcaggagtgacaaagagggaacggatgattctaggaagcaccttctcagcccatcacgtacatattgtgataattattcagatatagattcaagtagcgttagtgctagacatgacacttacaattataattttgtggggtcgagtccttcagatagcccttctaggattggttttacttctagtagtgctgggcttcctgtacagaaggggcaggagaaaggccccgtccctcagactgatggtccctttggtcaacaaagtatggccgttttaagaaagcctgggcaagggactgaggatgcatatactactgcttatttttctgacgacttgtctattttccggaaccagaatgagaattcacagaggccattggattttgaaaacaatggtcttatttggtttcccccacctcctgatgatgaaaacgatgatgcagaaggtgccttgttctcatccagttgcagtctatctaatatgtttcctggaaaggagaaacttaatgatgaaaacaaggaacctttaaaatctgtcatccaagggcattttagagctcttgtttcacagcttttacagggagagggaattaaagttggtaaggaaaatgattctgaggactggcttgacatagttgcaacggtagcttggcaggctgctaactttgtgagaccagatactagcaaaggtggcagtatggatcctggtgattatgtaaaggtcaaatgtatagcatctggaagcccaagtgagagcacccttgtcaaaggagtagtttgcacaaaaaatattaagcacaagcgcatgacctctcaatacaaaaagcctaggctactccttttaggtggagctctggaatatcagaaagttccaaatcaattggcttcttttgatacattgttacagcaggaaaatgatcatttgaagatgatcatttcgaaaattgaggctctacgaccaaatgtcttgctggtagaaaaaagtgtagcttcatgtgcccaggaatatttgctggcaaaggaaatctccttggtgttgaatgttaaaaggcctttgctggagcgtatagctcggtgcactggtgctcttgtcactccatcagtggatcatttatctaaagcacgattggggaacttttttgcagcctatcacttatctcttgagacctcattccttgccgatgagggtgctaccctacctaaagtgatagttaaaaactctactgacatgccagagagtgcaactgctgacactgatatttctatcatacctatctccttttctacaaccatgtgccaatcagaggctgacaatgcttttagagtggaggactttgttggccttgatttaaagcttgaaaatttgggatcagtgccagagcatcttgatgaccttagttgtcattcagttacaggcaccatggcagattatagagctgagagtgtactctctgattcattctataataatttaacttctaatttgactgtagaatcagattatttacatcagggcaatgaatcagatggagacactatatttagtacaagagaccttttgcaatcagaattgcaacaaaccacggttcaagaggagagggagtatggtgaagttgctgacttaacaaaagacaagacaaatgaagatgagctttctggtgaatacttttctgccactgatggtcatcagagcatattggtgtacttttcaagtcattgtgtatcaaaaggaactgtatgtgaacgtactaggttgctgcgcataaaattctatggctcttttgataagcctcttgggagatatcttcgtgatgatctgtttgatcaggcatgttgctgccagtcttgtaaagagccagctgaggctcacgtcctatgttttactcaccagcaaggaaatcttacaatcaatgttaggcgccttccctccttgaagttaccaggggaaagagatggcaagatttggatgtggcaccggtgtctcaggtgtccatttgaggatggagttccaccagcaactcggagagtcgttatgtcggatgctgcttggggattatcttttggaaagtatgggagcatggttgcttttttccggtattcccctattgatattctttctgtccatttacctccatctgtgttggaatttggtcacatccaagaggagtggattagaaaggaggcagaagagctttttattaaagtggaaaccttgtatgtggagatatctaatgtgcttgaatggttggaaatgaagattgtgtctcctggtattggaaatgagtcatctgatacatgtgacattcaaaaccacatactggatctgaaagatatgcttcaaagagaaagaactgattatcattgtttgctacagtcaggctcagtgaccacacaaccagggaagatgacactagacattctggaactaaatcgcttgaggcgttctcttcatattggttcacatgtttgggatcaccgactatactcgttggactctctcattaaaagaagttttagctccaaggttaaacaagaagatgaattatgtgcagatgttaaagagttaagagttgattcacttcacaaggagcggaattttgactgtggacttgagcaaaataatgctcgtctttcaaaattgcacgagtctcatgagagtcatatgcttgcagagccagatgacgcacttgaaacttgtgcgtcgggatcatttacatgttatcttgagggaaagaaagtacattcagatggtgaacttaacagaaccttatctgagtgtttcccaccaaatgagtccaatctttctgagagaatagattctgcatggaccggaactgatcaacctcaagctaatgccgtcccagctggaagtattcagcggtctaatcaacatgatagccctccttttagaagggtgtcacaaccaatgagagttcattcttttgattcagcagtgagagttcaggaaagaatcagaaaagtcttgccctcatctttacatttatcaacacttagatcttttcatgcttctggagattatgggaatatggttagagaccccgtctctaacatattgcggtcttactttcaaatgttgccatgggagacacagaaactaaatctgattctgagctccacaccatcattcatttcctctgtttcaggcatagctgaaggtgctcgattgctgctttcccaaacatatcatggtgatagagttattgctgtctatgacgatgattactctagcataatatcatatgcccttagttccaaggaatatgaagattgggtgtctggtaagtcagatatgcaagagagtaactggattgctcgtgagagaagcaaagaagatttagctgcttccagcttttctgcatggggtagtctggacttggattatatcaattatggtagttatgggtctgaagatgttccatcttctgttggttctcttctcagggactccaaaaaatctttacacttacaaatttcctttggcgatgattctgtgggagctggaggtaaagtgaatttttctgtcacttgctattttgcaaagcagtttgaatcacttaggaaaaaatgctgccccaatgaggttgattttgtgcgatccatgagccgttgccggagatggagtgcacagggagggaaaagtaatgtatatttcgccaaatcattggacgagaggtttattattaaacaagtgaccaagacagaattggagtcctttgaagaatttgcacctcagtatttcaaatacctgatggatgccctgaactcaggagggcctacttgtcttgccaaaattcttggtatttatcag

SEQ ID NO: 59894 - DNA, 216 bp, Glycine max
  Peptide Sequence Number=SeqID_176672
atggaggttgaggaaccttggcttgggctttttcgctgcaaaattcatttcttggttggtgttttggtttgcgcttggctattggatgtgcggccagcaaactttgtggatgatttagggatagcctttgtggatgactgggtggtgggtaaggagaagggccgatattggctgagcgatgacattattgggctagtgggaagcttggccatgtag

SEQ ID NO: 59895 - DNA, 279 bp, Glycine max
  Peptide Sequence Number=SeqID_176673
atggcacatttcataccttgtaagaaagttgatgatactcatcatgttgctaacatgttctttaaggaagtgctaggcacaaagcttcttctctccactacatgtcatcctcaaactgatgggcaaactgaggatttcaattcgagggtgaattcactcaaagaaggaggggatgatgaggatcaaacagggaataaggacattgaagcaatacaaggacttggtggaccagtgaaaaaggcacatgctaagaaagcaaatgaaaccttgatccaaatg

SEQ ID NO: 59896 - DNA, 174 bp, Glycine max
  Peptide Sequence Number=SeqID_176674
atgaatctacttttcggtaacctaacacttaagaactccacagttaagcgtgtttggcttggggtagctatgggatgggtgaccttcttggaagtttcccaaaaagcgtgtctcagaaagggctacctatggagggatctgactggtgggggattcagaccaacgaggagttga

SEQ ID NO: 59897 - DNA, 306 bp, Glycine max
  Peptide Sequence Number=SeqID_176675
atgaagactattgtggctaagcctcacccaagtgtagggaaggaagaccatccaaggaagaaagtcattccaaaaaaccctagatggagtaagaaaaagggagaaaacatcaccattcaagctcttggctatggagtggatgattatattgaaggatccgtgcacaaaaaggaaaatcaccttgttcaaggatgtacattttcccttttcatgcatttttcatttcatttagatgcattgaggacactgcatgttttaagtgtgggaaggggtatcattgatccctcaactttgagctctctatga

SEQ ID NO: 59898 - DNA, 528 bp, Glycine max
  Peptide Sequence Number=SeqID_176676
atgtcctccacacacccaaaaaacccagcaacgacaacaacatccactactctcatcgtgctctcaattatactcctttgttttccgacaaccgcaaaaaccgacaaccctccatgcccttatccgtgttacccaccacccattggaacggttactcccaccactccttcaggtggttccactgttccaccagcaccacctcaacccggattactatatccaccaccttctgggaattacccttattaccccacaccaccttacggcggcggcggtggtgttggcagcaacgacggtagcggtagcggtagtggtggttttggcagcccaccaccaccggaccctattctaccctactttccattctactacagaaagcctcctcacaagccagaagacaattcagcatcaacaaccactatgtacaaatggacagggatgttttgtctgaatgatataataattaggatagtgtcaccactcaccactgctatatgcctatatgtgtcacctgctttggatggttga

SEQ ID NO: 59899 - DNA, 1437 bp, Glycine max
  Peptide Sequence Number=SeqID_176677
atggactgcacagtgtcgtttccttgtgtgcattttgttccggtgggaagaactttgtgcaactacagaagagtcactgtagtagcacattcaaaaaggagaagaccaccaaaggacaatcggtatcgaccacgtcccaagcaacctccagagtttggcgttaatctgttcttgaagaagcctagcaccgcctctaaaccaactgacgacgacatggatagcaatgaagagaatgatgaagaggaggatggaaacattggtgttgtttgggaatcagatgagcttgaagccatctcatcacttttccaaggtagaattccgcaaaaacctggaaaattggatcgagaaaggcctcttcctcttccagttcccttcaagcttcgacctttgagactacctacaccaaaaacacaagtaaaattgacagctccagctgtggtttcttcgcgggcttctatggctaagaaagtgtataaaagcccgagtttcctagttggtttggcaagacaaataagcaggcttggtccagatgcagatgtatctaaaattcttggaaagtgggtgcagttcctgaggaaagggtccttgtcattgacaataagggaattaggtcatatgggattccctgagagagctctgcaaacattcttatgggcacaaaatcaacctcatctcttcccagatgattggattctggcctcaactgttgaggtcttggccaggaaccatgagttaagaattccattcaacctaggccagtatactggtttggcaagtcgtgctgtcttggaggcgatgattaagggttttattaaaggaggaaaccttagatttgcatggaaggttctaatagttgccagaagggataaaagaatgttggattccagcatatatgcgaagctaatattagaacttggaaagaaccctgacagacacaggcatgtattgcctttgttagatgaacttggggaacgagatgaattgaatttaagccagcaagactgtacagctataatgaaagtctgcgttaagatggggaaatttgaagtagttgaaagcctgtttagttggtttaaacagtctggctatcaaccgagcatagttatgttcacttctgtgattcacagccgttacacagagaagaaatacagagaggcattggcggtagtttgggagatggaggcctcaaattgcctttttgaccttcctgcttatcgtgtggtgataaaactgtttgttgctttgaatgatctatctagggccacaagatatttttcaaaacttaaagaggctggattttctccctcttttggcttatacaaggacatgcttcaaatttacatggcctctgggaggatagcaaagtgcaaagagctctgcagggaggccgagatagcaggtttcaagctagataaatatcttgtgtcagttagataa

SEQ ID NO: 59900 - DNA, 339 bp, Glycine max
  Peptide Sequence Number=SeqID_176678
atgtcagccttgatagcacacatcaaaagcactgaaggacacaccaccacgtatggtcgtggagaaagaaacattgccaatgccaccacaaggaggtcaagtagtagagggcttcatgatattccattgtcttttttggggtttcagatcgtgtaccaatggatttcaatattgcaagcccgtggtttaggtcgatggaacatggttgtatgggagagaatcgcagtaatgcttgcatctaaccaaggttatatgcaagtactaaacaaggtcatcgaagatgcacagggaaagacaaacgttcacactgttcttgagtttgatcgatgtgacacatga

SEQ ID NO: 59901 - DNA, 288 bp, Glycine max
  Peptide Sequence Number=SeqID_176679
atggagaagtctgaaaagaaaaactttaatgaaaagaaggcaaagagggcctacattacatgggatgataatgatatggactcatctgaagattcagaaaatgaagtggtaaacttgagtctaatggccaaaagttatgaaagagatgaagagtatataaaagaaattaaagatttgaaaaattctcttgcaaaattttctattggcaaaagtaacctagatgtaacattaggaaagcaaagatgtgtctttgataagacaggaataggatataagcctgaaaaataa

SEQ ID NO: 59902 - DNA, 612 bp, Glycine max
  Peptide Sequence Number=SeqID_176680
gaagatatttttcagtcagttggtgtccctttggttaagaatgctttagctggttacaacacttcaattctgtcatatggccagtctggaagtggaaaaacttatacaatgtggggtcacccaagtgccatgtttgaggagccctcgcccaaaagtcacaagggaattgttcctcggatcttccaaatgttgttttctgagcttgagagagagcagcatgtgtctgacgggaaacaattcaattaccaatgtcgatgttctttccttgagatgaaagatggttccaaaaatgcattgtatatagagaatctgaccgaggaatatgtcactagctatgatgatgtaacacaaattctgattaagggcctttcaagcagaaaagttggagcaacaagcttaaattctaagagctctagatcacatataattttcacttttgtgattgaatcttggtgtaagggaatatcatcaaatggtttcagtagttcaaaatctagcagaattagccttattgatcttgctggacaggacaggaacaaagttgaggatgcaggcaagcaatgtctaaaggaagacaagaatgtaaagaagtccttatctcagcttgggtaa

SEQ ID NO: 59903 - DNA, 882 bp, Glycine max
  Peptide Sequence Number=SeqID_176681
atgggggcctgcatgcagagagattcgagtgccaagtacatagttcagcagtacgtggcagcgacgggaggagtagctgcgttgaattcactggaaagcatgtatgctatgggacaagtgagaatatgtggatcggaggtgcgtcgtcaaggtgatggatacgaagaaagcgttcaatcaagaggcaaaactgaagtgggaggctttgtattatggcagaagaaccctgatttatggtgtttggaattggtcgtttccggtttcaaggtcagtgctggcagtaatggaaagctagcttggaaccattcttcttctcaacctttccatgctaacaaaggtcctcccagacccctccgccgcttctttcagggactggacccaaggtgcacggctaacttgttcctagacgcagaatgtgtaggagagaacaacattaacaacgaggtttgcttcatgctcaggttacaaacggatcaacacattctgcaagcacaaagcatgtccaatactgaaatcgtaatgcacacaatgctgggttacttcagccaacgcacggggctactggtgaagtttgaggacacaaagttggtgaaaatgaaggccgttaaaggaaaagagtcagtgttttgggaaacaagcatcgagtccatgattgatgattatagatacatagatggcattaacatagcgcatggtgggaggacaattgccacgctttataggtacggtgcggcgcataatcacaaacatatgattgaggaaacatggacgattgaagaggttgattttaacattgttgggttgtctatggattgctttctgcctccctctgatggtgagagagagcacgaaggtgcagagcaagcagtgggaatgggatag

SEQ ID NO: 59904 - DNA, 426 bp, Glycine max
  Peptide Sequence Number=SeqID_176682
atgcagttactgtcgttgccaactaccagggctgcattgcgttccttgatttttgcctcaagtcctccctcctttagttcaacaccgactccaaacaaggcatccgggacctctcctggacagaggcactcctttggagctttggccgtagaaatctttttggaagagtataaaattgatggttatctcaatgctcagtgcaactcaaaggttaacagtagaagcactattgcggtattggacatcttcaatggaatctcaagaactatttttataataaaggagaaagaaggaatggagttattgtcattacattcaacttctactagacaaagcagcagaaatgataaagagaatgtcaggtcttatgcactatatcagaaaggaaacctgtcatggaaagtgtctggccatgtcacttgttag

SEQ ID NO: 59905 - DNA, 1374 bp, Glycine max
  Peptide Sequence Number=SeqID_176683
atgtgtttatcggaattattatcatatgaagatggagactatgaggccgaaaatgaaactgatagtgaatacacacatccttggaatgactatagagaagaccgagattggaccactctgttggatccaaaaacttttgcagaaaatcgtactccacctctaccaaattgtgatgatgaatataaggccacttgggatgttgatgcatcattttggatgaatgatgaagcaacaacaacatctgatttgaagatgaggacagtgataccgatgagatggaaacaccacctgatagtgaagatgaagggattcctaagacatacaccaaatatgaagacacaagcactgattgcttatgcgttagacaaatgggggtataagttaagtttggatcaagcctacaaagctaagtgtagggcactgcaaaaaattcaaggtgcatccaaggaatacaaacacttgagacaatataatgaggaggcttgtaaagaggcatttgtaacaacatgtagaccattaattggtctggatggttgttttctggaaggggattttggtggtcatcttctaactaagacatggagtccaatccaagaattggatttcatctctgataagcaaaaggggttggtaaatgtcattaaggagttgggtcaacatgtggagcatcatgtttgtgtgaggcatctctacaacaactttaggaaaagacaccatggtgctcaactcaaggaaatgatgtggcaagctataagagccacgactattccagaatttaaaagaataattcaaaagatgaaggagactaatgggagtgattggaaggagttagatgagttacaagcttcatcatggacaaagtcaacatatggaacaccctatgttgtgtctagtggctatggaaaagttggtcacaataaacaaacttgtaaaggtaaaactcaagctgataggaagattaatagaggtggcaacaaggagcataaatcaagagcagaggcaagtgccctagttgctcgattagcttcaacgattcctaaaccagctccttctgcaaatttcgttactgatggtcaaaccccgacaccaataccaattgcaaattcagctcctcgtggtcgaacttcggcaccaacacctactgcaaattcatttgcttgtgtaaattctgcaatatgtgtttcagccccgacacaagcaccaaatgctaattcagttgcaagtgtcccggatgccttgtttggagtcggtgttgaactaaaggagggaggacttgaggcaaaaatcaaggaacgcaatgcagccctggtagttggcaacgacagtaactgcatggaaatgaagctgtggaagatgaatgccttgaggccatga

SEQ ID NO: 59906 - DNA, 1632 bp, Glycine max
  Peptide Sequence Number=SeqID_176684
atggtgaaagtgcctccaacaaaagcactcttgttgttcaacaccgcaacctatcaaggccttcagcacacttcccactctatctccttcatcctaaatcatctcctttcctctggcatgctaccccaagcccaatctctaatcctgcgtctaatctctggtcgaatcccctcctccttaatgcttcaactaacacaagcccatttcaccccttgttcaacctacactcctctctatgacacagttgtcaatgcctatgttcattctcattcaaccgaccaagccctcacttttctacaccacatgattcacgagggccatgttcctttatcaaacaccttcaataatcttctgtgcttactcattaggtctaattatttcgataaagcttggtggatattcaatgaattgaagagtaaagttgttctggatgcctacagttttgggattatgatcaagggttgttgtgaagctggttactttgtgaaaggctttcggcttttggccatgctggaagagtttggtttgtctccgaatgttgttatatacactactttgattgatgggtgttgcaaggatggaaatgttatgctggcaaagaatttgttttgcaagatgaataggttgggtttggttcccaacccgcatacttatagtgtgttaatgaatgggtttttcaagcaaggacttcaaagggaagggtttcagatgtatgaaaatatgaagcgaagtggaattgttcctaatgcttatgcttacaattgtcttattagtgaatattgtaacgatgggatggtggataaagcttttaaggtgttcgctgaaatgcgtgagaaaggtattgcatgtggggttatgacttataacattttaataggcgggctgtgtcgagggaagaagtttggggaagcagtgaagttggttcataaagtcaacaaagttggtcttagtcctaacatagttacgtacaacatactgatcaatgggttttgcgatgttagaaaaatggacagtgctgttagattattcaatcagttgaagtcaagtggactatcgccaacgttagtgacttataatactttgattgcagggtattctaaggttgagaatttagcaggagctcttgacttggtcaaggaaatggaagagagatgcattgctccttccaaagtgacatatacgattctaattgatgcctttgcgagactaaatcatacggagaaagcttgcgagatgcattctttaatggagaagtctggtttggttccagatgtttacacatacagtgtcctacttcatgggttatgtgtgcatggtaacatgaaagaagcgtcaaaactcttcaaatcattgggtgagatgcacctccaaccaaacagtgtcatatataataccatgattcacggttactgcaaagaaggaagctcttatagggctcttaggctgctcaatgaaatggttcaaagtggaatggttccaaatgtggccagtttttgttcaaccatagggcttctttgtcgagatgaaaagtggaaggaagctgaacttctcttgggacagatgataaattcaggactaaagccatcagtttctttgtacaaaatggttcacaaagtcaagggtgatgtttag

SEQ ID NO: 59907 - DNA, 378 bp, Glycine max
  Peptide Sequence Number=SeqID_176685
atgcaaaatgtgctgcgacaaggagagtttgaagaaactgaaatccagcgttccgtcgaggaagacgaaggttcggagaaacggagaggaacggaggtgaagaagacgacggtgacgaggagaagtgtggaggggaaggtgaaggagagcttcgcggtggtgaagaagtcgaaggatccttatgaagacttgaggaaatcgatgataacggagatggagatgtctgaggccgaagatttggagcagcttttgcagtgtttcttggctttgaactcgcggagttatcatgcagttattgtgcgggctttcatggagatttggcaacaaatgttcgtaatgaaaaatctccaaacgaacgttaaaactcaggaaaagtaa

SEQ ID NO: 59908 - DNA, 279 bp, Glycine max
  Peptide Sequence Number=SeqID_176686
atgtccatacatctcccttggaagggtttctcatcaagtgaaaaagccagtatttggaagattcaaactcacgcccatggaaaagacgataacaatgttggtgttggtgatattagtgacaacaatgataatgacgataaaagtgacaactatgataataataatgatagtgatgataggagtggtggtaatagtagtgaaaataatgataagagtgacattgatattgagaataacaatagtgacactagtgcatattggttgctacaaccaatataa

SEQ ID NO: 59909 - DNA, 1302 bp, Glycine max
  Peptide Sequence Number=SeqID_176687
atggctggggaggttgaagaatcattcagcatgaactttcagggatacaacaacaacaaagccttatcccatatgagccgttctcaagcccgggttaaggaggaaggttgtgtttggcccttagcagccaatataaaactcacggtagattctatacattctggttctatctcatttgggagatttgaaaatgagcctttatcttgggagagaaggtcctctttctctcacaataggtacttggaggaggttgagaaatgtgcaaaaccaggttcagttattgagaagaaagcatattttgaagctcatttcaagaggaagggcatgcttggttttattccatctacaggtcatgagggatcatcagatagagcaaccagtgaaaatgatggatcagagagaaatgccaagcaagaggattttgagtccaatgatggccattatgttcaatttgatgaaatgtcccaaaaggattttgagctagatgaaggtgaccattatattgaaatggaccaaagttcccaagaggattttgtgacaattgaagatggtcattatgttcaatttagtgaaattcctggtaattcaaattatcatgaagagcgtggtatggatgaatatgaaagagaagagaccatcacagaatatccaatggtttcattttcaggtttgcagatggaatctgctgtgaacaattctaatgatttggaggatgacagtaagaaaaatattactttggatgaagctcatcaatctgaaacaagtaatatactctcagatagtggcaagattgttatagaagtgaaaagggatgatgatgttactataaatactgatgaatcatcaacaaacatgattatgcctgttgatgaaccagcacggggtgttgaggaaacaatttcccatgatcctgcaaatccttctgctaaggaaacaaagctcaagcctcaacagaattctgaagacaacaatgttcgagtacggaaaagcacaccttctagatcagccaaggatcctgctaggattccaggtagagagagtccgaggagatcaaatatggaaaataatttatcaaaacttgcaactccaactacttggtcagctagcaaatccaccaaagaagtttctaaaagtgcagagaaactaattcgtgaaaacaaaagactcaaatgtgcttttaattttgatagtgaaaatgcatcaagagtaagaaagggtgcagaatcccaactttctgcttcaaaaacagctccgaaaggaattcaagaagcagagaggtttgttgacatgtgtaaggattaa

SEQ ID NO: 59910 - DNA, 255 bp, Glycine max
  Peptide Sequence Number=SeqID_176688
gttgtaaatcttgttgaggcaccttttcccgtgcttggaaagtttaaggaaaccttcttagatcttctaaaagatcttttgattatggttatgcaaaagcatcaaaagtattttgctgtatgtgatgctaatggacaattattgccttattttgttgctgttgcaaatggagcaattgatgagactacagtgaggaaaggaaatgaagctgtgctctggtattcttatctcaacttcttatcgtgtcatatatag

SEQ ID NO: 59911 - DNA, 255 bp, Glycine max
  Peptide Sequence Number=SeqID_176689
atggaggattgccttgagggtccgaactcaggcaatcatgaaacacagctccaaactcgaaagtggaggacacatgaacgaaaacgcaattcatggagcttcgaaaaagggggagaatgggggattgccttgagggtccgcactcaggcaatcatgaaacacagctccaaactcaaaagtggaggatacatgaacagactacgcaataaaattcatggagctctgaaaaagggggagaatggaggattgccatga

SEQ ID NO: 59912 - DNA, 207 bp, Glycine max
  Peptide Sequence Number=SeqID_176690
atgaatagtgctgaagagaggcaggaaagacatcatagcaaacacttaatcactgctagagaaacaacaaaacatgatgactgggggtggttgacacttggcagtctgaagagctggtcagaatgttgcatggccaaggaggaggggaaactgatggaaagagcttgtggttggaagagaacacaccccagttgtagggaagcatag

SEQ ID NO: 59913 - DNA, 636 bp, Glycine max
  Peptide Sequence Number=SeqID_176691
atggtgaaagctactcgcaggattatcacttccaccactgtcaataacaaaggtgcagagattgaacatcttattcctggtctgaatctaccatacggcctgcttcatctctcttgtatacaggaaaaatatatagatagcagcatcacatcccaagatcagtttccaagtgatgcaacaaagatttgggttccaacaaatccaagaggtgcagaaagattacctcctgggatagtaaatgcagaatcagacttatttttgggcagattatggggtcttcccagtgaggatttaacctttaagccaaagtaccttgtgactttcactgttgggtacgagcagaaaaagaatatcgatgcagctgtgaaaaaggtttgtgaacgcgtgtttaaactagatatgccacttgaacagttttcaaaggatttcacgatccttctgtttcattatgatggccgaacaacggaatgggatgaatttgagtggtcaaaacaggccattcatgtcagtgttcacaaacaaaccaaatggtggtatgccaagaggtttctacatccagacattgtggtaccatatgactatattttcatgtgggatgaagacctgggggttgagaatttcaatgctgaagagtga

SEQ ID NO: 59914 - DNA, 267 bp, Glycine max
  Peptide Sequence Number=SeqID_176692
atgcctggactaggtagtacagcaatgtgggatttcatgggtagttgttggaatgaggatgcttctgcatttgccgttgccatcaaagatatcaataaaaatgttcgaggtcggcttagcaaagaggccactcttcattcttcaatgccaatgtggaccaacaaatcatcgagtctgatactaggcgatgcagtgagtaggatgacgtatgaagccaatgcaacgagcaacatgatattttatggtggtgatgaacttataaaatga

SEQ ID NO: 59915 - DNA, 195 bp, Glycine max
  Peptide Sequence Number=SeqID_176693
atgcttatgagacatttccgtgagcgatttcgtgaagattcttcaccgttcttcgtcgttcttcgatcttcaaccgataaaaaacaacttaaccaacgtttagttctcaaagaaacacgtaggtctgatttcctcatcgcaattgaggaatacgtaggagcaagggaaacacccttgtcgaccacaaaaagataa

SEQ ID NO: 59916 - DNA, 651 bp, Glycine max
  Peptide Sequence Number=SeqID_176694
atggtttgcaccaaccaggtggatatgaccggtagattacttgtcggatcattggcctttgaataccgcatcatgcactacttgattgtgcaaatcctccttccccgatcatctaatcttgctcaggtctctaaggaagacctgatagttatttggtttttcttaatcggtcgtcaaatcgaatgggcccatcttgtcagatatcgtatgcataaggcattgcgatcaaacgctcctcttccttatccccatttgatcactctatttttgcgtcattttaatgttcctcttgactctgagccctttgttcaagtcaagagatctttttctatcggtgctggtgtggtttcctcctttagataccgtaaagagagggatggttcttgggtgaagaaggacgctcagccacagacagcagatgatcgctctccttctcctcctcctcagagggatgactcttcatcccttatgaaaaatgttctagacaagttagatggtctccacacctttgtcggtgagcgttttgactccttggacagtcgcattgatgccattgatgcatggtttgcaggaatggatacacgcatcactcagcttgaggaggatgtgagtttcatccgtcagtgcttcgaccttccacctccgccttga

SEQ ID NO: 59917 - DNA, 207 bp, Glycine max
  Peptide Sequence Number=SeqID_176695
atgtctcgtactcatgacgcgatcctgtattaccacgggaaatcaaacatgccaccacagtacaaatttgttggatgcgcgttcacaggaaaagatcctaagaaatttcgaattccttcaacatgtaccatcgatgaactgaagaatttaatcaagcaagttgcacctaaagggattccccctcttggaattcatgaatcacaaacg

SEQ ID NO: 59918 - DNA, 161 bp, Glycine max
  Peptide Sequence Number=SeqID_176696
gacttgatgctatcgactggtccctctgcttcgacatagcaccttttgattttgtgtttaatcagtttctcttttctgttatgccagtttttggtagtgggattgtggggtttttggaaggtgttagaatgctcaacggttcctttctaacaggaatttaa

SEQ ID NO: 59919 - DNA, 1152 bp, Glycine max
  Peptide Sequence Number=SeqID_176697
aaaacgcggtctatcctgcaaagcgcttccccgactttccagccgaccgttatcctgctgttatgcatgccattgaagcgcatagctttagtgcggctatactgccacaaagcgtagaggcaaaaattgtccaggatgcagatcgtctggaagctttaggcgcaattggcctggcgcgtgtctttgctgtttccggcgcgctaaacacgattttgtttgatgctaacgacccctttgctgaccagcgcgatcttgatgacaagaaatatgctctcgaccatttccagagcaaattgctccgtctgcctgagaccatgcaaacggagcagggaagagctttggcgtcgcataacgctcaatttctggtgcaatttatggcgaagctgagcgccgaactgcgtggcgacccgttgtcgttggatgaagcggttatgccgcaaaatttatcccaagaaaacctcctgtctttaccgtcaggggaacacgcgcaggcgttattgcgccagctgatgacgatatatgatgtcaaaaccctggtcgcacagctggtcgcggttggcgaccagcactggagcccggcgatactcaaacgggtggcgacggtgagccgtgcggcaagtagattgactaacgcggagtgcgctcatctggcgagcctgttaccggctccgccgcgccatcatccagactatgcctttcgttttatcgatctcttcgccggcatcggcggcattcgtcacggctttgaagctattggtgggcagtgcgtatttaccagcgagtggaataaacacgccgtacgtacctataaagctaactggtattgcgatccgcaagagcacagctttaacgccgatatccgcgaaatcactctcagccagcgcgccgatatcagtgatgaagaggcggcaaagtctatccgtgaggcgatcccgcaacatgatgtactgctcgcgggcttcccctgccagcctttttccctcgccggagtatccaagaaaaatgccatggggcgcgctcatggttttgcctgtgaaactcagggaacgctgttttttgatgtcgtcagaattattgccgcccgccgtccgccgatctttgtgctggaaaacgtcaagaatctgaagagccacgatcaaggaagaaccttcc

SEQ ID NO: 59920 - DNA, 213 bp, Glycine max
  Peptide Sequence Number=SeqID_176698
atgggttattttgtcatgcgtggcagtgtgcggttgggttttggcgtagtgggtggcggtgcacaacgttttgatggtggaggttgggttgttgccaattgcacaggtggttatgaaggacaagtggtttgtgcacatgtcagaggatggtggcgggttagtgtgcgacgcctagatgtcacatggtaccccatattcattccctctaaataa

SEQ ID NO: 59921 - DNA, 420 bp, Glycine max
  Peptide Sequence Number=SeqID_176699
atgttgctaaatagcaacgtcatccatatccatgtaagagtggtcatgttggtgcgcatgatccgcactcgtctttttgcagcggcacgggtgaaatcttgccccggtatgcatagtagatgcgtgatagcctccctctctggacgtgctcgcatagttggtcgccctccaatatcagggggtggcccaggaactgataaaaggaaactgaaaatgaggacgcgtagccctctaaaggcaagggcgtgcatccctctacaagcgaggatgtgcagtcctctgatggcgaggacatatagtcctctaaagattgactgtccttttgaaaaaggtgataattcatgcaaccttatcctatcttttgcaaatctctccgggaactccctcagagtgtatgttctgtttgatttagtcacttga

SEQ ID NO: 59922 - DNA, 219 bp, Glycine max
  Peptide Sequence Number=SeqID_176700
atgaaagagagggaatcatatgacatggtgctcagggactcgttgtcctcctcgagaagcggtgagtcgagtttagtctgctcggagacgtggccattttcgggagagtgtgacgaggcgacgatgagtttctatgatggtgacgatggtgaaccaaagcgggtgaaggcgatggtgtgcttcgaggaccgggccggtcttaatcaagacgtggcgtag

SEQ ID NO: 59923 - DNA, 752 bp, Glycine max
  Peptide Sequence Number=SeqID_176701
atggttgaatcagaaaggctttcttacatcagaaacaacaaaaaaaaacttcgagttgacaagttttgcagcttacaacagtcattggatgatggaagcacgaaaggcctaaataaaggtaaaagagtcattttgccttcaacctttgttggcagtccccgctatatggatcaactttattttgatggtatggccatatgtagccatgtgggcttcccaaatctatttattactttaacatgcaatccaaactggcctgaaatccatagattgctgaatccgttgaatttgaaagcaacagatagaccagacataatctccaaagtctttaaactaaagtatgaacaaatgcttatggacctgacaaagaatcagatgctagggaaagttattgcatatatgtatacaatagaatttcaaaaacgagggttgcctcatgtccatttgtttctttttttacatcctgataacaaatacccatcctcagatgaaattgatcaaattatatcagcagagataccttcacagcaagatgatccagaactgcattcattagtaaaaaaccatatggttcatggcccatgtggaacttcgaaccctggatctccatgcatgaaagaaggcaagtgcagtcgtttctatcctaaaatgttccaaccgcatactgttttagatgctgatggttttccggtctaccgtagaagaaacaatggtcacacaattgagaaaaatggtgttatcattgataacag

SEQ ID NO: 59924 - DNA, 942 bp, Glycine max
  misc_feature (168)..(168): n is a, c, g, or t
  Peptide Sequence Number=SeqID_176702
atgacaaacttgtggctaagcgagtgttgtctcgctaagcccagatacacggataacattctcggccggaatatccttccgaagagaaatgttcatatttatcatactgagtttgatgagttcaaagcggagttggagaggcgtaatctacacaaacacctcaccaanctccaagagggaagcattggtgtggcgattgtcaaagaattctatgccaacttgtacaaccctgaggatccgtcgcccaagcaagcaagagtaagaggacacttgatcaagattgatgcaaacaacctcaatgattttcttgagacaccagttgtgctagaggagggggagaccctacccacttactctagattttgtaggttgaggtctaatcctcaagagatagaggctaggccgtgtattccccgcaagggttttgtgttgaacgctgaaggccaaccatggaagctccttaggaaggacttgaccatattggcccagacgtggagtgtcctatcttactccaacctagctcccacatcccacacatcagatttaaacatgggtagagctaggctggtttatggcttggtaacttatatggatatgaacattggcgcccttatctcggatcaaatctcttctattgctcaaagtaactcctctaggctcggatttccagccttgattactgctctctgtagagctagaggagttacttctgatagtttgacctacgagagcctgagcccgaccattaatttggcctacattaaaaagaactgttggaatttgggtgatctgacaattaattttagaggggcaaggaaggcaagggcaagaccaactgatgttccttcttcttctactccactagctccatccacatctgctacaccagaacctccaggcccatctacccagggctctcaggatgtagagtccatgctttag

SEQ ID NO: 59925 - DNA, 801 bp, Glycine max
  Peptide Sequence Number=SeqID_176703
catgtggtggtaacggtgaaggccgccgccatcagccagctggcgaaagcgcgagctgccggcgcccattacagcgccgatagccactatccgtttatcgccggtattgatggcaccggcacgctgagcaacggcgatccggtctattttctcgcctttagcgcaccgtggggcagtatggcgcagcagacccgggtgccggctgcggcggtggttgcgctgccgccgacgcttgatccgctgctggctgcggcaatcgccaatcccggcatgtcctcgtgggccgcactgacgcgtcgcgcgcagtttcaggcgggtgaaaccgtgctgatcaacggtgcaaccggcacctccggcgggctggcggtgcgcattgcgcgtcacctcggtgccgggaaaatcatcgccaccggccgtaaccgcgcggtgctggagcagttgcgcacgcagggcgcggatatcatcctgacgctggatgaactgcccggcgcgctgccagcgctgatgcagcaaggcattgatgtggtgctggattatctgtggggccagagtgcgctcgacatcatgcacgcggcggtggccggcggtgagaaaacggtgcgctttgtgcagattggctcgctcagcgggcaggagatcgcgctgcacagtaaactgctgcgctcatccgggctgacgctgatgggcagcggactgggcagcgtctctgacagcgaactgatcgcctgcattggtgagatgctgaacgccgccgctgaaagtgacttctccatcgcttttcagcagcgtccgctgagtgag

SEQ ID NO: 59926 - DNA, 366 bp, Glycine max
  Peptide Sequence Number=SeqID_176704
atggatcaaagttggatgaatgaaagtcgcatcagcccagaatatgagagtgactcaaagaagcctttgtatacggggtgcaagaattccttgacgttgttgtcgacggtgttaagtctagttaatgtcaaggtcagatatgggtggagtgacaaaagctttacttcactgcttgaagtagtgcacgatctgcttccagaggaaaacacgttgcctaaaagctgctatcaggccaagaagatattgtgtccgatgggtatggagtatcagaagattcatgcttgccctaatgattacatattgtataggcatgaattcgaagaaatatccaaatgcctaggtgtggggcatcacggtacaaagtga

SEQ ID NO: 59927 - DNA, 306 bp, Glycine max
  Peptide Sequence Number=SeqID_176705
atggaatacttcaacaatgcatcattcacatacatccatgcttttcattggtcgtattgttcattgcattctttccttgaaaaccaaattgtaaacattgtaatcaaactgaaagaacgtgctttacgacacccttaccaaatgcgtgctagagctagagtaatgggtgaagtagaggaggtacaagaacagatcaaggctgacatagaggccatgaaagagaaaatgaccacaatgatggaggccaatatgagaatgaaagagataatggaggtcaatgcagctgcattgctgaggtggacctga

SEQ ID NO: 59928 - DNA, 302 bp, Glycine max
  Peptide Sequence Number=SeqID_176706
atgggggagacacatgaaatgccccaccataatgtagccgacttcaagccttgcctcggatatgccactgaagggcaagcacttggtgatacacccctgcaaaacactttggagggccctcagtatcacccacaaccacacttcttgcattccacagcaagtaaaaaccctcatgctatggcagaaatgggaaagttggatcatctagaggaaaggctcagggccattgaaggaggcgaagattatgcctttgctaacctagaagagttgttcctagtacccaatatcattacccttcccaa

SEQ ID NO: 59929 - DNA, 614 bp, Glycine max
  Peptide Sequence Number=SeqID_176707
gtgctccagtggcttctgtttctatcagctgtccctcctgttcagctactgacggggtgggcgaattggagctccaccgcggtggcggccgctctagaactagtggatcccccgggctgcaggaattcgatagccacgaacggtcggctggcgcgggggctggcgttgtggatggcttgtgcgaacagctccttgccggtgccactctcgcccgtgatcaacacattcaagggcgtggccgcatacctgcgtgcgctggccactgcgcgcagcagggccgggctggagccccggagactctcgaagtggtagcgcgcggcatggtccgcgcggcgatgctggatgcgcaggctgttgtccgcttcgtggatggtgctcgcgtcgtacagtgtgagcgccgcacccgtggtgcggccatgctcctgaatgggggtacggttgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 59930 - DNA, 703 bp, Glycine max
  Peptide Sequence Number=SeqID_176708
atgtctatcaaccgagactactttagtctcccatttgtcatccagaggaaatcaagtctgatggcacgcagagacaaatatggtcatctgctcattttgtcgaagactcaatgcccatcgaccaagactactttagtctccctttgttatccagagacaatcaaactcaatgtccatcaaccaagactacttttgtctcccttcactatccagagacaatcaagtctgatggcatgcaaagacaaatatggtcatctgctcctttttggagacctcagtgtcttgcgaccgagactattgcggtctctatttcgtcatctggagacaatcaagtccgatggcatacgaagatcgtcatggtcactcaatttcattgttccgagactatcaaagtccccttaccatccaaagacaagcaagtccgatgtccccttttgccacccagagaaagcgagtccaatggcatgtgggaagagaccatggtcttccgttgttctcaaaattattgaagtctcccctgctatctcgagacaaccgagtctaatggcatatggagaccatcacggtttcgctgattgggctagtgctcgcctgggcgagcaagttgcttttggagtaagccaccaactcgcttgggcgagatgggcagcaagctcctccccctattttgctataaataggcatgggaggctgaagggaaggg

SEQ ID NO: 59931 - DNA, 237 bp, Glycine max
  Peptide Sequence Number=SeqID_176709
atggaaggttaccccaatattgatccttttgctttgaaaaggttaccaagaagacctaggaaagctaggaggaagaatgaggttgaagggcaatctggtacccaacaggcaagaggtccaatactgtttgatgttcaacttgcaaagagtttgatcataattataggacctatcaaagggctccacaaacacaaatgcatttgcaagtgcccgttgaatcttcaagtggaggagtga

SEQ ID NO: 59932 - DNA, 173 bp, Glycine max
  Peptide Sequence Number=SeqID_176710
gaattgtagcaacggataacgaattggtggaaataataataaagaagggtgagggttacttacgtagacaaagtgagtgctccaagaaagacagacgaatggactgcgacggaggtgcagcggaggacggaggtgacggcaagcagacaactaaagatgcgaggctgcaatga

SEQ ID NO: 59933 - DNA, 511 bp, Glycine max
  Peptide Sequence Number=SeqID_176711
atggtattcttggatgcactgcgtgacttgacacagagtagaggttacgcttggggcgctgctgcacttgtgcacatgtatgataatttaaatgacacatccaagagcactgtgagacagcttgtaggatatatcactctattacagtgttggatctatgagcaattttcgtctgttagtttcactgttcctgccgaggattacgatgagaagagacagcgtgcatgtcgatggacctctggcaaggcactgcccatttccacgtatcggaggcgtatggatagactgacccctgatgcggtgtgctggagtccgtacggtgaccaccgctcatttagagaatttgaggtcatctcattatttttcggccatttcaaatggggccccttggctgtcattcaccgaccagagagggttgtacaacagtttggctacatccagactattccgccacatcctattgcatcttcactctctattgaagaaattaatgatagacggatgcagtttg

SEQ ID NO: 59934 - DNA, 550 bp, Glycine max
  Peptide Sequence Number=SeqID_176712
atgaaccggaagctgggttacggtgcccacctgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaact

SEQ ID NO: 59935 - DNA, 927 bp, Glycine max
  Peptide Sequence Number=SeqID_176713
atgaaaaagctaagctgcataataatccttctatttctttttttgagcaatagctgggcaagtgagcacaaaaatgttctattgctgctcggttcggctaatcctgatgtgctgacacgtcgggtggatgttgctgcacagctttaccgaatacgtaagatagatgctgttattgtctcgggaggatgtggagctcatggatccaagatttgcgaggcctcttcaatggctctgcagctcgctggtaaaggtgtaccatcaagcttaatcttcaaagaagaaaactcgaagacaactgtgcagaattatattttcagcaggcgtttaaaaaatgaagctggtcagcgaattatacaaggaggagatacggtgtatgtcgtttcggaccattggcacgctatcgctgttgctgctcgattggagaaatatgatggcgtgaccgcgaagttttttattgaaggatctatacaaccgaaaaaagaagatcgactggattatgcagctatatttaacggctacgaagataatcgcctattcactttgaaggggactggctcactccagaagccgtatggacaaaaagagatagatcaaccaataaatgaatggctgaaattgccagatagcctaaattggagtgaatttaatacgggatatatacaaacaaataagttggtactgatcggcaatgagaagatgctattggcggagaaaaatggaaagcagtttaacaggataaagatcacttcagcagaacgatatttcactaactggccatatagttgggccaaaggtaatgtaagtgctattgggcaaaagaatgataaaattgtgctataccgtaatatggaatccgtggaatttgatcctgggtcaaggattattggaaaagccttcgcgttaaagctgaaatggatctcaaattaa

SEQ ID NO: 59936 - DNA, 399 bp, Glycine max
  Peptide Sequence Number=SeqID_176714
atgcgggcatttgggactatggcagcttgcctaggcaagctgttacttagtccagaagaaattggctcgcctaggggagctggttcctttagccctaagcaatttgggggcccaagggagccagaggctagccttggcgagccaaggcccaaaaaattgcctgaagtgacccttttgcccctccccttgggtattttccgcatccttgaccaaaacgtcgaacgatctcacaccttgtccaaaaactggcgtcgaacaataccttacggcctaagatcttcttcatcaatggattcctttgcttcttggaagaagaatgatagtggaatggagaaggaagagagagaggagacaccacttcaaggagtagatgagtctagaagaagctcaccaccatag

SEQ ID NO: 59937 - DNA, 1008 bp, Glycine max
  Peptide Sequence Number=SeqID_176715
atggatggatcaagttcgacgtcaagccttcagcaaggcgtatgggaaaatctgggatttggccatgttggctctgaccatagaagagttcgaatggatcttatgatgcctgctaggaggaaggaagccataccttttttctgggttctatccttctatggaaagaatagccaaagtgctttggcaaatcaaggggagtggacctcgctcattgacatattaacactgttggtgtttgggactatactattcccgaatgtagacggattagtggacctagcagcgatcaatgcctgtatcgcttatcatcacagcaaggaaagcccggtcatcgctgttttggtcgatgcatatgatacatttgacttgagatgcgagaagaacagtgcaagaatcatcggttgtacgcctgttctttatgtgtggttggtctcccatgttttttgtcatgaagttaggtctatctgtcctctgcaaggtcatcgcatgtgcaccaaaaagggaaaagaaaattgggaagaactcttggcaggattcccaaacatccctttaatgggaacgaggggttgtattaattataatcccataatggccataagacaacttggctaccctatgagaggtgcaccgttgaaggagatcattgtgcctttcatcacgcgaggtttcaatgaagccaatgcgaagatacttcagagaatctgtaaagcgtggaatacagcggaaaggaaagataaggagcttagggcaattggcaatgcatcatcagtggctatcacaagtgcgaagaaaagcaagctcgaaaaaatgagaatggtcaaggagaagctaaagaaggtggtcactagggtcaggaaagagtgtgatgagctgagagatgtcaacatgactacagtcaaagcattagagcaggaaacaaaaagggtccgaaaggaagaatggggcaggaataagtttcgaggggctctatggggtagcagcaacaagctcaagcttagaagggcctag

SEQ ID NO: 59938 - DNA, 234 bp, Glycine max
  Peptide Sequence Number=SeqID_176716
atgtgggtgcaagccattggtctgtttgctcaagcgacctgtgctcctgagtttggacttccaagaccgttcaatcagagattactcgtcttgcacgttggtgggggtgccgtaaatcaacaagttccttgctacaaggtcatgacaaaagacaacgattgtacctcaaagccctacactggggcaatgaaaggccccatgcataaacctcaaacgaacctaggggcagattag

SEQ ID NO: 59939 - DNA, 382 bp, Glycine max
  Peptide Sequence Number=SeqID_176717
ggtacatcctttgtggtacaagtagagggtacatctacttgggtttgactaagaacaagagagggtacatctcttgtggatcagttctagtagagggtacatccactaggttcaaagagaacaagggagggtacatcccttgtggatatttgcttgtaaaaggatttttacaagacccgtatgcacatctagccacttatattgagatttgcaacactgtcagactggctggtaatagtcttaagacttgggatgaagtggttgaaaaattcttgaagaaatacttcccagagtccaagactgctgaaggaaaagctgctatctcatcctttcatcaatttgtagacgagtccttgagtgaggctttggaaagatttcatgg

SEQ ID NO: 59940 - DNA, 507 bp, Glycine max
  Peptide Sequence Number=SeqID_176718
atgtcaaaaccaagtatttcagattcaaaattcttagcttggatgaatagcaacaaatgtttttcagatggtagaaatttgacttattcacaatttgtttccaaatttgtctacaaccaaaaggctagatcatggaaccttagaaagaaaggcaatacaattggcaggctaatatgggttccaccaaccactggtgtcattactaaacctaaagaactttggagtcagacatggaattggttagctgaagacattgcatatcattataaaaaaacaactctgaacacagaattactcattgatgatgagcaacttaaaaatttaacattactggaaattgaaaaacttctgcatgcaaaccaaaaatcactcagagactatcctacaatgccagatcctaagggtggaaatcctgcatcatgtctagagaatagcttgatattgtctgaacttaattacaacaacgatgaggctagatcagaattcgaaatctttttctatggatga

SEQ ID NO: 59941 - DNA, 273 bp, Glycine max
  Peptide Sequence Number=SeqID_176719
atggcttccaataatagaaagacttatgcttcttcctcttcccaagaaagatttgacagatctaggtttcattcccaagaagcttgggagagggaattctacgcaaacctctatgagccaaaagacaagtttcgcaacccacccttcggcgggagggcgacgcgggggctcacgggtgcgtcttccaagaaaagaaaatgcgcaaagtcgccaccaacgtttattcgaggaaaacgtcggaaaaactgggaaggtgtggtctacgaactttaa

SEQ ID NO: 59942 - DNA, 843 bp, Glycine max
  Peptide Sequence Number=SeqID_176720
atggcggggtccaaaatagtgtttcgtgagtacacaagtgatgactcattcacaaagctaactgacatccctaaagatgtgagtgaaatccaagtagctctgacctttgccagagactatgatggggtggggtcaacccaaggaaagttcataccttactgggacacagcaatagtgaatcccgatgtgatagccaatttcaagagcaagtatccctctgccaaagtgttggttagcattgggaacaacaagaggcacttccccttcaaaattgatgaggatagagtaacagcatggattaatgctgccactgaatcgctcacacgcatcatcaaggagtacaaccttgatggaattgatgtttactatgaggacattgaggtcagcaacccggctatctttgttcattgcattggggaacttataaagaccctaaagctcaacaaagtcatcactagggcttccatatctccaaatattgaaatcaatgacaacttctaccggtccttgcaccaaaattttgaagatcatattgattatgttaatctttttctctcagtggtggagaatcttacaggcaacactaaccaagaagaggtgttagagaaacttaaacccacactcaaccaatatccccccattaaacgtttgcttggctacagcagcatccccccaccacccatcttctttgtcgttagcaaaattcttctgtctcacagtttcattaatggcatatcacttaaggttactagtttctcaatcacctactttcccccacagtggatccttgacctcctccagtctcccttagccatactgggatcatgcaaatgcaatctttaa

SEQ ID NO: 59943 - DNA, 933 bp, Glycine max
  Peptide Sequence Number=SeqID_176721
atggagaatcatgcccaagaagctcacttagtgcaagaagccacatgggaagtcaactgtcatgtgcaagaaccaacagtgtctaattcgcatctcatctttgaggagcctttaatggcaggagataaaccatcgagagtaactctaaaggactactctagctcctcaacaccacagtatttcaccagtattgcacagccgaaagttcaagcagccaatatttcatatccacactccctcattcagttgattcaaggcaacctctttcatgatgaggtagttaagaagttcttgaagaagtatttcccggagtccaaaaccgtcgaggggaagactcctactcatgggtttagtaagccaattcaactgaacatatttattgataccttacaaccccattccaggcaactcctcgatgcttcggctggtgaaaagattaaattgaagacccctaatgaagctatggagcttatagaaaatatggcagccaatgattatgtcattctccgtgataaagcttacacacctacgaagaagagtcttcttaagctcatgtctcaagatgctttgttggctcaaaataagctcttagccaatcaaattgagaccctcatggagacattgaacaaactccctcaatggttgcatgactcaagaggagctcataagttaggcatgtgcatgactcaagaggaaatgtttaaagaggtcaactacatggccaacccaaaccgccaagggtatcatcaaggagggaaaccaggttatcatcagggaggaaatttctctcagaaccagggtcaagagaaccgccaagctggaggacaccctgacttagttcatgctgaaatccactgcaaactttatggtgaacacaaagaagaacccaaaggaggaatgcaaggtggttctcacaaggagcaagaggaatga

SEQ ID NO: 59944 - DNA, 309 bp, Glycine max
  Peptide Sequence Number=SeqID_176722
atgacgccagaagccttcctagagcatgttgcttggcttggggacaggccttcctctgtcaaggaggggggtgccgcctttggagctggagctaacataggaccatctggtgatgatgatgcagcagaggctgaagatgataatgattatatcgcaaatggatataagaaacagtggcatagagaaccacaactacattccttggtagtttgttggttacaaaaagtggttcttcaaatagatagggaatgggtgaatgcttttatagaacctaagtgtttgaatccaagaaaaaccatgatttcctag

SEQ ID NO: 59945 - DNA, 1938 bp, Glycine max
  Peptide Sequence Number=SeqID_176723
atgtcgatatacactaaatttttgaaggactttctcacaaagaaagggaagaacatcaacaatgagagcattgtggaagaaaggaattatagtgctttgattcagcaaattctaccacaaaagttcaaggatctcagaagtgtgaccatcccatgctctattgggattgtatcagtaggaaaagctctcattgatctgggggcaagcatcaatttgatgcctctctctatgtgtcggaggattaggaacctgaagattgtcccaaccaagatgactcttgaactagaagattgctcttttatgaggtcatatggtgtggttgaagacgtcctggttaaggttcagcagttcatctttcttgtggactttgtgatcatggacatagagggggattcaaacgttttcttgattttgggccgtccatttatgctcactgctaaatgtgttgtcgacatggggaaaggtaatctagaaatgagtttggaggaccagaaggaggagaaggatctcaaggtagatgatgttaagtcagtggttatcagtaataacttgtcttcaactaaggaagcacgattagtggagaggagactcaaccaatccatgaaggaggaagtgcaaaaagaaatcctcaagttgcttgaagtaggacttatctatccagtctctaacagtgcttggaagattgtcttaggtcacaagatctattcccgagggattgaagtggacaaggcaaaaattgatgttattgagaagttgcctccacctccattaagcaacatgttgaacaaggatattgtgtttaagtttgaggaagagtgtttattggattttcagactctgaaggagaggcttgtgttcgcccctgtcatcattttcacagatcatgcagcgattaagtaccttctaacaaatgatgattcgaggcctaggttgattagatgggtgttgttgctccaagaattttacattaagatcaaagataaaaaggggtgcaagaatctggtggttgatcacttatctaggttgtttgtggacattgccaacttcaaggcagctagaatcatccccgatgatcttaattggcatcaatggaagaagctagaagtatatcatggcattgtcataattccccctatggagaacattataatggggaccggacaggtgcaaaggtgttacattccggattcttctggccctcgatttttaaggatgcccatgagcacatgttgcattgtgatcaatgtcaacggactaggggtatttctcagagaaatgagatgcccatgcagaatattatttaactggaagtgtttgagtgctgggagaatggcactaaaaccatcattaagttccttaagcaaaacatcttctcccaattttgagtcccaaaagtactcatcagtgatggtgagccacacttctgcaatgcacaactgcagaaggtcttggggcactacaatgtcagacataagggaattaaagaagatccttgagaagatcgttgcatctttaagaaaggattgggctgtgaaattggatgatgccttatggtgctatagaactgcttttaagaccccaattggtctgtctccattccaaatggtttatgggaaggcgcttaagttccttaactttgatgagtccttgtcgggggagaagcgaaagctacagttgttggagctggaagaagtgaggctcaatgcttatgagtcctccaaaatttacaagcaaaagatgaaagcctatcatgccaagaggtttgtgaagaaaaacttctatcttggacagcaggttctgctattcaactcccggcttaagcttttccctgaaaagctcaagtccaagtggtctggccttttcacaatcaaagatgtgaagccttatggagtatttgagctgatgaacccctcttctactgacctagagcgcagctag

SEQ ID NO: 59946 - DNA, 1500 bp, Glycine max
  Peptide Sequence Number=SeqID_176724
atggtgtcaccacttctaattctatgcttttctcttcctttgcttttgtttttcttcttccaaagccgcagaaccttcaagaagccaccccttccaccatctggtcctataggccttcccataatagggaatctccatcagctagatagttctgctctttatctgcaactatggcaactctcaaagaaatacggtcctctattctcccttcaattaggtttaagaccagccatagttgtttcatcccctaaattggccaaagaagtattgaaagaccatgaccttgagtgttgtggaagacctaaattactttcccatcagaaattgtcctacaaagggttagagatcgcattttccacatacggtgacatttggagagaaattaaaaagatttgtgttgtccatgtccttagctcaagacgtgttccaatgttttcctcaataagacagtttgaggtcaagcagatgattaagaaaatatccgagcatgcttcatcgtcaaaggttacaaatttgaatgaagtggtgatgtctcttactagcactatcatatgtagaattgcctttgggagaagctatgaagatgaaggaaccgaaaggagtaggttccatgggatgctaaatgagtgtcaagccatgtggggaaccttctttttctcagattatattcctttcttaggttggattgataaactgaggggacttcatgcacgtcttgaaaggattttcaaggagtcagataagctctaccaagaagtcattgatgaacacatggatcccaatagaaagattccagagtacgaggatatagtagatgtcttgcttcgactgaagaagcagggttcgttatccatagatctcacaaatgatcacatcaaagcggtgctcatgaacatgcttgtagctgcaacggatacaactgcagccacaacagtgtgggctatgactgctctactaaagaacccaagagtaatgaagaaagttcaagaagaaattaggactttgggaggtaaaaaagattttctagatgaagatgatattcagaaatttccctatttcaaggctgtgataaaagagacactgagactgtatctaccagcaccgttgctggtgcaaagagaaacaaatgaagcatgtattatagatggttatgaaattccagcaaaaacaataatctatgtgaatgcttgggctatccatagagaccctaaggcttggaaagaccctgaagagttttcacctgagaggttcttggacatcactatagatttacgagggaaagattttgagttaattccatttggtgctggtcgtagaatttgccctggcatgcatatggcaattgcctcattggatcttattgttgctaatcttcttaattcgtttgattgggaattgcctgaaagaatgagagaagaagacattgacactgagatgttaccaggaatcactcagcataagaagaatcctctatatgttttggccaagtgtcgtatctaa

SEQ ID NO: 59947 - DNA, 312 bp, Glycine max
  Peptide Sequence Number=SeqID_176725
atggtgaaggagtgggacttaccgagctcgaatccatcgaggaggaacatcaagggaagcaatcaaaacaagatcgacttcaacatagagcgtagccaacgatttgagaagcacgcttttactggaggagaggggaatgggggcggtggtggtaccagggagaaggtggagaaatgtaagggaaagaggagagaagaggagaaggagaagacagctagggagtggggagaggaacagacgccagttgggaaagaaaaggaacgagtgccacatttgcggaaagaagaggaacggacgcgaggggcgcattaa

SEQ ID NO: 59948 - DNA, 213 bp, Glycine max
  Peptide Sequence Number=SeqID_176726
atggagttatctaatttatgtaaatttccaattattggaaggcctttaggacctggaggtagggggggtttcttgaaggctctaaggtgttggatgaagaacaagaaaaacacagggagagtaagacatagaacaagtggtaaaagcattgtgaccatgaggaagaaaaaagttgtaaatcatataatcaatcagagtatgagaatgagatga

SEQ ID NO: 59949 - DNA, 333 bp, Glycine max
  Peptide Sequence Number=SeqID_176727
atgatgagagctgaaaatgttgatgatgaacattatgcactagttgtggtggagtctgagcgaagaaggaatcattcaaggagacatgatagaccaagaggaagattaaaatcgcaatcacatctacaacgagatatgagtaatatacaatgttactattgcaatgagaatggtcatgtgcaagcgaggtgcaaacaaatgaaagaggatttgaagaaattaagagatatgaacaaagatggggcaaactcccaagctaatgtagtaaaaagtgttgaagatgaagatgccgtgtttttggcaataaacgatgaggttgctaaaacaaaatag

SEQ ID NO: 59950 - DNA, 564 bp, Glycine max
  Peptide Sequence Number=SeqID_176728
atgagaaaaatttgtgttgcccatatctttagttccaagcgtgtctctagcttttcatctataagaaagtttgaggtgaagcaaatgatcaaaacaatatctgggcatgcctcttcttcgggtgttacaaacttgagtgagttactcatatctctctcaagcactataatatgtagagttgcttttgggagaaggtatgaagatgaaggaagtgaaaggagtaggttccatgggttgctcaatgagcttcaggtattgatgggtaccttctttatttcggattttattccattcacgggttggattgataaactcaaaggattgcatgcacgacttgaaagaaatttcaaggagctagataagttctaccaagaggtaattgatgaacacatggatccaaatagacaacatgcagaggaacaagatatggttgatgtcttgcttcaactgaagaatgatcgttcgctttcaattgatcttacttatgatcacatcaaaggggtcctcatgaccggtaaatacgaagtagataaggggcaaattcatgttagaagtagcaattaa

SEQ ID NO: 59951 - DNA, 429 bp, Glycine max
  Peptide Sequence Number=SeqID_176729
atgtcagagccatggaagatccacaacacccgatcgacaccaaaccacagaaaaacatgtagaaccatgctaaattcttgtgttcgttattatttttcctacggtgtaatctttgttatgttctcacgatcctttgtgggtagtactattcaagaccttttggtgcaacaaggtcttgatcaggcgttagaagatgaaagaccggcttctataaatgaaatcaagtggactaagatccaatggagggttgtgagcatgattcggttagtccttactcctgagataaaaacatgtgttgaaggagacaacaccgaaggcctcacgggagaagttcgagaatatctatacgtcaaagtcgctaaccaatcgtctttgtttgaagatggagttgtatcaactcaaaataaagatgagaggagatctccatga

SEQ ID NO: 59952 - DNA, 986 bp, Glycine max
  Peptide Sequence Number=SeqID_176730
ctccaagcgtgtctgtttctaccttttcctctattagaaattttgaggtgaagcaaatgctcaaaaagatatctgggcatgcctcttcgggtgtttctaacgtgagtgaattacttatttctctctcaagcactatgatatgtagaattgttttcaggagaaggtatgacgatgacgacgaaggaagcgatgcgaattatattccattcacgggttggattgataaactcaaagaattgcacgctcgtcttgaaggaagtttcaaggagttagataatttctaccaagagatcattgatgaacacagggatcagaatagacaacacgcagaggaaaaagatattgttgatgtcatgcttcaattgaagaatgagagttcgcttgcgtttgatctcacttttgatcatatcaaaggggtcctcatggtatggtggtgtcttaaatcttattcttactcttatcctcttgaaggcgtgccaaaccggcggcttgaacgagggttaggggctggagtgcctgtacttcgcggcggatgtcggggtccaagcccgagacgaaacagctcaagaggagcgatggcggcaggccgacaatcctattcgccagagcttcgaactgatgcagcgggtctcaatggcctgcaaaaatcccgcccaagtggggaactggtggttgcgggtcatccactagaatcaaaccagggcgggtccttccatggtgaaggaggcaatgtgttgataatggctggtttgggtacagggttaggtaaggaagatgaaggcgaagctgaggagtggctcgggttttcgagattagctactcaaaggaggagatcctctaatttttcagtaacgacaatttggcttgaggcaagcagggagattgcttcttcaatgtgttccaatggagatttagctcgaggggagtccgccatgggagaaggaaatgaaagcaccaaatttgttaagaaccaaagaacttcctag

SEQ ID NO: 59953 - DNA, 309 bp, Glycine max
  Peptide Sequence Number=SeqID_176731
atggagagaaagaagagagaaaggggagagaacgagagagaggaggaaaatgaaaggccttttattagtattggtactgcctcggtaacgccaaagcatcgcgggaaattggatagctggctgtgcgacacgttagccctgacaatgtcacgtcagcattgtcaggaccttcaaactgtttttgcatctgccgactttgatcctgaagtgctagaagctattaaacctgctatgagattatcaacaaatgttgatggctacaacatgcattttttggttttagaatgccgagaaacagctggcacatag

SEQ ID NO: 59954 - DNA, 889 bp, Glycine max
  Peptide Sequence Number=SeqID_176732
atggatgctcgccggccaccaccatatcaccctccaacgaccatcgcgacaaccataaccactcaatcgccttcacccaaccctactccgcctctgttacctacacctcaacgcactacaaccacttccattccttttaaacgccttacaccggaagagctcgcggtttgctgggaaaagggattgtgtttccactgcgacgagaaattctctcgaggtcacaagtgctcatcttcgttgtttctcttggtaacagaagatgaagagcttacaccgcagttagcaccaccacgttcaccatcacctgatttactttcggaaccttctctagcacaactcagtttactcgcccttggcgtctcctctatctcttccttctccattccgttgtcattcatcttccaagaagcaaaggaatccattaataaagaagatcctaggcctacaagctccaatggagcttacatcaagttcgaatggacaaccatcgcaggttcaaaggacaattgttgccaaaacatggagggggagctactcatgcatgttgaaggggaattggaagttgtcattatcaaaaagggggagattgtagaagcaaagcttcatgatgaatcaagattgattcaaagatattttgatgataacaaagatgatgacaaaggtgatgacaaaaagctcaaaggtcaatcaaagaatgagttcaagatgttcaagatagaatcaagaacacttcaagactcaagaggaaagttgaagaacacttcaagattcaagaggaaagttaaattccagaatcaagaatcaagattcaaggatcaagtttccaagaatcaagatcaagattcaagactcaagattcaagaatcaagagaagacttaatcaagataa

SEQ ID NO: 59955 - DNA, 4552 bp, Glycine max
  Peptide Sequence Number=SeqID_176733
atgctttccacaatattgttaccacttgttctatgtcttactctccttgtgcttctcttgttcttcatccgcaatctcagaaccttcaagaacccaccccttcctccaggtcctaaaggccttccaataataggaaatttacatcaatttgatagttccattctttatctgcagctatggcaactctcaaagaaatatggccctatattttctcttcaattagggttaaggccagccatagttgtttcctctcctaaactagccaaagaggtactgaaaaaccatgacctagagtttagtggacgacctaaattacttggccaacagaaattgtcctataatgggtcagagattgcattttccccatacaatgaatattggagacaaattagaaaaatttgtgttgtccatatctttagctccaagcgtgtctctagcttttcctctataagaaattgtgaggtgaagcaaatgataaaaaaaatatctgggcatgcctcttcttcgggtgttacaaacttgaatgagttactcatgtctctctcaagcactataatgtgtagagtagcttttgggagaaggtatgaggacgaaggaagtgaaaagagtaggttccatgtgttgctcaatgagcttcaggccatgatgagtactttctttgtttcagactatattccattcacgggttggattgataaactcaaaggattgcatgcacgacttgaacgaaatttcaaggagttcgataagttctaccaagaagtcattgatgagcacatggatcccaatagacaacaaatggaggaacatgatatggttgatgtcttgcttcaattgaagaatgatcgttctctttcaattgatctcacttacgatcacatcaaaggggtcctcatggacatactggtagcagggacagatacaactgcagccacatcagtttgggctatgactgccctcataaaaaaccctagagtaatgaagaaagttcaagaagaaattagaaatgtgggaggcacaaaagatttcttagatgaagatgatgttcaaaaactttcctatttcaaggcaatgataaaggagacatttagattgtacccaccagccacactacttgtaccaagagaatcaaatgaagagtgcattatacatggctatcgaattccagctaagacaatattatacgtgaatgcttgggttattcatagagatcccgaatcttggaaaaatcctcaagagtttattcccgaaagattcttggatagcgacgtagattttcgtggacaagatttccaactaattccttttggaacaggtcgcagaagttgcccaggtttacctatggcagttgtgatattagaacttgttcttgctaatcttcttcattcctttgattgggaattgccacaagggatgataaaggaagacattgatgttcaactttcaattaagcttgatgacaaaaacttccttctgtggaatcaacgggttggcggaattgttgcaatgcacaaattgcaccatttacttgtcaatcctataattccttcaaagtacaattcagatctagatcgtcaactggatcgcatgtttgttgaatatggaaagtggttcattcaagatcagtctctcttcacatggcttctgtctactcgttgcgaatcggtgctttcgacagtgttgaattgtcaccatgggcatgaaatttgggacaaaagccacactcaatactacgccacacttaaggctaaggtgcggcaactcggatctgaactgaaaaccgcaaagaaaggtaatcgttcaattgctgagtacacactccgtatttatgctttagtcgattccttgattgctataggagagacaatatctgatcaagaattgcttgatgttgaattagcaacacctgttgtatttgctaatgtcgcacacacaacacctaatcctcagtttcaaggaggtcgtggtggtcgtggccgcaacaacatagccagaggctgtggtagaggtagaaatcttggtaatcgtttaacttgtcaactcagtggcaagtatggacatgctgtcttgaactgctggttcaagtttgatgaaagttttgtgccaaccacttcagttgttgctcaaccagtggctgcaaacactgccaattcacaagcatcaacacttcaatctcagactgagaccaccactgcaaatgttgcacctcaggccaatttggcacagactagtaaagagtttgatgtctcaattcctactgacttagaatcacaagcttggtttgttgattcaggtgcatcccatcacctcacaaccaattcgttgaacttgcaacaaagctcagcttatgttggaagtgagcaagttcatatgggaaatggtcaaggctccttaggaggtgatggtttgtatagtttcaagagcattccactctctcagcagccagcattccagactaccaaagtttgtccaagtctgccaaatttgcctaatcctgcacctagtgtgcataccagtgtttctgcttctgttcagtctagttccgaagatgtagtagatccaattctatggcatagtcacctaggacatgtcaactttcaaactgttaaagttgtaatgaaattgtgtgacattcctattactccttccctgtccattcctggttctggtcaagctgctgaccaatctgtgtttgcatcttctactacaaaatttattccctctacagtttcagctccaaattccagtgcagaaattccttcttctgcacctgcttctgtcagctctaatccagtgcagtctcacatggaacaaaatttaaataatcaccctatgctcactagatccaaaatagatcattccaagcccaaaacctttctggttactgcaaaacaaaagactgtgaagcatgctttatctgactctaattggaggtcatctatgcaagctgaatatgaagcacttgttaagaataatacttggtctcttgctaaatttccatctcacagaaaaaccattggtcataagtgggttttccgaattaaagagaacctgaatggaactataaataagtacaaagcgaggcttgtagctaaagcactcactaacaagtggaatattcctcaaattgacacaaaaaatgccttcattaatggtttcttgcaagagggaatttatatgcaagaacctccagggttcgaagcaagtggcaagaccttgctgcattttgtttttgctcttaaaaatcttgggaagcctgattattttcttggcattaaagtcaagtatcaatcgaatggttctattgttctcacccaaaccaagtatattagagacttgttgcaaagagataacatgcttgattgtaatggcatctctactcttatggtttcaagctacaaactcagtaaatttgggtcagaattactgcctaatgctcatcaatatcgcgatattgttggtgcactgcagtataggattctgaggtacctcagtggaactgtcactcatggcctgctattgcaaccagctcacatggatgctaaaatttctttacgagcctacaatgattcggattggggtagtgatcctgctgagatgcattccacttcaggatcttgtatcttttctggttcgaaccttatagcctggagctcaaagaaacaaaccttggtggctcggtctgttcagaagcagagtatcaagcaacctactttgttgtgtatcaatctgagtgcagtcatgattgcatataatcctattcttcattcccgaactaagcatcttgatctagagattcactttgttcatgagaaggttgcaaccaagtctcttgttgttcagcatatgccttccaatatgcagttggctgatgccttaacaaagcctctccctacttcaaaatttcttgacttaaggcccaaactcaaggggatggtagcgagggtggcaatggcattctcgtggaggagaccttggtttgactggaaaataccgaagttaaaccaatttgaaaatgatttggaaggggccaagctagcccaatcatccatggctggctgggagtggtctaacagaggggagaagaaatatgttgtgaaggaaggattggtctggaagatggtgttcaacagaatccaaacggtggaaaatttgaagaaaagaaacattgtggctgatgggctatttggggaatatggaagatcaggaatgataaacaatgcagtatgcgaccctgtgactgtgttggatggtattcgttatcatgcttggtgctggtgcaaggctttcgcaaaggattgcccagatatttattttttgagcatttgcttcacctcaaaatttctaatagaggaaaaggtagagacagacacgcttggagctaaagatatggacaacataaacttttctgatttctctccaatactcattgcctcaaacctaattgaagggaaaatagagggtcatatttctttgagagttgccatagctgtgctgaggttttggataaagaacatgaaaagcacagggagagcaagacatagaacaagag

SEQ ID NO: 59956 - DNA, 462 bp, Glycine max
  Peptide Sequence Number=SeqID_176734
atgaagatgatgttcaaattccctcttaaggcagtgataaaagagacactgagattgcacttaccagcaccactacttataccaagagaaacaagtcaaaaatgcacgatagagggttatgaaattctagccaagacattaatatatgttaatgcttgggctatctatagagaccttaaggcttggaaagatccaaaagagtttatacccgagagatttttaaatagcaacatagatcttcgtggacaaaattttgagttcattccatttggtgctggtcgtaaaatttgtcctggtttgaatttggcatttgccacaatggatcttattctcgccaatcttttttattcttttgactgggaattgccaccagcaatgacaagggaagacattgatactgaagtgttgcccggaattacacagcataagaagaaccctctttgtgttgtggccaagtgtcgg

SEQ ID NO: 59957 - DNA, 891 bp, Glycine max
  Peptide Sequence Number=SeqID_176735
atggaatttgtgggttggtttcttggtatttctcttgggcctgtccctggtgggtgcttctttgctgatctgcgtcccattgctaacagactgcatgcacgtcgtgaacggaatttcaaggtgttgaatgagttctaccaagaagtcattgatgaacacatgaatcctaatagaaagactccagagaacgaggatatagtagatgtgttactccaactgaagaagcagcgttcatttttcgtagatctctcaaatgatcacatcaaagcggtgcttatggacatgcttgtaggagcaacggatacagctacagccatgacagtgtgggctatgactgcactactgaaaaatccaagagtaatgaagaaagttcaagaagagattaggaatttgggaggtaagaaagattttctaggtgaagaagatgatattcaaaagtttccctatttcaaggctgtattaaaagaggtaatgagattgcatctaccagcaccacttcttgcaccaagagaaataaatgaagcatgtattatagatggttatgaaattcctgccaagacaatagtgtatgtgaatgcttgggctatccatagagaccctaaagcttggaaagaccctgaagagtttttaccagagaggttcttggataatactatagattttcgagggcaagattttgagttaattccatttggtgctggtcgtagaatttgccctggggtatctatggcaactgccacattggatcttattcttgctaatcttcttaactcgtttgattgggatttgctagcaggaatgaaaaaagaagacatcgatactgaagtgttgccaggacttgctcagcataaaaagaatcccctctgtgttctggccaagtgccaaatctga

SEQ ID NO: 59958 - DNA, 639 bp, Glycine max
  Peptide Sequence Number=SeqID_176736
atgggttctctcagaaactcagatctcatcctcatcgcccagtgtttccctttcctcgaacatctcgaccttagtttccccaaagacaccgacaattccaccttccccgtctccgatgtcagcgtgaaggccctctctttggccctccctatgctacacagcgttgacctctcccgcaatttcttcatcaacgacgcttccattctcaacctctgcaaaaactacaactttctcgagcaagttacgatcttcgagtgccacttcatcacgcagcgtggcatcgcttccaccatcaaggagagaccttgtttgcgttctttccgcgtcagcaacttccgccatcagggagagacccttgttttgcaaggttgttgtaactatagctatgttggagtgctttgcttgttgtccacgtgtcagtctttggagcatttggatcttcaaaacgctgagtttctgtgtgatcagcgtgtggaagagttgtgtgagtatcttgggaatttggtgtctgtaaatgttggtggttgtaggatgttaactgatttagctttgtttgcactagttagggggtgtcctttgttgaatgagatcagaatgggggaactgatgttgggaagaggagggttgatgaggatttga

SEQ ID NO: 59959 - DNA, 714 bp, Glycine max
  Peptide Sequence Number=SeqID_176737
atggctcagtcgaatcaaaccagaatcaagcatagtctggacctgcttctcgagttcggttttttggctatatgggtaacgatagggcttaaccgtgactggtttggcatctgggttgaggtggatatggtgggaaatgggtcggactggggtagaggagatagagcagggggtgggggttcggtgtcaggaagtaagggccgcgacggcctgcgtttgaactctgaagcatacggcgaagctggtgggctgatgccgaagggggctcgtagccactggaccccaagcactaggtcagcaccacttaagggtaacccgaaaagggtagcggcggtcacaatggatgactccaccgtcaccaaccataacgggaatgggggtcaccagagtcgagggaagtccgaggaactttgccacgcgcagttgcacaaagttgtgcgtactgccaccatccacgaggatcgtgagttagtgtcgcatgacggtgccgtggagatatcggcaaggttggctgaggggaatcggggggttctaagcgatgccccggagaccatttctcatcgcagtgatagcaaagccccttatctcgtttcagagctaattcctcagggggggaaggtggggggtggtttgactggtgatgagtggtgggaacatgggaattgtggcggtggctgcggcggcggtctaggagttatcttcttaagctgccca

SEQ ID NO: 59960 - DNA, 1560 bp, Glycine max
  Peptide Sequence Number=SeqID_176738
atgcccaccattgacgagcttcttgacgagcttggtgcggcctcatgtttttccaaattggacttgcgtcaaggatttcatcaaatacgcatggcagaggaggacatccacaaaactgcatttcgcacacattccggccactacgaatactgtgtcatgcccttcgggctgtgtaacgccccggctacgttccaggcaaccatgaatgaaatgctcaaacctttcctacgcaagttcgttgcggtgtttttcgatgacatattagtctacagtccctcttgggctgatcatcttctccacctcgaggctgtcttcacggtgctggcccgcgattctttctatctccgcgagtcaaaatgcgtctttgccaagacccaacttcaatatttgggccacatcctctctgccaaaggtgtctccctagacccctccaaaatttctgctattctcgattggccaactcccacaaccaccacagctctccgtggcttccttggtctgaccggcttctaccgacgtttcattcgcggctactcactattggctgccccactgaatgcgttgctccgtaaggacagtttgatttggaccgtggattcccaacgcgccttcgacacactcaaacaggtaatgacctcggcccctgttcttattccgccagatttcacgattccgttttgcttagaaatagatgctttcggaatcgcgataggcgcggtgctgtcccaacacgctcatccaatcgtgttttttagcaagaatctctgccccaggctgcaacgctcctccacttacgtccgggagctccatgccatcacctccgcggttcgtaaatggcgtcactacctcctcgaccatcccttcactattatcactgaccatcagagcctgaaggacctgatgaatcaagtcatccagactccagaacaacaacagtatttggtcaagcttttgggttacaattacaccattgaataccgcgctggctccggcaacgccgcagcagatgccctttctcgcgtggttcccgccggccaatgtttgattctatccattcctcttttggattgtatcgccgatatccaccactcagtgcaacaatccccaacttaccatgaattacttgccaagctccaacaacaacccgagacccatcctgactactcaatcatctccggcaaaatccactttcgcggcaagctatggttgccttccgacaaccccttcattcccatgctcctagaggaattccactccacgcccctgggtggtcacatgggtgaaacgaaaactcttcgctgcttccgcgattccttctattgggatcacattcaccgtgatgtccaccgcatggtttctcagtgccgagtctgccagcaaattaaatacgaagcccgtaaacctgccggtctactccaaccactgccaatttgctttggcctgtgggaagacttgtcgcttgacttcatctcagaacttccgccgtcacacggcttcaccaccatcttggtggttgttgatcggactccaaggaacccacctcggcacactcccaccaaa

SEQ ID NO: 59961 - DNA, 3402 bp, Glycine max
  Peptide Sequence Number=SeqID_176739
taccacagagggcataggtgcgcctctagggttcttctcatggtagttgaggaagaggacccttcatggtctaatatagacccgggtgacccgaccccaactattgacccacccgatagcccaaacccacttcaggcccaaatcagcctgaactcattatcgggccacttagctcccaaggccctccgtttgctggcttccatcaccgaccaccgtgttaccgtcctggttgacggcggttgggaatggacaatacttggagtgctcgagtgcgaagatgttgcgatctgcattcagcaccacaccttcaacctcgacttgtacatactccccatctctgacgccaacatcatattaggcgtgcagtggctcaaaacactaggccccgtgttaaccaattacaacaccctatccatgcaattcttccaccaagaccaattggtggagctcaagggcgatcatacatccgacaacggtccactaacccagcaccaatttcgccgcctctaccgccaccaacccaccgcctcttacttccatatcactctatctcctgataatcccaccgtacccaatcctcaatccctacctccggaaattcaacatctactggcctcttatgacctcctcttcaaccaaccacagtccctaccaccccctcgtaccaccgaccaccatattcaccttcttccacactcctcacctgtaaatgtccggccgtaccactaccctcactatcagaaacacgaaattgagctccaagttgactccatgctgcaacaagggctcattcaacccagcaatagccctttctcctcgtcggtattactggtgcgcaagcctgacgacacgtggcgtttttatgtagattaccgagccttaaacgccgtcacggtgaaggacaggttccccattcccaccatcgacgagttgctcgatgaattggggggagctacatacttctcgaagctcgatttgctccaaggataccatcaaatccgtatgaacgacgaagacgtgcttaagactgccttcaaaacgcatcacggtcactatgaatttcgtgtgatgccattcggattgtgcaacgccccctcatcttttcaggccaccatgaatatgatattcagaccttacctctgccattttataatcgtcttcttcgacgatatacttatatatagcgcttccttcgaggaccacttgttacatttacagacagcttttcagatttttcttgataatcaatttgctctaaagttgtctaagtgtttttttgcccaaactcaggtagagtatttgggtcatgtggtctccgccagtggcgttgaaccagttgcttccaaggtcgccgcagttcatcaatggccgacgccacgatccaccagggcagtaaggagcttcctcggcttagctgggttttaccgcaagttcattcgcggatatgctacaatcgcagctctgttggtggcagctacgacgtttgagctacccttcaccgtggaaactaacgcctccggggtgggcatgggggcagtcctttctcaacaaagacaccccattgctttctttagtaaaccatttagtccgaagctcctccggtcttccacctacgtccgggaattatgcgccatcaccaccgccgtgaagaagtggagacagtgtctcctgggccaccactttatcatccttagtgatcatcgtagcctcaaggagctactcactcagaccattcagatgccggagcaacatatgtatctggcgagattgatggggtacgactatgagatacactaccgttccgacaaccataatcaggccgtcgacgctttatcaagactactagagaccacttccaccttgtctctgattctctctgtgcccactttgaatttcatggaggaacttcgaaggcaattggacgcgaattctgagtacgtggcactacgacaggccatccgagacacaccacaagatcatccccaattttccctttcgagggatttggtgttacaatcaggtagaatatggttacctagggagttaccactcatcaaaacgctactcactgaataccactcgattcccaccggaggacacgcaggggtgactaagacgttagctcgaatttcagagaactttcagtggccaggactcagggacgacgtcaaacacttcgtggccacgtgcgttgactgccaagtcactaagtatgaagcacgcaagacagctggccttttatgccccttaccagttccaattcgtccatgggaagacctttccctggactttatcaccggcttaccaccataccacgataacaccactatcctggtggtggttgatcgattttccaaggggatacaccttggtatgctcccaactactcatacatcccacatgacggccacattattcatcaatatcgtggtaaagattcacggcattcctcggagccttgtttctgatcgtgatcctctttttataagcaaattctggcaaaacttgtttcatgcaagcggtaccctccttcgtatgagttcctcatatcacccgcaaacggatggtaagacagaggtcctaaatcgtgtaattgaacaatacttgagagcgtttgttcatcgccgaccacacctctggggaaagttgttgctgtgggtagaatggtcccacaatatctcttggaacgcaggaacaggggctactccatatgaaataacctttggtcgcaagccttttaatttcgctgaatacgtggctggaacttcaaaggtggatgctgtggaagagatgttgattgacagggacgacacctttcgggccattcgaagcaagctcctcaaagttcaggccaccatgaaatcccgcgctgatggaaagctagctaaacgcttctatggacccttcaaggtcttagaacgcatcggcccagtagcttacaaattacaattaccagcgggagcacaacttcatcctgtctttcactgttccaagttgaagcccttccatgggtcacccgagggcgtagaaggcactccactaccagctgaaacactcaatgatcaacctttggtttttccgttagccatcttggaccatcgttgcaattcgaatggagatgcttgggaagtcctggtccaatggaatggtctctccccagatgacacaacatgggaggattgggagcagctttgcagtaactaccaccttggggacaaggtggtctttgaagggccaggggatgatacgaatgaacaagtagaagcacaaacagagaacccaacaggtggtataagtgataaccaggaggtgcgagtagcaagtgatatgcaagaggtgcaagaagcaatcaagactaaaaggggaatcataaagcccaagtacctcactgactacgtttga

SEQ ID NO: 59962 - DNA, 159 bp, Glycine max
  Peptide Sequence Number=SeqID_176740
atggagtctgcagcctcaatcggcgaagtacctgtagtatacggcgggaaagctgggggtgaggccggtaccagagtgagtggaggtattatagctccattcggccagagaaagaaaagagtgccacagggcaggcttgtcatgaacgaacgagcgaag

SEQ ID NO: 59963 - DNA, 711 bp, Glycine max
  Peptide Sequence Number=SeqID_176741
atgtgtagttgtcttccagtaaaatttgctgcatctaggtgtggtggtcttcaagctaggtgtagtcgaggtcttccaggtgtagtgcatgcagattttttatttttatttttgtacggggacactctcaatcttaccgagtacgaagtggtgataatagtagtggtggtgaagaaaatgacacgagagatatgtagtagtaacgataatcaagaggacaagtggactcgtaaacttataagagttagcgagttaattcgagagtttgataatcatgacggtaatgatgagggtgataacaatgataaaagtggtgcccacattggtagtgattgttgctacaacaacaacaataataatagtgacaataacaataaccaaggtagttacaatagtggtggtggtagtagcaacaatggttatggtggaaatgatggtagtagtaataatgatggtggtagaagtggtggtagtgaaggtgtcaccaaaagttggcagaaaatgctaggacatctcaatggtagagtcttggagcaggcgttaaagggttgtagtcgctgccccaaagaagagaacgtagaggggtgggaggtcacagaaattgtcgatgacgacggtcacaatgccatgtatgatgatatatggcaaatgttgcaatgccatggctcacgcgatggtgaaggaagcacctgcagcaacaatcgagcatga

SEQ ID NO: 59964 - DNA, 405 bp, Glycine max
  Peptide Sequence Number=SeqID_176742
atggcaatgaagaacaatgcatatcggcaactctccatgcgtccccactactctaagcttgcaaaaaggttctatggcccttaccgggtcacggaatgtgttgggcctgtggcgtatcgccttcagttaccggcaaattcccggatacaccccgttttccacgtgtctctcttgaagcctcaccacggtccgcctccacccatggatgaccctcttccccctacccaggacacttcctgggagaactgggacgcccttcgctccgtttacaacctcagggacgaggttgagtttctaggggagggtgttgttagcaatgggacgcagatcagcaaagaagcacccaccagggacaggcccaagagaaataccaagaaaccagcccaatatcaggattacatttga

SEQ ID NO: 59965 - DNA, 1167 bp, Glycine max
  Peptide Sequence Number=SeqID_176743
atgggatgtattttggccaaatttgatatcctagaagccccaaatgccaagaagaaggtcaggtccacgatggccactagatggaggcaatttaagtctatcctgaccactaaatttgtgtatgctgacactgagggtcaagataaacaagattcttctataaaatatggtatgtatcaacaaagttgggaggaatttgctgcaagccgcaagaccctaaactggcaggactctttacaagaacaaacaacacaaattacctttgttccccatggtcatgatgacatactcaatattgtcattgggcgaccgaagcactcaggtcgtgttcgtgcagtggggtctgcagttcctctacatccatcaccccaacaacaactatctgagattattggaagtcttaaggaagaatggaggaatgatttggaaccagaaaacaaacggagcctagagaaaatgaagcaagagttgaaggaagcgatcaaaattgagttattccaaagggattcaactattacttcaaacaaagtggttgaacctgttcaaaggttgaataatgtcgttgcagatgatccgttgcgtcaattgattaggatcctatatgacagttacgagaagcctattgagttgttgtgggatgggactaaatttgggattccaaatgtagatgcatccttcttattaacatattttgatggattccttgaacatcagtccatacacaatgcaaaggatagatatgttgaatgtcaacattacattgaaacgtgggtgaaggaatcccaacgagaggtctacctaggaacttacttgaattatacaatgaagactttaaagactatcgtggatggtaaaactgatcaagctgcacctcagtggattaaagtaaagtggtttagtgatgacacactattagacttggagaccataacaacaattcgcaagaaatgggcaacctattttgtaaaatgtaaagacatcttatttagaaaggataaatgtcttttgtgcgaccaagccttacattttgaaggtcattgtcaagctaaggatttggacaatcgtgatgatacaccaattggcatcaacaaatatgaggttcgacaactacactcatcttggcttttggagacaattgcatccattatatggattcaaaaccaataa

SEQ ID NO: 59966 - DNA, 323 bp, Glycine max
  Peptide Sequence Number=SeqID_176744
atggcggattcttcttcacatctcactgaggttcttgctcgcctcggagacaccatgaattccctgaacctgaaacttggcgaaatccttcattgtctctcccccacatcaccttcctcggcttttccaaatccatccccgccaccacatcctccaatacctgcagtcacccacaaaatgaagttagaggtcccccgcttcgatggaactgaaccactgggttggatctttaagatcaaccagtactttgagtatcacaatactctggacaaagaccgcctcaccattgcctccttctacatggaaggacgggcattggcttg

SEQ ID NO: 59967 - DNA, 826 bp, Glycine max
  Peptide Sequence Number=SeqID_176745
gaaaggaagtaaagggtacatgcaattgtccatgaaggtcatgggagcaagggctttgtggggtgatgaccttgtggagtggaaacaagtattgactgtgaattcttctggaggattattgtgtttatgggagcaaggaacattccaagtgatctcttgggaaggagagcttggttttctcttcatccaagtagggagggtgagtgatggattatggtgtgtcattggtaattttaattccataagatcccaagacaagaggttgggaagacatgcatcacaacattggaataaggaaatccatgagttcaacaacttcatcgacaatatgggattgtttgaaataccatggataaggaggaagtttacttgggagaaactaaaacatttgaagaaggatatcaagaaatggagtgtggagaagtttgggagtcaacaagcacttattgaatccttggtgtctaatataaacaacatgaactcaaaggaggaactagggggcatttctttggaggaagcaaggaaagggatgaaaacacaaagttcttccataccatcatcaattggaagagaaggaagaaaaacatcaagaggttgtaagtggggggaattggggaggttcaactctatttcgaaggaggaaaatattatgcttgtgggggtatttaccaaagaggaggtcaaagcggtagtttggaattatgatggtaacaagagccttgagccagatgggctaagcttcaatttcattaaagcttgttgggatgtgatcaaaggggatatcttgagcgctgttaatgaattccatggatacagacagttagtg

SEQ ID NO: 59968 - DNA, 864 bp, Glycine max
  Peptide Sequence Number=SeqID_176746
atgtccttgatatatcagcaggaagggagtggggtgaactgtgaacagtgctactatgggattgtttatataaacattatgagcctcacaatgactacttcaagttttgcactatatatgtcttacaagcgattgaagaaagcttttaatggaaaccaggagaatgaaagtgtgtcgcaaccatttgcaagaaacaaagtttatgattgggtgaaggacatcataactatcttttggaagacccaaaagaagtcatcatctgagatgaacatatggaagaaaaggttaatattctttaatcttccatactggtctgatctacatgtgcgtcattgtgtagatgtaatgcatgtcgagaaaaatatatgtgatagtttaattggcacccttcttaacattaaagacaagacaaaggatggtttgaaatgtctccaagacctggttgacatgggaatacaagaggggttgcatctgatatcacaaggtcgacgaaggtatttgcccccaacatgtcagacagtgtcaacaacagataagagaagtttttgtcaatgtctatggagtctaaaagtcccacaaggatactcttcaaatatcaagagtcttgtatccctcaatgatctcaaattggtcggcttgaagtcttgtgattgtcacgtcttaatgcaacaactattggctgtagtgatgcggggtatcctgcctaacaacgttagggttgccataactcatttgtgctttgtttttaatactatctatagcaaagtcatcaaccctcgacaattagatgatttggagaatgaggctgtcattgtcctttgtcaattagagatgtattttcctccatcattttttgacataatg

SEQ ID NO: 59969 - DNA, 216 bp, Glycine max
  Peptide Sequence Number=SeqID_176747
atggattatgaggtgagtgccggcggtctcggtgacctcaccgtcggcagcggcggtgggcgcgtcctcgattcaaatcttggcgttggtggcctcttggagcgtcttcatgagcacgccagacttgccgatgatggcactcacgcgcaacgcaagacaaaggagacggaaggtcacgtcaccattagagtttggagtttggttcgaacttactaa

SEQ ID NO: 59970 - DNA, 285 bp, Glycine max
  Peptide Sequence Number=SeqID_176748
atggatccgaaaaagctttccacgaaaaggtctaggagagacgccatggcggaagggtccagtgccgcccccgagtttgatagccactgtttcccgagcgccgagcaccagcagtgctttcaggctgcagacgcaccaccaccacctcatcaggccgatcccactggatcactaggcatggagcgttatctacagcacttggttcggcagcaggcggccaaccaccgggggcaggtgcagataaatgagtgtctctaccggttcagcctcagtcagcaggggtag

SEQ ID NO: 59971 - DNA, 174 bp, Glycine max
  Peptide Sequence Number=SeqID_176749
atggcggtgcgtctgtttcccgctgccgaccatcccaatgctgctgtggtgtttcgccctgcgcctgtctggggcgcagtacttcttgatgaaagctcgattagtagggggcctgatgcccttgctggaggtgacaggtgtcttgcagtcgcgatccctgcaaacaatagatga

SEQ ID NO: 59972 - DNA, 573 bp, Glycine max
  Peptide Sequence Number=SeqID_176750
atgcatgccatcaccttcaaagggctacgcgccctcgcctttagaggactacacgtcctcaccttcagagggctacacgccctcgcctttagaggactacacgtcgtcccctttagaggacaacacgtcctagactttagagggctacacgtcctcgccttcagagggctacacgccctctccttcaaagggctacatgttctcgccttcagaggactacacgtcctagccttcagagggctgcacgccctcgccttcagagggctacatgtgctcctcttcagaggactacacgtcctcgccttcagagggttggacgtcctaaccttcatagggctacacgccctcaccttcagaggactatacgtccttcccttgagaggactacacatcctcgccatcagaggactatatgtcctcgtcttcagagggcttcacaccctcaccttcagaggactgcacgtcctccccttcagagggctacgcgccctcgccttcagaggactatatgtcctcaccttcagaaggttgcatgtcgttgccttcaaagggcgacacacccctcgcctttag

SEQ ID NO: 59973 - DNA, 818 bp, Glycine max
  Peptide Sequence Number=SeqID_176751
atggaacagatgaagcccaaagaggcgcgcagggtgttggaggacgcgcaacgcagcgtcgaggtgccgctgcgcgaggtcgagatcagcgagaaaaccattcacgtagaaggtcaggatattctgctgcagctggtgcggccggccagggtcaaagaggcgctgccggtattcatgttcttccacggcggtggctgggtgctgggcgattttcccacccatgaacggctggtgcgcgatctggtgcacagctcaggtgcggcggcggtgttcgtcaattatccccgctcaccggaggtgcgctaccctgaggcgatcaacctggcttacgccgccaccgaatgggtggccgagtacggcgagaagatcaacgtcgacggctcgcggctggcggtggtcggcaacagcgccggcggcaatatggcggcggtggtcagcctgatggccaaacagaaaggcataccggcgctgcgttgccagatcctgctgtggcccgtcacccgcgcccagtttgataccgattcctatcatcagtttgccgaaggccatttcctgacccgcaacatgatgaagtggttttgggacagctacgcgcccgataaggcgcagcgcaaagacatctacgcctcgccgctcaacgccacgccggaccagctgcgggggttgccgccggcgctggtgcaaaccgccgagctggacgtgctgcgcgatgagggcgaagcctacgcgcgtctgctcgatgccgccggcgtcgaggtcacctccacccgctataacgggctgatccacgactacggcctgttgatccgctcgcccac

SEQ ID NO: 59974 - DNA, 291 bp, Glycine max
  Peptide Sequence Number=SeqID_176752
atgtcgtgttgggcgtgcggctggctgagatcgacggttttcttgggcatggggactccttgtgcgcagaagagaaggggcggtcaggatcacagtgtagtcgctggcgcacaaagcaggagccgcggccagcgtggccctttttggccggtgggggctcgcgtcgctgccgcgatgcaccattctggcgcaccgctgcacccgctgggggcaaaaagtgtgatagcgagcaaatcgggcgaaattatttttgcgagcccgatcagaaatcctgaagtttttcgcaattga

SEQ ID NO: 59975 - DNA, 291 bp, Glycine max
  Peptide Sequence Number=SeqID_176753
atggaagccaatgcggttgcagttgccgctaccagggctgttgctaaggtatggtgggcaaagatttgggaagtacgagcggcccccattatgcgcaaattcaaaacaagcatgccttcccaccatatggcttgcatcccaactatacaccacccaatgtggcatacactcccaaggaggatgtcaataactccactcccacactcattgaaagccaacaacctcaatctgatcatgcacatgtctctcaacccatgggggagacacatggaatgccccaccacaatctag

SEQ ID NO: 59976 - DNA, 789 bp, Glycine max
  Peptide Sequence Number=SeqID_176754
atggaaggaggtggcctgatgggcgttcgtaggacagcgctcccgttcgaggggcagttcacgcagatcccgaatgagtggctccgtgacaagcgtctgagccggaaggcgcgcgggcttctcgcggagatcatgacgcaccgggtgggctggcacgtcacgacgcgcacgctgacgacgacggggccggagggtcgggactcggtgcgggccgcgctgagcgagctcgtcgaggcgggttacctgcgccggggacagagccgcggtgagggcgggacgttcggggagatcgagtacgagctttcggatcccaccgtggccgggaaatccgaccacggtgagaaaacccctggtcagaccgcggtcgggtttaccgtggccggttcagccgtggacggtaaacccgccactaagaacaccagagatcaagaagaccatctggaagaagaccaaacccctgtagtccccagaggggacgcgatggaggagggcttgtcggctctctggaatctgtggccgacgccgcggcgggggacgaccaagaaggcgtcttcgtcgttccggacggcggtgacggcgaacggtgggctgaagcacatcgacgtcatcctcgccgctgctcgtcgcgacgtcgcggtctggcggacgtgggcaccgggtgatgtgcagttcatcccgctcctgtcgacgtggctcaatcagggccgctgggaaccgcaagcggcggcattgccgaggggcacggcgcggacgtacgcgcagaagcagcaggacaacacgctctcgctc

SEQ ID NO: 59977 - DNA, 455 bp, Glycine max
  Peptide Sequence Number=SeqID_176755
gtaagtatgcacatcgctcaactgatttcttatgtcatctattgtttgccgggatcgcgcccgcaagacacctagtggacccagagaagtccaacagggttctggggtttccagctctgattacgagacttggtcaattctacagagtgcccatcgcccctaacaaggtcatcaggccccctattaatcgagatttcatcaagaagtactgtgccccccaggcaggcgcagggcgagacaccacatcaacctggggatggccggcagcaggcaatagacgcatcgccgccacctccagagcccctcagctcatctacaaaggctggagcattgcctacgacccgtggctgaccaacaggcgaccaagtccaaagccaaaggtaagcaaaagtactaggtccatgaccgacaagtcatcaggcgtccagctcaagacgttaaaaaaacactactag

SEQ ID NO: 59978 - DNA, 373 bp, Glycine max
  Peptide Sequence Number=SeqID_176756
atggccggcgtaaggtcgatcgacgctaccgcaattttgcctgaggattatgaaaacgctttgctcgtcggccgcgtctggtcgaaaagcgaaggcggcccctgccccgtcctcctcaaggatggcgtgctttatgacctcacgtctgtttctccaaccatgtcagagcttctggagaagaccgacctggtggagcagctcaaggacaccggtactttcgtcgccttaggcgcgctggacgcgtttctggacggctcagctggcgatctcctcgctcccaacgatattcaggccgtcaaggctgcaggtgtcaccttcgccgacagcatgctggaacgcgtgatcgaggaacaggccaagggcgatccgctgc

SEQ ID NO: 59979 - DNA, 420 bp, Glycine max
  Peptide Sequence Number=SeqID_176757
cctgcccaccctggaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 59980 - DNA, 429 bp, Glycine max
  Peptide Sequence Number=SeqID_176758
atgaccgaccgttctggtaccaagcaaagatttgccattgtccgcgaacagatagtcgccaaagccttcaacaactctcaatctctcttcgatgagatcgagtttccttctttcttttgctgccgagggtgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 59981 - DNA, 291 bp, Glycine max
  Peptide Sequence Number=SeqID_176759
atgaaattcggcaatcaagaattgctcgtacttacaaatgagtttcactacccagcagataaaatcaagaaggcccttgagccagaaaccatgaccataatcataaatgctgaccaaaccaaaacctgccacaaaacctacaaggactcagtcagcccgaatgtccttgaaccaataaacagcttgagcctagacaacttcaagaaaatacaaaaactactatttagggtacacaacaatcaaacccagatttcaagcctttacataggtgtgcatgcttatttcaactag

SEQ ID NO: 59982 - DNA, 459 bp, Glycine max
  Peptide Sequence Number=SeqID_176760
atggaggagtttgacgcacaggtggactggccaagagaccaaccttgttcctctagagggggtggggcctttacagcccaggagcctgtgactgaggagccaccagcaccagcaccatcatcagcagtagcagaggaggagaccactccaactcagaccccacaaccatctccaccacctgcacctgctcttgaggagattcagccatcaacactggatcttaatgaagaacagccacacgaggattgggctaagcttagcagttggactaagcgcatatccaccgctaagcgcagcttcaatgcgcttagcacaaaggagaatctggctgagcatcagcatcaaggccgcacgctaaccaggctaagcatgagactggcgctaagcctaatttcacttacccatgctaagcgcgagggtggtgctaagcgcaacgttgtgaattcagagcctatttaa

SEQ ID NO: 59983 - DNA, 297 bp, Glycine max
  Peptide Sequence Number=SeqID_176761
atgcccgcttactggatcgcccatgttaccgtgaaagatccgcagcaatatcagcattacatggatttggcgccccaggcgtttcgccagttcaacgcccgttttctcgcccgcggcgaacaggcgcaaacgctggaaggcccatcgtttgtgaaacatgtgctgatcgaattcgacgactacgccaccgcgttggcctgctaccattcgccggcctatcagttggcgaaacaacagcggcgctacgtggcggaagccatgattaccatcgtcgacggcttgccgcccgcccattaa

SEQ ID NO: 59984 - DNA, 312 bp, Glycine max
  Peptide Sequence Number=SeqID_176762
atggcggtgcaaatccagacttcctggtgcacatcgtcgggcaggccgacgtcgctgttgactttatcgtgtaaaacggcaacgctcaacgcggagagtgtggaatcggccggcggctatagcctgaaatttttatctgattgcacgcccgacgtcttgccgcaagagcctgtggcgtggcgtcctgctcccgatggcattgcgctgttggacaaggatgggctgaccgtacttttcttctctcaggaagacgatcattatcgcagccagatctgggctgaaactgggaagatcctgaagagaaataactag

SEQ ID NO: 59985 - DNA, 215 bp, Glycine max
  Peptide Sequence Number=SeqID_176763
atgagtttactgtttagcgggacgcagcttggcgagttgtcgctggaaaatcgcattgtgattgcaccaatgtgccaatactcagcggaagaaggtcaggcaacggcctggcaccgcattcatctcggccagctggcgctctccggcgcgggactgctgattatcgaggcgacggcggtggaagccattggtcgtatcacgccgggcgacctggg

SEQ ID NO: 59986 - DNA, 585 bp, Glycine max
  Peptide Sequence Number=SeqID_176764
atggatgaagcactactcgcaatgatgcgttcaaatgggcgcaacagggcctgggcagaatcgatggtcaatcttgaagcccgtaatctgattgaaacggctaaccgtgaagccgggtttcacatcagggatggacttacgcgactccagtttgtgcaggaaataagggatgtgattgaagagcagttctcgattgcccggcgcgcaaagtctgatgaagagtgcatggcctgcgtaaaaaatctcagggcagagaccgaaaatcttgcagagcaggggcaaatgctgcgcatgaatactgcgaaactttacgccaaagtggagttcgtccgggaaaataacaaaattgtcggttatgtgatttctgctgttcatattgtggtatcaggtgcagcgctgtttggcggaatgatcatgatgtcgacaatgactcctttgggaatacttgccggggcgatactttttgttgatggtattaatgggatcacaaaagaggccagccatcttcgttatggcgatcaatccaaatcagagggaatattcgcagacagttctatggaggctgctaattaccttgagtgctag

SEQ ID NO: 59987 - DNA, 147 bp, Glycine max
  Peptide Sequence Number=SeqID_176765
atgaatctggggatcccacggtcatgtggctccgcatgccaccggtctcttgggacacgcatttcgtttctaaacgaccatttagaggaaacaccgggtccaacaaagataggagaaaatcactcaaagtgtatcaatctcacacag

SEQ ID NO: 59988 - DNA, 369 bp, Glycine max
  Peptide Sequence Number=SeqID_176766
atgaagaatttgttcaacaagaaggtacgcttgcgcaagttccatgagggggaccttgtgcggaaaaagatgtcccacgctgttaaagataatcgagggaagtgggccccgaactacgaggggcctttcgttgtgaaaaggtctttttccggaggggccctggtgcttaccaacatggatggcgaggagctaccttcacccgtgaactctgatgttggattcctgcctgctgtaattttctcatcacggtcttctaaaaagaagagaatgggaggacagaatcatcttaggtcgtggtcagatgtcgggactaagctgaaggcagaaaccaatcaaggtatgccacccgccaggggtttccagcattga

SEQ ID NO: 59989 - DNA, 240 bp, Glycine max
  Peptide Sequence Number=SeqID_176767
atggcttctatggatatctctgctatggtcaactctaagatctttccatgcaatctagcaatgcgggggtccgaggaatttgtccccttcttagatacaacgtctaggggtagcaaagtgcccccacgtacgtttttaagaaggcgacacggaccctccgttggtttgtttacagaagggatcaagacagaacccatatgcgatgcctatgcaaaagacacaatgcgggaatgtacatag

SEQ ID NO: 59990 - DNA, 543 bp, Glycine max
  Peptide Sequence Number=SeqID_176768
atgatcacaacgctgatgctgttggcgatggcgcttgtcctgatcgtactgccatgttttagcgatcacgggggggaatatgacggctcggatgctgaagccgaaaatcaaatccagcctgctgtttacgctccagggctccattggcgcatcgatgattttctatattttgggctacacgaaacggcagacagcgccgtgatgaccgggcttgacaggcttagctaccagagccactgggctcacgttgcgccggaacgcaagtttctgctctggctggtgctgatgatgctggcgtttgtgctgccgccgctgggacaggggatcgtagtggcgttgacggcgggactgacctgctggctgctgcgtatgagcttctggcgctggtgccgctggatggcgttgccgtttggctttatgatggtcggggtactgacgatcctctttagcgtcacccgagacccgcacacatatggtggtcagcgtccccgtggggcactactggctggggatcaccgtttccgggatgaccgccgccagtga

SEQ ID NO: 59991 - DNA, 451 bp, Glycine max
  Peptide Sequence Number=SeqID_176769
ccatacctccaagttgttgatcggaattggatgtgcggtaggttgcccgaagggctatctgatccgatcaactgcgtaagccgtagcgcgctagcgcgcgtactcttcctctatgagcgagactccatccaaatctgccactcgttgggcgacgccctcttttctatgaacaccccaccactgaatgatgaactttgccagtcttcgcctccgacccgaccaggagagacacagagtcaagccaagcccttacccgccagaatggattcatatctccttcgtctggataaggtttttgcttcgagcagctctcgggcattgattgaggaagtagcccaaccttttttcatctacgcaaagaggaattacttcttattttattcgaccggaaatggtgcatctagatcgattcctaaggctggtaatgccgaatcaaggataaggcaataca

SEQ ID NO: 59992 - DNA, 198 bp, Glycine max
  Peptide Sequence Number=SeqID_176770
atggaaagatcagagaggaaaaccttcaatgataagaaagcaaataaagcttatgtcacttgggaagataacaatatggattcatccgaagaagaggatcttttatcaaaactgacattcaaggacctaagaaagtttgggtacctaagtcataaacatgattatataggattctttgaagaagagttggtacattga

SEQ ID NO: 59993 - DNA, 591 bp, Glycine max
  Peptide Sequence Number=SeqID_176771
cctcaccacggatatgccgctgaaggccaggcgttttgcggcatacccctgccaaacactttagggggccttcagtatcatccacaaccacaacccttgcattttgcgatgggaagagtccctcctactatggtggaaagggagaaatttgatcatatagaagaaaggctaaaggtcattgaaggaggcataaattatggctttgctgacatggcagagttgtgcctagtgctcgacgtgatcattcctccgaagttcaaggtgtcgaatttcaataagtacaaggggactacttgccacaagaatcacctgaacatgtactgcaggaaaatgggagcatatgtgaaaaatgaaaaattattgatgcatttcttccaggaatgtcttactggggcagccgtcacctggtatactaatctggaaccttcccgagtccattcttggaaagacctaatggttgccttcattaggcagtatcagtacaattttgatatggctctgaatagaatgcaacaacaaaacatgtgtaagaagcagcatgaatatttcaaagaatatgccaaaggtcgagggatctggcagctcaagtag

SEQ ID NO: 59994 - DNA, 285 bp, Glycine max
  Peptide Sequence Number=SeqID_176772
atggctccacctaaagaaattctgaccctcatttaccacagtagtcacattgtagacgatccagttcaaggatcgacataccaatctcaactattcgacaatgatgatcttagaggcgcgatggaaacaattatccagaatccacaattgaattctgccgaattctatgttgttactgagcttattcctcaaccacaaccatcgtctccacaaccctcatgtccacaactacaactaccgcctccacaacagttaccgtacaacaacatagacctcaataatcca

SEQ ID NO: 59995 - DNA, 372 bp, Glycine max
  Peptide Sequence Number=SeqID_176773
atggcgccgactaggcaccctttggacccggataagtccaacagggccctgggatttcccgcattgatcacaggactttgtcagtcgttcggagtccccgtcgcacctagcaaggcgaccaaccaccgggcgcacgtgcagacccatgactgtctttaccagctgagcctcagcctgcagagccagggttttacttcttttccatgccctactctggatcagttcagggcagaggtcgcatggcccggagattggcctgaggcccaggcaggggaggcacccgcagaggctcccggcgaggcagatgaggctcgcgaggacgaggagatgaccgatttgcttgatttcttgggagggagcggagccacatga

SEQ ID NO: 59996 - DNA, 298 bp, Glycine max
  Peptide Sequence Number=SeqID_176774
gaaggataaattctctactaagaggaaatccaagcttagtcctagaggtgatggaccttttcaggtcttggagaggatcaataacaatgcctataggttagacctaccagaagagtatggagtcaacaccgcttttaacatttctgatttaatttcttttgcacgtggagttgatactgaggaggaggaaccaacagatttgaggtcaaatcctcttcaagggggaggggatgatgcaatcctccctaggaagggaccagtcaccaaagacatgagcaagaggctccaagaggattag

SEQ ID NO: 59997 - DNA, 316 bp, Glycine max
  Peptide Sequence Number=SeqID_176775
caaaataggggaggagcttgtcacccagctcgcccaggcgagcaaggttgcttcctccagaagtaacagccttctggaggaaggatctggaaggcccaagtgggccagattgctatttgtacccccttttttactaaatgcacccccttctatttttttgcgaatgcgagatgcaagaaggccattgaatcaagaggagggattcgcaagggcaatggtagcgttaaattggagagggtggtggcgatgtcacaatggcaaggtagtggcgagagtggttgactatgacgatggtgtcataagggtgtttaggtga

SEQ ID NO: 59998 - DNA, 873 bp, Glycine max
  Peptide Sequence Number=SeqID_176776
atgaaagaggttggaagtccaaatttggctgattgtttcccagtgttgaaggtggttgaccctcatggaatcagaaggcgcacggggagttacttttggaagttgttgaccatattcaagggcttggttgacaaaaggttgaagctaaggaatgaggatggttactgcaccaaaaatgacatgttagatgccattctcaacaatgctgaagagaacagccaggagatgtacagagataagattgaacgtttgtcattggacttgtttgtggcaggaacagatacagtaacatccacagtagaatgggcaatggctgagttactccacaacccaaacataatgtcaaaagcaaaggcagagctagagaacactattggcaaaggcaacctggtggaagcatcagacattgcaagactcccttacttgcaagcaatagtgaaagagaccttcaggctgcacccagcagttccacttttgcctagaaaggctgaagtggatttggagatgcatggctacactgtcccaaagggtgcacaagtgttggttaatatgtgggccattggtagggacccaaagttgtgggacaacaaccctagtttgttttcaccagagaggtttttggggtcagaaattgactttagaggaaggagttttgagctgaccccatttggtgctggtaggaggatgtgtcctggcttgcccttggccataagattgttgttcttgatgttgggtttgctcatcaattcctttgattggatgcttgaggatggaattaaacctgaggatatgaatatggatgaaaaatttggacttaccttggggaaggctcaacctgtgctagctgttccaatattcaaaccaagcaattag

SEQ ID NO: 59999 - DNA, 8823 bp, Glycine max
  Peptide Sequence Number=SeqID_176777
atggcgtcgtctccggaatcgatttttctggaagacttcgggcagacggttgatctgacgcggcgcatccgcgaggttctgctgaactacccggagggaaccaccgtcctgaaagagctcatacagaacgccgacgacgccggcgccaccaccgtctcgctctgcctcgaccgccgctctcacgccgccggctcacttctctccgattccctcgcgcagtggcaggggcccgcgctgctcgccttcaacgacgccgtcttcaccgaggaggatttcgtcagcatctccaagatcggcgggagcaccaagcacggtcaggcctccaagaccggtcgcttcggttctctagttgaactgttattaggtatgggttttgtggttgcatttactggttcaatgctaggatttaggagtgaagttcttgtggtagttgtaactggaaaatggcgagggaaggttggcttcaactcagtgtaccatttgacagatcttccctcttttgtgagtggcaaatatgttgtattgtttgaccctcagggtgtttatcttccaagagtttctgcagcaaatcctgggaagcggattgatttcactggttcatctgccctctccttctacagggatcagttttccccatattgtgcttttggttgtgacatgcaaagtcctttttctgggactttgttccgttttcctttaaggaatgcttatcaggcagccacaagtaagctctcaaggcaagcatattcaccagaagatatttcctccatgtttgttcagctctacgaagaaggggttttgacgcttctctttctaaagagtgtgctgtgtattgaaatgtatttgtgggatgctggagaacctgaaccaaagaaaattcattcatgttctgtcagttcagtaaccgatgatacagtttggcatcgacaggcgctgctcagattgtctaagagtttaaataccactgctgaagtggatgcatttccattggacttcttaatagagagaataaatggagatgaatctgaaaggcaaaaagagagattttatgtggtgcaaaccatggcctcagcatctagtaggattggttcttttgcttcttctgcatcaaaagaatatgacattcacttgctgccgtgggcatcaattgcggcatgcatttctgataattctcagaataataatattcttaggactggtcaggcattctgttttcttccattacctgtcagaactggccttagtgtacaagtcaatggattctttgaggtctcatcaaatcgtcgtggcatctggtatggggatgacatggacagaagtggaaaagttcgttctacctggaataggcttcttctggaagatcttgtagctccagcttttatgcatatgctacttggtataaaagaattgctagggccaacaaacatttactattctttatggcctattggttcttttgaagagccatggaatactttggttcaacaaatatacaaaaacattggtaatgctccagttatgtattcaaatttcaatggaggaagatgggtatcaccaagtgaagcctttcttcatgatgaaaaattcaccaaaagtaaagacctcggtttggctctgatgcaactgggaatgccagttgtgcatttgcctaattcattgtttgacatgcttttacaatatagttccagcaaggtggttacttctggtacagacttggttgatgatgacgttggtaaagaggcttatgatctacctttacttcctttagcaaatggcaattttgcatctttttcagaagcatcaaaaggagtctcttgtttcatttgtgatgaattagaatataagctgatgcggccagtttctgatagagtaattgatcagaacattcctctcaatatattgagcagactctctggtattgcgatgtcctcaaagaccaatgttattctttgtaatattcaccattttgctcagctattccctgcatttttcccagctgactggaaatatagaagtaaagtgttctgggatcctgaatcttgtcaaaagccaacatcatcatggtttctgttattctggcaatatcttggaaagcagactgaaatattatcactattttgtgattggccaatttttccttccacatctgggcatctgttaagaccttccagacaattgaaaatgatcaatggaagcaatctctctgatacagtacaggatatccttgtaaaagttggatgtaatatattgaatccaaaatatgtagttgaacatccggatatatctaattatgttcgtgatggcagtgcaggtggtgttttggaatcaatatttaatgcagtttcaggtcctgatgttatgcatgcttcatttgatagtctagtaactgaagaacggaatgagctccggagatttcttcttgaccctaaatggtatgttggacgctctatggatgaatttagcataaggttttgcaagagattacctatatttcgggtctatggtagagactctgctcaagattaccaattctctgacttagaaaatcctcgaaagtacttaccaccattggatgtgccggagattattctggtgggcattgagttcatggtgaaatcctcaaatatagaaggggatgttttgtcaagatattatggagttgagagaatgggaaaagcacagttttaccagcaacatgtttttaatagagttggtgatttgcaagctgatgttcgtgatagcataatgttatcagttctacaaaatttgccacttttgtctcttgaagacatatctatcagggactcgttgagaaatttgaaattcatcccgacgctcactggtgctcttaagtgtccttcagttttatatgatcctagtaatgaagaactatatgcattactagaagattcagatagttttcctgctggtgcttttcgagaatctgaaatacttaatattctgcaaggcctgggacttagaacttctgtctctcccgacactgttttagaatgtgctcgatgcatagagcgtttgatgcgtgaggatcaacaaaaggcatatttaagagggagagtgcttttctcttaccttgaagctaatgcattgaagtggcttcctgaccaagttatggataataaaggagcagttaaccgaatgatgtcacgagcgacgactgcttttaggtcttgcaactcaaaatctgatcttgaaaaattctggaatgacctacggctggtttcctggtgcccagttttagtctctactccttttcagtcattaccatggccagtggtgtcatcaatggttgctcctccaaaacttgtaaggccaccgaaggatttgtggcttgtctcagctagcatgcggatactggatggtgaatgctcttctacagccttattgtatggcctgggatggatgtctccaccaggaggaggtgtaattgctgcacagttactggagcttggaaaaaacaatgagattgtgtctgatcaagttcttaggcaggaattagccttggcaatgccaaggatatactcaatactgactggaatgatagcttcagatgagattgagattgtaaaagctgttcttgaaggatgtcgttggatttgggtgggggatggatttgcaacttctgatgaggttgtacttgatggccctcttcatttggctccatacatccgtgttatcccagttgacttggcagttttcaaaaaaatgtttctagaacttggtatccgtgaattcttgcaacctgctgattatgctaatattctttgtaggatggcagttagaaaaggatcatcccctcttgacacacaggagattagggctgccacgctaatagtgcatcatctagctgaagtttaccatcatgaacataaagtccagctctatctgccagatgtgtcaggtagattatttcttgctggtgacttggtttataatgatgccccctggttgctgggatcagatgatcctaaaggctcatttggcaatgcaccaactgtggctttgaatgcaaaaagaacagttcaaaaatttgtgcacggaaacatttctaatgatgtagcagaaaagctgggagtctgttctcttcgccggatgttgctggctgagagttcagattcaatgaattttagcctttctggagctgctgaggcttttggacagcacgaggctttgactacaaggcttaagcatatacttgaaatgtatgctgatggacctggttctctatttgagatggtacaaaatgcagaagatgcaggagcttctgaagtaatatttctcttggataaatctcactatgggacttcttctattctttctcctgaaatggctgattggcaaggtcctgctctgtactgttacaatgactcagtttttagtccccaagatctttatgcaatttctcgtattggtcaagaaagtaaacttgagaaggcttttgcaattggaagatttggattaggatttaattgcgtctatcactttacagacatccctatgtttgtttctggagaaaatgttgtaatgtttgaccctcatgccagtaatttgcctgggatttctccttcacaccctggtttacgaattaagtttgtgggacgacagattttggagcaatttcctgaccaattttctccattgctacattttggctgtgatttgcaacacccttttcccggtacgctattccgattccctcttagaactgcaggtgttgcctcccggagccaaattaaaaaggaagcctatacacctgaagatgtcagatctctctttgctgctttttctgaggttgtttctgaaacattacttttcctgcgtaatgtgaaatctatctctatttttgtgaaggaaggaacagggcatgaaatgcacctactgcaccgtgtgcgtagaacctgtattggtgagcctgaatttggatccactgaagcccaggatgtgttcaattttttcaaagaaagtagacatgtcggaatgaatagagttcagtttctgaagaaactaagcctatccattggcagagatttgccttataaatgccagaagatgctaattacagagcaaagcacatctagctgtaattcacactattggataaccacagaatgtttaggtgatgggaatgctcaaaagagaacatctgaaacagccaatagtaactattacaattttgttccttgggcatgtgttgctgcatatttgaattctgtcaagcttgatggggacctggttgaaagttcagagttggaggatgattgcatggtttctcctgatctgtttaaaagtgttagtttgcctacacatccactggaaaattttgatggtcgtgcattctgctttttacctttaccaatcagtactggtcttcctgctcatataaatgcgtacttcgaattatcatcaaatcgcagggatatctggtttggttctgatatggctggaggtggaagaaaacgctcagactggaatatttatctccttgaaactgttgttgcccctgcatatggtcatttgcttgagaagatagcatcagagattggcccttgcaatttgttcttctcattatggccaaaatcattagggtcagaaccttgggcatcagcagtacggaaactctatcaatttgttgctgaatttaatttccgtgtattatatacggaagctagaggagctgagcttataaaagcattgtccggggcttctctaccagtcattacacttccacagtcacttttagaaaggtttatggaaatctgtccatcattgcattttctgacacctaagctgttaaggactttgttaatcaggaggaagcgtgaattcaaggacagagatgcaatgattctgactcttgaatattgcttacatgacttgcaagaatccatgcagtttgataccctatgtggcttgcctttgttaccagtggcagatggttcctttacatctgttgatatgaagggagttggagaaagagtttacattgcacgaggtgatgaatatggtcttctgaaagattccattcctcatcaacttgttgattgtgctattccagaagaagttcatagaaaactatgttacattgctcaaacagatggtacgaacatttctttcttgtcatgccagttgcttgagaaacttcttgtgaaattacttcctgtagagtggcaacatgctcgacaagtaagttggactcctggtattcatggccaaccaagtgtagaatggttgcaactactgtggaactatctgaaatcatattgtgatgatcttttgatcttttctaagtggcctatattgcctgttggtgatgactgcctgatgcagttaacacaaaatttgaatgtgataaggaatgatggatggagtgagaagatgtcttctttgttattgaaggttggatgcttattcttgagacatgacctgttattagatcaccctaaattggaatactttgtgcagtcggcaacagcaagaggtgcattaaatgtgtttctggctattgctgggaaaccacagaagattgaggggatcttaacagacgtatctgaaggggagcttcatgaactcagaagttttattctccagtcaaaatggttctctgaagagcaaattgatgacaaacatattgaaatcatcaaacagcttccaatatttgagtcgtacaaaagcagaaaactagtaagtttgagtaatcctattaaatggcttggtcctactggtgtttgtgaagatcttttaaatgataaattcataagaactgaatcggaaatggagcgggtcattatgaaaaggtatttagggatgaaagaaccaaccaaagtggaattctacagagatcacattttcaatcacatttcagagttccttccgaagcaaaaagttgtttcagccattctgcatgacgtacagcatttaattaaagaggatctctctctcaagtcttcattctcctctgcaccatttgttctggcaggcaatggatcttggcaacaaccatctaggctttatgatcctcgggttcctcacctcaaaaagatgctgcatgggaatgttttctttccttctgacaaattcttagatcctgaaattttggattctttagtttgccttggacttaggacaactctgggatttactggtttgcttgattgtgctagatcagtcagcctcttgcatgattctggggacactgttgcctccaagcatggtggacagttactggatcttttagatgcactagcatttaagctctcaaataaaggagaaagtaataatgatgatcaacagggtggtgtggctgtgggaagtagcagcataatggatgatgcttttgtatatgatggctttcctaaagatgagacctccctaactgatattgattcatttttaagcagctcaacttgtgatatggtagaagaagaattttggtctgaattgaagttaatctcttggtgtccagtaatttctgatccacctgttaggggacttccatggttaaaatccaataaccaagtagtagcatcccccactagtgtgaggcctaaatcacagatgtggatggtatcttcttcaatgttcattttagacggtgaatgtgacacaacgtatctacaaactaaagttgggtggatggattgcccaaatgttgatgttttaacaagacagttatttgagctatctaagtcctatcaacagcataagatacattcactgctggatcctggttttgatgctcagttgcaaaaggaaataccttgcctttattcaaaattgcaagaatacattaatactgatgatttcaataaactgaaaacagggttggatggtgtttcatgggtttggattggtgatgattttgtatcaccaaatgcacttgcatttgattcacctgtaaaatttacgccttatttgtatgttgttccatctgaactgtcagagtataaagatttgttgataaagttaggtgttagattgagttttggtatttcagactatcttcatgtattacaaaggttgcagaatgatgtgcatgggattcctctgtctactgatcagttaaattttgtccatcgtgtccttgaagccatagcagaatgttgcctggagaagccactctttgagccttttgataatcccttgttgattcctaatgattttggagttctgatgcaagcaggtgatcttgtatataatgatgcgccttggttggaaaacagctctcttattgggagacattttgtgcatccaattataagcaatgatttggcagacaagctgggagttcagtcagttcgatgcctctctttagtcggtgatgatttgaccaaagatctgccatgcatggactacaataaagtaaatgaacttttggcccagtatggagacagtgagtttttactgtttgaccttcttgagttggcagattgctgcaaagccaagagattacacctgatttatgataagagggaacatcctcgccaatccttgctgcagcacaatttagttattaatgtgcttgatgcttcttgtaatcttgtttatgctcatcatttgagaagttcatggttgccccccacttatatcctctatattggccttatctctagccaatgtgggacttgggtttttcccaatacaccctctcacgcccaacacatttgggcttggtgcgtggataacatgttgggtgatcctttgaatgaatctaggataggctttggtaccatcttagcttttaggaatgcttatttcatctgtgaatgtgggtttggatgtaactcaactccaaaagctagctcatag

SEQ ID NO: 60000 - DNA, 255 bp, Glycine max
  Peptide Sequence Number=SeqID_176778
atggggttaagtacctcgaggatgtcaagtgaagcttgcatgccaccaaacaatggtccccggacgaaattaggctataaacaaaccatgttgggattatacactcatttctctcgaaaaatgattgaaaatcacgtgaacatggttgttgaagtattggtaatcaaaatttttattcttgcgaacatagggtcgcaccaagcacatgcttttaagaagaggttttcatcaagtcaaggtcaagtatggaagtaa

SEQ ID NO: 60001 - DNA, 245 bp, Glycine max
  Peptide Sequence Number=SeqID_176779
gggaaaagagggaggtggttgccacccagcttgcccaggcgagctgggttgcttccaccagaaggcaccgccttttgttggaaccccctggaaggcccaaaatgtcgcaaaactttatggattacgcaacaatgccctttttgacttttgaaatgttgcggaactttacggattgcgcaacaatgcttgctttcgacttccggcatgtcgcggaacttcacggattgcctaatgatggttgttaa

SEQ ID NO: 60002 - DNA, 192 bp, Glycine max
  Peptide Sequence Number=SeqID_176780
atgacgtgtgattgtgagatgataataataaacaacaaaataagtgtgggatactggaagagtagcaaagacggggaaagagaaaacggcgtctttactgtcatggacgagaaaccactccaggagcaggattatggccactctgtcaatccgactgcttcaccaaacctagacgtgacagtcttggtatag

SEQ ID NO: 60003 - DNA, 490 bp, Glycine max
  Peptide Sequence Number=SeqID_176781
gtcttctccaagtagattggctacttttaagaggcgtgcagaggaagttagtgtaaattcggaggcaatgctaacacttgatgtgccaacttggtggaactccacctatttgatgttagatgttgttgaaaattttgagcaaactttcaatcattttgagtatgttgaagctgcatatgtgctcactcttctaactagtgaagaaggatgtcctaaagagatggattggaaacttgctcgtgtgtttgaactttattcacgagcaagggagcaagaagaggagatcctctccctccgtgaacagattggcattgcctgtatgaaggaactgcagctgttgaatgagaaatgcaaactagagaggcaattctctgaactaagaatggcagttgatgagaagcaaaatgaagccatctcatccgcttctaatgatttggttcaaagaaaaggttatcttgaagaaaatttaaaacttgctcatgatttgaaa

SEQ ID NO: 60004 - DNA, 668 bp, Glycine max
  Peptide Sequence Number=SeqID_176782
atggcgtctcgtgctcggctggtggcggtgaatcgggtggtgaaggctggggcgctcgacgaggcgggtgtcgacgcggcgatcgtcgctcaggcccgcgatttggcgcggatgctcgacaagttcgatgacgcgaagccgccgacgtcgccccctctgaacatgctccgtctgtacgactcggcgctgacgaagctgcagcgcgcggtcgaacgcaacctctctgtgaagcgcggtcgaaagtcggtcgaaccggaggcgagtgacgccccggatcccgattcgccgccgtcgctgaagatcgtggaggagtcgccccttgagaagctccggcgtaaaaagcaggcccgcgcgacgtacgggaagcacatcggttcgacggagccgaggatcttcacgaagccgcttcgggagttgacgccggagacgtcgcacgggttctccgtgatcgaattcgcgctcgaggtcctcggtgtccggctgtacccgtggcagagggcgctcctcatccgcgcgctcgagctcaacgaggacgggacgtaccgcttccggaagatcttcgtcatcgtcggtcgccagaacgggaagacgacgctgctcacggtgctcgcgctctggtggctgttcatggatgcggacagcttccccgagcacctcccggcgaatga

SEQ ID NO: 60005 - DNA, 717 bp, Glycine max
  Peptide Sequence Number=SeqID_176783
atggaggattcgaagttcacattttttggtagtcttcatccccagaggtttctttacatgcctgatagaatgggagagttaacttctgttctagaaagccgtgctgataatggtaatcacgttgttgaaagtccaggttctggaaatttgacaagtcacactcataatgatttcatgtttcagcataacttcccccagcaaaatcttattgggaatgaacaaagccatcaaccaatgagcaatgttgcaggatatatgcacccagctcttcattctgatgtaaactggggattaaaaacattcaactatcagcagacttctaacgctgatagggggatatcttctttcccacacgcatcaattgataaaattggagtgcaggacaaaaacatggaaagaaattttggcaatggcaacttttatcaacatccacctgatttggatgagactgcttcctctgtttctgaggacggccctggcattgagaattttcaagtttctggtgatgctattcctggagaaaagcttcttggatgtggatatccagtccgtggaacttctctttgtatgtttcagtgggttcggcatcttgaggatggcactagacaatacattgaaggagctacaaatccagagtatgttgttacagctgatgatgttgataaattgatagcagttgaatgtattccaatggatgataaaggccgtcaggtttga

SEQ ID NO: 60006 - DNA, 1173 bp, Glycine max
  Peptide Sequence Number=SeqID_176784
atgactctcgctgatgatgcattaggcgtccgtgcgtcgctggaaaagcttaaaaaggtcgctggaaagagacgaagcacgacgtcaaacagtactcaaacagggttgcctgaagtagagaaggatggcgagagcgatcagcggaaagaggctcttctaatcggagggtcacaccagcgagaagtcagcacagtggcagtgattccaatgaaatccttctacaaggagatgttggacctgatggcttttcagtttcctagcctcaaattctccccagctgtctcttcttcagctgttgttgtttctcctttgtatcggattaattgcttgccttcagctcctcttaattttgacacaccttatcatgtctcgtttcacacttttcctgattataactttcttaagtccactttgcttcagttcgggttcactgacagaaaatgtgatccttctctgttcacctacagtactaaatctgctactgtgtacattctggtgtatgtggatgacattatcatcactggtagttctccttctatggatggttctttttacaggtccattgttgcagctttacaatatgtggcaatgactcatcccaaggttcccaagaaggtggtggataagctagtatgcttacagagaaaattcctatggggaggagttgcagatcacaacaagatagcctgggtcaaatgggacacagtgtgtcttccaaaggacaaaggggggctggggataaaggatgtaaacactttcaatcttgcattacttgcaaaatggaagtggcaattattccaacatcaagggcagttgtgggctagggtattggaatccaaatacggtggatggaggggtctaaatgaggcacctagaactagcagagaatccatattgtggagggatctaatgatggtgacccatcattcggagcatgggtgggaatggcagttcacttgggggagaccactgttcgataatgagatagccatgactgtttcattcctaaaagatgtggaaagcaagcaaattcaatcacaaaggccagatgagtgggtgtggatggcagattctagcggacacttctcagcaaaaagtgcctacaatgtcatgaggggggattcatcagagggggcagaagatatagtttttgaagaattgtggaagataaag

SEQ ID NO: 60007 - DNA, 324 bp, Glycine max
  Peptide Sequence Number=SeqID_176785
atggccccagactgcagtggtaggtgtgcgaggaagggacgtcgccaaaggtggaagcatgctggcaaaggcaccgtcaggcaccttcacgcgtccgagaatagtgatgcgaacgatagttggacagcagcggctgtggccgaaaaattccccggaaaagaaggaaaatctgtcgggaatgatattgcgaggataaaggtccaccggaaaccggaaaagtcacaacagctgatggtggctggaaatgtcgtcggaaaaggagaaatggatcgtcggaaaaggagaaatggatcgtcgaaaagcgaaaccaggttgctggaataa

SEQ ID NO: 60008 - DNA, 987 bp, Glycine max
  Peptide Sequence Number=SeqID_176786
atgggcatgtcggtgtcggacgtgtacagcaccatccagctgatgctggccccggtgtacgtcaatgacttcttctatgaaggccgcatcaagcgcgtgaccatgcaggccgatggcccgtaccgcaccggccaggagtcgctgaagagcttctacagcccgtccagcctcaccaccaatgccgatggcaccaacgcgatgatcccgctcaacacggtggtcaagtccgaatgggtgtcggcaccgccgtcgctgagccgctacaacggctactcggcgatcaacatcgtcggttcgcaggcaccgggcaccagctcgggtgaagcgatgcagaccatggaggcgatcgtcaacgacgacctgccggccggtttcggctacgactggtccggcatgtcctaccaggaaatcctggccggcaacgcggcgacgctgctgctggtgctgtcgatcgtagtggtgttcctgtgcctggccgcgttgtatgaaagctggtcgatcccggtggcggtgctgctggtagtgccgctgggcgtgctcggcgccctcggcctgtccatgctgcgtggcctgccgaacgacctgttcttcaagatcggcctgatcaccgtgatcggcctggcggcgaagaacgcgatcctgatcgtcgagttcgcggtggagcagcgcgcagctggcaagaccctgcgtgatgccaccatcgaggcggcacgcctgcgtttccgaccgatcctgatgacctcgttcgcgttcatcatgggcgtgatcccgatggcgatctccaccggcgccggcgccaactcccgccacgccatcggtaccggcgtgatcggcggcatgctgttcgccaccctgctcggcctgttgatgatcccggtgttcttcgtggtcgtgcgccgcatgctgggcgacaagctggatgaaccgtccaaggagttcatggaacgccagcgtgatgcggatgctgcacaccgcccggatcgttga

SEQ ID NO: 60009 - DNA, 285 bp, Glycine max
  Peptide Sequence Number=SeqID_176787
atgacagatatatctcctgttcagggggaactggtgaagctttttgctaatgatcagaacaaaataacgtgtgactcagaaatgaaacatgagattggcacaaatctgtctaaaggagaagccacattcagtgttctacttttgagggattcttccgagaattgggaacaagcaactctattcttaagacgatcaggatatcaaattaagattaatggtactgaagctacagtagttgatgagaaattctcaaaggaattatcggtatgttattcaaacttctag

SEQ ID NO: 60010 - DNA, 1479 bp, Glycine max
  Peptide Sequence Number=SeqID_176788
atggctgagaatacacgtttaaatgatttacaagcggagattaaaggacaagttgatgctctgaaaaggatgatggatctgttggagcttcgtgattgtgaacagagggctcatatgcaatcggttcaagctgaagctcaaaatcatatggataagatacaaaaatccttggatctcttgctaaattcaccagtgcaatctcattcccatggtggttcagcatcaaactcttccttttgcggagctattccgttatctatagctcttatggttaaggacatttcccttggatttcctcattttgacgggcattcttcagtgttggaatggatctttaaggccgaaaaattctttaactaccatcgcacacctgatgctgatagggtcgaaattgcaacgatgcattttgagaaggaggtagtcccttggtttcaagtgttacagaggatgtcagcgattcattcttggacagaattgaccaaggcgttggaatcacaatttggtccatctcccttcgattgccctatggcagacctctttaagttgcaacaaacggttacggtttctgattactatctcaaatttatgtctctagcaaatcgatcttctggtcttcaagatgatgctctgctgaattgtttttggagtggtttgcatactgaaattagaagagacgtggttgcccaagctcctacttctttattgagggttgtcgctttggctaagttgtatgaagaaagatattttccagtgtctaaaactagttctatacctgttcgatgttattctccaatttcgtcgtcatcactgtctgttaatcagaaccaaaataagagcaatgcaaaaaatgcattaccactgttattacctaccccaaatgtgcaaccattgaaaaatgtgaatgttaagaaaatgagtccagcggagatgcaaattcgtagagaaaagggtttgcaatacatgttcttgcaattggatgagacattgatcgatacatccgttgatccgcctccagagccggatccaccagtgttgcttgatgaaccggttatagatgatcaccatttatcattaaatgcgttaaaagggggaaaagggataggaactataagatttctagcttacgttgataagctaccagtgactgttttgattgatggagatagctcagataatttcctacatccgcgtattgcaaagtttttgaaacttccggtggaaccagctccaatgtttaaagtaatggtgggaagtggcaactatatggcaacagaaggtttggtacagaatgtggtggtgcaggcccaaggaaatacgcttcaattaccagattatcttcttccaatttctggagtagatttgattttaggggctcattggttgaaaacaattggaccgcatgtggctgactatgaatccttgaatctgaaatttttgcatgatggtaaatttgttacttttcaaggtgatgtggattag

SEQ ID NO: 60011 - DNA, 168 bp, Glycine max
  Peptide Sequence Number=SeqID_176789
atgcccttcatgatgcctgacttgcatttagcatccatggacgagtcatcagagtttggaaactacggtttccacctaaaagatgttatgagatcatacaaaaaatgtttctctaacaaaacattttggacacaggcattggatgacaaaaggaaagggagagcatga

SEQ ID NO: 60012 - DNA, 1320 bp, Glycine max
  Peptide Sequence Number=SeqID_176790
atggtgtggtcagaactttgcaataaatggttgaggaaggtagctatttgtattcaaaccgatgataagttgaaagctttgtatgagcagtgtgtggcaaataaggggcactttcaggaatatgcaataaaagatggccttttgttctggaagaggcgtgtttgtttaccatttaaggaagatctcatcaaggaagtgctaaatgagtttcattcatcaaaagtaggtgggcatgtaggagtatcaaagactatggcccgaatagcttctcaatttttctggcctggtatgcgacaaagcattcgacgatttgtgcgtgtgtgtcaaatttgtcaacaagcaaaggtggaacaagcattaccagtagggttacttcagccgttaccaataccgcagcatgtgtgggacgatgtttccatggattttatcacaaactttccaccttcacatgttctttttggcaacacttgttcaaagctcaagaacaacacttgccatgagctcttcatatcacccgtagtccgatggacaaacggagtattgccatgggcccagtattggtataattcatctttgggtgttgctaggtgcacccagcattattgctggtgcactcatcacttaagaaaccttacggatcaacttgatccgtacgatttacgaatcaccctcacacacacccatcacaaatgcgaaaaaagtgcagaggcagttttgcaacactcttcatcttttcatcaaagcattggtatgtctccattcaaagctttgtatggcaaggatccacctgctgtcatgtgttatgaaatcagtcccacagatctggtgtcagttcaagaacagctacgtgaacgtgatgcgattttgcaacaattgaaattgaatttgctgaaggcacaacaatatatgaaaacacaagctgacaaaagaagaagggacatacagtttgaagttggagaattggtgttggtcaaactacaaccttatagaaaacactcaattgctttaaggaaaacacagaagctgagcatgcgctattttggaccctttgaggttttggaaaaaattggaaacgtggcttataaattgaaactaccggatactgctaggattcatccggttttccacatttccttacttaaaaaatttgtaggtagtccttcacaacaatttatacctttgcctttgacaactactgaatgtggtccttcagttcaacctttaaagattttggatcaccataccattatgagaaatgcaagtctagttcaacaagtgttggtccaatggaattcacaggatgtgtcagcagctacttag

SEQ ID NO: 60013 - DNA, 1704 bp, Glycine max
  Peptide Sequence Number=SeqID_176791
gcagccaaggaatccaaggcacttgaagctgccaaaaataatctggaaatgcaagtcaaagaattaacttcgtgtctagaaacagagaagagaatgagggaagccaagacacaggaaaataaaaaactacagcatgctttgcaagagatgcaacttcagctccaagaaatcgaggaagccaaaaaacaggaaaatgaaaaactaaagcatgctttgcaagagaaggagcttcagttccaagaaattgaggaagccaataaacaggaaaatgaaaaactacagcatgctttgcaagagaaggagcttcagttccaagaaattgaggaagccaataaacaggaaaatgaaaaactacagcatgctttgcaagagatggagcgtcaattccaagaaattgaggaagccaagaaacaggaaaatgaaaaactaaagcatgctttgcaagagaaggagcttcagttccaagaaatagaggaagccaaaaaacaggaaaatgaaaaactacagcttgctttgcaagagatggagcttcagttccaagaaactaaggcagcgttaattcaggaacgagaggctgccaagaaagtagatgagcaaactccaactacacaggagaattctgttaatgttgttgacagtgaattgatcaataagcttactacagaaaatgaacaactcaaggaactagttaattcgttggaaaagaaatctatacaggagtttcctgttaatgttactgacaatgagttgatcaataaactttcttcagaaaatgaacatcttaaggaactgattaattcactggaaaagaaaactatacaggagtttcctgttaatgttactgacaatgaggtgagcagtaagctcattacagaaaatgaacatcttaaggatcaggttaattcattggaaagaaaaattgatgaagctgagaggaaatatgaagaaagtaacagggttagtgacgagcgcatgaatcaaattatagagacagaatcaaagatgattgagataaagacaaatgtgcagaggcttgaagaaaaactatctgatatggaaactgaaaaccaagttttgcggcagcaagccttgttgagttcatcatccaggagaatgtcaggaaagcttgcacctgctacaactccgcctttggaaaatggtcatcaggcatcacagggttctgtccctgcgaaaacatttggtgcagaggataaagagagtgtggatgctcttttcaaatgtgtgacaaaagatcttgggttctctgaaggaaaacctgttgcagcatttaccctttacaattgtctgctacattggaaatcttttgaagcagaaaaaacaagcatatttgatcatcttatacagctgattggttctgagttagaggatccagacaacaatgcttgcatggcttattggctatccaacacatcttctttgtttttccatcttcagcaatgtctaagagtacctacaacacggaaaccacccactccaacgtcatttttcgggagaatgacccagggtttccggtcatctaatagtctttccagcaatgcttttgatgtagagcatcaggttgatgccaagtatcctgctttgcttttcaagcaacagcttgcggcttatgtggaaaagatatatggaatcattcgcgaaagttttaagaaagacttgtcacctctcctttcttcttgctctaag

SEQ ID NO: 60014 - DNA, 2844 bp, Glycine max
  Peptide Sequence Number=SeqID_176792
atgagtatctgcagcaagatgataaatgaagaaacaagccaatctattttggttagtggagaaagtggagctggtaaaactgaaagtacaaagatgcttatgcattatcttgcctttttgggagggagagcagcaactgaagggaggtctgtggagcaacaagttctggagtccaatcctgttttagaagcatttggaaatgcaaagactgttaggaacaacaattcaagtcgttttggtaagtttgtggagattcagtttgatcaaaaggggagaatttcaggagctgctatcagaacatatttgctcgaacgatctcgtgtctgtcaagtttctgatcctgagagaaattatcattgcttttatatgctttgtgctgcaccacaagagacatttacagcaaaaggtttgatgcacttccacctgcggtggaatccagcagccgtcattggtggcattggtgcctctttgaacaagagcaaggatagggatgttgataagtataaattgggaagtccaagaacatttcattaccttaatcaatcaaattgcattgagctggacgggttggatgattctaaggagtaccttgcaactaagagagctatggaggttgttggaatcaattctgatgagcaggatgcgatatttcgaatagtagctgcagtacttcacttaggaaacattgaatttgttaagggagaggaagatgaaacggattcctccaagcccaaggatgaaaaatcccatttccatcttaaaatcgcagctgaacttttgatgtgtgatgagcagtcccttgaagactctttctgcaaacgtgttatggtgactcgtggtgacaccataacaaaatcacttgatccaaatgctgcaactctcagtagagatgcattggctaaaatagtttattcaaggctttttgactggattgtggacaagactaacaactctattgggcaagatccagattcaaataacttgattggggttctagatatttatggatttgagagtttcaagacaaacagctttgaacaattttgtatcaatttgacaaatgagaaattacagcaacatttcaaccagcatgtcttcaaaatggagcaagaggaatatacaaaggaagagatcgattggagttatattgagttcgttgataatcaagatgttcttgatctcatagagaagaaacccggtggcattattgctctcctggatgaggcctgtatgtttccaagatcaacacatgaaacatttgctgaaaagctatatcaaacctttaaagacaataaacgcttcagcaaaccaaagttgtctcgtactgacttcaccatcaaccattatgctggtgatgtcacttatcaaactgattttttccttgataaaaataaagactacgttgttccagaacatgctgctctactcagtgcttcgaagtgctcctttgtttcagggctgttcccacctttacccgaggaaactacaaaatcaaccaagttctcttctatagccgctcagtttaagctacaactgcaatctttgcttgaaacactaaatgctaccgagccacactacattcgttgtgtaaagccaaataatcttctgaagcctgggatattcgagaacaataatgtgttgcagcagcttcgatgtggaggagtaatggaggcaattcggataagttgtgctggatatcccactagaaagaactttgatgaatttgttcagcggtttactatcctagaacctaagattctgaaagcatgccctgatgagatgactgcttgcaagaggcttctagatcgagcaaaccttaaagattatcagattggaaaaaccaaagtgtttctgagagcaggtcaaatggcagaattagatgcatgccgtgctgaggtcttgggaagatctgcaaacattattcagagaaaaatccgcacatttatttgtcgaaaacactatattttattgcagttgtctgccatagaacttcaaagggttgctagaggacatcttgcacaacatcagtatgaatgcatgaggagggaagctgcttctttgaaaattcagaaagacttccgcatgcatatgtccagaaatgcttacaaaactatttatgcctcagctgtttatattcaaaccggtatgcgagggatggctgctagaaatgaccttaggttcaggaaacggacacaagcttcaattgttattcaggatcactacagaggttattcagcacgtatttatttccaaagactaaagaaatcagcaattgcagcacagtgttcctggaggagaacattggcacgtagagaacttcgaaagcttaaaatgttaacattggtgcttgtgcgtgaagtgcgcattgagagatctcgatctgttaatctcaattctggaagttcttctcttgataattctgttcatcctaattctgcacagtctatgaaccctaactctcaagctcaagttaatttgaccactcagaccacttgtgaggataattctgcgaacgattacataggaaatcgattttcagtggtcatggtggtgggaatttttgccagaacaactatagtggtcatggttcaggccatggtggtggtagaggtaggtttgttgatgctagaggagaattatgatcctactcttcctccacctgcttcacttgctcctactcaatctacttcagctccaagtgctcagacttctcagcaagttcagcatgctcaacccattcagtatgtgcttccttcacctcagcaatcactcacggcatttgctcaacctcaatatgtgtatctgcagccacatcagaccgatcaacaatgttctaaacaatag

SEQ ID NO: 60015 - DNA, 309 bp, Glycine max
  Peptide Sequence Number=SeqID_176793
gttgtgagcaaatcagctaacatgtatcccaaagatccagagttcccacctaatggtgtggaagatatgacaagattggcatatttgcatgaaccaggagtacttcaaaatttgcatcttcgatatgccatgaatgaaatttatacatacacaggaaatatattgatagccgtgaacccttttcaaaggttacctcatttgagtgcaactagtaccatggcaaagtataaaggggcggcttttggtgagcagagcccacatccttttgcaattgcaagttctgcatataggtatcttgttgttgcttaa

SEQ ID NO: 60016 - DNA, 762 bp, Glycine max
  Peptide Sequence Number=SeqID_176794
atggccaaacccaaaggctcttcaaaacccaaaacctctatttttctttgttgctttgggtcttcccatgccatggaatcatcacccacaaaagggtcttatgatcctattatctcagagatgaagaagaagaagaagaagaaaagtacttctactagttggttttcgtggcgaaggattcgattactcaaaaagagctcagcttacaaaacggtgccgcttgaagcctcaacctctgttcataaccatgttccttattccaagtccaagtcaacctttcaccataaacctcaagctccgaccaccaatccctcgctgccacagctagctccagtgctccccggcacaccctactatacccccacacaaacaaggcatggtgcgagcaaggtagaggacacgcgtcaacagagtagagcctctccagcatcggcaaaacggcaggcgcggcggctgtcgtcgtcaatgcaagcccaaacgacaccgaagaaggcccaaaacgcgtacgaccctgtcgttgggatgtccgtgctagtggtcactttggtaattatgctattttggggtcgtttatgcgcaatcctctgcacttcggcgtggttatattgcactccccgtttcaggaagagtggtggttatgtaaacgacgatgaggatcttcaaacgacgaaatcgaaggaggtggacttggattcggaggagtacaagaaaaaagtgatcatggagggccttcttgggagaaatcatagaactatgaattga

SEQ ID NO: 60017 - DNA, 219 bp, Glycine max
  Peptide Sequence Number=SeqID_176795
atgtctcataggctagtctgcatgccaacaactgattcttataatgcaaatataacttcaaacgaggctggtcaactcagttttgtagtggggtcccatgtttgggttgaggaccctgatttagcttggatagatggagaaattcaggaatctaacaatgaagagatcacggttatgtacgaatcaggctcgaaggtgggtcccctgaatctattgtaa

SEQ ID NO: 60018 - DNA, 246 bp, Glycine max
  Peptide Sequence Number=SeqID_176796
atgataagatctagagtcaaccttctacaagaagagatgatcaaaaggatcaaggatggactactcatcaaaggcaaggaaggagaaaatcacaaggagctgaattggattcttggaaggtcaacaatgttaattcttgaatttgcatccggaacgatccgaaccaagtgtccatggcttggattgaatcaagtggtattagagcttgaattcggagagcagttcaaaattatatccatcaattag

SEQ ID NO: 60019 - DNA, 372 bp, Glycine max
  Peptide Sequence Number=SeqID_176797
atggcttgggacccggtgttgagagaaacgaggatatgggctacgtggaagtacgtgagctcagatggaggtgggcaacaggggatgagtggtacctggagatatgtcgcgggggtcaggagaccttggggacgtcaggcgagctcctggcagtcaacagataaaaggaacaaagaccacaaagcaaggaggcttgtggtggctggccagctgcttgaaaacgaggtcaaggaagccatgagggcttctgggggctggaacattgtggaggcctctggtaatcgattaccaggctgtgtaatcgattacacagagggatgggtcactggtaatcgattaccagatcgtgatggcggcgtagctaatccgtga

SEQ ID NO: 60020 - DNA, 906 bp, Glycine max
  Peptide Sequence Number=SeqID_176798
atgtggatttcaaatgttgcaaataacagggtcaggaatgggtggcctgagacagccaacacatgggagcctccagaaaatctagagtctgttcctgatgttgttgaagcttttgaggagagcttgaagtcaggcaaacatcggaagcgcaaacgcaagcatgtagtgcatcatactcaacccaagaagcggctggagcgttctaccactccttacagccttcggcgtttttcgactggtacagctgagaaccatacacagtcagctcctcctcttattgatcctagccttcctaatattcccgccttccctcgtactgtgctgttttctgatgatgtgggaaatggtgctgaaggcagcagtcttagaaaagccacaccctctaatgctaacaggtctgcaaatggttcagaaccaaatattaaaaggactgaggaaaatgattatgatcctgtgcttagtgagcttaaaactatgactgccaatgggaatgatacagacaggcttgcaatacggattccagaagccaagggttctgggccttctggcagtaacgatcaaatggatgctaaatcaaagggggtttccatggaaacaaatgcaagtggccgctgccggggatccaaaaggagaaaatgtggttccgtaaagaggttcaagaaagaattatatgctaatgagcctgctaatacagaaaatccagttggcttgcctgttagtacagctgagccagaacaaacaagagatgctggtagtggtggtaatactaatcatgccagacctgctagcaatattgtaaacattataaagccagtaggctattcagcttcagtagccagtggaacgcaggatgttttagtaaccttcgtggcttcaaatgacaaagttgatcaagcttctggttaa

SEQ ID NO: 60021 - DNA, 1140 bp, Glycine max
  Peptide Sequence Number=SeqID_176799
atggttgcatgttcggtggaactctccaagtttggcctacgattcaaagcacgaggccccatcaaagggcagtgcctagctaatttcctggccgaactcccacctgccaaggacaacagtgaagcctggtggacgttgcatgtggatgaagcttccaccagcaagggcaacgacacaagcatcaccctcgaaggactagataacatctccatcgaagagtcgataagcactaagatgtcaagtcagcatcgcacattcatccaagagaccctcacctcccctaccactgacgttaccaagtcctgctcaaatcaaattgatcccagcggatggatgtctcccatatgggcctaccttatcactgacgccttgccccaggagccagttgaagccagaaagggaggacaatacgatctggccttaagggcagtttgcaccaagtatgtcaaaaagtgtaaagaatgtcaagagttcaaccatatccaccacgcgttgcctaaggagctccataacatcacctccccttggcctttcaccatgtggggaatgaacattctcgaaccatttcctatagccaaaagccaaatcgaattcctcctcgccatggtggactatttcaccaaatatggcttacctcaagccatcatgaccagatttggaaggcaattcactaaaatgggccgcaaacaaggtcatcctcgtcaagctacacaaaagaacgtcaacaattcccaaggggctgtgggtagacgagctcccgagcatgctatgaggataccactgtactcccaagtctaccacacaagaaaccacattcaagttaactacaacaccaatgttatgatacctatggaaattggcgaaccttcactccgcataagcatgttcaatgtggccaacaactcagaatcattggcggtggagttggacctgactgaggaagttagaagtgaaccacgaattcaagaagatgcctgcaaacaaagaataacttggaaatgcatctcaaagcgcaagaaatgtagcttcaagcccaacgccttggtttggaggctccaaggagatgccatgaaagacaactcaaaaggaaagctctcaccaaacagggaaggctcattctacatcactgagtccttgtag

SEQ ID NO: 60022 - DNA, 948 bp, Glycine max
  Peptide Sequence Number=SeqID_176800
atgttcagaggaaacaacgacgacgagtttgagtttgacggtggcttcgacttcgacaaggaggaggcactgtataaagagttggagaccctcattcattcagagaacactgccccatcgatgatgtttccgttggaggacgccacccatgttcacagtggtgattctgattctgatggtggctccgacaacaacaagctgcaggtgtttgagttggagaacagcctcgttcaacttcctcccaagttgtcatctttgtcagtgcctcccccgacggaatcgatgttgccgcatacacagtttcacggcggcttcgatgagtgggacgacaccctcgtttaccttcctccgatagaagaaaccctcgatcagttagagaacactgccccaaggcttctttctccgtcggccgaagaaaccctcgatcaccttctttccctttcgactccgatgttgttgcaagagttgttggagtcaaagaacactgcccctgcccctagccttcttcccctatccactccgatgttgttgcaagacacccttgttcaccttccacccctgtcactgccagacaacacttcacctagggtattcactccggcagggcacatcacccttcttccacagacacagacagcgaaccgaccctccacttcatcggcatcatcatctcacaatcgctgcaacagatggaccaatgaagaacacatgttatttcttcaagggcttgcaatctatggcaagggagattggaagaatattgcaaggtatgctgttaagactagaacctcaacccaagttgctagtcatgcccaaaaatactttcttcatctgcgagcctcaaacaaaaagggaaaaagaaagagcatttatgacacgaccttgcaagatcaagttccaccacctcaccaacattgggttttgcctccaaatcttgcaacatactga

SEQ ID NO: 60023 - DNA, 934 bp, Glycine max
  Peptide Sequence Number=SeqID_176801
atggattacatggatcaaaggttgcctgaaatcagcttctatttctattttggtcaacaatggaagccaacagctgagttcattcctcagagaggtctcaggcaaggggacccactagcccctttcctgttcaacgttacattagcatattacaatatgcaaacgacaatctttgggacagcgacgatggagaatgtcaaagcaatcaagatgatgctgagatgttttgaattaatgtcgggattgaagattaattttgccaaaagtagttttggggcatttgggacaactgaacattggattaacaatgctgccagctacttaaattgcagaaggttgtcaatacccttttcttatttgggtatccctattggggcaaacccaaggcatagtgagacatgggatgcaataggtgccgaagaaggtggtggacgggctggtaaagctatagaggtggttcttggatttgaggaagttcaacaatgctttacttgggaaatggcattggaacctgtttcaccgttaagggacctaagcttcatttgcaatttgacggaggaagggagctggtttaatagcaaaaaaaaatggaaaataggttgtgattcaaaggtgctgttttgggaagaagcttggaaggaggatggagtgtcattgaaggagaagtacccaagactgtaccagatttctcaacaacaagaagttcagcaaatggagataacaacaactacaggagaaatagttgcagctgcaaattttatggaggatatacagggtttggtagtacaaatgcagcaacaagacacttggacttggggaggggattcaattgggaagtattcagtgggaaatgcttatacacttctcaacaaagtcttgttatcattgactcgggatgaagtgtttaaagcaatatggaaattaaaaatcccaa

SEQ ID NO: 60024 - DNA, 270 bp, Glycine max
  Peptide Sequence Number=SeqID_176802
atgcagttgaatgatagcttttatcagtatacactgcaccatcatctccaggaccctaacccttacggtctactcccgagcagttcagaaccactatcgcatggcctggggataggcccaatttttagaaggaggcaagtcctgcagatgctcaaagagcttccaaagggaacgaaggcggagctgaggatgatggagacatggcagatttgcctgatttcttcattggaggaggttgagttccccgaccacgatcttctaaatttgtaa

SEQ ID NO: 60025 - DNA, 210 bp, Glycine max
  Peptide Sequence Number=SeqID_176803
atggttgcttatgtcccatcgggggaattttttgttaaggtgcattcacttgaggatagagctgtgaactattatggtgtgaagaaaacttctgaccctgaaattgattataaagacaagatattgaaatatgactggccagatccacttaaggtgttctcgactactcattatgatttgattacatgcttatcagagagagttacatag

SEQ ID NO: 60026 - DNA, 1076 bp, Glycine max
  Peptide Sequence Number=SeqID_176804
ggggttcttctaggatctgtgatgatgaggttgtggcgttcaatggctctgccaccaaattctgcagtgttggaaatggaagaggaataggaggaagaggagctagtggtttagaaaatctgcagtgtaacagaaagaaaggtggaagaaacagggggcgtgttggagtaatcaacaacagggagaagcataagggtagctttgagacaattcacgtgcaggattccactggacatgaatttgctactcgcatgggcaatgtgttcactattggaaagggcacaaagccatggatatcactgcccaaggtagagcatgaaagcaacatagattcaatagaagaatctatgatttatgatctcgttttctccgagaactatgcatcttccacatggtgtttggatgaactcacaaagatactcgattgcaagaagagatatggaagggttgtgatcccagttttctataaggtggatccatcaattgttaggaatcagaaagagacatatgcagaagtattctttaagcatgaacatcgatttgaagacaagatcgacaaagtgcatgcatggaagtctgctctaactgaagcatgtgtgagcaatagcatcaacccaccaagctatgtcttggtacctgttggtgttaagactacaagtacaaaaagcccaagcacaagcattaacccttctttgaagagacctcaacaacaaaatgagctacatttgcaaaactttgttgtgccagggaagccaaggagcaaaaggaagaggctttcagcaccaagaaccaacaaagaccctctaagcatatgtgaactcatcatgccaaagccaaaggataatgaggagcaacaagaagaggttgtgatcatgaccaaagaggatgaagaaaaagtgattattaatgtgagcaaggaaataagctttagggactctgaacttgatgagtgtagcaatggtcaacaacaaccaatgccaagaaggtacaagtctggtaggttgctaccagagtataggccagccaaaagtcctacttttgtgagctacttgcactccaattcccacaaaaagtaa

SEQ ID NO: 60027 - DNA, 373 bp, Glycine max
  Peptide Sequence Number=SeqID_176805
gagtaacgtcctttggggttcattgcaagaagtggaatttgcttcttggtgtaatcactggacacaaaggagtaacttcctttggggttcattgcaagaggtgggattgcctcttggtgtaatcactaaacacaaaggaggaaggtcctttggggttcattgcaagaagtggaatttgcttcttgatggctctgaaggatccaatgtagctccacatgcagaaattgagtttgatggatatcactttcgaagcgaggagcatcaacgccttattgaggtgattaaggattggtcttttctcaaagaaagatgggtccaactagcggaggaagagtgtgcagaattccaagccaaagttgccaggaggcgttag

SEQ ID NO: 60028 - DNA, 249 bp, Glycine max
  Peptide Sequence Number=SeqID_176806
atgactactccacttgtctcgcctcctcctcctcctccttcagacgcatcaatgtctccgtctaccgtgaagcggacacgcaaaacgacacagctacgatcgttggccactagattacctggtgcagagagaccagtggtcaacgttgatccagctatcggcaaggtcgacggtccccacaagaagaaattaagaacatatttggggattgtcgcccgtgataaggtggacgtcacatacgagacctag

SEQ ID NO: 60029 - DNA, 354 bp, Glycine max
  Peptide Sequence Number=SeqID_176807
atggttaggggaaattatcaatggtgtcaaaagactggaattgaaacaccatataatgccaaagagaacctaatatcagaattgaaactactactatacaatccctttggcattcccaactccattggagcttgtaggcctaggatcttcttcatcaatgaattcctttgcttcttggaagatgagtggcagcggaatgaagaaaggaagagagaaaggagacgccacttcaaggagaagatgagtctagaagaagctcaccaccataggaggccatggataagagcttggaggaagaaggagatgaatgaggggagggggagagaagagcacgaaattttgtgctctaaatga

SEQ ID NO: 60030 - DNA, 585 bp, Glycine max
  Peptide Sequence Number=SeqID_176808
atggctaatggattcattcatctaaagaaacattacatgctaaagatgttggtgatgatgtgtggaatgagttatattggagatcattttttcaagatattgtcacagatgaatttggaaaagttacaagtttcaagatgcatgatcatgcacaacttgtttcaaaagaggtttgttgcattgcaaattgggtgccttgacggatccgccgtgagcgacaaggtgaatcttgagcttgacagtgaggggaggggcactgtggcggacgtagtgatggaggccactgcggacggcgacatgggcgaccttctcggtgctgatgttggctgcacggagggcggagagctggccaggatcaagatcggtgttgatgttcccatacttgcggtaccccgcgtacacatgcctactcctcactcaggccgtgcgctttgtactcgcccttgccctctgcgaagagttgcgagtgacaacgtgagtgagatccaagagtggaagcactgtgagagtaggggtgggaataggccaggtcgacctatagaggcctacgacctggcctacataaagcctgacctattaaattaa

SEQ ID NO: 60031 - DNA, 1248 bp, Glycine max
  Peptide Sequence Number=SeqID_176809
atgtggaaatccaaccatcaagtagttgaatatattgttattactggacatttcattgacgcgggatggaatcttcaaaaaagagttttaagttttatgaaagtgcctgctccaaggtgtggtattgatgttgctgatgctattttgcaagatggccttagtacaattaaggatatcattttcaatattcgtgaaagtgtcaaatatattaaccacaacgatgcaagactaaaggcattttgtgatgttgttgagcaaaaacgcttgaaagaaaggaaacttgttattgattgtccaacaagatggaattcaacctttaatatgctgtcaaatgctttgaaatttaagattgcatttgcttcttacaaagaaagagagccttactataattatgcaccttcacttgaggagtggaatcaagttgtgaaagtttgtaaactgctagaagtttttaatcttgctactcatgtcatctcagatagtgagtatctgactgcaaatttgtatttggcagaagtttggaaggttaaacaaatacttgataaggagattgaagatgaagatctcttcatgaggaaaatggtaggtccaatgaagaaaaagtttgacaaatattggggggaatgtaatatgttgatggctatcataagtgttttggatcctaggggcaaatttcatatggtgagtatatgttttcccttgacatattctaaagaagttattgatgagaatataaagaaggtgaaaagttcatttgaagaattgtatgatgagtatgtaggtctatgtttagaagagtctacgtctagtgttgttaatttggatgataatatttcatcatcctcccaattcaatacttcagttgtcactggttttgatgaaattatgagcatgctacatgaaaaggaagttgtttctcctataaaatcagaattgaaagattatcttgatgaaggtatttatgttcctaacactaattcctttagtgctttggactggtggaggaacaataacatgaaatataggatattgtctaagatggctgttgatatactagctattccaatttcaactgtggcatcggagtccacatttattgctggaggtagagtaattgatgaatttcgctctaaattaaatgaagaatctgttgaagctctaatttatggtggagattggtttcgtcataaatataatgtgaagaaaaaatcaaaggctaatattacttattataatttttataagtaa

SEQ ID NO: 60032 - DNA, 264 bp, Glycine max
  Peptide Sequence Number=SeqID_176810
atggccgaggttgtacttgaaggtgtgcttggacatttgagctctcccgttggaaaagagttggggctatttttgggttttgatcaagacttggaaaggcttacaaggagaatgaaaaggataagtgaaaaattagatgaactttctgaagaaaggaagaaacttaattggatgagatggttccggagagaaaaagtggtgtcacagaggagaaagaagtggagttatcaagtggcatcaaaccacctcattattcatcactga

SEQ ID NO: 60033 - DNA, 726 bp, Glycine max
  Peptide Sequence Number=SeqID_176811
atggcgctgttaatcttcggagtagtcctttttccaaacgtggatggtttagtggacctagcagcaattgacgctttcctcgcctttcaccacagcaaggaaagcccggtcgtcaccgtcttggccgacatatacgacacattcgaccagagccctctatgtgtggttggtttcgcacctattccgccaagatgcgagacacacctgcccactacaaagccaccgttcatgcgcagaaaagagggaagcaaattgggaccaattcttggcaagcataaaaggggcgtcggtcaactgggagtccgcaaggtgtgggaggtggtgcggagaaaggatagagaacttagggggagtagcaatgggactgtcgacgggtatcataggtggttgagagcctacacacgaggtctggattggctcccgaagctgagagctgctaaagaggaagaggctgaagccccagaggaaagtgaagaggtgcaagctctcaaagcggagctcgagaaagcccaagcagttaaggaaagattcaaaacaagagccgtcagaattcaaagggagaatgacgaacggatggacatcaatgcagccactgccaaagccttggagcaagaaaccaagagggcccggaagggaaaacacgcccggaaggagctttgtggggcagcaacaacgagcttaaactctggagagaagaaagagactagtcacgagtggaaggcatga

SEQ ID NO: 60034 - DNA, 423 bp, Glycine max
  Peptide Sequence Number=SeqID_176812
atggttgaggcagtacttgaagacttggaaaggtttgccaacttactcactacttttaaggttgtgcttggagatgatgaggagaaacaattctcaaatagagctatagagatttggttgcaaaatctaaaagatgcagttcttgagttggaagacatcatgaacgagtatgcttatgaagaagtcaagtattgtctacgtctaccagaaatggttccagagagaagtggagtcatcgactggtgccaaactaactccctcatcactaagcaaaaagtctatggaagtgaaaaggatacccttaaaattgtacaatttttgtttggcaaggcttctcgttctgagaatttatcagtctatccaatcatatgtctgggtgaacttggaaaaacaacacttggctcaactcatcttcaatcatga

SEQ ID NO: 60035 - DNA, 204 bp, Glycine max
  Peptide Sequence Number=SeqID_176813
atgaagtcaggtgacagacgggggtaccgtatggttatccgcatctttcgtcaaccgaggtttttactctcttcgtccggagacattcaagcccgacgacgcacgagattcttctctactgggcgggggcgatcgagtgcgatggcgtggggaagttccgctggttgggatattgactggccgaatgatgttccgctcgaatga

SEQ ID NO: 60036 - DNA, 114 bp, Glycine max
  Peptide Sequence Number=SeqID_176814
atggcgcctactaggcaccctctggacccagagatgtccaacatggccctggggtttccgactctgatcagaggcctctaccagtcctacggagtttctatcacccccagtaag

SEQ ID NO: 60037 - DNA, 417 bp, Glycine max
  Peptide Sequence Number=SeqID_176815
atggctccgaaaaaactttccacgaagaggtctagaaaggacgccacaggagaaggctccagtgccaccttggattttaatcgtcatcggttccggagtgccaagcaccagcagcgcttcaaggccatcaggggatggtcattccacagggagaggcgtgtccagctcagggaagatgagtacacggacttccaggaggagatagctcgcaggcattggacacctctagtgactcccatggccaaggttgaggggtcagtggattcccttcgacgcagatgccctcagctagttcctgggcgacccgctgattttggaggaaggccagcagtgaaggcgggtatggatcatgcgcaccagcatgactaccttcacccagatatggatgacactgctgctcagcaatgtcttgcctag

SEQ ID NO: 60038 - DNA, 477 bp, Glycine max
  Peptide Sequence Number=SeqID_176816
atggaccttgcccaaggttttcatcaaattcgcatggtagaacgagatgtgcctaggacagcttttcggactcaccagggccactatgagtatgtcgttatgccttttggtctctgtaatgcgccttccacgtttcaggccacgatgaacgaattatttcagccattcattcgtaagttcgtactggtcttcttcgatgatatcataatttacagtcatgatttccaggctcgccttaaacatatggagtacgtacttcaaactctacaacagggtgttttccacttgaaatcattcaagtgcgttgtcggtcaacgccgcattgaatatcttggccactttgtctccttcaaggaaacgtcggagcaacacgtgtaccttgctaagcttctcgggtataactacatgatccaatataaagcaggccacaacaatgtggtggctgacatgttttcacgcctgactgagacggaatag

SEQ ID NO: 60039 - DNA, 300 bp, Glycine max
  Peptide Sequence Number=SeqID_176817
atgggatcgcggttggagattagactccaaggaaaatcgtggagcttgcacaccatatctatgaaaagctgtgctactatgtgggccgtgaaatgggaagggagtgatccaaaaatgggcccccttggagaagtgatctacaacagtcatgatgacagtggttccctgaaagttgggaggttatcctggagggtgaactcagagcattgtcaggggtcgtcacgagcgcaagcaataagggacttgaattcatctgactcaacgaactcccttttcaggccctccaagaacttaggatga

SEQ ID NO: 60040 - DNA, 1014 bp, Glycine max
  Peptide Sequence Number=SeqID_176818
atggtggaagaagcgctggtgtttggaaaagatgagtgtacgtgtcgagaagacgacgtactgaagggggaggaatgggggtgccagaagcaactggtccatgatcctggagttggatgtggaacagggccgctactcactgggtggtcatcaggcgtctcatttggccgtggtgaatctcagctagaccgccaggctacacccaacataatatttgttccccataatgccattacatacaagtctagggtaaacgcgatcgtggatgaagtggtgcgtactaccaccgtccataagaacaaccacggtgtgcccttaatcgagcccagtacacgaagagtagccgaggcaggggggatcaaagagtggtttatcgtcatcctcggaagcaacaaggagaaaaaacttggcacgaaaatggtggtggttttgggagaagctggaaaaaggggaaggaggggtgaggaaggtaagggagagggggaagctggggtcagtgtatggggtcgggaacgggaggagcgagagaccggaaataaagcaactaaggaggaaggagggcgcctcgggggtcatcgtagagagaaggggcaaagcggagctctaatgcctaaaggaaagatgcccatgatggtagctagtcgttatggtacatccactgaaaccagcttagtacgacaccatcaaggtaaaatgatacgacctggagatgttcgtccttgggggttcgatgcagttgatgtctcgttaagcgaggcctatgcgcttagcaagcaacattcgctaagcgaggcactcagcttgcttagcgagttaggagaatctggaagaggatctgtcaagcatgcacgcgctcagcgcgccattagctcacccaacgagttatttgtctcttctagcgctaagcgcgcctggctcgctaaacgcgcctggctcgctaagtcaaaaatcactaactctcacttagcgcaaaaaatggtgctaagcgagccttcgaggacagaaagcccttaa

SEQ ID NO: 60041 - DNA, 315 bp, Glycine max
  Peptide Sequence Number=SeqID_176819
atgaagaataagaaggttgttgtggctggtgccttgcttagcgaggcatatgtgcttagcgagcaacatctgctaagcaagacatcagcccgcttagcgagtgaggagaatctggaagagaatctaccatgcaagcacgcgctcaacatgccattagcttgcccaacgacttatttgtctcttctggcacccagcgcgcctgactcgctcagccaaaaatcactaacttgcgagaagcttgagaacctatgcaatagagatatacgtgagaaacgcaacagggcaagggagcaccaaaaacctcaactttcatga

SEQ ID NO: 60042 - DNA, 321 bp, Glycine max
  Peptide Sequence Number=SeqID_176820
atgccgttgatgagatcaagaagagaaggacagcggcggcgcggcgacacgtggctggtgtcggtattcgtgataatccaaatcggggttttcatcgccaccatgctcgtcaacgattgttggaacaattctcacgacgattgcgttcttcaagcccttagaaggaacaagaaaatttctgctggcgcacttggcagagccactgctgtttgggttctttttgagttgcttgagtatcaccttcttactctgggtgaaaaatccaagttcaaaggttccatctttagaaaccaaggtggtgtttttaccatcatcacttag

SEQ ID NO: 60043 - DNA, 852 bp, Glycine max
  Peptide Sequence Number=SeqID_176821
atggagtaccagagaaaaaccatcatcacaaaacttgtgaaatcatccaaatttctccccaaagttattcgcatttcggtgacggatcaagacgccacagactcttctagtgatgaagaaggagaacatgcaagagtgaagaaagtgattaatgagataaagattgtttgtgtcaacaacaagaaaaatcacaaaaatcacgacaacgacagtagttgttgctatgcaaatgcaaccaaagagaatgaaagtctcagaccacaacaacaaaacattaatccattaaataaggtgggctacatgaatcagaatcaaaatctcaaacagcacaagtttcgtggcgtgcggcaacggccctggggccggtgggcagccgagataagagaccctacgcggcggacgcgagtgtggcttggcacgttcgacacggctgaagaggctgccatggtttacgacaaagccgctattaaattcagaggcgctgaagccgtcaccaatttcatcaaaccgcggttgaaagatcacgagtcagtgtcccttgaatgtgacagtgttgtcaacggaacgagttctgcgtgtgcttcacccacttctgttctcgtgtttcagccttggatagaaccaccgttattggaagaaacgttcaaagaagaagaagtgtttaatgggttaactactgatgtttattgtgatgatgggttcttgttttccaatgaagcactctgtgatcaacctcttcctacgacgttttgtaatgttgattgcattgatattccgttggatgaagatcttgagtcatgtaaatgggacgtagataattatttcagtgatgatgcttcatggaaacaatga

SEQ ID NO: 60044 - DNA, 249 bp, Glycine max
  Peptide Sequence Number=SeqID_176822
atgaataaacaaagccaaaagaaaggtcaaaatggtcttttcacaaaggtttatgaccccaaattctcctcggctagcaaccagcttgtctgggctaaagatcttacttcagccctaagcaagcaacttgcttgggcgagctacagctcacttgggagagtggaagtcttcaagagtaagcaacaacaaattcgcaagctacaactcgcctgggcgaatttatctgcactccttggctattttctataa

SEQ ID NO: 60045 - DNA, 378 bp, Glycine max
  Peptide Sequence Number=SeqID_176823
atggaagatactttaacacagtttatgcatgtatccatctcaaaccagaagagcattgatgcttctattaaaaatctagtagttcaggttggacaattggcaaaggaagtggatccttctcagcaaccacacaggtgggggactgtggttggtttgaaggataatgatgagaaaaagaataaaggagttgaaaaagaaaacgagaaaaatgatgaagtggggattagtgaaaaagtgaaaaatgacgatctcggacaaattcaccattggattgtcgtgaaacttaaacagcatgttcgcaacccctttccgagaattttcaccgttgagaatttcgatatcacgtatgagctaagagaaatacccctcgcattgtag

SEQ ID NO: 60046 - DNA, 1059 bp, Glycine max
  Peptide Sequence Number=SeqID_176824
atggctacttccggctcatctagtgaggacgatcttactccaccaccaccaccaccttccttgtctcacatcacaatggcccaataccaacaattgatgaatcttctcagcaaattctctggacctggtggtgcaagctcagagactactcttacacgagccaacctcactcattctaacccaaatcaaattcacaattctggttttggtagtcattttgacatgagcactttgaagacgattagtttggttgacttgaaggaagacctttttcacttgatagttggaaaggataaaagcccatctaccaataatatcactaccaccaacaccaatacctctaagctttggcattttagattaggtcatttatctgacccaatttcatatacgctacctacaccaccccaatttaccccatccacacctatcacaacaaacactgaaccaacaattcctcaacccaatggctcaccatcacctttcccaaatccttcaactcctcctacaatcgacacaccaaatcccaacatcattgatcaacacatccaagaaccaccatctaaccatgctttaccacgtcgctccaaccgcgacactcatcctccttcttacctttctgattatcagtttcaaattccttccctcaattctgctcaatcatcatcaacatgcacatatccaattcagagtttcctctcatacactcatgtctctccttctcatcgccatttccttatgactctgtcatctgagcacgaacccaccagttttcatgaagctgtgaaacatcaatgttggcgtgatgccatgaaatgtgagatcaaggctctacagttaaatcaaacctgggacattgttcaaaccccttctcatgtacgaccaattgggtgcaagtgggtatataaaatcaaacgactaccgaatggatgtgtcgagcgtcacaaggctcgtcttgttgcaaaaggatactctcaaattgagggcataaattactttgaaaccttctcccctgttgttaagatggccactattagagtttttcttgctctaacatag

SEQ ID NO: 60047 - DNA, 495 bp, Glycine max
  Peptide Sequence Number=SeqID_176825
atgcggatagaaaaattttgggataatcttggcataaaccaggatatatccaagaagctcagcgccactcagggggcatttggattcttacgtccagacaggatctcacatgcgatctcattgactctatggcatatgctattaccatttctacctagaaacccaattctcagtggttctgtaaagttgtatatgccccctattcctattgctcgctcagtcttttgggaatatctcattcaatcggagtccaccgttcagggccggtggttgatgttgggtgactttaatgacattattctctctttagaggtgtctgaagacatggaaactattggtggttgcttcacttggcgcaagaatattcatcaggatggtcatgtgaggaaaaaactcgatagatgtttagctaatcccacatggcagggatgtcctagcctaggaggagatcctttggttccaaaaatcataggaaagttgggtaaaatttggtaa

SEQ ID NO: 60048 - DNA, 324 bp, Glycine max
  Peptide Sequence Number=SeqID_176826
atgcagttgagctcaaagaaatgtgtcttcagggttggagggggactccacaataagcttggatctcctaaaggaagaaggcagaaagaagatgccaatttacttcacaagctgagtattccaaggagtgaaaaaaaatgctaccaaatgattgaaaagcttgccttggaactaattcattctgccaggcaattacgacaatattttcaaagtcaccaggttatggtgaaaattgaccactccctgaagcaagtactcaaaaagctgagcctcatcggacgaatggtagcatggtcggtcgagctcttcgagtttggcttatga

SEQ ID NO: 60049 - DNA, 391 bp, Glycine max
  Peptide Sequence Number=SeqID_176827
atatggaaaaaccgaaaacagcaaacaatatccaccattgcagagacatgcctttgtaaagtggtggtcacaatttgatacctcaaaggctgctccagaacaagtcaagaactggtttcagagcaaccctgagtttctcaagcctgctgatccagagacatcattgtttctaaatcaaaagtctcaacttgcagcattcttagcaagctcaaaatctaaagaaagtcttgctcagaatcttaaggaagttctccagctacttcaacaggaaggagaagaagaaccccccaagaaggaagtcgaatcatccgagaataatgatgaccaagaagatgatccattctaccagaatgaggatgactgttttggtatatcgttagacgatgattag

SEQ ID NO: 60050 - DNA, 405 bp, Glycine max
  Peptide Sequence Number=SeqID_176828
atgcacgtcttgactagtgtgtatgcttttggatggcgagacatcttctggataactctctttctggtagtcatgcttttggataaatctgccctttttgtgagactaatctcgaaagtagttggcatattcttctatgttgtacctttgttgaacaagtttggagggaagaggaactttggcttaaagttgaaagaactacgaataggtttgaaagaatggctcattgttgttacatggcgtgagtgtaggaatgttagagattcaagatcttctcgtgaggacacaaacacaagacaacaccaggagagatggcagcctccgccaaatgaactgctcaagtgcaacattgatgctacacttttccaagaagagacaactttagcgttgacatgtgcattatag

SEQ ID NO: 60051 - DNA, 486 bp, Glycine max
  Peptide Sequence Number=SeqID_176829
atgacgacgagtttcaaaacagaaccgccttcctattctttcttttataatactaaccctagcttgatgccgcacctcaacttctctcttccacctcgcatatcaacaatctgcctcttctcctcaccttcaccttcgtttccccttcttcccttcgtcactcctctccttcttcctccctctcccccccaagctcccttcctccttcgcctccgcctccaccgctccctctcctttcccttcaaacgaatgtttcttcatgtcggactcagccaacaagttgtgattgcgaagcataaaggttatgtgagtggtagcttgtcggatgaggggaaggttgaacttggaggagattctggtaaatcagaaagttctttggagaaaggcttagttgatcgcagtgacgcttcacatgttgatgctaaagtagataacatggcgaggtgtttcagaaccaaccagaggatactggtgagaaaggggtaa

SEQ ID NO: 60052 - DNA, 300 bp, Glycine max
  Peptide Sequence Number=SeqID_176830
atgtcaccacatgttatgcaggatggtggaagtagtcaatattgtatcatcatcatgattttgcaaagaatattactcggtgaaagagcagtctatgcaatgatgctggtgtttccacctgaattttctcctttgaaaactattttatttggaaatctttcccaagacaccgttgaaccactgatggaggctttggaggaagattataaagatggaaatgagataaatgaatcaaggcagtttattggaggagtattggatcttgaaaagagaatcaatagactagatacattgacttag

SEQ ID NO: 60053 - DNA, 426 bp, Glycine max
  Peptide Sequence Number=SeqID_176831
atggcttctacggtggaaaagaaatatggtgcgtataatgtaattttattccgagattcatgtgggactaagacaactacacttcctctctcatgtgatcggattggcttcatcgatgaagcaatgtgcgccggcggcattgataaaaggatgatggagaagaaaaaggggagatttcaagatcgatgcgaattgaaaccgccgcaacgtgaggtgttgccgacggaggccaattcacgatggccatttgcgatcatgcgttttcgatggggatctcgttttgtacgacttgggcacggtgctgggttgacgattgcgggtgatgcggagacgagggtagaagagggacgcacgcagcctccctggtgcagtggtaacgacaatctatttgcttccttttctggattaggttacgatgaaccttga

SEQ ID NO: 60054 - DNA, 317 bp, Glycine max
  Peptide Sequence Number=SeqID_176832
atgcctacttgtagagcaaaattgtcggcgtcaagagggttctcttcaactgatcgtgttgtgttgtcatcatcatactcggaacccattgtatttggatggagaaaatgcttgtgcgatgatagggagatgcttgtcactttacatggctcaaagaatactagagggatggaaagttactgtaatcacttccgttgggctgatgaaattgatggtggtattgatgaagttgttgcaaaagcagtggatgaacacaagaagaggattgtgaggatgcaaaaaaaggatggtatgtgtcatgagttgcagcagtgtag

SEQ ID NO: 60055 - DNA, 228 bp, Glycine max
  Peptide Sequence Number=SeqID_176833
atgggttccgagtatgatgatgacaacacaacacgatcagttgaagagaaccctcttgacgccgacaattttgctctacaagtaggcatcaaattaaaaatgaagaaaacctattgctacaacatggcatataggaacaagccagatgtacacactcatagacacttaaggatgcaagtgacgacaaggatgaaaacaatggatagaatacaagtttcgggatgttga

SEQ ID NO: 60056 - DNA, 2370 bp, Glycine max
  Peptide Sequence Number=SeqID_176834
atgggttatatatgtgatttttgtggagaccagagatccatggtgtactgccgctctgacgctgcatgcttatgtttgtcttgtgatcggaatgttcattctgctaatgccctttctaagcgtcattcacgcacccttttatgcgagagatgcaattcacaacctgcctttgtaaggtgtgttgaagagaagatttcactttgtcagaattgcgactggttgggtcatggcacctctacatcttcttcaacacataagagacaagcaatcaattgctactctggctgcccttcagcggcagaactgtcttcgatatggtcatttgtgttagaaatcgctgccataagtgagtctacatgtgagcaagaactaggcttaatgagtattaatgagaacaagtgtgttggtgttcctccggaagaccagaatgtgtctggttcagatgaagttaccgatctacctgctttgaacaagtctttggttggtgcatctttgatgcctgaatcaagctccgaaccttgtattctggaccagccagctggacctaccaatgaatgtctgccaaagttatactgtcctgctacaaaatgccctgccttatctgaagatgataatctgtatgatgatttcaacatggatgaagtggatctagatcttgagaactatgaagaactttttggtatggccctcagtcattctgaggagctttttgaaaatggtggaattgatagcttgtttgggacaaaaggcatgtctgctggagattccaattgtcaggaagctattgctgctgaggaagatcgtgaagttggatgtgaaaatccagcttacgaagcatgggaacaacaagatcaggctttattaacctggcttcaatccactctttctacaccaattctttctcatagtttgtctcacatcaaagcactcactgatgctcttgcttcagtaggaagccctataatgattcaagagcacgtggattcaattcttgaaggtcttactccagattatcacctgataattgagagcaagtttgaacgttccaatcgcgcaatgaatttgcattctgaaaattacactgtgccaaacaagtcaagttctcaatcagatcctgaaagtttttctggttttcgcggtggttctgcgcgcagtggctataataagggtggcagcagcaacggtcgttgtggtggtggcagtagtggccgtggtcgcactggtgcagctgtttgtcactatcgctatgatcaatattatcaaccaaattctgccctatctctacatgatcctatgagtgctgattattcctcacacacctcatctcagaggaatgacactcagcataatggcaattttggtcagacttgtagtgaacctcgtccctctaataacattcaacagctagagccctctgaaggaccagaacagattttcataggaaacggccaaggtctgaaaattcactcttctggttcttccatttttacatcaccttataattcttctgtctctttatctctcaatcatctcctgcatgttcccaccataacaaagaaccttatatctgtcagtaaatttgcaaaagataatttagtgttctttgaatttcatgctaattgctgtgctgtcaaatctcaggttaccaatgaagtgttacttcaaggtactgttggtcctgatggttcatacacttttcccaacatccagtttcattcatcttcaactggtgttgcttcatactgcttgtctactgctgtcaattctgttaatcctgccacttctaaagtcaattaccctttagatacttgtaataagattgacaattcccttgagagttggtccctgtcatggcatcaaagcctttatgaccaagtggtcaagagttcagataatgttgcccctcttcaaaataaaaatgcttcaagcccgagggggtcgtcggttggacaggtcaatgcaatgcaaccagcttgcagcaatgcagcgtctgcagattccattttgagtactaaaactgaaccaattctttgttttactggaaggcaaactcaatcaaacctttctttttctggtgttactggagagagtagtgctggagactatcaagactgtggggcttcttcaatgcttctcatgggagaacctccttggtttgctccttgtccggagaattccctacaatccgccaaccgtagtaatgctgtcatgcggtacaaggaaaagaagaagacacggatgtttgacaaaaaagttaggtatgcctctcgcaaggcaagggctgatgtcagaaggcgtgtgaaagggcggtttgtcaaagccggtgacgtctatgattatgaccctttgagcacaaccagaagctgctga

SEQ ID NO: 60057 - DNA, 150 bp, Glycine max
  Peptide Sequence Number=SeqID_176835
atgggttttcacaagaagatgagaaagtacgaggcaagaaaattacctcacggcaaggaagacaatgagaacaagatcgttttctcagagttcggcggcgaggcatccatggatttgttgcctaaggttaggtcttttattagtcaatag

SEQ ID NO: 60058 - DNA, 204 bp, Glycine max
  Peptide Sequence Number=SeqID_176836
atgttaatgtgtaatcatcaattttcgtgtgttggtctgattgagttattatgcaccattggtagaacaccatatggaaaaaatcccaaaaagtttgacattccttccggatgtaccatggatgaattgaaggatttgatcaagcaagttgcgcctcatgggattcctccttatggtattcatgaaacacaaacggtagggtga

SEQ ID NO: 60059 - DNA, 347 bp, Glycine max
  Peptide Sequence Number=SeqID_176837
cactttccgtcagttgcggagtgcatcgctgatctggagtacgacgagttcggatacatccagagtattcctacaccgcatgtcgattcatgggagtcatttgatgagataaacgacaggtggatgcactactcagaccatcttgcgccagcaacaacatcgacacatgcccgttctgatgaggacgagcccaggcatgcagtggaggcttgccatgcaatcgctgaaaggttggagcgtcatctcaacctagggatagtcacgccaggcatagagacacatgaggtcatcgaacaatgccttaggattgtcaggggtgtcacagaagaccgcattgtgtatgtgag

SEQ ID NO: 60060 - DNA, 300 bp, Glycine max
  Peptide Sequence Number=SeqID_176838
atggaagcagaacgacacaagaaaagggacaataggcttacctcaatgaagaacgaaagctctcagaagaatgaaagaagaagaggcactcacaggagggacgaagaggcagcttgcggaagaagaatagccagattgcggaagaaccaagctcaactcgcggaagaacgaggctcagctcacggaagaaggggaatcgcgaaagaaggagaggaagaaggagaatggcggaagaagaaaaggctagtgcacaatttttataaaaaaatacacaggggtatttttgacttttcccattaa

SEQ ID NO: 60061 - DNA, 171 bp, Glycine max
  Peptide Sequence Number=SeqID_176839
atggacggtggcaaaaaatggaaccaaatgaagtctggaagatgggttcagaataaatgttgtgataaaaacaatcattcaactctcgaaagatgcaaattatttatccattccactacaccagctatagcctacatgtggaggtcaatgtatggacaacatcgtggttaa

SEQ ID NO: 60062 - DNA, 195 bp, Glycine max
  Peptide Sequence Number=SeqID_176840
atgggggcatacgcaaaggatgaggaactactgatacatttcttccatgaaagtcttactggggtagctgttacctgtatcagtacagttctaatatggcttcagataggatgcaactgtagatcatgcgcaaaaaagagcatgattccttcaaggaatatacccagaggtggagggatctggcaactcaagtag

SEQ ID NO: 60063 - DNA, 225 bp, Glycine max
  Peptide Sequence Number=SeqID_176841
atggaaaaatacttgccaacaccttatgttgggggaaatgtcttgaaaattatgaccaggccttgcttaaagggagtagaagagaagactgccaagttgaaaggaagtgagaaggctctagttgcacggcatgaagctagtcatgttgtagtaggtactgcagtagcaaaccttcttgctggacagccacatgttgaggcgatttttatcaaatacgatttgtaa

SEQ ID NO: 60064 - DNA, 249 bp, Glycine max
  Peptide Sequence Number=SeqID_176842
atggtcaacaagtcatcacttctgcacttggatcctaaatcacctgaagctcaagcttttaatcaaattggtcagaaatccaatggtggttctatcagtccttcgcccactacttctgctgaaggaagttcccagaatggtagaaaccaggggacagatgaaacggccacagctaagaagaatagcgcgtcttatatctggaagagattgttagaaagtttggttgcagttgcagggcttctaatttag

SEQ ID NO: 60065 - DNA, 447 bp, Glycine max
  Peptide Sequence Number=SeqID_176843
atggcttcccataagagaaaagccatagcttcagtgtctcaggccgattatgatagatcaagatttatatcacaggaggcccgggacggttactcagataatgtgcttgccaggaacattctgccagaaagaaatgtcaagttagagttaattagaagaaacaagcataaacaactgaccaacttgactaagggaagcattgatgtggcaattgttaaagaattctatgcaaacctatatgtccctgaggacaaagaaccaaagcaagttagggttcgagggcacctgataaaatttgatgttgattccctcaacacctttttggagactccagtggttgtggagcaaggggagagcttgccctcttactccaagtttgctagactgaggccttatcctcaggagcttgtagcccggctatgtatccctaggaagggatttacttaa

SEQ ID NO: 60066 - DNA, 333 bp, Glycine max
  Peptide Sequence Number=SeqID_176844
atgccccatgtatggcatctcttgtcaatgtcaggattcacaaggacccataaatccagggctagaagatctgaggccccatcttcttcagctgcccctactccccctacatcagctccatctacttctgctcttccttcaccactagcagctctagttcttccagagcctgcattagagccagctcctgatcacgcagagtttgcaggatatggtccagcagtggccagttatggagtatggaggagtttctttagaaggtggcctggccaggagtccaaccttctcctttgggagggggtgaggcctttacagcctaggatcctcagttga

SEQ ID NO: 60067 - DNA, 207 bp, Glycine max
  Peptide Sequence Number=SeqID_176845
atgcgtctaccggggaaggagagtctgctgatgggatcccccataaccataaatgagattttggatgttagcatttcgtttctaaatgaccatttagaggaaacaccgggttcgacaaaaatagaagaaaatcactcaaagtgtatcaatcttgcacagtgcggggcgagaaaaaaagtcgctagcgcacgggattttggtgggtaa

SEQ ID NO: 60068 - DNA, 259 bp, Glycine max
  Peptide Sequence Number=SeqID_176846
ggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 60069 - DNA, 426 bp, Glycine max
  Peptide Sequence Number=SeqID_176847
atgcataaggcattgcgattgaatgcccctttgccttatccttatcttgttacccttttccttcaacacttcaacatccctcttgattctgaaccttatgttccaatcaagagatcattccttataggcgcttcagtcatagcatcctttggttatataaaggagcatgatggctcttgggtgaagaagggtgctagaaatgttggtgaagaaggacatgagggagaagattcatctcttctttcgaagattatggacaggtttgatggtcttcaaacctttgttggtgagaggtttgacactttggaattgcaagtggatatgcgcttcaatgaaatggagtcaagaatcacaaaggttgaagaagatgtgtcttacattcgttcaagctttgatcttccaccaccgccgccaccatcatcttag

SEQ ID NO: 60070 - DNA, 812 bp, Glycine max
  Peptide Sequence Number=SeqID_176848
ggaacaaaagctggtaccgggccccccctcgaggtcgacggtatcgataagcttgatatccgagggtatgcagccttagcagcaccactcaccaagcttttgcgtcacggccaatttgattggagccaggaggctgatacggcatttcaaaacctcaagaatgctctcacggtggtgcccgtcctcgcgttacctgatttcagtacacccttcatggtggaaacagacacatcagggtcaggtatgggggcggtattgacactggggggtcaccctctggcttactacaacaagcaatttttccctaagttgctgaattcttctacctacgttcgagagttggcggcaatcacagcaaccgtcaagaagtggcgccaggagatccaatgtggtggcagacgcattatcacgagccatggagggtcaagctgcttctctttactatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccc

SEQ ID NO: 60071 - DNA, 234 bp, Glycine max
  Peptide Sequence Number=SeqID_176849
atggttcttggagcaagtagtccctttgaacttgtcaaagtccggcaccttgaacttgggaatgaccattgtcataccatcattgtgacaatggtccttgtgaggcccacttgggccctccagaatattcctccagaaggctgttgcttctggaggaagcaacctggctcgcctgggcgagctgagctcgcctgggcgagctgggcggcaaccacctcccctattttgctataa

SEQ ID NO: 60072 - DNA, 216 bp, Glycine max
  Peptide Sequence Number=SeqID_176850
atgatagaatgctggaatgagaggaagaggatgcacgaggagttacctgcagatggagcaaacgacagagaggcgaagaggcgcaaggaggcgaatcaagaggaggcgaacaaacaagaacgtgaggaagacttgtttagtctagttcggcagagaaatggaaactgcccgaacgaaaatttcatctatgacaaaatcgcattgtacattgaatga

SEQ ID NO: 60073 - DNA, 435 bp, Glycine max
  Peptide Sequence Number=SeqID_176851
atggaccctattgaaagggaaactgttgaagaagccatgtttcagtcagtcattaaagcatctctcgtggaagcagacactgatatcattgagataaaagcaggaaaggagttgatgatgtctaaagagcctataagggataccttgcctaaacaagaaaagtatgcacttggcatatatggagatagggaaccaatgatcaaggagttccctccaagacaggttgttgctcccaaccctaatagtctgatctttaagcatcagcctacaagcacaaagatgtatcctcctggtgcaagcatttggaaaattagagaggctgagatgcctttctctactcctttagatcttcaacagttgttgggtctcatgtgtgccctcaatgttgttcttccttgggatcacaccaagattggagaaatgtttcaaatatag

SEQ ID NO: 60074 - DNA, 186 bp, Glycine max
  Peptide Sequence Number=SeqID_176852
atggacaaagatacacttgggtgtagtgggcaaaggggttcgcggaacctaggaaaattagcgagtgctggccacctaacatttggtgcactcatttgggtgatcactcctgactgtcatccacataaaagtgtaagacagtcacgatctgggagggttggtggcaatggttgcgtcttattgtga

SEQ ID NO: 60075 - DNA, 300 bp, Glycine max
  Peptide Sequence Number=SeqID_176853
atgtaccacaacaatggtaaagtgacaaaatcttcaaatcttagattattctacacacatcatgtggatcttatcattgaagaagttgaatctgatgttaaagataaagctacttctacttctatggttgtccaagtgtatgatcctcaactcgcatgcgcttatgctagtctacttgatggtaaacatgtcagaaccagagaaggtcttgctcaagccttgaaggatcattgtgctggtgaaaaggaggctcgcaaatggttcgtgattaaggaatacttcaacaagataaatggatag

SEQ ID NO: 60076 - DNA, 942 bp, Glycine max
  Peptide Sequence Number=SeqID_176854
atggggatgtttaacgcggcgtcgatgattggtctgtcggtggcaccgccgattctggcggcgatgatgctggtgatgggctggcgcggcatgtttgtcaccatcggcgtgctgggtatgtttctcgccattggctggtatctcacctatcgcgaccgggataacaacaaactgagcggtgaagagattcactatctgcaggcgggcagcgtggcatcacgcaaagagccgctgagtttcgccgagtggcgtgggctgtttaagcagcgcaccatgtggggcatgatgattggcttcagcggcatcaactataccgcgtggctgtacatcgcctggctgccgggctatctgcagtcgacctatcatctggacctgaaaagcaccggcctgctggccgccattcctttcctgttcggcgcggcgggcatgctgctcaacggttacgtggtggatgcgctggtgcgtcgcggtttcgacgcggtgaaagtacgtaaagtgtcgattgtcagcggcatgctgctctctgcggcctttaccacctttgtgacgcgcgccaccgacaccaccagcgcggtaacgctgattggtatggcgctgttctgcattcactttgccggtacctcatgctggggcctgatccatgctaacgtcacggcgcgcatgacggcgtcagtgggcagtatccagaactttgccagcttcgttttcgcctcttttgcgccacctcgcgctgatgatatgtgcgggcgtcacggtggtcggcgcgctggcttacctgctgctggtcagaaaaccgatcaccgatggggtgtaacaccagggtttctgcttaatgctcttctctgggtgcgcaggttatgcgcacccttgcttcatccgcccgccacacctattccagccgccgcgttatcgcctgagtccgggtctgatcagataaattaa

SEQ ID NO: 60077 - DNA, 153 bp, Glycine max
  Peptide Sequence Number=SeqID_176855
atggaggttgaggaaccttttctaggattatggctaccattgcattattgggtagatataggacaggcaggttttgtggctgatttaggggtggcctttgtggatgattgggtgttcttggctgatagggtggtgggtaatgagaagggttga

SEQ ID NO: 60078 - DNA, 821 bp, Glycine max
  Peptide Sequence Number=SeqID_176856
atgccatcaccttcagcgggctacatgtcctcgccttcagatggctacatgccctcacctttagagggctacacgtcctcgccttcagagggctgcacggcctcgccttcagagggatacacttcctcgcctttagagggctacatgccctcgccttcagagggctacacgccctcaccttcaacggaccgcacgggactacacgtcttctcctttagagggcttcacgtcctcgcttgtagagggctacacatccccgccttcagagggcaacacgcccttgccttcagagggctgcacgccctcaccttcagaggactccacatcctcgccttcaggggactacatgtcttcacctttagtgggcttcacgtcctcgcctgtagagggatacacgcccttaccttcagagggctacacggcctcgccttcaaagggatacatgcccttgccttcagagggctacacgcccttgcctttagaggactagatgccctcaccttcagagggctacatgtcctcgccttcagagggctggacgccctcaccttcagaggactgcacgtcctcgcctttagagggcttaacatccttgcttgcagagggctacacgtcctcgcctttagagggctgcacgctctctccttcagaggactgcacgtcctcgccttcaggggactacatgtcttcgcctttagagggtttcacgtcctctcttgtagagggctacacgcccttgcctttagagggctgcacgccctcaccttcagagggctacacgtcctcgccttcagagagctacacgccctcgcattcagagg

SEQ ID NO: 60079 - DNA, 270 bp, Glycine max
  Peptide Sequence Number=SeqID_176857
atgacgaaggatgcgatccacgatgtcattttagcttcaaagacatggctatttatagaaaagagccaagaggtgcaagccaattcgcccgggcaagttgtagctcgcctaggcaaattgttacttagtgctgaaggcatagattcgctgatgcaatcctaccccacaagggcattggatagaagactccaagaagattgtgccagagatgcaagagaaggccttagggttctcatgagccttagggtagatttcgggcccatgagctaa

SEQ ID NO: 60080 - DNA, 303 bp, Glycine max
  Peptide Sequence Number=SeqID_176858
atggtggtcatcctgcccaaggaacacttagttgtctggttttcttctttgcataacaggccagacaactaccttaaagagattattaatagtgctttaaaaggtcttaatgatgctccacagcctaaatcaaaggcttctgctaggtggattgtcgtcaagatgtccaccatcattttaggaacttttaggaataattgggaagcgtattttaacgatcctagaccattggagccagagagattaaaggcattgcgaatccagtgggcacaattttatctccgagttagagatcaggcctag

SEQ ID NO: 60081 - DNA, 891 bp, Glycine max
  Peptide Sequence Number=SeqID_176859
atggatcccataatttggagcaaattgccacccgaaatcctcgaatacatactctcttttcttcctctcaaaaccttcttaaacctaagatccacttgcaaaggtttctggtctctcatattctctcctcctttcatttcgaaacactgttctcccactgcttcttcacccttctcttcattcctcttactctcacaccctcaattccaccgtcacttccctctctacgattgcacactcggcacgtggcgcaatttctctctctcactctctgattcattccactcttttccttctttcagcactcttatctcctctggtggtctcttttgcctatcagattccacatcatgttccttgctcgtgtgcaaccttttggccaagtcctctagaaagattcaatacccaagtttctctcttcacttggagcatctcacttttgtcaccaccccaactgggtacaccatatttgttctattttctgaggctgcctcaaactgtgcctttgtttatgactcaaaggttcaaacttggaaacgttttcgcggttttgctccggttctcggtgacaaccatcagcaacaaggtgttttgttcaatgggggtttgtattttgccaccccagaaccgttttctgtggtgatgtttgatttgaagagtggaaggtgggagagacccgtttgggagttaccgagtcatcacctcacttttgttcgattggtgagtgatggagggggaaaattgtacttggttggtggggttgggagcaatggaatatcaaggagcatcaagttgtgggaattgggtggagatgggaattattgggtggaagttcaaagtttgcctgatcttatgtgtaggaagtttgtgtcagtgttgggattgtgttag

SEQ ID NO: 60082 - DNA, 306 bp, Glycine max
  Peptide Sequence Number=SeqID_176860
atgaaatcaaaacactcgtttaacaacttattacacacacatgcattgatatccaaattatgtgtagctcttttaacaattcaattagttgaccctcctgcagttctcccttatttctccgcgggagccagtgaggggactaatgtctcccatcctgatcatggcggcggagaaatcggcgaaaaaggaggccgggttggtgctgtagagttcttggtcggaatggatgagacccttcttctgaatgaggttcttgaagtagtggttgtcaaagaaagtgggagtggcaaagtcaatgggtgcaag

SEQ ID NO: 60083 - DNA, 327 bp, Glycine max
  Peptide Sequence Number=SeqID_176861
atggcgacagggccgccgacgggtgcaggcgaggtccacgtgcttccacgacatagggtagagcttcggcatacagtagtagtggttgtagaggagctgccattctactgtgacggatacgtttgccattgttggagtacaaagagacagtggaatgaaatttttcgcaacctacccttttgcgtgcgagcgaggcgaggctcagggtcgacaaaagtggggctcttgctcctatgtaccctccatcgaagaggaaatcagacctacgtagttctttctaaaggggcgaatcaagtgattctttttacttggaaggtggtcatttaa

SEQ ID NO: 60084 - DNA, 582 bp, Glycine max
  Peptide Sequence Number=SeqID_176862
atgtcagggaaaggacctggtttcttctctgagatcggcaagagaggcagagatatcctcacgaaggattacaattccgatcaaagattcaccatctcctcctccaccaactccggtctcgacctgaagtcaacactggtgaagagtagaggactttcctctggtgatgtggctgcagaatttaagtataagaacaaggcggttaatgtcaaagttgatactgaatcaaatgtgttgacgacattcactgtctctgatgttgtgccatccgcgaaaaccattgcttctattcgtctgcctgattacagttctggcaaggttgaggttcagtatcttcatgagcatgttgcttttactcttggtgttggtttagaccgctcccctgttattgatttttctgggacgatgggtactcctagcattgcctttggagcagaaaccagctactccacaagtgttggcaagtttatgaaatacaacgctggtctgtgcttgaaaatgccaagttccaatgcttcaatgttagatcagtacatcaaatgcatatttgcaaagccaagtatttatggatggaatggttaa

SEQ ID NO: 60085 - DNA, 510 bp, Glycine max
  Peptide Sequence Number=SeqID_176863
atgacaccgacaccagacatgacacggacacagatacatggacacctgtcaaacatatcaaactcaaccctaacaccgaagtcggtgtcgtgttggtgtcggtgtcgtgttagacaccagatacaacaagggaccggactgtattacggatgggtcaaatgcaatacggacggggctactataggatctcccggtgtagcaggttgtggtggtatctttaggaatcaccacacaaaaacttttgcagcagttatagctattgagactgcctgcgagaagggatggaggaatttgtggttggaatgtgattcaatgctggtggtgcaagcttttaagaatgagaatatagtgtcgtggaccttgaggaacagatggaagaatgctatcatcaagactagagatatgaaccttgttgttgggcacatataccgtgagggcaacacttgtgcagatagaggtggtgtcaaagattatagtaaccttctagccttgacattgcctttgttttaa

SEQ ID NO: 60086 - DNA, 231 bp, Glycine max
  Peptide Sequence Number=SeqID_176864
atggcggtagtggtggaggttgggaaggtggtggagaggatggaggtggtgatggtatcggagccaagggttgtggcgaaggttcaagagaggcaggatgacaccaaggttggagaattgcgttgtaatggcattctgcgtagaggtgaaattgctcattctcttatcgttagcattctacaaaggactacattgcttggccaaccatgtcttgaacatgatcatgagtga

SEQ ID NO: 60087 - DNA, 1083 bp, Glycine max
  Peptide Sequence Number=SeqID_176865
atggaggaggattccaagcatgccttaatagttaagggtctagtggtcgctgaacaacaaaagtttagcaagactaacctgaaggctatgaaggtggccttggaacaaagcttaagggaggctccagaagtggatgtagaagccaccaacatgagaaaacaaaagaggttggccaagtccactgctaatgaagaccttagtctagatagctttggcatttcaatgaatattaacaagatcatggctgagaccgaaagaaggcgtgagtctgctgtgtttgctcctatgcatccacccatagtgaatctagtcgcacaaaggttgaaagacttgagtgagaataatgatgatgatgaagggctggtgcaagtggccctccaaaataggaaagttgttgcttctaatgttcctactcccaagaaagtgaagaaagctcaacctattgctgaaccaagagcatctattctcccctctgccattccacgatggattaaggcaaaggaaaccatggctaatccaaagattggtgacaatgaatgggttgtttctttcaccagaaacaagaaagatctagccttttcctcatcaaataatgagtcgacaaatgacacttcaatcatgctcctctgtaagtctgcaccaaacactcaactacgtccacctttctctcctctacacttggaaaggttcaaaatggaagctccaagcgagccattattagatgctcaaagcttccccctggccttcattcatgataaccctacacgtgtcacccctttctatgaagctatcttctctaaactagtggttagagatattgtatttgttttagcaccttcatggatgcaatatgactatctgcactcttcatttgaggcctttaaggctctaccattagatgccatttttcatttaccacctccaacatggactcatccagtgcagctatttgttatcaagatgcctcctcattggctagcacccaaaactcaatacaaagaaggtacccactctttgcaagaaatggaacctcccaaggtacagtttgagaagatggtgcacttgtggagcccaattacatga

SEQ ID NO: 60088 - DNA, 372 bp, Glycine max
  Peptide Sequence Number=SeqID_176866
atggcttaccctactagtctgcacatatctagggcaactggcatcaagatggttgctaatagagtctgtctaagactactagtatgggatgctatcaagaggaaggggtttgagctatactacaaggaacaaatgcctctaaggcagatgaagaagagggatgaagaagttgttgttgctgccattactgagaaagaagttactgccaccatccaagctaaagcatatgctaaagctatggacaaaaccattgtgtgcagggtcatcattgatcttacaaacactggtgtcatggacgggactggtgaagtgtccaatgtagctatggttgatgaagttgaaccacccaatccaggtcctgcctccaagtag

SEQ ID NO: 60089 - DNA, 201 bp, Glycine max
  Peptide Sequence Number=SeqID_176867
atgcacaacaagaaaagcaaagtggagcacgatcagaactatcctgaagaacgaacaaaggtgaagatggaagagatgaacgatgatacaaaacatcaatgggagttggcaatggttgatcaaaagattacaaccatcacaaaaataagtgtcttcttctccaggcttctcccatcgtttcctcaccaaattgaaacctga

SEQ ID NO: 60090 - DNA, 252 bp, Glycine max
  Peptide Sequence Number=SeqID_176868
atgagaaccagactgagtagagttgtgagtgacaacgagaacgagagggtgagagtgatagcaagagtgagagtgagaacaagagcacgaagtgagaacgagaacgagagcacaaagcgagaacgcagcggtggcacgatgagcacgtcatgtcgcgaggagttgagtcacaatgagagtcgtgaggaggaggagaatgggagttgtagcgccacgaggaggaggaagagagtgagagaatgtgagaactaa

SEQ ID NO: 60091 - DNA, 392 bp, Glycine max
  Peptide Sequence Number=SeqID_176869
gggagaccgcagataaagcacagcaggttccagcaaaccatcgtgagggccgagagcacgccgcctgccgtcaggaccagcaggaccagcagcgcggtgattacgcccggcggcatcatatcgccctgcatcatgcgggtggcaaggtcatacgtatagagctggctgtgggtcatgagggttctgacgatatcaggcccgaactgccacagcacgaccgcgctccaggcaaaaaacagggtaaaccagacaataagggtgcgtgccgcaccgctgaacgtgagcatgggaatatccttcagagagttaagaacaggggggttaagtacagtcgttacagcgcaattcccgacgcgctcagcgcgcagcaaaccgcacgcggagcgagataa

SEQ ID NO: 60092 - DNA, 393 bp, Glycine max
  Peptide Sequence Number=SeqID_176870
atggatctgcgtcaggcacagggcttcctgtcctccggctacgaagggggcgtgctgggtgccgcgctgggcagcgggatcaccgcctataacagcacctctggcggagctatcctcggtgtcggtcttgctaccggcctggccggtatggccgcagatgcactggtagaggatgttaatttcacgatgcaaaactgccgtaaccacggacaacgtggcggcgctgcgtcagggcacttccggaatcaaactgcagaccagcagcgaagagggcaaccgcatgaaataccagaccccgtggtgtcaaacgcgaacaaggtcaacctgaagtttgaagaggcgaagccggtgctggaagcgcagctggcgaagtccgttgccgggatcatgtaa

SEQ ID NO: 60093 - DNA, 1206 bp, Glycine max
  Peptide Sequence Number=SeqID_176871
atgaaaatgcaactcagcaagcaaggactggatcctcagaatttcagcttctggccagcagtgttagctaagctcttgcattttgcttcagtactagacctagcaaccggaggccggcataatccacatcacaaaagggaaatagaaggattggttggtgcaatggtgctggctgaagaagacaaccatgagatactgacagacattgttgatggggctgggagaggaggatgcagcatgttgtgtttgggagttaaactgttaaaattaagcagccttgctgtattagttatcaacaagcctaaagaagctgatagaaagactgttgggattattagaaaatttgtgggatcattgagtctttctgagccttggacccgggaactcatggtccttgggatgcctgctttatctcctacaatgacccaaggtaatattgctaaatggaggaagaaagaaggagaaaaggttgaggatgaaaatgacatccaaaatgttcctgcttccgtggggggtgagactggggttgaagagaagaaaccaacacttgggggtgtctcagatgagaggaaatcagaatcaacttctagtgtagttaatgcatcagaacttccacctcatctccttcttgaaatgccagctttgtcaccgacaatgaaccaaggaaacattgctaaatggaggaaacaagagggagacaagatagagacagacaaagctacacttgaatttgagagtcttgaagaggggtacctggctaagatacttgctccagaaggttcaaaagaagtggcagttggacactctattgcaataacagttgaagatgcaagtgatattgaagctataaagaattctgttagcagctcaacaaaccaacagaaggccccccaacgtggcactaaaagcgaggtcaaagctcagaaaaacaatataacacgtattagtccagctgcaaagttgctaattgcagagtatgggttggatgctccaacattaaatgcaactggtccttatggcaccctactgaaaggggatgttctatctgcaattaagtcaggaaaattgtctccaaaacctgcttcatctaaagaaaaggcattgtcatctcaaagtcatcaacaagttgcagcttcccaagagtcaaaatctgacttaaaaaagtcagatgcttatgaagattttcctaatagtcaaattcgcaag

SEQ ID NO: 60094 - DNA, 120 bp, Glycine max
  Peptide Sequence Number=SeqID_176872
atggccatgtctgtggcccaacaagtcagggccaaggtcccattgtcttggagaaaaagtacttttgctgacttcatctttcgtactggttcaagcctgaaagggttctggggtaaatag

SEQ ID NO: 60095 - DNA, 748 bp, Glycine max
  Peptide Sequence Number=SeqID_176873
gtggtctactagctgccttacttctgcggaagaacttgccggttccccgatttgcgttgcctccgccagctgctgtaactcagggatgcttgggggtgtctgtgctagacagtcccaccatatcgcgcacccaagatatagcgctgctctctggtcttgacccacggcgagctttttctctcgtaatgccccgtaggcctctctcgggtgacctaagcatttggtacttcgatcttttattaggttggcgccagggaagttggatgtttttctctatttatcatcactacgggccatatggccagatcgacgttgtcagaataatagtgtgcccctttgaaaaggatgaatgccccacccatgtgatatctgctaaaggcttcgtcagtgaggcactctatgttctcgttctcggtgctccggtcaagggcttgacctctgatgtatggaagtacgtggttgaagtgaattcctcggaaatgcagccggagggcaatctctcttttgacccgcatatggctatggttcagatacagactaaagactttctttcgtgctttgatctcagtggaagtagacttttcaaaatcttccggatagtcaccgcgccattcatagccatcaggaaactgccctcttccctcaaagatggtccgtcttgcttctgcttgatggaaactagggttcaagttcagacttttcgaaatcaagacatggcgggggcaggattcgaacctgcaatcttcag

SEQ ID NO: 60096 - DNA, 237 bp, Glycine max
  Peptide Sequence Number=SeqID_176874
atgaccggccctttcaatgagtcaatctcttgcattctcataagggtggacccttgggtacacgtcctccacttcagaggactacacgtcctccacttcagaggactacacgtcctcgccttcagagggttacacactctcgccttcagtggactccgcatctgcaccttaagagaattgaagggattgcgcccgcaagacacccagtggacccaaagaagtccagcagggtcctag

SEQ ID NO: 60097 - DNA, 198 bp, Glycine max
  Peptide Sequence Number=SeqID_176875
atggcaaggattcctgacaagattaagtctattgatgggtcaagagagatgcttaagcttgctgtgagagtcacgaatctttggttcgttgggactcccaacaagtctgagcaagcgaaaatgattattgttgattctgagggttatcaaattcatgttgtttgtaaagcggaccagctaaagtcttggaaagcttaa

SEQ ID NO: 60098 - DNA, 239 bp, Glycine max
  Peptide Sequence Number=SeqID_176876
aatgttgctgctgtcttgtggtcactatgcaccggagatccactgcaattaaaactagcgaaagaacatggtgcagaagcagcactgcaggagttgtcagaaaatggaactgatagagctaagataaaagctggaagcatattggaactcttgcagcgaatggaagggggacctgctatcaagtcagcagcaacagcagaaccaggtagtcaaaacggaaagaaattggaaggtgggag

SEQ ID NO: 60099 - DNA, 987 bp, Glycine max
  Peptide Sequence Number=SeqID_176877
atggctcaacgggcggcaaaagaaaatctcacccttgatgccgaccagctcgcgttggttgccaacttgcaaacgctgagccagcagttattccggcagcaaacggcaatacaaggattgtacgtctgggggcgaaccgggcgtgggaagagctttattctcgatagtttctttgccagcttgccgctgcgtgaaaagcggcgggtgcattttcatcactttttccgcgaactccatcagcggctgaacgccccttcggcgccgcggttgcaagaggtcgtcgcgcaaatgaccgacaactgtcgtctgctctgttttgatgagtttcatcttcatgacccggctgatgcgatgttgataaaggtgctactggagcatttgttcgcgcgaaatatcgtcttattagcgacctccaattatccccccgaccgtttgctggcgaatccgctctatcacgaacgttttttgccttccattaacctcattaaacgtcatatgacggtaacggcgctcaacggcgaacaggattaccgcgagcgacatgcctcgctggagaatgatttctgccagggaaaactgttggtgcagccaacccccagtactcgcgcgacgctcggtttgccggatattgccctgcaggcgcaggctctgcaagtaggttatcgcaccctgcagacggcatctcggcaaggtgcttttctgcatttcactttcgaccagctctgccttgcgcctacctcggttatggattacctgacgctatgtgagcaacaccagaactggctcgtcgagaaggttccaccgttggcgcgagttagccctgcggcacagcagcgctttatcaacgtggtggatattttgtatgaaaaacagtgccgcttaattttaattaccgattgcgggctggaaacactggtggcggatgtggagctggatgatattcaacgcacctacagtcggttacagcagctcgctcgggaagcataa

SEQ ID NO: 60100 - DNA, 390 bp, Glycine max
  Peptide Sequence Number=SeqID_176878
atggtaactgggtttgatatagtaagcaaatattctagacatcttctaaggtggggaatatgtgtaggtctcccatcgtgggcaacaaaggtggtgcatctaactattaacatcctggtactactacttatttttgtggatgtgaaatctaaccggcaagtgcaccgggtcatcaagttaattgggcaagctttggaaaagcgagcatccgctaagcgcaacattcctgggctaagtgcgaggaagaatctagaagaagatgagttgtacaggtttgctaagggcaccgcttcatctctctatgcgcatcgcttcagttcatccgctaagcgagaaaggcgcgcaaagccaaaaatcacttgttggatcaagtggcctcgaaataattaa

SEQ ID NO: 60101 - DNA, 192 bp, Glycine max
  Peptide Sequence Number=SeqID_176879
atggagggaattgacgtagtcgggatcggttctacaatctcccacaaatttacagatgtcctccacccctggggaacacgagggggacctgcaaagggcttcgacgctcaagatttcctggaagagcagtctgcacagggtagctttgtttctcatggacgtcagaatgtattgattactgtcattgggtga

SEQ ID NO: 60102 - DNA, 669 bp, Glycine max
  Peptide Sequence Number=SeqID_176880
atggcagatgcacctagggcacagaagaacccaattatttgcttctgtttggaaaggttctttgtttcctcagattcagtattgagtgcaatcagggtaactgatatggtaaggacgattatagagtttaagatcaatgcagtgaacttttgggaattgatgaagaaagtgagcactgcattgaagattaattgggatgcacatactagtgcaaaagtggaaagaggaagatataaaagtgcacatgcatacgtaaggtccatagctgctatcattaagccgaaaactaggtacaagaaaaatgtgatgggaagttttggtttggttttggaggggttccaaaatacaggaaagtatgttacgagaaaaatttaccatatgttgagaggggataagcctaaagtgacatggagaaaaatcttctatgggaatttggttaggctgagagctaagtttattttatggatgacttgtttggataagcttcccaccaaagatcgcctccatcgctttggtgtggtcactgacagtaaatgtgttttttgcgggttaattgagacatgtgatcacctcttctttgagtgtgctaccactaaaaaagtttgggcggatatccttaggtggattagcattatgcgtattcctgggggctggcattcagaattgtag

SEQ ID NO: 60103 - DNA, 267 bp, Glycine max
  Peptide Sequence Number=SeqID_176881
atggtaaccgttgatgggcccgttgctgctccccctaagttccttgtcctttctttgttgcatttcctatgccttggggaccctctaaagcacccccgcgttggagctattgaaacctcgtgtaataaaaggagtaaagagggaggtggttgccgcccaactcgcccaggcgagcagggttgcttccaccagaaggcaccgtcttctgttggaacccctggaaggcccaagtgggcttattgctatttgcacccccctttttactaa

SEQ ID NO: 60104 - DNA, 363 bp, Glycine max
  Peptide Sequence Number=SeqID_176882
atgatcgtgggtacaattggtggccttgtgggattgcttgtaagtggagattggagaactatgggaatggagatgaaggaattcgaaaacggtagtgtgtcatatgtaatgactctggtttgtacttctgtgacatggcagataggttgtgttgttgtaataagtaatctggaattgaccatagctcctatccttgctgttatggtctttcatgacaagatttatggggttaaggttatagccttcttgttagctatgtggggatttctgtcttatatttatcaacattatctagatgatcaaaaggccaaggaagataaaagtgattgccttgagattttaaaaggaaatggagaaatttga

SEQ ID NO: 60105 - DNA, 569 bp, Glycine max
  Peptide Sequence Number=SeqID_176883
atggggggctttccagagccaaaaggtgatcatgtggccaggaaccatggcaggtccaagaaaggagggaatcccgaggatcaagatctcaacccagtgagcatagggcgcgacgaatccaatgggtgcatggtactcatggtggacgcggtgaatcttctcgtacccccaatcgttgtgcagaaacctatggatccagtaattggtgtaatcctctacgagaaaaaagataatgagttggaaggggccgacgacgaggaagaacatgtgcatgatgtctttgtagcacttgaaggtttcggtgagggacaagtggacttttggttggatcttgtgggaagagacgaaggagaagcgcttgaattcgaggaagacgagggggagggggacaagggaaaagacgaggaagaggaagaggaacaaaatgttgtggcagtagaggaagtaattggacttggcggcggagtagttgaaccagagggtctccgcgaaggggagcatcgtcactgcaaccctaggattgcggtgtgtgatttttgcggacgtggtggatgttgcgctggatgctt

SEQ ID NO: 60106 - DNA, 387 bp, Glycine max
  Peptide Sequence Number=SeqID_176884
atgacaaacaaattcatgacagatccagtaaggatccttgtaaaacgtgatgaattgacattggaggtggactggttaactgaaaaaatgcgtaacaataatttcactgtctcatcaatgcatggtgacatgcctcagaaagaaagagatgctattatgggagaatttcatgctggaacaacccgtgtactaataacaactgatgtttgggcccgtgctcttgatgtttctctagttatcaattatgaccttccaaataatcgtgagctttactacattcatcgaattggccattctggacgttttggaagaaagtcacttagtctaattttcatatgggaaactgtcttgcactttaggacaattcttagagaacctcagctttaa

SEQ ID NO: 60107 - DNA, 843 bp, Glycine max
  misc_feature (811)..(811): n is a, c, g, or t
  Peptide Sequence Number=SeqID_176885
atggcagaatcatccaagaagtgcaaggtttcatccacctccgttgcggcacatagaacatcacgtcccagagccaccggagcatccccgacaccaattccaccatccttgtcatcttctacactattttcatctgatgaaaaatgtatccagtattcctctctctttcaatctcatcaaattcttgatcccaaatatcttgaccttgaattctttgatggggaaatatttgattgctatcaagtgtttcaaaacattggtttgattccttttatgtcattaaaattaccatattatcctgagttagtacgagtcttttactcaaatttgaaaattcaagatggaactttaatttctgaggtgcatggtatccctatgattattgatgaatcacttttcttttctctgacacaactacccaatcagggtgcaccttttgagggtacccttgttgacaacaaaaagtttgattactcctgtcatgatgcccgccgcatggtctgcattgaccaggtggatatgaccggcagactgcttgccgggtcattgacatttgattgtcgcatcatgcactatatcattgttagaattttgatgctccgttcttctaatctcgctcaagcctttgaggaggacatgattctgatgtgggctttcttgaccaattgtccaatcgactgggcccatttgattcgttaccgcatgcataaggcattgcggtctagtgcacctctaccttactctcaacttgtgactttgtttcttcgactttttgaattcctttggattctgagccttttgtgcaagttanacgttcctttgctattggtgtcgatgcggtaa

SEQ ID NO: 60108 - DNA, 306 bp, Glycine max
  Peptide Sequence Number=SeqID_176886
atgaagatgaaagcaaacaaaacaagaaatgaatcgaaagtctcggattcgaacacttatcggttgaagaccgaagaatggacaaagaacagcggaaaaccttcatggattggctcacggaaaggtcttggaggcgttacaaaagcacctcgccttggattttcttcatggaaaacatgggtggtgcttgccgcccagctcgcccaggcgagctctggtcgcccaggagagttgggttgcttccttaggaagtttcttgatgcatccccaaaattactaatttcacccccctttcatactttatga

SEQ ID NO: 60109 - DNA, 438 bp, Glycine max
  Peptide Sequence Number=SeqID_176887
atgactattgaagaatcaattcatgttttctttgatgagactaactatattaggcaaagaaaggatatacttgatgatattacagatactttagaagatacgcatattcatgaagaagtccacaaagacaaagaagatggaaatagcatagattctcaatccaaagaaaatcaaataaacatggatcttcaaagggagtggagaacttcaaggtatcaccctcttgataatatcacaggtgacatcttaaaaggggtgaaaaagaggctaagtcatgaagtgccgaaacgcagcttcaacgcgatagaagaatatggcagggcatcagcatcaaggtcacgcgctaagcgtgagatcagtgcactaagcgcagcaggtgtcttcagccaggctgagcgcacgactggcgctaagcccgaatccacttacttgcgctaa

SEQ ID NO: 60110 - DNA, 606 bp, Glycine max
  Peptide Sequence Number=SeqID_176888
atgacaggtgacaagtccaaacttactgactttgtgtcaaaggaaggaggatatgtcccttttggagacaaaaataagggaagaattatgggagaaggaaatattggaaatcagcacaagacacaaataaagaatgttttgtatgttgatggacttaagcacaatctcttgagcataagtaaaagaataggtaatatctacatgcttaatattgaacatgcctcatttcatgaactaagttgtttggtaagaaagattgatgattcttggagatggcatcgtaaggttgtacatataaacattcatcatctcaatcatctcgttaaaaaggacttagtaattggtattccaaaactcaagtttgagaaaaatatattgtgtggagcatgccaaaaggggaaacaagttaaaaactcttctcaaaaaaattctttggaagatgaagatgcaggttttcaggataaggatactacacttgaagatgaaaccaaagttgaagattttgaacaaagtaaggaaatcactgctatacctcataaagacctcccaaaagaatggagaactcaaagagacctctccttggacaacattattggtgacatataa

SEQ ID NO: 60111 - DNA, 198 bp, Glycine max
  Peptide Sequence Number=SeqID_176889
atgcagagtaagaaaaaggatttagagctggaggccaatgcattaattttcgtgggaggaaaacatcaggttctgaaaatcttcaccttgccatgtaggtttccgttgatatattactgtatgatgaagctactaagctttgcggtgggtgttcttcctgatcatgttcccaagttgttggctttgctatcaccataa

SEQ ID NO: 60112 - DNA, 936 bp, Glycine max
  Peptide Sequence Number=SeqID_176890
catcctttccaagcttcttatccaaggcttatcttggtggtgaatctccttcttccatggcttattcaagatgaggctactacttcaccttcctctagtgaaagtgaagaagcaaaaggggaagaatctagtgaagaaatctacccccaagaagaaggacaacctttaatgacaaatattaaagaagcttcccctcttagacaacctccacatcttctcctttgtaaaaagacacttgttagcactgccacacctcttgggtttgaggttattcctcaagtaaatgagttattggatgaagaccctaagagaataaaggtcattcctgattggcctacttcactaagtataagggaaatctggggctgccatgacttaacaaacttttacaaaaggtttgtcccatatctttctatacttgtagcaccactcattgagttggtgaggaactatgttcccttacgggaagatgtccatgaaaggggtgtcgagggaaggatcccagagtatgaagaacctcaggatttaaggtcaaatcctttccaaggtggaggggatgatgcaatcctacccccaagggtattggatagaagactccaagaggattgggctagagctgctaaacaaggccctggggttctcatgaacctaagggtagatgttttgagcccatgggccaagaattttgacaccatgtcccttaaagaacttgttggaactcttgaggttcatgaacaagataaaggacttaagaaagggaagtctctggctcttagtgttcaaaagaccaagaaaacatcatcgtctgagtcatctttaaaattaacgtccaatagcttgtccagagctataagtgtagaaagttcctctgatgaagaatctgaggacaagtctgatgaagatgatgagcttgctttcatctcaggaaagatctag

SEQ ID NO: 60113 - DNA, 603 bp, Glycine max
  Peptide Sequence Number=SeqID_176891
atgatgcagagccatgccttaaaggtggtcgcccatctagacaatctaagtctatattcagaaaatgaaaatattaaattgagtcatggcaacacccccaaggtcccctccccattcatcagatccttcaaagtcttgactgtaagagacttggttcagcccaggccaatcgttaacgtcaatcctaccactgggagaggtttaagcccacataaagagaaattccatagctatttgggggtgggaaaaattgatatctcagaagcatccaatgccaagaaaaggggttatgatttgcttgacaagaacctcatggaggagaaaaggaagaaaagaaaagaggaagtaattttgattgaggattcaacaatgattgttgacccttcatctcccattgaaagacatgtgaagttgaagttgacccgcagaaagctatatcggcagatgacatctaaggactcattacaagagcagatgacacaagaccactttgttccccatggtcgtgaggatatacttaatattggcattggacgattagagcacccaggtcgtgtttatgctgcgggaggtggtgtgacaatcaaccaatactttggatag

SEQ ID NO: 60114 - DNA, 525 bp, Glycine max
  Peptide Sequence Number=SeqID_176892
atgaaagtagagttaaaggaggccataaagaaggagtttagccaaatggcatcccaacactcaccccccattgaggcagatatacaagtatttggttcatgtgtcatcacaaagggaagttgtgttgatactgccatcaatccatcaagggaagaacatgtcgctgatgtgatgcctactatggggttgtatgttcaagatgatcattctacctgcttggtggccttgggaaaagtatatgagggagtgtccaccatacacaacttgccttatgtagatgatgtgattaaggtgagtgttggaaaagtttacaaaggtaacacccaagtcctttttcccacattagagattcagtttatgaatgagtcgagtataaggttgggtcatggtttcgtgtatggattccttgagtttcagtccatacataatgcaaaggatagacacgatgaatgtcaatattacattgaaacatgggtgaaggaacataaaatagaggtctacctaagaccttacttgaaaaaataa

SEQ ID NO: 60115 - DNA, 1173 bp, Glycine max
  Peptide Sequence Number=SeqID_176893
atgacagaagagtgcaccgaaacagaactcactcatcagcaacctcatcaacgtccaaggttcagaaattacaaacgttggtggcgtgtatccctatacatatttcttgctcttggaggccaatctgcagccactcttttgggaaggttatactatgacagtggtggcaatagcaaatggatggcaacatttgttcaaaccgcaggattccctgtacttcttccactatttttatacttcccaacaacacatgacaattctagtaacatgtccaatgataatttctccgaaaccaagccaaaactctacactcttgttttcctctacatagttttcggcttaattgttacagcgaatgacttgatgtattcctatggacttctatatctccctctcaccacctattctctaataggtgcaacccaattagtcttcaatgcagtgttctcttacttcctcaatgcccaaaagttcacagcattcatagtaaattccatagtcctcctcagcatatcagtttcgcttctcgcgatcaacggcgaatctaacgacccaatgggccactctagcaaagaaaagcatatgtatatgtttgggttcatttccacccttgttgcatcagctacgtttgctctacaccactgtcttgtgcaggttgctttcgagaaagttattaagagacaaaccttttcagttatcttggacatgcaactttacccgtccctggttgcttcgtgttgttgcgtcgtggggatgttcgcaagtggagaatggaagagtttggatagggagataagggaatacgaagatggaaaagtgtcttatgtgatggttctgttttggaccgccgtgacatggcaaatatcatgtattggtctttttggattgatttttgaggtgtcttcgttgttctcgattgtaatagatactatggagttgcccatcgttcccttccttgctgctattttctttcatgacaaaatcaacgcgatgaaggttatggctttcgtattagctttgtggggctttctctcttatgtttatcaacaatatcaggacgacaaaaaagccaaggcagatacaaatacaagtgatgatgatgataattttgttgggggcttgaggttacaaggggttgaagaaatgaaggaattacagaccaactgtttgtga

SEQ ID NO: 60116 - DNA, 411 bp, Glycine max
  Peptide Sequence Number=SeqID_176894
atgaaaactgctacttctcgacccacttttgaagttcaaaacttaaaccctagttctctctctctctttcttctgcatcttcaaccttggcaagggaagccacagctgttgagcaacatcaatgcctgcactgccgtcgttgacatcgttcgcaccaccctcgaccctcgcggcatggacaagctcatccacgatgacaagggagccgtcaccatctccaacgacgacgccaccatcatgaagctcctcgacatcgtccaccccgctgcaaaaatcctcgccgacatcgccaagtctcaggactctgaggtaactttaacttcccttcgatctcatgcaatgccactgctttcaagatctgttcattttcgcttcattcagatgctttacactgtggaattggaattttaa

SEQ ID NO: 60117 - DNA, 144 bp, Glycine max
  Peptide Sequence Number=SeqID_176895
atgtgttacaattatgaggaaaattggggtatgaatcaagatatggtgcatggtggtagagaggcaggtattttaatgaagttagaccattggaagcagagagattcaaggcacttcgcatacagtgggcacagtattatctaa

SEQ ID NO: 60118 - DNA, 423 bp, Glycine max
  Peptide Sequence Number=SeqID_176896
atgaaggagaagattcttttatttggcaagattctgatgacacaaggtgacaaatccaagtggttaattaatgagaaatttaaaaggaggtacatattttcctccaaattggccaaggactcttggtattgtgctggatgttatttggcaacgaagaaactactttgtatttcatggtacaaagtggtctcatcaagaaatgagttgtcaaccttcttgcatgggattcggttagccagagaaagaggattcaacttcatagagatgcattctgattctttagatgctgtcaaattgatcaatgaagggtgcgcaaggaccattcttatagccatattgtggacgctatacgtgggatatattcccagggaggggaacatcgctgctgatgctttcgccaagaatggtcttcaatggaagtaa

SEQ ID NO: 60119 - DNA, 528 bp, Glycine max
  Peptide Sequence Number=SeqID_176897
atggttaggagtattggggaatctggtagtgagggtgaagtttctacttctccaccctctgattttgaaaaaatgaatgagttattgagagatgatgaggttacaactgttaagaggaataggaattgcaattctcaggataatcaacctaatgttgaaaataatgaagataatgatgatgtcaaagttactaagcaagaaattaaggatattaagattatagcagaatggcctcacaaaatgtcttgtaaattcattttggcaattcctaattcaaatcatcctgatcggattttgagccatgattatctgttttatttttgcagtgttgatttattcaaatgtttgttgagttctaatcgatttgttttatccatttgtagaagtcatgaagtctcaaaaccatatggtggtagcgattttgttggtgatgatgtggttgttggtgttgccagacttgttcaaaatgaaaagattatcggtttgaccatgccaaatgttcaagttgaggaagagaaagggaaataa

SEQ ID NO: 60120 - DNA, 435 bp, Glycine max
  Peptide Sequence Number=SeqID_176898
atgtcaatattgggctctcatgttctgcttgctttcttgctcactacttatctttctctcttccctttcccccaacatgttaccactgaaggtatggctttggtgaagcaggttaaagatgcagccagcaacaaaaaggctcttaaagaggcttttaaggtcttttgcaacaaaggtgttgttggaagttcaagtgtagaattgcttgtctccttctatgataacattcttaagaaagtaggaagggaaaaattaagtgatgaagcaattgaagaaactcttgaaaagattaaaaatcgagatgaatgggtagctaaaatgaaattgataatggtggggaagaagcttgctcgaaggcctctctttgacaaaagtgccaatgatgatcatgagcgaagtattttgaaaaaattgaagcaacaatgtggtggatag

SEQ ID NO: 60121 - DNA, 255 bp, Glycine max
  Peptide Sequence Number=SeqID_176899
atgaaagtgaaaccacaatgttcgcttttcactctctttccgcatagcataaataaaaaccattcttcctcttctccaccatccaatttcccccttcgttcttcagctgatgacgacatcatttggaccaaccaccaccttagcgtcgctcaaggaccacaaagttcagatcccaagcttccatggcttgaggtctggctccgcctctgctctcgcccgcaatgccctctcccttccttcattgttgaatactag

SEQ ID NO: 60122 - DNA, 258 bp, Glycine max
  Peptide Sequence Number=SeqID_176900
atgaaagccaagaaggaggcaagagcatggcaacacgagttatacgtgttggatactattggccaacaatttgagcagactatgttgagtacatcaagaaatgtaaagaatgtcaagagttcaacaataattagcttgctccctctgaggaacttcatagcatcacatctccttggccttttgccatatggggaatggatatacttggtccatttcgagtggttaaaggtcaattcaaatccctacgtgttgctatag

SEQ ID NO: 60123 - DNA, 348 bp, Glycine max
  Peptide Sequence Number=SeqID_176901
atggccgaagcaaacgctggaaacagtagacaacatgagctactttgcgggattacctcgcctttagtgtgggaatcactacggcaaaatcgatcatgcctggatgctacaacaaggggaaacctcatgcacaaactaactgatgcaacaatagagatcattgaggtcatggcttctaatgcttacaatggtgtaggaaacagaaggattctcaagaggcccactggagttcatcaagtggtgactgatccatctagttcttctgttgaacaaaagatggatatgttgaccaagagaatggagactcatgttgggtcatgcttgagtataggacatttgttcaagtag

SEQ ID NO: 60124 - DNA, 339 bp, Glycine max
  Peptide Sequence Number=SeqID_176902
atgagttcccatggtggtgtacaaatttcagaacgaccaaacgcccatctgcttaattgtggccattactccagcaaatcaagatatagcacatcagatgccatcaaggtttccagaaaagttgaccctgcaggggaaagaacgttcggtgtgttgacaaagcttgatttgatggacaaaggaacaaatactctcgatgtccttgagggaggatcttatcggcttaaaaaccctagggttggaattgtaaaccgttctcaggcagatattaataggaatgtggatatgattgctgctcggcagcaggagcatgcatttttcactaccagtcctgattag

SEQ ID NO: 60125 - DNA, 219 bp, Glycine max
  Peptide Sequence Number=SeqID_176903
atgtgggagcgcgtcgatgaaatgaacacgatggtcagtagttcaggaactctaagtgtggcttgcaaggttggccataacaaaaagaagaaagaaatgaatcattatatggatgaatttcctaataagttgcaacaatacattctgaacattgtcgatgtcacaccaaatggaaattgtggttacaaggaaattacatctttactaggccagggttag

SEQ ID NO: 60126 - DNA, 267 bp, Glycine max
  Peptide Sequence Number=SeqID_176904
atggattggaatactttcatatcttttgaggttacaatgtcacctagatggggaaatatggatgatggaagcaaatgtttcttttaccaattcgacctcttatatggaaccgagcctaacgatacagggttgaggaatgataatgctgacgatgtgggtggtgatgacactaataagcagccacaacctagttatcttgacttttctagttatttcatgcccgatgaggtttttcaagagcacgatgatttgttaaattgggcttga

SEQ ID NO: 60127 - DNA, 504 bp, Glycine max
  Peptide Sequence Number=SeqID_176905
gaattgaagcgctttccaactcttcaagctgaaatagcagaagcagctaatgaggggttagagagattccatgatgacggtaagaagacaacgttgcggctggtggaaatggaatcttcctatatcaccgttgatttcttcgggaaactccctcaggaagttgacaagggaaagaattcagcttcctccttgttagatgatcagtatgccaagggacacttccagaggatcggttcaaatgtttcatcttatgttgggatggtgtcacaaacgttgaggaacaccattccaaaggctgtggttcattgccaagtgatggaggctaagcgatctttattagaccgtttttatgcacaactgggcaaaaaggaggaaaggcaactcgcatggatgctgggagaagattctgtgttgagggaaaggagattgaagcagttttttggtcgggataaaatgaatcttgagttaatatacgaaggacctctcttaatgggaaaagaatga

SEQ ID NO: 60128 - DNA, 1098 bp, Glycine max
  Peptide Sequence Number=SeqID_176906
atggcaactgaagccgatgctcctgtcattcctcttctcactccctacaaaatgggtaacttcaatctgtcccatagagttgttttggccccgttgaccagaatgagatcttacaataacgttcctcagcctcatgctgtattgtattactctcagagaacttctccaggaggtcttttgataagtgaagccactggtgtctctgacactgctcaagggttggtgcacacacccggcatatggagaaaagagcaagttgaagcatggaaacccattgtgaatgcagttcatgccaaaggtggtgtattcttttgtcagatttggcatgttggaagggtctcaagtccagtttttcagccaaatgggcaagcaccaatatcttctactgacaagccactcaaacaaaatggcattgaggaagcacaagtcacaccaccaaggaggctaaggacagatgagattcctcatattgtcaatgacttcagagttgctgcaaggaatgctataaaagcaggttttgatggggttgagatccacggtgctcatggctacttacttgagcaattcattaaagacaaagtgaatgatcgaagtgatggatatggtggatcccttgagaaccgttgccgattcgctctggaagtggttgaggctgttgtgaaggagataggggcagaaagagttggagttagactatcccctttcacagagcatgcagagtgtggagattcagaccccaaagcattggggctatacttggctaatgccctcagcaagtataacattctctattgtcacatggtggagccaagaatgaagaatgctcttgaagtagttgagtgccctcacagccttatgccaatgagaaaggccttcaatggaacttttatttctgcaggaggttatgacagaaaagatggcatcgatgctgtggctaaaaataggacagatcttgttgcttatggtcgcttgttcttggctaatccagacttgccaaagagatttgggcaagatgcgcctctcaacaagtacaaccgtgagaatttctacactcatgacccagttatcggttacactgactacccctttcttgaatga

SEQ ID NO: 60129 - DNA, 240 bp, Glycine max
  Peptide Sequence Number=SeqID_176907
atgaagatgacagaaatagaggctgtatcaatgttgtgggttgtggaaactgaaggggataaagagaaggagcaaggacagaatcgaactgatgcaaaaatagaggagcagagacaaatacaacaggtgttggatgaatatgctcaagtattttctgagcccaagagtgttgatcagattcagtcaccgcggaagccaaaggccttgcgagtgtaccaaaagaggaataaggcccattaa

SEQ ID NO: 60130 - DNA, 267 bp, Glycine max
  Peptide Sequence Number=SeqID_176908
atgaagaatcttagctggttgaaagtgcagactcttgttttaaagctcgtgaatgataacttgaagacaccaaaggctgcacctttaacaaagtccaaagctacgagattctattctacacgttcaacacctgaaactcacacattcaaatttcctcatagaaaggctaccataactttacaagatatgaccttgcagttgggcctcaagattgacggactgcctataaccggtgtcattaccagtgatgcacgtgttgcttgttag

SEQ ID NO: 60131 - DNA, 492 bp, Glycine max
  Peptide Sequence Number=SeqID_176909
atgtgggatactctagccatacaaagtacaaactctttactaaggaaaaagaccaaggttggaaccaaatggaagaactcctccaagaaggtgttcaaagaaaagggagacaaagataaaagcttcatcattggctatgggtgtaaaaagcttgaacacttcaagtctgagtgcccaaatctagggaagcccaaggacaagaacaaacaatacaagtccaagggtaagaaaggcctcatgagcacctgtgagatcctggacggcaccttgtctgatgaagaaggagagggggaagccaacctatgtctaatggctaacacaacctctaaagaatctgaattagatcaagaagagatagattttgacaaccctgaactgttgaaacaagcttatcatgaactactttctaacacgtccattctttcaaaagcttttgaaaacatgcaaaaaggttttaagaagttgtctaaagatcataaagagctggaataa

SEQ ID NO: 60132 - DNA, 507 bp, Glycine max
  Peptide Sequence Number=SeqID_176910
atgggcaaaaggtatggactcgtcatagtgaacgattactccagatggacatgggttaggttcctagcccacaaggatgagtctcttagtctatcttctttatattatgtaaaagagttcaaaatgaaaaaggagcatgtcgtacttcaattagaagtgattatgggggagaatttgagaatgaaaatttctaaatttttcgtgaggaaaatgggaatttgggaacctctcttcgatcaatcattgaaggtggataagtcaatccttaaggtgcaaaatgaaaaagctcaatcactgattctcttgccattgtttgatgatgttctttatgaagtttctcaaaagaaaattgtttttgcgttatcgctcaagttggagaaacaagttaattatgaaatgacatttgtttggcctctaaacaagagaagagggcagaagaagaagaaagacaaaggtagcaagaggagcaagactgatccaaaggacgtttgtaattactgcaaataa

SEQ ID NO: 60133 - DNA, 897 bp, Glycine max
  Peptide Sequence Number=SeqID_176911
accttaagtctctagaaggttttctagtacaagatgtcagcggaattgttctggaaggtctcaactctcttcgacgccatgaagttcactacgacgatggagacaaccataggattgtcttggttgacgggactcatgcccttgaattccttatccataaacgtcataggcggaagacttcgttgaaggggtgcatcgaaaaaattaatgtcgatgtcccggatggaaaagccgccagtgatggtgttgattacacctctaatgtgttgggcgggttcttgttgcggtggagtctcgctcctgcttgggggttgcctggtctcttaacaaattgggctaagtacccagcttatgggtaccttcatgttgaatgcttcctcgagaatcatggtgcgattggttgttatgggtgtgtaacgctcgtacctggaccctttggagagaagctggcacttgtctggcttgtgcctcttgttcgacttgtgtgtctcaagcttggtgtgtactttgcgcttgttgtgcttctatccggcttgattgtctacaaacttgcagggtgtaaggcgaggagcatggaatgcaacgctacctcgaaattgagattttggatttggatggttgtccacccaaatctttccatgaactttctaagggacttgtcatttgcttgtcatagactggctaaggcggccaagtcagtgacggaggtctcacgtctgaggccacatcgagtgctaaccacggacgaatgtgagaggattgacatgaggccgtggggtatgttttaccgtagtcccacggtgggcgccaaatgttcttaccaaaatccgaaactgtcacatgttagggtggacgtggttgagtggggtcctgaacttcacacgtcgactaggatag

SEQ ID NO: 60134 - DNA, 315 bp, Glycine max
  Peptide Sequence Number=SeqID_176912
atgattgccgccatgaccattgtcgttgccaccaacatgattattgtcgttgccactgccagcagtggcagaggcaatagtcatgttggtggcgacaatggtgatcatggaggtgataacaatggtggtggtggcaacgataatgatggcggcaacaagcatgttagtggtgccgtaatggcggaaacagtcatgacggtggtggtggtcaaagtgtgtggaagcaatgcgttccaagattatttcgatgatgccaaagaatcaagagtcaagcaagttccaaagaatcaagagtcaagcaagattcaagaataa

SEQ ID NO: 60135 - DNA, 456 bp, Glycine max
  Peptide Sequence Number=SeqID_176913
atgcaagctctaacactgaagattgagacactcatgagagctcaagctcaagtccccatcactacacttgtattcccaacttgtgaaagatgtggattgtgcataggccagtcaggaaacctcctttcacaacctgaaccaaatcttaagggagaggatgtcaatgctttgatgaccagaaacaagaggattcaagaggactctaagaaaagggaagattattttccaaattttgcaaatgacattattactaaaaaggaccaaacacctgggaaagttgaggttcatactaatgagaatccaatggcaaacaaggagggtgagaaggaggtactgatacctcctcatggtagtgttcccttccctcaaagattgaaagacaagagcaaggatggacaattttctagattttttgagatgcttaaaagggtggataataatatccccttcacttag

SEQ ID NO: 60136 - DNA, 345 bp, Glycine max
  Peptide Sequence Number=SeqID_176914
atggaagctacaaaagctacaatagcaagtggcatttcagttttggagactgtggtgttgaccccaggttctatagcagctggtgaaggagcatcctacaatggccctagggctcagattgtttgtagttatttgtatgttggatggggggtgaatgggcaacaacaacctaagtatttgaaactaacagcaatgtggctaaaaattccactaggaacaaaatcaagcttctcagtatttaatcaaaagctgcctataaaccactcccccaaccctacacaaataacaaacaaggaactagaggaacttacatccaagttagaatgccttatgagtagacagtaa

SEQ ID NO: 60137 - DNA, 345 bp, Glycine max
  Peptide Sequence Number=SeqID_176915
atggattcggatcaaggcaagcttttcatcggtgggatttcatgggatacgacggaggacaagctcaaggagcatttcggtaactacggcgacgctttgagcacttccatcatgcgggagaagaacactgggaagccaaggggcttcggtttcgtcgtttttgcagatcctaacattctagatagggttttggaagacaaacatgtcatagatggcagaacgagaaaagtgaagcttagaaatacaactcttatttataagtcacagtgtacagcggatataacgggaaatcataaaggtcttaactgttctcgcggtttgttcatggaggtagggcttatttag

SEQ ID NO: 60138 - DNA, 855 bp, Glycine max
  Peptide Sequence Number=SeqID_176916
atggagcgcaaagaaaagagggtcacggcggtgcgggtttatgtcacagctggggatggaaatgttgccatcgtaccactgcactaccatgacggtctcgatgttgtcggcaatgaggtccctggactggaggctttagcacatgccacgagtgcccatggagatggcatcgctgacgccaatagtgttgaagcagaagggaaccatgccggcggcggcaatgccgtcacgcacggccttggagaggtggaggaggtgcatgttgcaggtgttgccctcgtactagacccaggagacatcgacctacggcttggccatgttgtcctcggagacaccaatgccatagagcacggtctgggaggcgctctgctacttgggctccatgatgttgtacttgttcagcttcaccgtctcggtcgaggtttccacgatgatggaggcgtgaacggagatggggataaaggaatgggtggggttgaagagtgtggactgcattctgaaagtgcagagaagtggacggtcgtgaatgaaggcacgcaggtatttttcgaggacgtggttaaggacctcggtctgtccatcaaattgggggtgataagtggtgctcaaaaggagcttcgtaccgctcaaccggaaaagctcatgccagaaattgctgatgaagagtgggctgaagtgcaaccaggtgtgtgcccttggaatagcgatcaacaacaaccaggattgttgtatatccctgagaagatgtctcatactttgtctattgacaaatggaacaatgtgccatatattggcggacgtcatggtgcatgtgaggccaccgaaaatttgcctacaagtgatgaagtgttttag

SEQ ID NO: 60139 - DNA, 586 bp, Glycine max
  Peptide Sequence Number=SeqID_176917
atgtctcacaaagaaaatctgatatatgagttacacaccagaaaaggaacatggaaaatagttgtgcgtatcactgatctttggcaagctcgaaagcaaaatagtaaacaaacaattgagatggtgttgatggaccaaacgggttcaaaaattggagctactctctggcaagaactcttcactgaattgtgggacaagattgttgacaaccaatctgcatacagagtcaacccagctccatatttggtttatttcctaaaaactacatctgtcaaggaaattcaccatccagaaattccttctaatgtttatctcataactctttttactgatataatcgctggtctcgcaccacgccatactttagtggatattgttggtgtcattgttgatttgatcgattttaagacagttaatccccctcacaggatgacagtcaggctcagggataacagtaactacgacattctaataactgtttgggaggactatgctattcagctacatgatgttattgacaaaaaccttctgcttcaggaaccattggttgttattttgaccttaggtaaaatcaaggatgctacag

SEQ ID NO: 60140 - DNA, 132 bp, Glycine max
  Peptide Sequence Number=SeqID_176918
atgaagtatagatactccaaaaatgaaaaagtatcggtgttgctcgtctcctcctccgtcaactcctcagtctttatggcgatgggggttcctgggaaacgctcaaatgtaattcaactttatgagcattaa

SEQ ID NO: 60141 - DNA, 141 bp, Glycine max
  Peptide Sequence Number=SeqID_176919
atgtatcttgaagatcgaactgttcgactgcagttgtgggatacagctggacaggaaagatttagaagtcttattccaagctacattagggactcatctgttgctgtcattgtttatgatgttgcaagtatgccattttga

SEQ ID NO: 60142 - DNA, 279 bp, Glycine max
  Peptide Sequence Number=SeqID_176920
agggtacatctacttgggttgttgactgagaacaagagagggtacatctcttgtggatcagttctagtggagggtacatccactaggttgttcaaagagaacaagggagggtacatcccttgtggatctttgcttcatgacactcgtgctaagcgcgcatgtccagctagatcaagtggccacacgataagtcgcaggatgcgcactcttgctcgtgacaactgtcttccaatgtggcttcttgtgctaagcgggcttgcttgcactgagcggtcctga

SEQ ID NO: 60143 - DNA, 345 bp, Glycine max
  Peptide Sequence Number=SeqID_176921
gtctcgcaacaccttcacctctgcaacttcactatcgcagccccccaccctgagctccgcgtggcgtgtgggtcatttctgagaacccgacctggttgtggcactgacactgttttcgaaggaacttgtaagttcattactacctatctcggacctagttgtgttttgcggcaagtagctttctcgctttcaagagaactggaactgcccaagaataattatcgtgttcatgagtggaatagaaaattccaaattggaatcactcaggaggggctagaacttgagttacaagatgaaggggagccaaaatatgtaatggtgatggttagcagacaagttatttag

SEQ ID NO: 60144 - DNA, 121 bp, Glycine max
  Peptide Sequence Number=SeqID_176922
gcatgctgatggtgtacaagcaaaacataaacatcaggcagaagataatacagagtggaacctaattttggatacatccagttctgaagatctgtcagatgtagctgcttcagttggttga

SEQ ID NO: 60145 - DNA, 1287 bp, Glycine max
  Peptide Sequence Number=SeqID_176923
ttggtgatccaatatgttaaacatcgtgctgttcttggtgccaaatatcatcgcatagattggacatccatttctgatcttccagcttctccaatcgcttgtatgagaagaatgaattcattgaatagtaacatgagatttaggaaagcctcctgtgaaggtatcctcaataattctagtcctgatgctgaaattcaaattacaagtctaaacaaagaagcttgggatgactttgagaacaaaaatatcaagatggcccttgatgagattcttcgctgtaagatgatggctaagctgggtgcctcctcccaaaaaggtcaattgcaatatgatgggtggtcagatgcaaatgcgaatgctaatggacttgttgggggcactggcaatgaacgttttgaactatcacaacatttcttgcagagtgtttccaagtcaccatttccatttaatactggaaagcaagctgttaaattttctgcatggctggaggaaagaggcaaagacctcacagaagtgggcgctaatcttgctgaagatctacaatgtggggacatttttcatttgcttgctttagtctcatcgggtgaactttcaatttctccattcctaccagataatggtgttggagaggctgaggacttgagaagtgcaaagcgtaaatatgatactaccgagtcttcatatagtgataaagccaaaaagtcaaaatccttctttggagtagaaggtgaaattatttctcgtcgggaaaaaggttttcctgttgtttatgctgccatccaaaaggctggtgaccaaggattaagcatgggagaaatttcccaggttattaacttgccaggagcagagatagatgtcttgattgttgatgctcttcaagcatttgggcaagccttaaaggttaatgcttatgatactgtccgtgttgttgatgtcttataccgtcacaagtactttttgacacctatgtctgattttcatcttcgtgttgtacaaccttcctcatcaaaaaccatcgagaaaagtgatcatacatgtgagctttatgaatcggaggaaagggatactacttctgttgatacttcgaggaatgaaggctgtaagcaaaacagacttggcttatccagagtcaatcataagaaagaaactctcgaattttcttctagtaaatcatgtgtgccaatattgccatgggtcaatggagatgggatcatcaacaacattgtttacagggtactcagacgtcgtgttcttggaatagtgatgcaaaaccctgggatattggag

SEQ ID NO: 60146 - DNA, 309 bp, Glycine max
  Peptide Sequence Number=SeqID_176924
atggaagcaaaagcgcaaaaatggtggtctaggggcgaaaatctgcaaaacctgtgggtgctgcattttttgaatgagggaggggagttttgggtggagagaaactccccctccctcgtttttatgtttccaggtgcaggggtgctcgcccagtcgagctcagctcgcccaggcgagctaatcccttctcccttttttttggggaagacacaggctgcctcccagctgcgcttcccgcttttccagagctgggcatgggacgacgatccatcgatcatggtcctagcctctactcgcgtccatccctaa

SEQ ID NO: 60147 - DNA, 273 bp, Glycine max
  Peptide Sequence Number=SeqID_176925
atggaagaatgttcagggtttcctgtgttatttgggggtgcaaattcaaaccctcctaatgatggtggcaaagacaagattctggggctggaacttattgcaagacttcaaaataatggtctcaaagataagatatttctagggttggaacttattgcaagacttcaacaccgcaccagaggtataagacatttaactaggatacatggtgtggatttgacaaacgaaattgaggatacatgccccaggagatctataaagaaagaaatataa

SEQ ID NO: 60148 - DNA, 441 bp, Glycine max
  Peptide Sequence Number=SeqID_176926
atggtttatccaagtggtagtagacgcgaatcccttaagcatgtggtcaagggtttgaatcctaaccaatgcatatatggagaaaatcttgttgagaaagagatcccacctatgagtgccaacaagttaggactgaatcatgaaagatttcagtttgattcttttgagttagatgaacctgaagatgctggcaggtatatagttagaaagagcataaagagtgcaagagacttagtttgtttccctttcgaacagaatcccatcatactttacttattgcacactatgtacagaggcagagagaatctcccattactgactgcgcactatatgatgcaaccctaccccccaagggtgttggatagaagaatccaaaaggattgggctatagctactgaagaaggccctaaggttctcatgaacctcaaggtagatttctaa

SEQ ID NO: 60149 - DNA, 339 bp, Glycine max
  Peptide Sequence Number=SeqID_176927
atggagaccataggtaacatgccgaaagtgttaaagaatcttgagtctatgtctcttgaagaacttgttggtaccctcaaggttcatcaacaagagcttcagcaagacgaaggtcttagaagagaaaagtctttggctctcagcagtcaaaagaacaagaaagaacaatcatccagaaaacaagtacggagaagctcctccaaagtgcttaaagtcaatgactacattatccaagcttcacccaaccccttcatgactaacacaaaagaacccagaaagattagggaacccaagaaaagaaattttcctattacagatatccttgatagcagaaaatag

SEQ ID NO: 60150 - DNA, 303 bp, Glycine max
  Peptide Sequence Number=SeqID_176928
atgtatattcgggtactaaagggtacaactgatactggacttgtctaccatagagacatgtcttgtgctcttgctggttactcagattctgaatatgctgtagatttggatgcaaggagaattgtgacaactataatatgtttagtcaaggatcaagtccatcatgagaggactaagtactttgacatcagataccacttcatctgtgtcaagaagaggctcaaaatccagaaagttgataccacttcatccgtggagcatctaatcacgtcgaatggagttttcaatctagtggttcattaa

SEQ ID NO: 60151 - DNA, 510 bp, Glycine max
  Peptide Sequence Number=SeqID_176929
atgaaagttgtgtacttccttgttgccatcttggctttgacatcctctcttgtctctgcctatgatcctagtcctctgcaagatttctgtgtggcagccaaagaaaaagatggtgctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaaatgaatatgggaaatgggaatgctgttgccattgctggccttagcagtcaaaatccaggagctatcactattgcaaatgctttgtttaaagttaatccgcctatttcttctgaggttctcaccaaagctttccaggtggacaagactataatcgattatcttcaaaagctatcttggtacgacaacaataactaa

SEQ ID NO: 60152 - DNA, 564 bp, Glycine max
  Peptide Sequence Number=SeqID_176930
atgtcctatgttactgatgcaagtgttgtaggaagtctcatgtaccttaagggtacaactaatattggaatcatcttccatggagacatgtcttgtgctttcccgttgatgggtctagcttctggttctaaatccataccagaaagtattcgcacagagagtcttgaggtgtatttcggcaattgcactatgataaagatggaagaaagttcagggtttcctgtgttatttggtggtgaaaattcaaaccctcctgatgatggtggcaaagacaagattctggggctgcaacttagtgcaagacttcaaaacaatggtctcaaagataagatatttcaagggttggaacctattgcaagacttcaacaccgcaccagaggtttaagacatttaactaggatacatggtgtggatttgacgaacgaaactcaggatacatgccccaagagatctataaagaaagaaatatatgaagaggtgctgggaatttcttattccacggtgagtcaatcagagaaggttgtggcacatgatctgaaaaagagccacattctggtgcaataa

SEQ ID NO: 60153 - DNA, 309 bp, Glycine max
  Peptide Sequence Number=SeqID_176931
atgggtctagcttctggttctacatccataccagaaagtattcgcacagagagtcttgaggtgtatttcggcaattacacaatgataaagatggaaaaaagttcagggtttccggtgttatttggtggtgaaaattcaaaccctcctgatgatggtggcaaagacaagattctggggctgcaacttagtgcaagacttcaaaacaatggtctcaaagataagatatttctagggttggaacttattgcaagacttcaacaccgcaccagaggtttaagacatttaactaggatacatgggagtgaataa

SEQ ID NO: 60154 - DNA, 732 bp, Glycine max
  Peptide Sequence Number=SeqID_176932
atggagttagagcaactttatgtcaaaaatttatttctccatggaagactggaggaagacattctaatgcaacaacctgaaggttttgaggacatgggagttgctgaaaaaattatgagcatggagatcaagaactatcgagtcgagaagaagctatttatgtgtcaaaaggaatacattcagaaatcagagtcaaagaagaaatacatgtcctatgttacttatgcaagtgttgtaggaagtctcatgtactctatggtgtgcactagactggacctagcccaaacagtcaatattgttgtgagtagttatatgggtaatcctgagatggaacattggcaagctgtgaaaaatatattgaggtaccttaagggtacaactaatattggaatcatcttccatggagacatgtcttgtgctttcccgttgaccatacttcaggacacaatggatttatccactacaaaggaagagtacatggctaagtggcagcattgtccttcgccgcctgataggattctccacagtggtggtattgttcttcgtcgtcgtgatggggttctctgcggtggtagcgttgttctttgcctctgtgatggggttttccgtggtggtggtgctgttctttgttgccgtgatggggctctcctcagtggtttttgcattagtgtagcagaagtgcagaacagcaaaagccaagatccaatagaggtaaacgaaaatgacaaatga

SEQ ID NO: 60155 - DNA, 213 bp, Glycine max
  Peptide Sequence Number=SeqID_176933
atggaggggacaacgttgagggactgttcgatggtgactttgacggtggggcttgagacactagcttctctcatgaccttgctcacgctggggtcgttgagaatggatatgattagttgttccaactccactttcactctgaggagtggcggggaaagagggtggtgggaggaattaagggatggaagaaagaggttggaggaaccagaatga

SEQ ID NO: 60156 - DNA, 534 bp, Glycine max
  Peptide Sequence Number=SeqID_176934
atggcattcttgggagagacaagcagtcagacagttgtgaactccacattaggttttatttttccaaatggatccattgttcacaacgacagtggtgtttccttccaagcttccactccagttcccattcgagtacttaacgagtgtgattttcaaacgttaaaaaccagaatacacaatacccttaagctaaccgacaagcaatttttggatgaaatttactaccggcagcctttcacgtatgcaagtaatcaatttcggtttcaatgtatgcaactgaaagatgatgctgatgttaacacaatgttaatgtgtaatcatgaattttcatttgttggcccgattgagttcttatgtagcattgctagaaccccagatggaaaaaatctcaaaaactttgacattcccaccggatgtaccatggatgaactgaaggatttgatcaaacaagttgcgcctcgtgggattcccccttatggtgttgatgaaacacaaatggacgtgatgaaggtgctcattgagtctaactactag

SEQ ID NO: 60157 - DNA, 276 bp, Glycine max
  Peptide Sequence Number=SeqID_176935
atgccacaagctgtgcttaggaggattaaaagcattcaaagaaaaatattgtggggtgaagttgatgaccataagaagattccttggaattgctgggtaaaaatgtatagtcccaagagtcatggaggtttaggcattaaagacatctccattttcaatgatgctctaattgcaaataagatgcggttattgaaaagatgggaatatgggaagggcaaaattggatatgggactttaggtggcacaaaattggttccaatgggaaaatctgattaa

SEQ ID NO: 60158 - DNA, 285 bp, Glycine max
  Peptide Sequence Number=SeqID_176936
atggaggagtttgatactcagatggcctgtccaagagaccagccctcttcttctagagggggtggagcctctgtagcccaggagcctgtgactgatgagccaccagcaccagcagaggaggagaccactccagatcacactcctcagccatctccatcctctgcatctactcctgaggagactcagccatcagcactggatcataatgaagaccaccataggaggagcaggacgtttaaatttttgcattttgaacactttagtttatttttagttattttatga

SEQ ID NO: 60159 - DNA, 1007 bp, Glycine max
  Peptide Sequence Number=SeqID_176937
ggatacacgtcctcgcctcaaagggcttcacgtcctcacctttagagggcttcacgtcctcgccttcagaggactgcacgtcctcaccttaagagggcttcacgtccttacctttagaggactgaatgtcattgcctttagagggctacacaccctcgccgtaagagggctgcacgcccttgcctttagaggattgcacgtcctcgcctttagagggcttcacgtcctcacctttagagggctacatgccctcaccgtaagagggttacacgcccttgccttcagaggattgcacatccttgccttcagagggctacacatcctcaccttcagagggctgtacgtccttgccttcagagggctacacgtcctcgccttcagaaggctacacgtcctcacttccgagggctacaccaattgtgcaagcacagccagaggaggaggcaggtctccggctttgatgaggaggctatcgcacaactactatgcataccagggcaagattttgcccagacctctacagggagacgagtgcggatcatgtgcctctgtcttggggtttccagctctgattacgggcctctgtcagttctacggagtgcccattgcccctaacaaagtcatcaagccccctattaacagggatttcatcaagaagtactgtgcccccaggcaggggcagggcgaggtgcaccacaatagcctggggacggccaacaaccggcaacagaggcaccgctaccacctccagagtccaccaacgctcatctacaaaggctggagcgttgcctacgccatgtggccgaccagtaggcgaccaagtccaaagcaaaaggcttcgaaaaacaccgattctagagcgtggaacatcagtagcgtttcaaggccatcgaaggatggtcattcctcagacagagataggggtagccgagggatgatgaatttctgcacttccttggaagaggcgaagccatacaaccaggatcgccaaacttgtgattcatcca

SEQ ID NO: 60160 - DNA, 270 bp, Glycine max
  Peptide Sequence Number=SeqID_176938
atggcaaccaataagaacttgaccgctcctgaggcttttgaaaatggtcccaatctgtccatcccccacatggagaaaggccaaggggagctcaagccatggaggttgtcaggtggtatgcatggcacatctataaattcttggcattgtttgcacatccttgtgaagtcgagggattcaaccaatagtagtcggcaagcaccactttggttgctagggagtgtccctcggtatggaggctacctattccttcatgtagctctcgcatga

SEQ ID NO: 60161 - DNA, 373 bp, Glycine max
  Peptide Sequence Number=SeqID_176939
ggtcgctgcttggatagtgtggaaagtagaacatcccaaggtggtcaatgctatagtcgcctttgctgaggccactcggtctaaccatgggttgtcgtccaggagtactactacaaagaaggaggagcttgctaaggtgattgctaaccttcaggccaggttgaaggagtcagagtccaagctgaaggagtttgagctcaagaagggcttttacaaggatgttaggaaggccaggttcttcaccatagatcttgacttaggtctttttgatccatttaaggatgtgaaggatggcaaattacttgatgaggaagaaatagctgccacaaaggaggacgtcaacgaggagcaagatgttggggctaatgtttag

SEQ ID NO: 60162 - DNA, 246 bp, Glycine max
  Peptide Sequence Number=SeqID_176940
atgggtttgacgagcctttggagacgtgagactcaccaaggacaaaccttaggtttgatggcctttagattatcggctaggaacgcgtccgtcctggattttggcgagacttgccaaggcctatatgctcaattgtctaagtttgccacgaccctgaatgagccttcccagttgtgtccttgctttcccgctcggggatctttccttgcttcacctcaaactcgccacactaggtcgccaagctga

SEQ ID NO: 60163 - DNA, 504 bp, Glycine max
  Peptide Sequence Number=SeqID_176941
atggtcattgatgctaccgtgtggaaggaagtagttggtctggacatgggtggagttcacaagttcgatgaaatgcccgatgggttcaacaagatgtggacttatagggagatgcttcttgactctgctaggaacttgaggaattgcttaggagttggtggaatgactgcaagagatagaatgttagtttacctcattacctacattcttactccgaggtcaagcaatcatgctcagatgctggagagtctctacatggttgattatgaatttccttatgttgtgtttgccccgagattcattgactacttcaatgttaatgttttaaatgagattatggactttaccaaagcatctagtgagattactgaaagacatctcaagaagcttggaatgaggtttgttgatcatgaatggataatgactagagaggcggtagttggaaacatagaacaggtggaagaagatgctgaagttgaagctccatcaatagagtccttttga

SEQ ID NO: 60164 - DNA, 588 bp, Glycine max
  Peptide Sequence Number=SeqID_176942
atgactaagaaattgccctattaccctgaattggttcaagtgttttataacaacttggaaattcatgaaggagtgatattttttgaagtgaacaaaataccaattgttgttgatcaatccttgttttactccctaaccaaactgagcagtcaatgcgtgccttttgaaggaacttttgttgatgattggaaaccaatttattctagtcttgattctcataaaatgcacttcaaagtccctcttactaatgaaccatctgtcaaggttaagcgttcattcacaataggagccattgcagttgcttcttttggttataagaaagatcttgatggacaatggattcacaaacaggattaccaggaaaatgctcccgacgaacgcactccatctccaccacctagcgatccctcctctgctttactgaatgatgttctcaatgagattcgggatcttcgcgctttgatggtgaaaggtttgattccatggattctcgcatcactcgtcttgaggatgacatgggatttatccgccactgctttgatcctcccaccgatcctcagcattacaattagttatataaattattaa

SEQ ID NO: 60165 - DNA, 399 bp, Glycine max
  Peptide Sequence Number=SeqID_176943
atggtgatatatgctactgtgtggaaggaagttgttggtctagacataggtggagtcaaaaaatctgatgaagttgatgtttctaaagatattattaactacaccaaagcctcttgtgagataactgaaaggcatctcaagaaacatggtgtgaggtatgccaaccatgaatgcataatggcttatgagcttgctgttggaaacattgatgaggtggaaagggatgatgaagctgaagctcaacatgagtctgcacctcaatggagtccttttgaatctctcacgattcataagatggatgccatgctttacctccatcaagagcactcaaccgaagtacacaacttcttagagaatatcaatactaggttggaaaacatcaaaactaggccaacctaa

SEQ ID NO: 60166 - DNA, 348 bp, Glycine max
  Peptide Sequence Number=SeqID_176944
atggacgtggcaagtgacgtggcactccaatacgcacatcagccctccaagtcaaccctagcactggaacacggacacaccatccttagcagcctgactactggccgacagctaggaattatctataagggttcttacaccactgtaacgactcctacaatcaaggacccgaagttatcccactctataattaccaggtctccccctcaggtccttataacagagggtacctacagtctaacatgtgagatcgtagagcccatcttggctatgtcgaccctgatgtcagttaactctaaattttgtctacaactaaagttcaagcttactgttaactacttcccttga

SEQ ID NO: 60167 - DNA, 390 bp, Glycine max
  Peptide Sequence Number=SeqID_176945
atgataccaagagtttcatcaagaatgtctcacttgatggattatgcagggaggaaaattgctcacaatgaaatcttgaaggacatagtgatagagaaggactatccagagatcattgtctcagagtgtacacatttgctagattttttgtatgccatgattgcgcctaaattggaagaacaatcagatctagttcaattagaggatcaacatagagataaggaggacaatgaaaaatcaattgtgaactatgccaagcaatttctcagtgaggtttggagggataaagaagcaaccaaagcagatgatgggaatttgagctcagataatgtcatcaacaaaccacccttaatggaggaaattgttattccttcagtcaaagaactctaa

SEQ ID NO: 60168 - DNA, 911 bp, Glycine max
  Peptide Sequence Number=SeqID_176946
atgggtaaatcatcggagaagcccatctcctctgtcgctcttcttgctgccaacaatagtgacaagaaaaagatgctttcgaggaacaattttgagccgaccaacaaagatgattcaagaccaaccaggacttgcttggtcccaactaacaagcttagtggtcctcctatgtggatgtcttctggcttagagattgacttgaaggggtatttgactcatgttgcgctgggttataaagattttatgagattaaagcattcctttggcgatgctaaccctttggtgctgcttgaggagaaaaatgccactttgaagattgaggcagccgatgtgggacttgggtatttcccaatacacccccttcacgtccagcacttattgggtttggtgcgtgaaccacaaatggtgggtactcgtcgcagcggaagtgaagacgaggtcccaaggcagccgatgtgggacttgggtatttcccaatacacccccttcacgcccagcacttattgggcttggtgcgtgaaccacaaatggtgggtgcttgtcgcagcggaagcgaatgagaggtatataagctgcactccaaggattgaggcagccgatgtgggacttaggtattttcccaatatgaagaaggcatatgaggatgttgccaagttatctgaagagtatataagctgcactccaaggattgaggcagccgatcggaagcgaatgagaggtcccagggttagagcctgctctgataccattcgatgtgagacttgggtattttcccaatacacccccttcacgcccagcacttattgggcttggtgcgtgaaccacaaatggtgggtgcttgtcgcagcggaagcgaatgagaggtatataagctgcactccaaggattgaggcagccgatgtgggacttgg

SEQ ID NO: 60169 - DNA, 171 bp, Glycine max
  Peptide Sequence Number=SeqID_176947
atggagagatataaaattgcatcagcaaaaacattccaagaaaagctacaaaaccgcaagttagaacacatggttgaccaattgataaggttagaacataggataagagcatgctaccacaggaacttctctctggtgcactttgatttccttgaaagaggagataaataa

SEQ ID NO: 60170 - DNA, 549 bp, Glycine max
  Peptide Sequence Number=SeqID_176948
atggcgtcaaggaagagctttctttcaaacccgaaccgttacatctttccgacaacctcagacacccatttgagccaaacccaagagggcatgttcgagttggacgaggctgagttatggaacaaccacaaccactcttccacaacaacggatcagggcaaaaaggggttaccttcttcaggttcgcgttccgttctgaagagagcttcaaggaatcataacaacaacaatggagggagagacagaatcactaccccggcgtcattgcctgtgaacatacccgattggtccaagatcttgaaggaggactacaaggagcaccccaagtactgggagagtgaagatgaaaaagaagaagaagatgatgatgatgatgaagaacacaacaacgttgttggtgaacaaaaccatgggtttagaaatattagggtacccccacatgtgtatttggctaggacaagaggtgcttctctgtcggtgcatgaagggatcggaagaactctcaaaggaagagacttgcgcagtgtcaggaatgccatttggaagaaa

SEQ ID NO: 60171 - DNA, 1243 bp, Glycine max
  Peptide Sequence Number=SeqID_176949
atgccccttttgttgagtttcccgtttcagttccacacttgtcttcacaagctttgttattgtccctttcctcgtaccaatgcttatgtgagcacacgcgataactaccttggcattgttttcttgtcacaatcgaaatactcaattgggtcaacagggtttcatgaggccactccactgtccagggacacggtcgctgctgttgttgactttggtctgtgtgaagaagaatgtgatggtagtgttgtttttgaaggaagtgaaacggttgataccaacccttttgtgtccaaggaggaattgcctccttggggagaagtagagctggaagatggtgatgttgaaataagagaagaatttgatacatctttagtgtccgaggagcagttgcattcttggggagaagtagaactggatgatgatgatgatagaggtgtagaaggtgttaatgcatattttgtgtccaagaaagaactgactccttggggagaagcagaagaaattgatggtggtgtagatgacaacgccgaggacaatgttgaaagaagagtgaacggggaagcatattttggggccaagaaggaattgcctccctggggagaagtggaagatgcggctactgatgattttgacaacagtgttgaaagaagagcaaatggggttgtatattttggggccaaggaggaattgcctccctggggagaagtagaagtggaagaagatggacaccgtgattctagacctgttgaaactactccatcggctatagaggggataggactaatgaatgagcacggggcgctttttcttgaggagttggatgagaatgtgctgtctagtaggattttggtgcttagtagaactaacaagattagaagtgcaatggagtattttaggtctatggaattatcggctatttctccaaatatccatgcctgtaattctcttatttctagccttatgagaaatgggtggtttgatgattcaatcaaagttttcaattttactagagcaaaagggataactacagggcatacttatagcttgattcttatggcacatgcaaaagctcacggttgtgattcagctcttagattcttcagagaactagaaagtgaatgtgatgtggagaaggattttgatgcaattgtgtacaacaccatgatatctacctgcagaaatgttgaaaattggagtgaaatagaaaggttgtggaggagtatgaaggcaaacggctgtgctg

SEQ ID NO: 60172 - DNA, 171 bp, Glycine max
  Peptide Sequence Number=SeqID_176950
atgcccccatcactgagtgcagaaaaggggcaaagttatccagttccagaaaaactaacacgtggaccaacgcaatgcttctctccaaatacgccttcagaacagactatcatatgcaaaatactgctcctgaatatatttttagccaactgtcctatggacatattataa

SEQ ID NO: 60173 - DNA, 165 bp, Glycine max
  Peptide Sequence Number=SeqID_176951
atggcattaggggtcatggcagcacgcccaggcgagctgttacttcaacctgaagtattttccatattctttaccgaaatgttgaatgatccttcatcttgcacggtaactggtgtcgaacaactcaattcgactagcgaggatcaaaagatcaacaaacgatag

SEQ ID NO: 60174 - DNA, 495 bp, Glycine max
  Peptide Sequence Number=SeqID_176952
atggtagacaagtgctattttgaagcattggacaagactttgagagacatcatgagaattatagatgaagttgatattgcttttagagggaaagtcatagtttttggaggagactttaggcaaattttgccagttattcctcgaggaatgtgttcaaacattgttcatgctaccatcaacgcatcctcattatgggaccattactttgctaaatggatccttgaaattggtgatggcaatcatggtcagccaaatgatggatatgctactatagaaattcctccagcccttctcatcctaaaatacattgatccaatcgatgctattgttcaatccacatatgctaatttaactaatcattttatggatccacaatttcttcaatctagagctatacttgcatctataaatgaacttgttgaacaacaaaatgattatgatttatccatcattctaggttcgttaattctgctaatattttatcccttcacctaa

SEQ ID NO: 60175 - DNA, 682 bp, Glycine max
  Peptide Sequence Number=SeqID_176953
tccagcaagggcattgtactgactcaacgaaaatatgctctttccttattagaagatactggcttccttggctgcaaaccatcttctcttccaatgtatccaaatttaaagctcagcatgcttaatggtgagttactgactgatccctcaatgtataggcgtttacttggtcatctaatgtatctaactatttcaaggccagatattacatttgttgttaacaaactgagtcagtacatgcagaatccaagaacacctcatctagatgttgtgcatcatctcctccaatacatcaaaggtactccaggtcagggtcttcattttccaacaagcaattccttcaacttgtctgcctatgcagatgctgattggggaagtgcttggacacacgcagatcaacatctggcagaatatcgggcactctcctcaatatctagtgaagtgatttggctaagaagacttttactgcactttgagattactattccttctatcatgtttttctgtgatagcaaatctgtcatagatctagcatccaatccagctcaccatgaacgaccaaaatacattgatattgattatcacttcattcgtgagttagtgcaatccaacatcctcaagcttgttcatgaagttagttattacggttgtataaagggatggaagttagttagaatagctg

SEQ ID NO: 60176 - DNA, 918 bp, Glycine max
  Peptide Sequence Number=SeqID_176954
atgggtgccatggatgattccaatccttttctcatacaacccagtgataatcctggattgagtcctatgactcatcctctatctagcaagaattataattcttggaagaaagccatcaagatggcatttcttggcaagaataagtttggttttatggatgcaaccttgcaacaaggttctatgtccgtctcatcctattattccatgttgcgatcaatttgggaatcgatttctgaattaaagcctagacattcatggacctgcaacggcatctgtcattggcacgactatgtgcagatggagtatgccatgcatttcttgatgggcctcaatgaatcctatggttcaattcgaggtcagattctttctatagaccctttcccctctattactctcattttttctctagtggttcaagaagaaaaacagagagaaattggtgcttctgtttctactttcaactccacaaatgatgcttcacagtctcatgcctttgctgccaaggactccaaatatcaatctgatcacaagtttaatgctaattccaagaatcaacccctctatgcacattgtggtcgacttcgccatactcaagataagtgcttcaagttacatggttttcccccaaattacaagaagaataagccttcttcttctaatactgaaagcaaaacagtgaatcaagtctcaacacccatttatgttcctgattttcatctcacagcccaacaatatggccaactcatgagtttgcttcaagcacaaacttcaaatgttgttattcccaatattgagtcttctaacacttgtatggtcttgtctgctcctttaactaagtttcctcaaaaattttggattgttgattcaagtgcgagcactcacattgtttgttccattgatctctttgattcctattaa

SEQ ID NO: 60177 - DNA, 177 bp, Glycine max
  Peptide Sequence Number=SeqID_176955
atgccaattagaagtgggagcaacatgccaatcacttttactgctgagtccaattacgagctcgttgaagtgcaaaaggctctgcttcttgaggttgaggcatacctggcatcaaggttacattttatggagcccgataatggaggagaccacgatatggttgatggtgttgagtaa

SEQ ID NO: 60178 - DNA, 309 bp, Glycine max
  Peptide Sequence Number=SeqID_176956
atgattactttttacaatatcatttcgcccaagatcaaccattttctatggcgagtccttcgtcaatgtttacccactcgtgcaaggctaatcacgaagggagtggagtgccctttacactgttatttctgttcgcaatcttatgaaaacgagtggcatatattttttgcttgtgataaagctaaagaagtgtggcaagctgctgggctttggcatctcattcatccaaaggctggttctgcggaaggttttaaggatcttctttcgaccttctcaatcatcttcaacaacatgaagttcagaagctag

SEQ ID NO: 60179 - DNA, 173 bp, Glycine max
  Peptide Sequence Number=SeqID_176957
ggtcggggacgggggacaattttttggctccattgatttttgagacgagacaggggagggttttgagattcaggaatgagggcggaataagtaaatacggtccccttgtcatgcctacacaaaagagatttggaaagaaaaagaacaatgaatgtacaaccagtattcaataa

SEQ ID NO: 60180 - DNA, 2094 bp, Glycine max
  Peptide Sequence Number=SeqID_176958
atggggaagggtcattgtacgcagccttaccctagcatatgcaaagaggctgtttccggatttgaggttgatagatttcatgagttggaagaggagttgaagcctaagggatatagcggcatctggaaggaacacaacacagtgaagaacacaaacaaaaatgagcagatacatgcatggaaagagacttgtgcttgtgtaggaacaggaacagaaacctgtgggtgtcagaaaatgccaggcttggccacaatattggtgagctgtgggtcacaggttggctcgaagcagagcttgacagggtctagtaaagttgtggtttgcaacattcatgtgctttacaatcctaacaggggagaaattaagcttggccaggttcgagtgctgcttgataaggctaaagccgtttctaaactctggaatgatgcccctgtagctatctgtggggattttaattgtactcccaagagtccattatataactttatatcagaacagaagttagatctgtccggaatagataggaataaggtatcaggacaagcttctgctacaattcatgcatcaaagctctattatggtcctaattctagtgaaatatctgctaatggttcagttcaggcaacatccactgaaggtgacaaagaagacattgaacaaaataattctcggttggacacgagggacctggacactaaatgtcacagtttggataatcaacatactcagactgtttcagatatgtctgttaactcttgtacaaatgttgattgtggaaaggaaagtgatgcatatgcaggaaaagatactcaggaaacttctgttgaccattctaaggtctcttgtgaagttggtagcataaaagaacctaatccttcttatagtgaaggtaggatccatattgatcatgtaaatggtgacattcatgacattacacccgtgaccttctcagctcctgaagaagttcacagtgatgcaacttggcttggcagcaatgaacatataccaaatgctgtcccaacttcaaataaagaattattaattgaagaatccaacttgcatgtgcctgaagggaataaacatgtggagtttgactgtgccccaacctctctccaggaagatgatcaatcttccaagatgaggattgatcttgagtcgatagatctagacaatatagaaatttcttcaactaaaccatccagccagacttcagtttcatgtgtatttgaagatgaagatagtccatctcatgaagaaattgataatgaccaaaataacagctcatcaacttcatatctagttgacaaattacatcacttgtccaacattacctttccaccagacatgaaagagaaatcattctttgatgagatggataaaaccattataggtggtgaaagtgaagatggcagccgttttgtatcttccttgcataatgctggagaagtggcttttgatcttggctcatcaatgaaatcagatcttgaaaagccatatcaatctgaggaattagattctgcttccaacaacttgttgctgcccgtagaaagcattgaaatggaggattacttatctccaaggcagatttctgaatccattaattcagagcaagctacttatactccagcattgtggactcctatggagatagaaactgcaacaggaaatgcagactgcaccttcttggagcaccctttacagcttaggagcacatatactgaagctatggattgttcagggactagagacccccatggagagcctctggtaaccagttataatagacgcttcttgggaactgttgactacatttggcggtctgaaggtcttcaaacaaccagagttcttgctccgatatctaaacatgccatgcaatggactccgggtttcccaactaagatggatggggttcataagtgggttttttgggacttttctttcactcgttatcattatgtgttacccccaactcagataagaggctattgttgtgaggttgcgacttcagagaaatggggtagtgatcatattgcattggttaccgagttggctttcttgaaagacagtaccgacactagcaacgatgttaaatag

SEQ ID NO: 60181 - DNA, 489 bp, Glycine max
  Peptide Sequence Number=SeqID_176959
atgacgggtcatgtccagatttccctagtgaacatggaaggtccttggactaatgtttgcttgcttgtagtattgccgattttggtagaggtaggagtttgtgtctatgtgcaatccatgctatcctcctttggtgcatttggttggagtgtagtgttagtgtctttgaggaggttttttggaccttttctgtttcctgttggacgcattcatcgtcttctgaagtcaagggtgacagcacatggaagagttggggcaacagctgcagtttattctgctgccatcctggagtatttaactgcagaggtgttggagttggctggcaatgcgagcaaggatctgaaggtgaagcgtattaccccaagacatctacagcttgccatccgtggagatgaagaacttgataccctcatcaaaggaacaatagctggtggaggtgttattcctcatatccacaagtcccttatcaacaaatcttcgaaggaatga

SEQ ID NO: 60182 - DNA, 1029 bp, Glycine max
  Peptide Sequence Number=SeqID_176960
ggtacatcctttgtggtacaagtagagggtacatctacttgggttgttgtaactgagaaccagagaggatacatctcttgtggatcagttcaagtggagggtacatccacttggttgttcaaagagaataagggagggtacatcccttgtggatctttgcttgtaaaggtttttacaaggttgaaagaaatctcaagaaccgcaggttgcttggggactggatgtaggcacgggttgttgccgaaccagattttggaagctagggagcaacccatcgtagctatgctagaatggataagagtgtatacaatgactagatttgcaaaaaatagaaaattaggagagaaacaaaaggcaaagggtcaaaaagtgtgtccaaggcccatgaagagattagatcaagaggtgttggcatattcaaagtggagtgtggtttggggtggtggtccaaaatttgaggttcaaaaatacccacttgcattcaaggtcgatctagatgagaaaagttgctcttgcaggaatgcaatggcagcaatgtttgaccgtagattgctaccatctgactctgttcatccatattatcatgtgaatacttatataaattgttatgcacccattctggaaccaattaatggagaagatatgtggcagcaaactggactcccaactgtcttaccccctcaagttagagtcccaattggcataccaaagaaggctaggagaagagaaaatgatgaagcaccaaaacctcataagctaaagaggacaaacacatctttgagaaaaacaaaaccacttcaacaagtcagcaaacccaaccctccagcactcaacaatctcatactcaaccactcaaaacaagcaatatgcacactcaacaatctcaaacccaagcatcaacaactgcaaaaagcgactttaggcccaaactatagatcaagagtaaaggcctccaatgaagggaaagcaagccatcaccctacaacaattgcaagatgttgtgaagaatgcatcttggaagaaaactga

SEQ ID NO: 60183 - DNA, 150 bp, Glycine max
  Peptide Sequence Number=SeqID_176961
atgacgttgtttcactccccaccaccatcacataagttgtcgaacccaacaactcaggttcccaagaatgttgtcatcgttgatgccaaagcgagagcttgcagtgggcctggtgccattgatggacacaatggtgaaggtgagtcatga

SEQ ID NO: 60184 - DNA, 1458 bp, Glycine max
  Peptide Sequence Number=SeqID_176962
atgtcgactaccgaacaacaaattttctatcgccaacttggaataaggttggataaagatcttgttaaagtttggaatgatgatggagcaaggaaaattgttaagattgttatggatttgattcaaaaacatgttgaagtatatattgatcatacttcacacatgacagagggagttttgttgactattgatgaggggggaaaacccatagttgaaggagatttagggaacgatgtcattgatggaaaagacagtgatggaaaggttgacaaggttgacttggatgatagggataaggaaactgatgaagataagggagatgatgataattatgatgaaaatgatagcgatgatgaggatgacttggatgctaaatatgatactgataaattagaatctaatatagcaagtgaagaagatgatgattattatgcacttactatagcaccaattaatggtaaagatatatcaataaaaccagtttccaagagatttcaacctcatgaaatgggaagagattttaattttgaggttggtatggagtttgattcaattagtcagtttaaggcagtcatcaaagaatatgcaaacctgcatggttttggggtgaaattcaagaaaaatgacaatgttagatgtagggtgatttgtcaagatggttgtcaatgggtggcatatgtgagtaaggttggtggatcaacaacatatagcatgaagacttacaatgaaaagcacacatgtgccaggtctagtggtggtaaattggcatcaagcaaatggattgcagaaaaattgatagaacctttgaagtatacccctaacatgtcaattaatgcagtgattcaaaaagtcagtgaaagatactatgtaaaaatatctagtaagaaggcatattgggcaagaaggattgcaaaggaaaaggtgcaaggaaattatgcgaagcaatacaataaattgtgggattatgctaatgaagttagaaggtctcagcccgattcaatgttgttattattgactgagccatctgcatatggtagtggagaattatttatgcgattttatatgtgtcatgttgtaaagcaaggatttctgcaagcatgtaggcctattattggtcttgatgattgtttcttaaaaacaccttttggtggtatattgttggtggcaatgggtcaagatcccaatgaccagtattatcctcttaacgtggttgttgttgaaagcgagaacaaagactcttggaagtggtttctacaaaacttgttaaatgatattggtcatgagaagaagtgggtcttcattttagaccaacagaaggtctctaaggaggcacatgattggttgatgcagcttgacctaagattttggtcaaaggctcacatgtcagagtactccaggtgtgatatgatcatgaacaacattgtagaagcaagcttcatcatgatgaatcaagtatga

SEQ ID NO: 60185 - DNA, 904 bp, Glycine max
  Peptide Sequence Number=SeqID_176963
ggactcccaatctgaactggttgatgtaaaaatgggagattgcttagaggaaatgatttgtgatcttggacaagaatcttttcagcaagcacaagcccgtatgtatgatacattgcaaagtgattccaagaagcctttgtattcaggaaaaacaattggtgttaatgttgaagatgatgattcaacccttgaaagttgtctcactcttttctccaaaaaaatgtcgaggaacgtcaacggagaagaagaagttgatgacatcctcgcaaatcgtaatgatcatgatgaaggagaattaattaacatcgtgcacatggttacaccacccagctcacctcctcctcctcctgagtcagcaacaccttcttcatcgtcttcgtcaaagaagactagaaaagcaacacaacttagatcattggctactagaccaattgaggtgaagagaacagtggttcatgttgatcctgtcactaggaaagtcgatgagcgatggaggcagattaagttaaatctgacctccaaatgggccctgacacatagcaaggagggcgaggatgataaagtctatgagaagtatgaaataagaaaagaaattgtagccagttttgttagagccatagagatccttcatgggagaaagcacaggccattcaggaacaaaacactacacctcaagtgttgtctcgattcattggaggagcaggcctcacagggaagctttgtcacccatggacgtcaggatgtactgacaattgccattaatcgaccaaagcatcctagtcatgtccatgccactgaagccaatgtgatgatcaaatactactttggaccggctccaaggggctcccgcacctcttcctccatggctattgaagacctagagcagctgacacaaaagatctga

SEQ ID NO: 60186 - DNA, 306 bp, Glycine max
  Peptide Sequence Number=SeqID_176964
atggaatgcaagaagaagcaaggaagatgcagaaagtacttgaggcacagcagcaaaatgcacacacgcaaaaggattagtgcaacaagcacgctaagcgcacttccaagaatttcaaaaacagtaagggattggcgcttagcgcatcctgcggctaagcccaactatgaaagctcaattccagaatggatatggggcttagctcaggacaacacgcttagtgctgcaataaatttttccaaagaagaagtggcgcttagcgcatcatctccgccaagcccactgcttaaagtttacttccagtga

SEQ ID NO: 60187 - DNA, 258 bp, Glycine max
  Peptide Sequence Number=SeqID_176965
atgcctaccttttgcgtgtgtgcattttgctgctgtgcctcaagtactttctgcatcttccttgcttcttcttgcattccatcacaatccaagctaagcgccaatatgcttctatttttcagtcctttgaataaggctaagcgcagctgctacgctaagcccttgttgtgtgtcaaggaggttgagctaagcgcgccctgctgcgctaagctcaactctctcactgctaagcgtgagtctgctgcgcttagcccatga

SEQ ID NO: 60188 - DNA, 1017 bp, Glycine max
  Peptide Sequence Number=SeqID_176966
atggatttgcctattagtttattgtttgcagctagcagaggtgatgatatgttgttgcaacaactgctaaagaagggttcagatccaaatgaaccagataagaatggaaagacagcattgcatattacagcttccaaaggcagagaccattgtgtagctttgcttctagagcatggggctaatcccaacatcaaagacttagatggaaatgtcccactatgggaagcaatcaagggtgggcatgattctgtgatgaaacttcttatagacaatggtgcagatatatcatctggtgatgtaggttctcttgcatgcgttggtgttgagcaaaataacttagaattactcaagcatattgttcaatgtggaggggacgtgacacagtccacgagcaatggaaccacagcactccatgctgcagtgtgtgaaggaaatgttgaaatagtgaagttccttctagagcatggagcagacattgataaacaagatggtagtggctggactccaaggtttttagcagatcaacaatgccacgaagaaataataaatgtattcaagaaagttggacacaagaaaacaccacatgctattcctacaacatccttttttgaaaggtatcaaagtgaacccactataccaggcattccccagggaagcaagccacctaatgaagaaccaacatggtttgataatcatcaaagaagaagagttagccctttccataattccttttttgggataatgtcaaatgcaaattatgataaaaaagactccacaaccgcatctcaaagtagtcacattagtagggaagaattactagccagagtaactcttagttgtccaaagaaaggtgaacatgccaaaaagcttatttttctgccaaaatcccttgaagaattgctacatattggtgctgaaaagtttgattactctgccaccagaatattaagcaaagaaggagctgaaattgaagacatatatgttataagagatggtgatcttcttattcttgcatag

SEQ ID NO: 60189 - DNA, 405 bp, Glycine max
  Peptide Sequence Number=SeqID_176967
atgtcatcaagccggcaaaggaagacgaagatgtttgggatgtgtggcggtgattataacgacgacgacaaggatgatgcagacaagagagagattgatgaagcaagagaagatggcagccaatatagtctcacaggcattcttcttccgtctctcggtgccacggctgtccgcaatgacagcggtagaccaaagcttcgccgatacattgtctcaccatataatcgtcgttacaaactatggaacaagtttctgctgatattggttttctacactgcttggatgtgcccatttgaatttggtttccttgagaaatcaatgggtgcagtggctataaccgacaatgttgtaaatgggtttttttgccatcgacattgttctcaccttcttcgttgcctaccttga

SEQ ID NO: 60190 - DNA, 180 bp, Glycine max
  Peptide Sequence Number=SeqID_176968
atggcgatatatctagcatggaacttcttctcttacagctgcttgacagttcatgttcaagaaagagagcttgcatcagggaatagtcttcgtggttatatccacttagttgacttggcaggaagctataaaggtaacaggaagctgtcccttagagtgcttcagcattctcctaattag

SEQ ID NO: 60191 - DNA, 168 bp, Glycine max
  Peptide Sequence Number=SeqID_176969
atggtaatcgattacaactttcaaaattcaaatttcaaaaccctttcgaaaagcagatttgcaaaattgtcttctggagaccaaacatgcgaagaagagcaaagaagtggtggcgtaaaggagttcaagtggtggtggcatatgggagctcaagcgatagtggcataa

SEQ ID NO: 60192 - DNA, 261 bp, Glycine max
  Peptide Sequence Number=SeqID_176970
atgttcattacacggatactctacatgcataggacattgccattccaggacgtaatcttgattgccactaggaggatagtaagaccaccaaagaaaggttctgatgttcaggcaatgctggaagatattatattggctgctgagattgttggaaagcgtgttaggtatagaatttatggttccaagattatgaaggtaaagattacaaccatcaactcggcacttacacatgcaatctgtggtaatttaaaggttgcttaa

SEQ ID NO: 60193 - DNA, 342 bp, Glycine max
  Peptide Sequence Number=SeqID_176971
atgaaaagaatgagaacctttttttctatcaccgtggcagttagcgaaggtggagacataggcggggtcatcggacaagtaaccttggggggcggagcacaggagaggtttaggttccccatgttggcactcttcttaatgattgatccatccgtcagcctcacctccaaaagcttcacacctccgcccccacgcgaaggacatgtccggggcgttatggccgttgttgttgcaattatattgttgcgagccattcggggaggcgtggtcgttctccagcggcgtggcgaggatgccaaacgaagcgtaggagggaccaaacgcgaaggctttgtggtggtg

SEQ ID NO: 60194 - DNA, 279 bp, Glycine max
  Peptide Sequence Number=SeqID_176972
atggcttcatttatccaaagaatcaaggatttcaaatatataagattgggttatggagcactcacacttgggaaagaattggggagaggccaatctagggtgatttatctctgcactgaggattcaattggcctgcaatatgcctataagtccattttgaggaggaagtttatgagcaaagctgacaaggaggacatgaagagggagattcaaatcatgcagcatttgagtggacagtccaacattgtggagttcaaaagtccttttgaggataagtaa

SEQ ID NO: 60195 - DNA, 192 bp, Glycine max
  Peptide Sequence Number=SeqID_176973
atgcagaggcgaagtttctggaatctggctaatttttttgatactttcgcttaccagaccgctgcgctaagcgagcaagagacacgtttggtttctcaacaaggctcgcttagcagactcagacttggcttagcacgagggtacgtccgctttgcgaggtatgcagatcagaaaagctgcaactctcgctaa

SEQ ID NO: 60196 - DNA, 141 bp, Glycine max
  Peptide Sequence Number=SeqID_176974
atgtttgggctagatgaaatagaggaaatgtgtgagacaattactaaattgaatgttgagcttttggcaaaggcatataaggagaggacacttgaggaaaagatgttgcagttgatggagaatcatgaccagcaaagttag

SEQ ID NO: 60197 - DNA, 204 bp, Glycine max
  Peptide Sequence Number=SeqID_176975
atgggttctgcttcaagagttgaaagtagcaactacagttactactttaaggaaaatggaactaggtggcataggatcatatataccacgttcttgcaaattcaagaactgttcctctcaaaggaaaccctaggaactgagccactaccaattgtacgaggaatgacatatattctgcttggtgaatatggtgcatacctctaa

SEQ ID NO: 60198 - DNA, 585 bp, Glycine max
  Peptide Sequence Number=SeqID_176976
atggggcctcaccacccatcaatgcatggtgttcttagacttattgttactctagacggtgaggatgttattgattgtgaacctatattgggttatttacacagaggaatggaaaaaatagcggaaaaccgaacaattatacaatatttgccttatgtaacacgttgggactatttagctactatgttcacagaagcaataactgtaaatggaccagaacagttgggaaatattcaagtacctaaaagagccagttatatccgagtaataatgttggagttaagtcgtatagcttctcacctactatggctaggaccttttatggcagatattggtgcacaaacccccttcttctatattttcagagaaagagaattaatatatgatctatttgaagctgcgacgggtatgagaatgatgcataatttttttcgtatcgggggggtagcgactgatctaccttatggttgggacccatgcttcgggcttccggaatacaatgggatctccgtaaagtggataattatgaatgttacgaagaatttgattgggaagttcaatggcaaaaagaaggagattccttag

SEQ ID NO: 60199 - DNA, 359 bp, Glycine max
  Peptide Sequence Number=SeqID_176977
atgcatgccttcgggcaggaacaagggcagcatcaccgaggacatgaacagcacggtgatcagcggcacaccgcgccagaactcgatgaaggtgacgcagatgaccttgatcgccggcaggttggaacgtcgccccagtgccagcaggatacccagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 60200 - DNA, 837 bp, Glycine max
  Peptide Sequence Number=SeqID_176978
atgaagcacttcactgacaccctcatcagtgccaacataggaacaaaagctggtaccgggccccccctcgaggtcgacggtatcgataagcttgatctgggtatcctgctggcactggggcgacgttccaacctgccggcgatcaaggtcatctgcgtcaccttcatcgagttctggcgcggtgtgccgctgatcaccgtgctgttcatgtcctcggtgatgctgcccttgttcctgcccgaaggcatgcatttcgacaagctgatgcgtgcgctgatcggggtgatcctgttccagtccgcctacatcgccgaagtggtgcgcggtggtctgcaggccattcccaaagggcagtacgaggcggccgcggccatgggcctgggctactggcggatgatgggcctggtgatcctgccgcaggcgctgaagctggtgattccgggcatcgtcaacgtcttcatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60201 - DNA, 342 bp, Glycine max
  Peptide Sequence Number=SeqID_176979
atgagttcatccattaaccaaggtatcccccatagaagaatagcgcaatcttcaaaagtccaaggaagatctgccttagttcaagctgaagcatttgctaaagttatggatgacacccttgtacgagggatcatcattgatcttacaaccactggtgtcatggatgaaactcctaaggcatctaatacaactttagctaataaagttgaactcaatgctttagaacctgggtccaagcaatcaacaacttcaaatgagggtgcttttagagacaaggatgaactcgatgttgccatcatatactccaccagtttgggccccactcctctaaactatgcataa

SEQ ID NO: 60202 - DNA, 771 bp, Glycine max
  Peptide Sequence Number=SeqID_176980
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtgggcgattcgaccagcaggcggctgtccttgtcgatcagcaccttggcgatcaaatccagcccctgctggctgccggtggtgatcaacacctgatcgggcgacacggtggcaccctgcttgcccagctcggcggagacccactggcgcagctcgggcaggccttcgctggacgcgtactgcagcgacggcttggcgaccacgctgccttcggccagcacgctggcgcaggcggcgcgcatggcttcgacggggaaggtctcgggcgacggcaggccgccggcaaagttgaggatgccggggcgctcggtcaccttcaggatctcgcggatcgccgaggggttcatggcgtgggcacgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 60203 - DNA, 474 bp, Glycine max
  Peptide Sequence Number=SeqID_176981
atggaggaaatgggaaagttggatcatctaaaggaaaggctcagggccattgaaggaagtgaagattatgcctttgctaacctagaagagttgttcctagtacccaatatcatcacccctcccaagttcaaggtgccagactttgacaagtacaagggtactacttgccccaagaaccatctaaagacgtgttgtcaaaagatggtggcatacgcaaaagatgaggaattgttgatacatttcttccaagaaagtcttactggggtagctgttacctggtacgctaacttggaaccttcccgagtccattcttggaaggacctaacggttgtctttgttaggcagtatcagtacaattttgatatggttctggataggatgcaactacagaacatgtgcaaaaatgggcacggatatttcaaagaatacgcccaaaggtggagagacctgccagcccaagtggcacctcaatga

SEQ ID NO: 60204 - DNA, 406 bp, Glycine max
  Peptide Sequence Number=SeqID_176982
gtcgactctagaggatcccactcgtagttggaccttgggttgggtcgatcggtccgcctccggtgtgcaccggtcggctcgtcccttctgccggcgatgcgctcctgtccttaactggccgggtcgtgcctccggtgctgattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 60205 - DNA, 876 bp, Glycine max
  Peptide Sequence Number=SeqID_176983
atgaagctcaacaccagcgacaaaatgctgaaagaggtggagcagagcgtcatcccgttgctggccgagcgttatcagaatatccagaccaccaaagaagagaacttcagcgtcggcaaacagaagtttcgccgggtgtattccgagcagactgtcaacgggcaaaaggtggtctccacgctggtgttgtcggtgttcaacaagcgggtggtgacgctgcaaatgctgtcgccggccaaaacgccggaagtgcatcaggcgctggtgcagcagattatcgataccctggcggtgaacccctttgtgcgcaagatttccgtaatgctgctggaaaaagggatcgcgttcgaattcgtcaacgatccgccgtatgagcccggcagccgggtgaaggagcttaacccgctcggcaaggtgccggtgctgatcgccgatgacggcgaggtgttttacgattcgccggtggtggccgaatacctcgaactgctgacggtggagccggcgtttttgccggccgatcgcgccgccgcactgcgcgtccgccaggtggcggcgctggcggacggcgtgaccgaagcggcggcgaccctgtttcgcgaaagccggcgcgcgccggaaaaacaggacgaaaactggatgctgcgccagcgtgacaaactgacgcacgggttggatgcgctggaggcgctggcgcgggacaaaacgtggctcaatgccgagcggctgacgctggcggatatcgccaccggctgcgcgctgggctacctgaatttccgccgcatcctgcccaactggtgcgtcgggcgcccggcgctggtcaagctggccgaacgcctgttcgcccgtgaaagcttcgcccgcaccgcgccgccctga

SEQ ID NO: 60206 - DNA, 2715 bp, Glycine max
  Peptide Sequence Number=SeqID_176984
cgcttcgcccggggcgtccgcgcctttccagtgccactgcagccagcggccggagttgacgatcgagccgttctcttcggcgaagcaggtggatggcaggcggaacacttcggtctggatctgcgcaggatccacctcgttgaactcgccgtggttctgccagaagttggaggtctcggtgttcaacggatcgatggtcaccaggaacttcagcttggacagcgaagccaccaccttgtttttgttcgggaacgacgccaccgggttaaagccctggcagaagtagccgttgaccttgccctgcgccatcatctcgaagtactgcagcacgtcgtagcctttgtcccacttcggcaaccagtcaaagccccagctgttgtccttctgcgccttgtcgccgtagaaggtcttcatcatgctgacgaagaatttcgggtagttgccccagtagttaacctggcccggcagcagcgccttcggcgtgttggccttcaggtaggtgtcgagatcggtctgtttctccgacggcagcgtcaggtagcccggcaggctctgcgacagcaggccgagatcggtcagaccctgaatgttggagtggccacgcagcgcgttgacgccgccgcccgccatgcccatgttgccgagcagcagttggatcatcgccatggtgcggatgttctgcgcgccgaccgagtgctgagtccagcccagggcgtacaggaacgaagcggttttatccgcgacgcaggtttcggcgatgtattcgcacaccttgaggaaatcgtccttcggcgtgccgcagatgttggtcaccacgtcaggcgtgtagcggctcacgtgctgtttcagcatgttccacacgcagcgcggatcctgcagcgtgacgtcgcgcttggcgaagccgttctcgtcgaactggtagttccaggtggttttgtcgtacttgcggttttccgcgtcgtagccgctgaacaagccgtcttcgaaggcaaaatcttcccgcaccagcaggctggcgttggtgtaggcctcgacgtactcgcggttgaacttgttgttggtcatcagatacagcaacacgcccgacaggaaagcgatgtcggtcccggagcggatcggcgtgtagaagtccgccaccgatgcggttcgggtaaagcgcggatcgatcacgatcagcttggcattgttgtgtattttggcttccatcgcccagcggaaccccaccggatgcgcttccgccgcattaccgcccatgacgataatcaaattcgcgttcttgatatcaacccagtggttggtcatcgcaccgcgaccaaatgttggagcaagacttgctaccgttggtccgtgtcagacacgcgcctggttgtctacggcaagcatgccgagagcgcgactaaatttttgcgacagaaaaccggtttcgttgctggcggccgaggcgcacagcatgccggtggtcagccaacggttgacggtaacgccctgatcgttggttttgatgaagttggcgtcgcggtcttctttcaccagcttggcgatgcgggtaaaggcgtcgtcccagctgatgcgttgccatttgtccgatcctggcgcccggtattccgggtacttgaggcggctttcgctgtggatgaagtcaaccaggccggcgcctttcgggcaaagcgcgccgcggtttaccggatgatccggatccccttcgatatggaaaatgctttctttggcgtttttggcgccatcaccaaggctgtacatcaacagcccacagccgacggaacaatacgtacaggtattacgggtctcgcgggcgcgcagcacgcggccaccgtcgttcctgccataccgccagcgcagatcttaaagaactgccttctgctgacctgcatgggggtctcctttactctcgattgtcacattgttcaaaggcgcctgcccgctagcgcggcaaacgcgaatgtcactgttgttatgcttgctacgaacgccggccatattaccacagcgtgcttgtggttgttacacactcgtgctcattcagtgaacgctttggcacatttcgatacatttcggcgttggcgctccctacagtatagagattcacagggcattgataatcattttcaatatcatttaattaactataatgatccgactgcttacgcggtgctcacgctttgcgccgcccatacaccactggagatgatgattatgagttattcactgccatccctgccgtacgcttacgacgcactggaaccgcatttcgacaagcagacgatggaaatccatcacaccaaacaccatcagacctacgtcaacaacgccaacaccgtgctggaagcctaccctgagctggccaaatacagcgttgaagagctgatccaggatctggataaagtgcctgccgacaaacgcaccttcatgcgcaacaacgccggcggccacgccaaccacagcttcttctggaaaaacctgaaaaccggcaccacgctgggcggcgatctgaaagcggccatcgagcgcgatttcggcagcgttgagaaattccaggaagagttcgagaaagccgctgccacccgcttcggttccggttgggcctggctggtgctgaaggacggcaaactggccgtggtgtctaccgctaaccaggacagcccgctgatgggcgaagcggtcgccggcgcttcccggtttccaatcatcgacctggac

SEQ ID NO: 60207 - DNA, 426 bp, Glycine max
  Peptide Sequence Number=SeqID_176985
gtattccgcaaggacgactatgcggtgaaatatgccgtcgaaccgctattgtccggcagcggcccgctgggggagctgtcggtgcgcctgaagctgatgtatgggctgggggtgatctcccgccacgaatatgaagacgccgagctgctgatggcgatgcgcgaagagctgaatcacgacggtgcggaataccgcttcgtcgacgacgaaatcctcgggccgttcggcgagctgcactgcgtggccgcgctgccgccggcgccgaccttcctgcagccgggcgaagcggatgaagcgctgatcgccatgcagcgtcagcgctatcagcagatggtgcgctccaccatggtgctgtccattaccgatctgatcgccggcatcggcgccaaacaaccttcccgactctctcctctcggccgcggctaa

SEQ ID NO: 60208 - DNA, 1226 bp, Glycine max
  Peptide Sequence Number=SeqID_176986
atgacgccgttaaacgcgcgcagcttccaggcgacctggagcgcgttgcgcaaccggtcgcccagcaccgcccacagcagcacacagggtaaattcagcacgacgaaacctgcgatgacgctcagcgatcgccacgttgatcaccatcagccaggccttggggttgaccgcctgaaacagcgcgccgttgaggaaactcattggcctcacctgctctttggccaggtaggcgcagccgatcaccgccagcgggaagcggatgacgccggcccagctgagcgccagcgccagcagcgggataatgatagccagctgcaccgcgcagccggcgccgatgccgaacagcatcggcagggtgcggcgcaggccgaagttgacgcccgacgaggccagcagcaggttgttggggccgggggtaatcgacatgacggtgacgtagctgacaaaggcggagtccagcatggcaggttccttgaaaatgacggtaataacgagaggatcagcataatcgctgcaatgggagaaactgtgaccctgctcgatgaaaccccggatacccgttacctgcagctggcggatacgctggccgaggccattcgccgcggcacgctgctgcccggcgaccgcttgccttcggtgcggcgctgtgcgcaaacccatcgccacgctgccggcgctgaagatggcctcggcgcccagcggccgcatcgagccgccggcggacgacgtgctggcgctgatcgatactgtgttcgccgcccagcagaatccggccttcaccaacattgcgctggcctgcccgcagaccagcgatttttatcccggcggcaagctggggcgcatgctgtcctctcagctgcgccgtcaaccggatctgatcggacagtattcgttgccgcccggcagcctgcggctgcgtcagcagatcgcccgccgttcgatgacgctgggcatgctgctggagccgggcgacgtggtgctgacccacggctgcatggaggcgttgcagctggcgctgcgcgtcaccaccaaaccgggcgactgcgtcgggctggagtcaccgacctacttctacctgctgccgctgctggccagcctggggctgaaagcgctggaaatccccaccgatccgcagctggggctgtcgctggacgcgctggagctgctattgaacgagactcggctgaacgcggtgattgccatgcccacggacaaaacccgctggg

SEQ ID NO: 60209 - DNA, 295 bp, Glycine max
  Peptide Sequence Number=SeqID_176987
ggcaaccaccaccgccactaccaccattagtcataggttcctggctccaccgacacctctcggcaacacttcaccacggatcgcttcgagatcttctccgtcaagcaggaacctacgtccctcactcttatgccgttacgcggtcatgattctggtgaagtgcatcattttattggttgctcttgatgtagttaagtcagctggtgacggattctttaggaggttttacacttctttcgcaccaagtacattggaaattagttttaattttactatggcttcatctatttcataa

SEQ ID NO: 60210 - DNA, 354 bp, Glycine max
  Peptide Sequence Number=SeqID_176988
atgcccgtatcgtacgaagtactaacgaaatttattggacaaaaggttaaagacatttatggaagggagttcggatacctaattcacgtatacagcgagatagatggaagtataactgggattgaggtagctcaaggttcttctatcttgactatgggaccagaaaggataaaattagatggagatagtatattaattctcccagattggaaagcagaagcaataagaatattaagcctaatggaaaaaattagaaaaaggcagagagcgttagaggaattatacaataaacaagagattcctaaaagcgattatgatgacatgaaaaggaaacttgatacggagatgttaaag

SEQ ID NO: 60211 - DNA, 249 bp, Glycine max
  Peptide Sequence Number=SeqID_176989
atggagcagaaagaggtaggagacattgttggtgacaagccacaatccgtcacaattatcattttcagagaccaagcaatgccccaccactgttggtggaatccaaacgtagcaaacatatctatcatgagtagtcttgctgccaaggcctccctcaagaagccacatacaacagcatgggtagttagggatttcatgagatgggtacataagttctcctccatcatgactcttcaatctaaggcctaa

SEQ ID NO: 60212 - DNA, 519 bp, Glycine max
  Peptide Sequence Number=SeqID_176990
atgtatctccatccaagctatcctcgcacaccttatattcgaaagggttggctgtttcgccaacttgtcaagctgataatatttacaggagttatgggatttataatagaacaatacattaatcccattgtacaaaattcacagcatcctctcaagggaaaccttctttacgccatcgagagagttctgaagctttctgttccaaatttatatgtgtggctctgcatgttctattgctttttccacctttggttaaatatattggcagagcttcttcgatttggtgatcgtgaattctaccaggattggtggaatgccaaaactgttgaagatcaaaatgattttcaggtctcctgttgggatgaaattcatgtgaacacaccctgttcacaaatggatgatccgccacctatattttccatgtttaaggcacggtataccaaaggatttgtcagcctctgtttaccatctcgggttgctactaagatcatcacatttaacatagttgaattaaaatga

SEQ ID NO: 60213 - DNA, 186 bp, Glycine max
  Peptide Sequence Number=SeqID_176991
atggaacctcgcgttgggaataagtttcgcctgggtcggaagatcggaagtggctcctttggggagatctatttaggcactaatattcagacaaatgaagaggttgcaattaagcttatgtctagtatcatttctgagcttattcctgcgtcttatttcttggaaggtgatgaagttccctcttaa

SEQ ID NO: 60214 - DNA, 1077 bp, Glycine max
  Peptide Sequence Number=SeqID_176992
atgacggcgccgttaacgggtcgtcgtcgccgaaaacctatggaagggttgcacgaggtgggtcccccaccgttcctgaagaagacgttcgaaatggtggaggaccctcacaccgaccccattgtgtcgtggagccaaactcgcgacagtttcatcgtttgggactctcacgaattctccaaatcacttctccctaagtacttcaagcacagtaatttctccagcttcgttcgccagctcaacacctatggctttaggaaggttgattcggaccgttgggagtttgcgaatgaaggattccaaggagggaagaagcatttgctgaagaacataaggaggaggtgtaagtacaacaagctgcatcagggagcattcaatatgatgaagccatgtgtggattctgaagtggagaagctgaagaaggaccagaacattttgaaggtggagattctgaagctgaggcagcagcaggagaattcgcatgttcagctcacaaatgttcaggagagaattcggtgtgcagaggtaaaacagtatcagatgatgtatttcctcaccagaatggctagaaggcctgcgtttgttgagcagttagtccataagattaggcgaaaaagagagattgatggtaatgaaatggttaagaggcctagattgatgggaaccccgtgccatgtacccttccccaagaccatggaaacaacacctgattttgatcatagacaccaacaaggtcataaacaatttgctacattgcaatctgaactcaatggacttctgtctgaaactgtgaacactggtaggatggagcacccaactccatctcctttggaagatgaattatgcagctctttgcaagggttaagggctcatggtatttctagagcaagtgcgcaagatgcatcttcttctgcctatcatgttatgtcagaaaaactaatgagagaaaattctatagttgatgaagaactagatgtgaatgactcaaatatctatctcgaattagaggatttgattactaagccaacagattggtctgttggatctgcaagtggattggtggaacaaaccagttga

SEQ ID NO: 60215 - DNA, 183 bp, Glycine max
  Peptide Sequence Number=SeqID_176993
atgacctccttccccctttccctctaccacgaacgcaacctccctttgcaacaaaggtctaagcctgaggccgacgtagtgtgggagcttggtgaaagtccaatggggtgcgacgtgggagaagttagaggaagggagatgcacgatgacaaaggaatcaaagaggtgaccatcgtgaaatga

SEQ ID NO: 60216 - DNA, 135 bp, Glycine max
  Peptide Sequence Number=SeqID_176994
atgagagaggagagtggcgtatctttgagactgtccatttcaggaaactccgttcgacagccacgttttcacgcctcttactttctttttcttgccacttgtacggatataatcaagctaaggcaattgagatag

SEQ ID NO: 60217 - DNA, 120 bp, Glycine max
  Peptide Sequence Number=SeqID_176995
atggccattttctcagtcatggtcatggatatgcatggttttaaactaggaataattggcacttctcagattttgagcttttcgtctaaagttaagctcatggtggatgatgctggataa

SEQ ID NO: 60218 - DNA, 438 bp, Glycine max
  Peptide Sequence Number=SeqID_176996
atgggaaaaaaagcatgtcagcagacatacttgcggagaagagaaacacagttgggagaaggaaaagaatacaaatgcatgaactactacagatgcacttctgctggatgtccggtcagaaagcacattgagaccgctgtagataattcagatgccgtcatcataacatacaagggtgtacatgaccatgacatgccagtgcccaagaaacgacatgggccaccaagtgctcctcttgtggctgctgcagcacctgcctccttgaacagtttgcaggtgaagaaatccgattccccacaaaacaagaaaatttctactcaatggtcagtggacaccgaaggagaactaactggggaagcactggagcttgggggtgagaaagcaatggagtcagctcgaacgcttctgagcataggttttgaaattaagccttgctga

SEQ ID NO: 60219 - DNA, 159 bp, Glycine max
  Peptide Sequence Number=SeqID_176997
atgatctcttggaagctgtatcttctggatgtgttattgaagcataattgggaaaattttggtggggttgatgatgctgaggagttgaagaagaagggtttcaggaaagtgggactggaagtgcccggaatactgagtcatagtgaagatgaacattga

SEQ ID NO: 60220 - DNA, 405 bp, Glycine max
  Peptide Sequence Number=SeqID_176998
atgataggacagctaatatcactgcctggaggattaagcagtcttgaatacactttaagcatggaaagtgatggctcatttcagtatggttactattggagggaggcagaagatttgcgtgctgtaattcaacattttcatgaatcaaaccgtggagttagtgccattgtcgggcacagtaaaggaggtggcgtggtgcttctttatgcttctaaatatcatgacattaaaacagttgtcaacctatctggacgctatgatctgaaagtaggaatcgaagaacgccttggaaaagatcatattgaaagaattaggaaggatggtttcatagatgtgacgagaatattgaagatgaagattaagatgcaaactatttcaacaatattcttcaagtatgcaagataa

SEQ ID NO: 60221 - DNA, 888 bp, Glycine max
  Peptide Sequence Number=SeqID_176999
atgattactgtcttgacgggtccggtcggaactttacctcatcaggtttttgaatccaggaagcattcacaaccaatcttttctgatttttctcgcaaattggttcgcatttccagaaaaaccctgagcttgaagatggcccaagctgctcaaaaccctactcggcagcagaaagtcataataactaacaagtatggcaataaactagtgggcattttgcatgaatctggaaccaaagagattgttatcctttgccatggtcttcgatccaccaaggaagatgatatcatcataaatcttgctgctgctctagaaaatgcaggagtcaattcttttcgctttgacttcactggaaatggggaaagtgaaggttcatttgagtttggtcactattggagggaggtggatgatctacatgatgtggttcaacacttacatagggaaaaccctaaagttattgcaatcattggacacagtaaaggaggtagcgtggtgcttctttatgcttctaaacatcatgacattaaaactgttgtcaacctctctggacgctatgatctgaaggcaggacttgaagaacgccttggaaaagattatttggaaagaattaggaaggatcgtttcattgatgtgatgcagttaggtaacctatcatttaatcacacaaaagtcccatggctcttagagcatgttgaagtttttgattaccgtgtgactatggagagtttgatggatcgattagatacaaacatgcatgaagcatgccttcagattgataaagaatgcagggtcctcacagttcatggttcttcagacccagttatccctgttggagatgcatctgagtttgccaagattataccaaaccacaagctaattatcatatag

SEQ ID NO: 60222 - DNA, 471 bp, Glycine max
  Peptide Sequence Number=SeqID_177000
atgcataaggcattacgtgcaaatgcacatcttccttatccccaacttgtcactctttatctccaagactttaacattcctctagatgatgagtcttttgttaaagttaaatgctcttttgctattggggccgctgttgttgcatcttttggatatcgaaaagacatagatggtcaacgggtgcggaaacaagatcttccaccgactcctaatgaacgcacaccctctccaccaccacaaaggaattcctcttcttccttgctgcaagatgttctaagtgagcttcagggttcgggcttttgttggggcagagatatccgtaaggggagtgaacgtgccgcacagagatattttctttactcctttcagatggttgtcatcatcaaaaagggggagaatgtgaatagtcatgacccttcaaaacataattgtgtaatcgattatcaagaagctataatcgattaccagtga

SEQ ID NO: 60223 - DNA, 1035 bp, Glycine max
  Peptide Sequence Number=SeqID_177001
atgtattacatatttaatggttgcgggaaaggagacctagtgacgtgttctgcggagaacaactcggagttattttacgccgttctaggaggtttaggccaatttggaattataaccagggcaagaatagctcttgggccagcaccaacgagggcaaataattttaaagaaaaaactaaaacagacaaattccatgcatatatatggttagtgaagtggctccgtttgctgtacaacgatttctctgcattttctggagaccaagaacacttaatctctttcaatggaataaacgagactaatgcagctgattatgtagaaggttttcttttgcaaaatcagccaccactggacctttccttttatccagaacctgatcatcctcgcataacttcccttgtaacccaatacggcatcatctacgtcatagaacttgtcaaatattatgacaatagtactcaagaacacgttgatgaggatgtgaatttttgggtcgaggaattaaagtttgttcctacgtttatgttcgaaaaagatgtgtcgtacgaagagttcctaaacagggttcatgctgacgagcttttcctaaggtcacaagggctttgggatattcctcatccctggttaaacctctttgttccagcatctcgaatctcggatttcgacgaaggtgtgttcaagggcattattctccagcaaaatatcactgcaggacttgtgataatctaccccatgaaccgaaccaagtgggatgataacatgtcagcagttacacctcatgatgatgttttctacgtcgtgtcatttcttcattcaactgggtttgataagttggaggaatttcaggctcaaaaccaacaaatattacagttctgtgcgaatgctggtattgggataaagcaatatcttccccaaaacaaaacacaggaagaatgggagaagcagtttggccccaaatggaaaactttcaaagaaagaaaagctcaatttgatcccaacagtatattgtcacctggacaggggattttcaattaa

SEQ ID NO: 60224 - DNA, 480 bp, Glycine max
  Peptide Sequence Number=SeqID_177002
atgaagggtgcatttccttccatctttgaagtcaaaaagaggaataccaaacttgaatttggcaacttcactatccctccacttttggtgaacttgaatttgatgaaggaagcttggcctgttcgctaccttcactcgttgtggagtgtcaagttgcgatgtctggttcgaacaagaaactctgaatttgatagtggcgtggccttggggttgggaaggaagaagagccacacggtgtggaagaagaacaattcaatggaattggttgaagcgccatggcataataattactccctctatcatatggaatggaatcgcataaaacctctctactacttcactattttcagaagcctcttacttgctgcacctccaaaaacacccaaacagacaaaactacccctgcagccaaccacccaagcatccaactctaatgtagggaagaaggtgcagatggagtcaaagatgaagacgaaatag

SEQ ID NO: 60225 - DNA, 1659 bp, Glycine max
  Peptide Sequence Number=SeqID_177003
atggctctacactacccttttccaacctacttcatactactactagtaaccataacccgtttgatatacaccgtgggaaaaaccgagcaatggaaagctccgattctaacagagcttgacattaataacatatcccacaaactccatgatgatcctgaaatcattcaaatggcttcaagggactatggccacatcgtgcatgaattcccattagctgtgtttcgtccatcttctatagacgacatagccaccttgataaaatcctcctacaatagctttgccccttttggcatagctgcgaggggccaaggccactccactcatggacaagccatggctcgtgatggggttgtggttgacatggccaacctcagaaaacaaagaaatggggttgcgattagtgtctctaaggaccctttgatgggtcactatgcggatgttggaggggaacaactctggattgatgtgctacataccacacttaaacatggacttgcaccagtttcttggactgattatttgtacttgaccgtgggagggacactttccaatgctggaatcagtggccagagcttccgttatggacctcaaatcagcaacgttcatgaaatggatgtcatcactgttagtgtggttgttgaatctaaaacaggaatagtctttgtctacaatatgggaaaaggagagttcgtaacttgctcttcacagaagaacttggagttattccacgcggttcttggaggcttagggcaatttggagttatagcaagggcgagaatagcacttgagccagcccccaaaagggttaagtgggtcagactactttatagtgacttttttgcttttaccaaagatcaggaacgattaatctcaatcaatggaaggaaacaaaagaacgcattggattttctggaagggatgctgctaatgaaccaaggccccataaataattggagatcctctttcttccctctatctgaccatcccagaatatcttctttaataactgaacatagcatcctctactgtcttgaagtggctaaatattatgacgaacaaaccgagataaatgtggacaaggaaattcaagttttgctccaaggactagcctatatccctgggttttattatgagaaaaacgtgtcgtacgttgagttcttgaatagggtccgaagtggagagttgaagcttcagtcacaaggactgtgggatgttcctcacccatggcttaatttgtttataccaaaatctcaaatcttggattttaattcaagagtattcaaagatatagttcttaaaagaaacatctcctctggaccagtcttggtttaccccacgaatagaaacaagtgggacgataggatgtcagcatctataccagacgaggaggttttctacacagttggatttttgcactcaagtgggtttgatacttggaaagcatatgatgctcaaaacagtgaaattttggagttctgtagagatgctggcatcaaggtcaagcaatatcttcccaaccacagcacacaggaagattggacaaaccattttggtgctaaatggataaaattcttagaaagaaaacatcagtttgatccaagaatgattctatcaccagggcaaaaaatcttccacaaacaattacagccagcgttttaa

SEQ ID NO: 60226 - DNA, 1055 bp, Glycine max
  Peptide Sequence Number=SeqID_177004
atggcccagcgccgcagcccccaacctctcccagagccagacaccaaaggaaacgattcccaccaaaaaccgcaacacaacaaggaaacagaccgagtcgccgaatcgccttccgccgccgagtcgcagcgtggcgagttacggagctccgacgagcctcgtacggagtccaatttagaaaccctaggccgtggtgtttcctcatcggttgaaacccttgctgcgcagtctccgactgacgtgaattgtgtggttgatgtaacagatttgcaagggagctctaccgcgcttaattcgggtgccaaagccgaaagtaaggagaccgttggatctcctgaaaaggaaattattgatagaggagcagtgcagccactccaaactcagacagaagatcggcttcaggtgtctgcgtgttcaactccattgtctgatctatcaccaacttctgttacacaatctttatcaattgtttctagtccaaccataccgaaacagaaaatatctactccaaaggtcaataacgcacatgtgccagaagtagataagaaaaatccttctggtcgcaaaaccttatcttctgtttctattgcaaggacatcagcatctgatggatacaactggcggaagtatggtcagaagcaagtgaagagtcctacaggttctcgaagctattacaggtgtactcattcagattgttgtgctaagaagattgaatgctgtgatgattcaggtcatgtgatagagattgtatataaaagtgagcacagtcatgatcctccacggaagactaattccattagggaaaataagtttctgtcttccagtgaacccattgtagaaaacagtgttccggagcagcctatcaaagttctgaaggatgctgatccatccatttcttcaaaagaatctctacaagaagcaccctgcagcactgataagaaacgacaaaacacatctaatatcagtggtaatgccggagatgtggggatatctgctgatggttaccgatggcgcaagtatgggcagaaaatggtgaaaggaaatccacatcccag

SEQ ID NO: 60227 - DNA, 177 bp, Glycine max
  Peptide Sequence Number=SeqID_177005
atgagtcatcacagacaaactcctggtcctgggggctttaatagcatgtcaaggatcaattctcctaaaagctcagagttggacataagctcgagaatgaatatgcaggatcaaaatcagatctcaacaaccatagagattacgacaccaaatgacagaacaaaaaaaggaagttga

SEQ ID NO: 60228 - DNA, 1288 bp, Glycine max
  Peptide Sequence Number=SeqID_177006
ctccctcgaagactattcttccttcttcttccctgatatggatcccaagcgtcgtggaaacgacaccgctttcaacgacctcctcaattccctcatccacttagacaacaaacaaaccctcatggatcctactcaattccaattcgactcctcccccccaaccaagagacctcgtcgtgccattgaagacatccacaatgtcacggtccaacaacaacaacaacaacaacgccgcctgtgggtcaaggatcgctccaaggactggtgggaccgctgcaaccagccggacttccctgaagaggaattccggcgctacttccgcatgagcaaggccaccttcgacatgatctgccagcatctggactccgccgtcaccaagaaaaacacgatgctccgccaggcgatcccggtgcggcagcgcgtggcggtgtgcatttggcgcctcgccaccggcgaccccctccgcgaggtttccaaacgcttcggcttgggaatctccacgtgtcacaagctcgtgctggaggtctgctccgccataaaaaccgttctgatgcccaagttcctccactggccaaacgaagccgaaatgaaacccatcacccaaaaattcgaatctctctccggaatcccctacgtgggaggctcaatgtacaccactcacattcccatcattgcacccaagtccaacgtcaacgcttacttcaacaagcaccacacagaacgaaaccagaagactagttactctataaccgttcagggcgtggttgattccaaaggtgtctttagtgatgtttgtatcggttggcctggttctctctccgacgatcaagtgttggagaaaagcgcgctgtatcagagagcgactatggggactttgaaggacgtttgggtggtgggaaactctggacaccctcttatggacggtgttttggttccttacacgcatcagaatcttacttggacgcagcacgcgtttaatcagaaggttggggagattcagagcattgctaaggacgctttcgcgaggctcaaagggaggtggtcttgcttgcagaagaggaccgaagtgaagcttgaggacttgcccgtgcttcttggggcgtgctgtgttttgcataatatttgtgagatgagagatgaggaaatggatcctcactggaagtttgagatcttcgatgatgagatggtggcggagaataacgttcgctctaatgctgcagagcaagccagagatcagatagcgcactatttgttgcaccatggtcgtgcagggactaattttttgtag

SEQ ID NO: 60229 - DNA, 303 bp, Glycine max
  Peptide Sequence Number=SeqID_177007
atgagagagtgcaattggcgatggagagaatcgaagggaaagttggaattaggaagagttgagttgcccgactctgagttggagctccaaattcgtacaaggcgaagccatggagtccggtgttttgatcatgatcgccagcaattggaccgacttcaaattacccttttgcccatcttttccctttttccgaatttaggatccccattcaatcaggggcgttttcggaataccgctgttccaacaccgtataactggcaatgtgttacacacatgtgctatgattattatggcatcatgtaa

SEQ ID NO: 60230 - DNA, 2208 bp, Glycine max
  Peptide Sequence Number=SeqID_177008
atgagatcaggcatatcacgaaatttccgaaatgcaaggcaggaggatgcacatgagtatatggtgaatttacttgagtgtatgcataaatgttgcctgccttctggcataccaagcgaatcacctggtgcttatgagaaaagttttgttcataaaatttttggtggtcgtctcaggagtcaggtgaaatgccaccagtgttcttattgctccaacaaatttgatcctttcttagatttaagtcttgaaatattcaaggcagactcattgcaaaaagcactttcaaatttcacggctgcagaatggttggatggaggggagaaggagtaccattgtcagcggtgcaaacagaaagttaaggctctcaaacagctaacaatacataaggcaccttatgtgctaacgatccacttaaagcggtttcatgcccatgatactggacaaaagattaaaaagaaggttcaatttggctgtgcactggacttgaaaccttttgtcagtggctcaaatgatggagatgtgaagtactctctatatggtgttctggttcatgctggttccagcactcattctggacactattactgctatgttcgcacttcaaataacatgtggtataccttggatgacaaccgggtaagtcatgtaagtgagcgggaagttttaaaccagcaagcatacatgttgttttatgttcgtgatagaaaaagtattgttccaaggaagcctgttgacattgctaagaaggaaaatatgaagactaatttgaatgtaaatagagaatcttcaacttcaaaccatgtattgaaggaatatccaaatggtaccgtcgaaaataaagctgagaagggtgctctagttctgcaaaagcatagtgtcatattagcagaaaacttgatacaaagtaaaagacatggatctgaactttcttctgaggcacaggcacagaaagactcaccggatggactgtctgtagctaaatcagaacttggatgcttgtcatcattagatcactctggaaaagattatagtctccctcataatctgaaatctttagctgcaccagttggaaaaaataatttgcgcaatgagaatgtattttcaaaagagggcattaaagattctccttcaatagtgccctcatccactaatccccagaatgttgaactcactactgaatggaaatctcagtctctgaagaaaaatcttgtcaagatagttgatgttgctacacctcaagattcaagcacaaatatgaccaatggcatttgccctaagacatcactaattcatctgaaagttaaccatcagcttggaacttctgcaattggttcggtgtgtgagaaagcaagtagtgtggtgcatgaagatctggttggttctcagggactggttcttaataagtcagtaaatacatctttgaatacagagagtcttaatcaaaagcctttgaaaaaatcaaaaaagaagttccttaagtatcaggtatcttggatgcatcttcgcccaatcttctattacatggcatacttgggcccacggaagaagaatcacaaaagaattaaacgccgcactttgagtatgaagaatccaaacaaagacaagcttgataagcttgctttctcatcagaagatgccaaacctgatgtatttccttgtctatcaagttgttctgatagtaaagcaaccaaggctggttatagacctagtgctaattttaaatctagtgatgaatctctaatagagactagggctgaaggggaatttaggaagagaattgatcatagctgtgctgtgcttgcatcagcggcgcaaattgaaaatatatctggaagtggttcagtagtaagtcaatttgaagctagacaggctgatagtgcacaagatagtacaagagatcaaatgcataatggtttaatgagtatgcctaatggaggtccggaggagacagttgttgctcgatgggatgatatagaattaccttcatctcagcatttggagtcaaagaatgacaaaactgtcagcattggatatgttggggatgaatgggatgaagaatatgataaagggaagaggaagaagataaggggcttcaagcatagctttggtgggcctaatcttttccaagaaattgctgtcgagaaatcgaagtttaaaagggcaaagtttgaccaatcttgctcagggaaccctccatttaggatatga

SEQ ID NO: 60231 - DNA, 528 bp, Glycine max
  Peptide Sequence Number=SeqID_177009
atgacgcataaactatttttttatctcaaactaagcaatggaattgaactcactattctgcggaagcgacgtaaccggaggggtcgaggttcggaggaggaggaagggtttagggtttcgacgtggaaatggttggagaaacccttgaagggcttcttgacaggaagaaacacgatttttctcgacagcaaaggaggagcggcggtagtagtagtggacgaagaaggatccggcggattcggaggctccgtttggatcacgatggtttcggccattggtggagttcgagaagcttcgaaaagagaagagaagaagaagacgcggaagaagcagagggtttcggcttctggaaagagaaggcctgggcctgggcccggaattgagtgtatatatatgtgtggccttgaaaatcctgggtcggtaatagaacaactgggccactcaaacttgaaccgcgtggaccggggtggtcaaacttcaaaccaggatagatttctacttattcttaccttcaattatggaatctaa

SEQ ID NO: 60232 - DNA, 567 bp, Glycine max
  Peptide Sequence Number=SeqID_177010
atggatcataaattttcttcttccaggaagctaaaaggacctgggataccaactaccattctaagatgtgctcctgacagttgtgttgtatatattgtagctagagatagaattatatccaagttggctgatttttcatcttcccgttcttgtgaaactagcccaaggaacttcgtgtccactaaagtaaacaaagcggacaatcgtgctggtattggcagagaaatgtctggaattagttcattctcgactgaacctaaaattctaaggaatttccggtttttatcaatatcagagcgtagttacattggtctgcaatcatctagtcgtagggattcttttgaaaatactaccaaaaatgaagaagaaaatccagaaaactgcggagatgatattgaaactatcagcctccattcatttgatttcattccttctgcacaacgtgaacagttagtcatgcaagaagaagtggaacggctgcagctggagttgcaaaatactatcaccatgtataaacaggtctgtggagagctggttcaagctcaaaacgaggtgagagttggataa

SEQ ID NO: 60233 - DNA, 942 bp, Glycine max
  Peptide Sequence Number=SeqID_177011
atggctgaacttgatgtccttaaagaatcaatagaaaaacagagaattgtggatacattgctctcaaatgacaggagatacagaaagtacaccatggatgaaatcaagctagtaacgaacttttttgctgaggacttgataattggtgaaggaggatatgggaaagtttacaagtgtaatcttgatcactcaccagtagctgtaaaggttctgcatcaagacgcaatcaacaagaaagatgagtttctaaaagaggttgagattcttagtcaactacatcatcctaatatggtattgttatttggagcctgtcctgagagtggttgtcttgtttatgaatacaaggaaaatggaatttttgaaatggcttgtgggctctcattcttgcataattcaaagccagagcctattgtccatcgagatataaaacctggcaatgtcttgttagacagaaattatgtgagcaaaattgcagatattgggctggctaaactccttgtagaagtagtgcctgacaatgtcactgagtacagagaatcaattcttgccggtactctgcattacatggacccagagtatcagagaactggcactgtcagaccaaaatcagatgtatatgcttttggagtcataactctccaattgataactggtcgccatgcacgtggactcatcgtgacagtggaattggctcaagtagcccttaaatgctctgcacttagatgcagagatagaccagaaattgatactgaagttcttccagtgcttgaaagattttctgatgcggcaaattctagtacaaggatgggaataaatagtgtaagtgtgccaagccagtattattgtccaatccttcaggaaatcatggatgatccatatattgctgcggatgggttcacttatgagtacatagcaatcaaggcatggctcagcaaacacaat

SEQ ID NO: 60234 - DNA, 1177 bp, Glycine max
  Peptide Sequence Number=SeqID_177012
attcatcaatcgcaacccggattgcttcgcgatcctcctcgatctgctccgaaccggcgagctacacgtcccacccaacatcccggagaagctcctctacagggaggccctctactacggcctattggaccacgtgcgcgccgccaagtggggcccattcgacggcaacagattaaggttgtcgcggtccctgcagggccaggcaccgggcgacggaaccgccgtccgggcgggcccggatggcggctgctgcgttgcgcacggcagcatggttcacgtctatgactggatgttggaagaacaccgtcctctgaacctcgattaccagagggtcaacgatgttggttgggttgactccgacaacgtggttatcggagtcagcgagcgcctcgggcgaggtgacggcgggatggggctgttcagctcccacacaggggagctgagatacaagtttcacgtctgtcatgacaatcaggtgaaaagttacactgctggagctctgagtttcagttcggattataagatattttctagctgcaaagggaggagtaatgagtatggtgttggggtttgggatcaggttactgggaagcagattgatttcttctacgagcctttggggtggtcccttggggatgctgataagcttcagtggatggaagggagcaattgtttgttggtggctactatgtttcctaggaaggacaactgttacattagtcttttggatttcagggacaagaagatggtgtggtgttggtctgatgtgggggctccttttgccgtcgatgagaaacgggtcagggatgctattgccatggaagataataactccatttgtgtggtaaatgagtttgaggatttggggttcatggatttgagaagttctgctgccaatagcattaggtggagctccaggagtaggttgatgaaggggaagatgcctgaggaaccatgttatcctaaactggcattgcatgggggacagcttttttcgtccatgaatgattgcatttcggtgttctgtggtcctgaatgggttttgacgtctaggctcagacgaagctatggtggttcaatttgtgatttttccattggaggggataggcttttcgcgcttcatagtgaggagaatgtggttgatatttgggagactccaacaccaccaattatatga

SEQ ID NO: 60235 - DNA, 3441 bp, Glycine max
  Peptide Sequence Number=SeqID_177013
atgctccgcaaattgttcttccgcaagcctcctgatggactcctcgagatctgcgagagagtttacgtttttgattgctgcttcaccacggatgcttggaatgaagagaattacagagtgtacatggatgggatagttggtcaactaagggagaacttgcctgatgcttcgattctgattttcaattttcgggaggaggatacgaagagtcagatggcgaatatcatgtctgagtatgacattactatcatggactatcctcggcactacgagggtgttcccgtgctcaaaatggagctcattcaccactttttgaggtctggtgaaagctggctctcgcttagccagcataatgtgttgctgatgcattgtgaacgtggtggttggcctgttttggctttcatgttggctgcattgttgatttatagaaaggtttatactggggagcagaggactctggatatggtttacaggcaggctccgcacgagcttttgcatttgttgaggaatgtggccctagattggcctcccctggacagggcactcatgttggactgcatcattatcagattcttcccaaactttgagggggaaggtggttgtcatcccatttttagaatatatggacaggatccctttagtgctgataaaaatccaaaaatgttgtactcaacgccaaagagaagcaaaaatgtccgggcctataagcagggagagtgtgaacttatcaaaatcgatatcaattgccatattcaaggtgatgttgtcattgagagcattaacttgaatggtaacatggatcgtgaaaagatgatgttccgagtcatgttcaacacagcttttgttagatctaatattttgatgcttaaccgggatgaaattgacattttatgggatgctaaagatcactttccaaaagattttagagccgagatccttttctcagagatggatgctgctgcagcagttattgcggatggtacctcatgctttgagaaggaaggacttccaattgaagcatttgccaaggttcaagagatctttagccatgtagactggatgaaccccaaggatgatgctgcactaaatgtgctccaacagatgcgtgcttcagctatgaatgacaggttggatacagtttctgatcagtatgtggaaaatggcactttattgcatgaaaaaagtcctagaacgcctcaggggaatttgagtgaagcaagacagggtttatcctctaccaagagatcaccagataatgacaagagtagaaaagatgataagaccaacaaggttgagggtattccccaacaacctaatacatctaacatcatgtatcaagagacagccagatcttcagaaagaaccatggaatccaataaatgtccaacaggaccaacaaatcttgacataaaactgcaggcacctcatcctgccttatcttcttctgttgatactgcttttccccctagaacacctcctttgcggcctcgatccactagtgctaaagaagttcatgattctcctcgccaaacagaatcgcccccttcttatcttttgcctttgcaatcaaaacaccaatcacaagacagaagttctaaccctactcctgggacccaattgtcatctactgttcatagtaagtcaccagaagacaccatttctcatccttcatcttcagcaattacttcacctcagctatctccttcactttcttccaaaaatgtgaatgagattcctcctattagaacaagactagagtcttccccttcacaacctccaactccaccacctcctcctacccctccactaaaggatcatagactagttcgagctaaaccacctccaccaccacctcctcctcctaagaaagaagtacatgttaaagccggaccccttccttctcctctatctcctatgaatgtggagtcacaggttagaggtggaccctctcctccccctccccctcttccaaaagaggagcgacctgttacatttaatgctcctccacctccaccacctccttgtctctcggggaaagttgcaggttctactatagcacctccaccaccaccaccaccagcacctccaccaccactttccagagcatcacttccctcagatcacattaattcttcgttgcaagagtctgcacctcctcctgcagcacctgctcctccacctcctcctggggcacctgctgttccacctcctcctggtaaaggaggtctaaaatcaggcagtccgtttccattgtctctttctgtgagtggtgatgggaataatgtgtccggaccaactagctcaaagggacgaattctatcacgtacgatcaactcaaagaataacaccaaaaagttgaagccattgcattggttgaaactatctagagcagtgcaaggaagtttgtgggcagagacacagaaatctggcgaagcttccaaggccccagagattgatctttcagagcttgagaatctcttctcagcagcagtcccttcaggtcctgccaaaaagtcaaatgtccaaagctcagctggccctaaatctgataaagtgcaactgattgagcataggcgagcatataattgtgaaatcatgctttcaaaagtgaaagtgccattgcatgatttaatgagctcagtgttagcactggaggagtcagcactcgacactgatcaggttgagaacctcataaagttttgtcctacaaaagaggagatggaattacttaagggttataatggggaaaaggagaagttgggaagatgcgaacagatcaggaattctgtcaaattaaagagaattatgcaaacaatactttctttaggaaatgctttgaaccaaggaactgccaagggttctgctattggattcagattggatagccttcttaaactcacagagacacgtgcacgggacaagaagatgactcttatgcattatctttgtaaggtgctagatgaccaactaccggacgttttagacttctccaaggatgttgctaacctagagccagcagcaaagatgcaattgaagtttttggctgaggagatgcaagctataaacaaaggattagaaaaagtggtacaggaactatcaacctctgaaaatgatgggcctatatcagaaactttctgcaagaaattgaaaaaattcctcggttctgctgaagctgatgtccgttctctggcttcactatattccagcgtgggtaggaacgtggatcaattgattctctattttggtgaagatccagctcgttgcccatttgagcaagttgtgtcaactttgctcaactttactaggatgttcaacaaagcccatgaagaaaaccgcaagcagctagagcttgaaatgaagaagacagcagaaagtgagaaaaagaaatgtgaatcagaaagaattttacctacagctatccggactggcaatgtcaaatag

SEQ ID NO: 60236 - DNA, 1716 bp, Glycine max
  Peptide Sequence Number=SeqID_177014
atggatgtgagtaggagaagacttggagttagatgcagtgtggttgcagggtcagtgtgggagagcagaatgaagagtgatgaagttggtggtggagttaaggtcttcactggagaacaaagtgctgaagaaggaggcaatggtggcacctgcagattgaagagaagccaaattgggagtgtggttgccactggaaagagaaaaacttggaaatcagaagggttagaaaacaaccatattcaaatagccataggaaaatcagaaccccagaagaatggtggtaatagtagtagtagtcagcaatgcaaggatctcaacatatcttctgattcaatcaagaagagcccaattcaggccaggaagaaaaggtctggggtgggtgaatcttttgaaaagaatgctgggaagctcagaaagaacaaatcagatttaattaagaatgtcggtgatggagatgcgggaaatgcaattcagcctaggaagggcaaatcagagttggatcatgttttggatgaatcaaggaatgatggattggctggtgggtctgcaagagttgtaattctcaatgggaagaatgattgtgatgaaaattgcaaggattttggtgtgtgcctagagaaggtcatttctagcaattcaggtaatgttggcatgatcaagtgttcaccagtgcatgttgatgatgatgatgaagatgatgtggtagaggaagaggtggatgatgaggagattgatattgagatggagaaggggagctttgatgttaaggaaatcagtgtaccagaatccaaggttgtgaatgagacagaaaggaaggaggttgtgaatgtagcagcaaaacagaagattgtgaatgaaccagaacctaaaaaggttgtgagtaccaacagacaatttcatcaaaaaaatgaaaggccagtgtctgttcctatatctgtgaagccatctcttccaattagaaagctttccacaattcaccaaaatttctccaaggctgattcaattgatttaatcatgtggagagatatctctagatcagcatttatcttcgggattggaacattcgccatagttttatcttcttatgcaaaagatatcaatctgagtcttatttctgtaatgtcctatattggccttgtctatctagctgttatcttcctctatagatcactaatatgcaggggggtcatagatgtagaggacacaaactatgtactacgagaagaagaagcaatttgggtgctaaaattgatccttccttacttgaatgagttcctgtcaaaacttagagccatgttttctggagatcctggtaccacaattaagatgtggcagctacataaccatttggaagatggccaaattcggcttctttggagtttttaccgtgccaaaaatctgctcctcgtattctgcacagttaactgcattcgcaaacttttggattcgtcgattccgggatgcttgggattcttgctctcacaaaaaggctgtggctcttggcatttttggccttgtttggaatttgtcatcagtggttgctcgcatttggtcagatattatcaacaacattatttggtgagagaggaattggtggaaaatgaagcaggatgtgatgaaacatggcaagaacctgctggagttaaagttggaatgcagagacaacagtccacacacaaaatctttgaaactcagaaagtaaagaaagtattctaa

SEQ ID NO: 60237 - DNA, 747 bp, Glycine max
  Peptide Sequence Number=SeqID_177015
atggcgatttccgatgagcctgaaactgtagccactgctctcaaccactcttccctgcgccgccgtcccaccgccgctggcctcttcaattcgcccgagacgaccaccgacagttccggtgatgacttggccaaggattccggttccgacgactccatcagcagcgacgccgccaattcgcaaccgcaacaaaaacaagacactgatttctccgtcctcaaattcgcctaccgtccttccgtccccgctcatcgcaaagtgaaggaaagtccgctcagctccgacaccattttccgtcagttgcagagtcacgcgggcctcttcaacctctgtatagtagtccttgttgctgtgaatagccgactcatcattgagaatttaatgaaggttgttgttgtacttcatataatcattacctcagcttcacttttctatccagttttagtaattctcaggtgtgattctgcttttctatcaggtgttacgttaatgctatttgcttgtgttgtatggttaaaattggtgtcttatgcacatacaaactatgatatgagagcacttaccaaatcagttgaaaagtttttgaacctgaacatcctgcttgacttagcagtagcttatggatcatggagaagctctgcccgatactctgaacatggactatccttacaatgtaagcttcaagagcttagcatatttcctggttgcccctacattatgttaccaggtagcagtactttcaagtga

SEQ ID NO: 60238 - DNA, 558 bp, Glycine max
  Peptide Sequence Number=SeqID_177016
atggcagtgcgcgacaatgaccgcggcggcattatgcttcagtgcgcccttcacgatttcacgcggatgcacctgggtgctggcaatgctaccgctaaacaggggctcatgggccagcaggcgatgttgattgtcgagatagagcgccataaagacttcgcgctccagccgggccatctgcaggcgcaaccagtcgcgcaccatgaacggggcggtgaagggttttcccggtttgcgcagatgttgctccagcaatgccagtgcacgttgaatggtgcgttgggtgggcaagggcagaccggcggttgccgagggttagtcgatgatgcgcataatggcgttgctttcgggatggctgagggcgtaatcccgcaggcgatagtagtgttcggtcatggcatcgcattcggtgcggcaggcatggtggctgtaagtgatgaggcaagcaatgatgccggcggcctcatgccccaccgttgcgctattgccattcagggcgttaaagagcatgtactcgccttcgctggacgggataataaaaggcgccgccgttactga

SEQ ID NO: 60239 - DNA, 477 bp, Glycine max
  Peptide Sequence Number=SeqID_177017
atggcgcgctggcgggcggattccgccggttgcggccaggatgttctgaatggaggtatgtggccgatcgaacagcttgccgatctggtgcagggtatcgcccttgctccagcgatcccacatcatcgccttctgtgcttcggtgtagtagatccgaggtcgttgcttcatggccagcactccttgcgccaggtgcagtcattgtgttgcatcgaccggttgaattcacagctggtagcggtccttcgcagtcctgtggtggttgacagctttggacctcgagtcagccatcccagaaagcagcggccgattgatgcaaagactgtgcgtatgactaggcatactgagacaattgaggtcatcacccgaaaccagcgcaggcggcgctggtcggctcctgaggaggcgatcttggttcgcaagacgtacgaaccacgcatgagcgtgtcgctcgcggcccgcgaggaaagggtgtag

SEQ ID NO: 60240 - DNA, 374 bp, Glycine max
  Peptide Sequence Number=SeqID_177018
gggtagattatttgctgcaaagtctccagctggtagcacctccagactccatccctacagtagagcaatgtaatgaatgggtagcttggccaaggactcaacctcctcctcatagggatgacgaggatcccgctgctcaggtaccacatcagccatcggatgagtcatcagagtcttccacccctgagcccttgataaggaagaggagggtagttctaactaaggaagccgtagccactcctgaaaagtctcctgaggccactctagagcctccgacaccaatggcagataccacttctccacagcaggcagcaaatccttcaacgcctgaagttcaaaccactcagtcctgtctccaaacacttctcccgtag

SEQ ID NO: 60241 - DNA, 442 bp, Glycine max
  Peptide Sequence Number=SeqID_177019
gtttattcatgattggagtgcgagcattggttatggagcattgtatgggttccttgaaccccagtgtatccacaatgcaagcagtagacgtcaagagtgtgaaaattacattggaaggtggttgaaggaagcaggaaaacaaatttacatagcaccttatttaaaccaggcccattggcagctcgttgtattgtgcctaggcaacaatctagtggtttggttttgttctttgcgaaagaagtcggatgctgccatcaagggtgcagtaaacagtgcaatgaaatcagtcaccaaaactgcagagggaaagccacctcagcatgggcctcagtggattgaagcaaagagtcatgttcaaacaggaaattacgagtgtggatactatgttatgcaatggatatggtgcatcgtaagtggtggattgaaggatgactggattcac

SEQ ID NO: 60242 - DNA, 135 bp, Glycine max
  Peptide Sequence Number=SeqID_177020
atgaaaataaaatggactattagcaacaatgcatcaccaaaagaggaaaactctatatcaggcttcgctattatcaagcgagtcggagacctagcatggccacagatcgacctccactccttatggctcatatag

SEQ ID NO: 60243 - DNA, 1821 bp, Glycine max
  Peptide Sequence Number=SeqID_177021
atggcagttactttgtttttgagggagcaagagcctgaatttgtaacaacccttgttcgtacccggattttgccactgtatacagtagctgtgtccctaccatacctagttgctagtgcaaactgggtacttggagaacttggctcctgtctaccagaagagatgagtactgaggtatattcccaattgcttatggcattggtcatgccagataggcagggtccttcttgctatccagtgcgggtttctgctgctggggcaattaccacactacttgataatgactacatgccccctgattttctaccccttctccaagtaatagttggcaacattggaaatgatgagactgagagtgagagcgagagttccatcttatttcagcttctcagttctattatggaagctggagatgaaaaagttgcagtccatatcccacatattgtctcatcaatagtgagtccagtctcaaaatggttaacttccaatctggagccttggcctcaagtggttgaacgtgcaattgctgctctggcagttatgggtcagacttgggaagactccaggcctgaagaatctgagtcagatgagtctcgtcaaaattgggctttgggtcaagtggcaattgctagagcttttgctgcactcttgcagcaggcttggcttacccctctgtgcacactggatcaacaagatcagcaggctcccccctcatcatgcattgaagatttgtcaactttgctacagtctgtcttgctatctattgatgaaaatcacatgattcaagagcttaaagtatcagaactgctgtcagtttggtctgaaatgattgcagagtggcatgcatgggaggaatcagaggatttatcgatttttgaggtgattaaggaaattgtgaatttagattgcagatataagctgaaaaactttgttgtaaaagagatgccaccccttccagctccacccgttcctgaacgttcaattgtagagggcattggtgctttcatcagtgaggcaattaagcaatatccttctgcaacattgagagcttgctcatgtgtccatatattattacattgtccaaccttctcacctgaaactgaaggtgtaaagcagtcattggctattgtttttagtcagacagccttctctcgctttatagaagttcaaagcacacccaatgcactttggaagcctctattgcttgctatatcttcgtgctatttgtgttatcctgatatagtagaaggtattctggaaaagggcaaacacggaggcttcaaaatttgggcatctgctttgtgtcatgtatccaatagatcttttgagcctggtctgacggcagaggctgagatgaagttaattgtgatgacattggcccgattgattgagcaacttctcaaacaagggaactcaggcgatgaaattcaaaactgctttacttcactgttggaggtatccgttcgattgaaagaagcacatgatgggaaagaagatgaacaaggatctgataatgatgaaaacgaagatgatgaggacgaggacgaggacagtgacgatgattatgatgaggattctgggagtgaggaatacgaagaaacagaagaagaatttcttaataggtatgctaaagctgctgaggcattggaaaatggttcagctattattgaagagggggatgatgaagatcaagaactggggctggaattagacaagtaccaccatgtgctcacacgagggctagttttgccatcggagctcgtcatgaattttctgaatgccttccccgggtacggttcatacttccagcaatacagataa

SEQ ID NO: 60244 - DNA, 1440 bp, Glycine max
  Peptide Sequence Number=SeqID_177022
atgaagaaatggtatggaggcttgttgataatggctttgggtatgatgttgttgttcctctacaatgtcaaaggaattcagccgcagaagcaatccgcaaaacagtcggcatataatttcttccataatcatacacctggtgattctattaatggaagcagcaatcttccagtaaactcttccgaggtggaactaaaaagggtaacaacaccagcaaaaaggccacatttggtacatgttgcagggctagatgatctgtatgacatgaaaaatctatcgaaagaagagacgaattctgtgctaatttgggattccttacgttccttgctgtcaaggtcagatgctttggctgaaacagctcaaggagttaaagaggcttctgtagcatggaaagaattgctgtccattgttgaaaaggacaaagcttctaagattaataagatggatggcccagaaaatcaaaactgcccattctcggtgacctcgcctggtaaggctgtaccagatagtggaatcactcttgatctcccttgtggtctggttgtagattcttctattacactgattggaatccctaacaacagaagcttccagattgaccttgctgggctagagcaagaaggggagccaaatcctccaattatcttgcattataatgtgagtcttcctggagaaaacatgacagaggaaccatatattgttcaaaatacatggactagtgatttagggtggggaaaagaggaaaggtgtcctgctcgtggttctgccaacattcaagaagttgatggacttgttctctgcaacatacaagctgtcagaagtaacaacaaagggaatgcaaatgttgaccaacctgctagtgatataccttctaatatttcctcagaaagtgtacatagaaccgctaattttccctttgctgagggtaatcctttcacttccacattgtgggttggttcagagggatttcatatgactgtgaatggaaggcatgaaacgtcttttgcatatagggaggttttgtggatgcagaaacttgaaccatggttagtcagcagtattaaagtagcaggcagtttaagtctcttatcaatcctggctaagggtttgcctgttactgaagataatgatatagttgttgatattgagaatctgaaggctccttctatcgccagaaaaaggcttgctttgttgattggagtattttctaccggaaacaattttgaacgtcgcatggccctgaggaggtcttggatgcaatatgaggccgtacattctggagaagttgctgtccgatttttcattgggcttcacaagaacaatagggttaattttgagttatggactgaagctcaagcatatggagatattcagttaatgccttttgtagattattatagtttgatttctttgaagacaattgcaatttgcattatgggg

SEQ ID NO: 60245 - DNA, 2148 bp, Glycine max
  Peptide Sequence Number=SeqID_177023
atgtctgtatccgttacttttagtgttttcatgacatcgtggatttttggcggcagttctggtatggaaatgtatgatgtttctgaaactagaaatgcagatgcttatttgattgaaggcactgatttaaacttacatctgacaagcccaaatattcaacaatttcaagccatgtttaatgatggagcccctgaatttgttgctgatcagaacttgtattaccctgctgccaccaattatgggtattactgtacaggatttgaatcacccggagaatgggaggaccaccataggatttttggtgtagatggtcctgatattcagtacacaggtgcacaaaacgaaagttttccatatgtatattatacacctagctatggatttgcacagtctccatacaatccatacaatccttatattcctggtgcaatgataggagttgatggttcatttggaggagcagagcaatattactccctccccaattatcaaaacactatttcttcacctgcttatattcctgttgttcaacctgacaatttccctaacagttctgttgactcatcgtttgataccagtgcttctgtcagcagacctgatggaaaaggtttaaaacataagttcaattcagcttctggttcctttactaggaactcttcaaaatcattatcaaatcccacaagttccttggccaggatatcagaaggtccgagagataatactggggtgaagaaagatttgacaagtggcaggggttttcttaatatggcttcctcacctgtccatcaggccagaagcattgatgcctcgacccatgctgtagatatttccaatggaaatgttttgtcccatagtaatcaattaaaaatagcttcccctctgagtagtggattttctgattatggatctaatgctaatggacagtctgtggttgctaaacttcgaccaaaggttcatgtaggtaaaggactgagtgaagtaaatggaagttctgatgttttaggtgagcaaaatcggggcccgagaattagtaattataagtcaaaatttccactggctgtcaaagcctatgcaaataaaggagatgacaatacacaagagaatatcatcatttctactgatcaatataacagggaggatttccctgtcaattatgaaaatgcaaagttttttgttataaaatcgtacagtgaagatgatgtgcacaaaagcattaaatataatgtgtggtcatcaacacctcatggaaacaagaagctgcagagtactcatgaagatgctaagagaatagcttctggaaattttggaagctgccctatctttcttttcttttctgttaatgcaagtggtcaattttgtggggttgcagagatgattggacctgttgacttcaataaggacatggacttttggcagcaagataaatggagtgggagcttccctgtaaagtggcacatcataaaagatgtgccaaatgcaaattttaggcacattatactagagaacaatgagaacaaacctgtcactaatagcagagacacacaagagataatgtatagtaaaggtttggaaatgctgaaaatattcaaaaaccataatttgaagacatctttgcttgatgactttatgtattatgaaaatcgtcagaagatcatgcaggaagaaaaggccaagttgctaattagaagttttaaaaatccgttagtgttacccacattagaaccacctcgtaagttgaattttgtcattgacatccctccagttggtgatgagaaaaatgcaaagatggatgacgaggttgatagcctaaaacagatttcaagtgctggacatattgttagtagttctgagatcaccagcactacatctgtggatgaaaaggctgagaaaggttcagttgataaagaagatattgcttctgtccttaagattggttcagttactattaccccaaaacaggtggagactaaaccatctggcattagtgttgctaataaggaaccgcttgatgttatcacagtaggctcaatgcaaatcagagttaatggatttgccgagtcatccggttttttgaagattgggactattccccttgatccaagaacactacagctggacggaggttctcgtgttaaaaatggatcttaa

SEQ ID NO: 60246 - DNA, 2136 bp, Glycine max
  Peptide Sequence Number=SeqID_177024
atggcagggaattcaaatagaagagaaggaaaacctgttatggttccaaaaactgaggatttgggttatgagttaccaccttatacttcattttcaggggatgttggggctcttcaaaaatcaaattcacagtcttctgattctctggatagcttatttgatgataaggatcctccagagatttccaatgtcaatcaagcgaaggaggagcctgatgaacttagtggagtcattgatgataaaagaggttccttactaatgatgaatttctcggtggaggaagttgagcttgcaatccacaagcttggtgatgaagcatcaattcctgagctggtggatttcatctttgcttggcagattgctaaaaaattgaaaaaggaaccagatgatatcaccttcacctattatggcagaggaaatgaggtcaccaatgaaaaactctttggaattatggcaaaaacacttcaattgtttgaaatgggtttctctgagaatgaagtatcatcagcaattgataaattaggttcagaggctccaatttcagagcttgcaaactttatttttgcagaacaaaatgggatcgattatgtgatggaatataagtttcccaccacttctacttattctgtggggatcaaagaagaaccagaaatggatttatatggtacggccgaagtgaaagttgaggattttagcaatgaacctccacaatcaagccaggtcaacttagaggaaacttataatgaagatatggtgaaggaagaagagggtattgatgcatttcccagctatgtttctgaccaatatttggatgttgtggagaatggtagaggtaaaaggcccaagtatgaacatgatgatgattcaatcacttgtcttgaaccttcttgggtggaagaaagggttgatgttgttgttgccgaaatgtcaagacgtcccaaaccaaatccatccaggtgtcttagtagtgtggcagcaaagccaccatttttcttatttgggaatgtttcaaacatatcctacgactcatggacaaagatgtctaagtttttatatggtattgaacctgaatttgcgaatgctcagtccttttctgctttagatagaatagaaggttacatacacaatcttccagttgaaaacagattccacatcctcccaaagccacctatgactattgaagatgcaatgccgctgacaaagaaatggtggccaccttgggattcaaggaagcagttgagcagcatctattgtgaaactaatggaatagctcaaacatgcgatcgactaggaaatattcttgcagattctggtggagtgctcacatctgaactgcagaaagacattcttcgttattgccgcggattgaatcttgtgtggattggaaaattcaaacttggtcctgtagagcctgaacagttggagctcattttaggataccctttgaatcacactcgtgcttctgagggcaatgtggccgaaagacttaaatcactaaaatactgcttccagacagacacattggggtatcatctttctgtgttaaggcccatcttccctcatggattaacaatgttatcactctttagtggccttggtggggcagaaattgccctacaccgccttggtattaaaataaaagttgttgtctcagttgagacctccgagacaaaaagaaagattcttgagaggtggtggcgtcaatccggacaaactgggactttggttcagttggaggatattcagaagctgactagtaaaaaacttgagggtctaatcagtaaatttggtggttttgaccttgtcatttaccaaaacccatgctctaacttgagttctaggcttctagctggtgtaggtctcccagctcttgaattttcagtgttttgtgaatgtgttcgtgtcttgcaacgtataagagcaaccagcacccagaacactgcggcgtctgcgaacatcattctcttccccagcaacagcactgctgccgtcgttggttcccctccgcgctgccggaagccaaatacatcgtcacgatgccctacaagttcgggtcggtcgtcggaggcttcatgggaggatgtggaggaaatgttgaggtttcatgatccaaggattcatcaaagtaaatgttga

SEQ ID NO: 60247 - DNA, 450 bp, Glycine max
  Peptide Sequence Number=SeqID_177025
atggccccaaggaagcttgcctcaaagagatccaggaaggataaagcggctgaaggaaccagttccgctcccgaatatgacagtcatcattttatgagcgctgagcaccagcagcgcttcgaggccatcaagggatggtcatttctccgggagcgacgcatccagctcagggacgacgagtataccgacttccaggaggagatagttcgccggcggtgggcatcgctggttacccccatggccaagttcgacctagacatagtcctcgagttttatgccaatgcttggcctacagaggagggtccagttcctgggatatcctttagtgctggaggagggccaggagtacgagtatggccagaggaggaaccaggccgatgggtatggcgcctaccaggcaccctctggacccggataagtccaacagggccctgggatttcccgctttga

SEQ ID NO: 60248 - DNA, 177 bp, Glycine max
  Peptide Sequence Number=SeqID_177026
atggagaagaaagaaagcacggaggaaacctcgtgtagcaaacaaaaaatggaaaacctcagcaaggggaaaactcaacggcaagtgaagctggaagaaacggaccacaaaaatgaagaaaaaaagcaaatgggagaagggggacacgtgtcaccacctggagcatgggcgcaatag

SEQ ID NO: 60249 - DNA, 117 bp, Glycine max
  Peptide Sequence Number=SeqID_177027
atggccccctctctctacagcgacgttctctgcttgtccaacgccgggaagggacgacgatcggtcagtcgtgaccctatcctccattcgcgtccgttcctaagtacctacaagtag

SEQ ID NO: 60250 - DNA, 804 bp, Glycine max
  Peptide Sequence Number=SeqID_177028
gactacacgtcctcaccatcagagggctgcacgcccttacctccagaggactacatgtcctcgccttgagagggctacacgccctcaccttgggtactacttaccctcaccgtcagaggactacacgtcctcgcctttgggggcatgccctcacctttagaggattgcacgtccttgccatcataggactacactccctcgccttcgaaaggcgacacgtcctgaacttcagagggctacacgccctcgcctttagaggactacacgtcctcactttcagggccagtagtttccttttaacggttcctgggccaccccctgatattggaggagggccaactgtgcgagcacaaccagagagggaggctattacacaactactatgcataccggggcaagatttcattcgtgccgctcaacattctgcccagcgaccgcaacgccaatctccccctgcaaaagtatcagttggtctgtgtcgtcccgacatggggatcgcacccacaagacacccagtggacccagaaaagtccaacagggccctggggtttctagctttggttacgggcctctatcagtcctacagggtgctcgtacccccccgacaaggtcacatcatcatagggatcgcgcctgcaagacacccggtggacccgaagaagtccaacagggctttcatcaagaagtactgcgtctccaggcaggcgcagggcgaaacaccacagcagcctggggatggccggcagcgggcaacagacgcaccgccatcacctctagagttcacctcagctcatccacaaaaag

SEQ ID NO: 60251 - DNA, 1038 bp, Glycine max
  Peptide Sequence Number=SeqID_177029
atggcgatcaggacgtcgtcgcggggtgatcatgcccaggtcgccgtgcaccgcctcggcggcgtgcacgaagaaggcgggcgtgccggtggaggccagcgtcgccgcgatcttgcgggccacatggccggtcttgccgatgccgctgaccacgacgcggccgcggcaggccagcagcatggcgacgacctgcgcgaagctgtcgtcgagccgggcggacaggtccaggatgccctggctttcgatttgcaacgtcctgcgcgcagatgccagcgcggtctcggacgatgtggtgggatggtcggtcatcaggggattttaatatcaggttgcgggtttgccccgggctgggggcattcccagtcccgtcctcggcacgcccctgtcccccctggccacccgcgtcatgctgctcgggtcgggcgaactgggcaaagaggtcatcatcgccctgcagcggctgggcgtggaagtcattgcggtggaccggtatgcggacgcacccggacaccaggtggcgcatcgcgcgcacgtggtgtcgatgacggatcccgaagccctggaaaaggtcatccggcaggagcagccgcacgttattgtccccgaaatcgaggccattgccaccaatttgctggtgcagctcgaatcggccggcgtggcgcgggtcacgccgaccgcccgggcggcgcaactgaccatgaaccgcgagggcatccgccgcctggcggccgagaccctgggcctgcccacgtcgccctatgccttcgtcgacacggaagacgagttgcgccaggccatcgatggcggcatcggctatccctgcgtcatctagccggtcatgtcctcatccggcaagggccagtccctcatcaaggcccccgacaacgtcacgtccgcctggcgctacccccaggaaggcggccgggtctgggccggccgcgccttctcctagggcttcgttctcttctactaccaaatcaccctgttgatgttccgggcgcgcggcgccgatgggcatgtcgagaccctctattgtga

SEQ ID NO: 60252 - DNA, 468 bp, Glycine max
  Peptide Sequence Number=SeqID_177030
atgtcattgcctagcgctgttcatgtgtcctccaccttcgagtctggagccccgcgaatgtcattgcctagcgctgttcgccaattctccattctccacttttattcggagacccatgaatgtcattgcctagcgctgttcatgtgtcctccaccttcgagtctggagccccgcgaatgtcattgcctagcactgttcgccaattctccattctccactttttcggagacccatgaatgtcattgcatagcgttgttcatgtgtcctccaccttcgagtctgcagccctgcgaatgtcattgcctagcgctgttcatgtgtcctccaccattgagtctggagccccgtgaatgtcattgcctagcgctgtccatgtgtcctccaccttcgagtctggagccccgcgaatgtcattgcctagcgttgttcgccaattctccattctccacttttttcggagccccatga

SEQ ID NO: 60253 - DNA, 225 bp, Glycine max
  Peptide Sequence Number=SeqID_177031
atgacattgctacttagcaacattctgcccagcgaccgcaacgccaatctccccctgcaaaagtatcagttggtctgtgtcgtctcgacatggggatcgcacccacaagacacccagtggacccggaaaagtccaacagggccctggggtttccagctctggttacgggcctctatcagtcctacagggtgcccgtacccccccggcaaggtcacgtcatcatag

SEQ ID NO: 60254 - DNA, 480 bp, Glycine max
  Peptide Sequence Number=SeqID_177032
atggcgaggacatgtagtcctctgaaagggaggacgtatagtcctctgaaagtgagggcgtgtagccctcagaaggttaggacgtccagtcctcttaatgtgagggcgtgtagccctcttaaggtcaggacgtccaatcctctgatggcgaggacgtgtagtcctctgaaggggaggacgtgtagtcctctaaaggtgtggacgtgtagtcctctgaaggtgtggacgtatagtcctctgaagacgagggcgtgtagctttatgaaggtgaggacgtgtagtccgctaaaggcaaagacctatagtcctctgaaggtgaaaatgtccattcctctaaaggcaaggacgtgtagtcctctgaataggaggacgtgtattcctctgaaggtgaggacgggtagtcctctgaaggcgagggcgtggaaccctctgatggtgagcacgtgtcgtcctctgatggtgaggagtgggatcctctag

SEQ ID NO: 60255 - DNA, 400 bp, Glycine max
  Peptide Sequence Number=SeqID_177033
atggcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcattagagggagtggcaaaggactgcctgtattaccttgctccaaggtccatcacgagctgggatgaccttaagagagtattcttagaaaaaattttccctgcttccaggaccacaaccatcaggaaggatatctcag

SEQ ID NO: 60256 - DNA, 1313 bp, Glycine max
  misc_feature (36)..(36): n is a, c, g, or t
  Peptide Sequence Number=SeqID_177034
gtctcgggacgttcctggcggatggtcacgaccttncccttgttggcggtcgccgtgccgtactggttgcccgcggcgtcttcgcgcatttccagattgtcggaggtgagcgtcatcaggccgcgcgtcatgttgacgttgcccgtgaagacgctctgctttttcacgtcgtcgtagtgcagcgtatccgacaggatcgtggtggtggaggtgttggcagggctgtcggcctggcggcgcggcttgttctccgagccggcgatctccacgtccgtggaggccgatacctgcagttggcgtgtcttgttgttgtagtgcatacccttgccgttcatgcgcgagcgtcccttgatgacctcggccggcaggtcggtgtacaccacgtcttcgtcgggcagcaggatcagctgttggctgcgcacgtccagcacgtcgttgttggcgtcgggctggcggtgcacgtgggcgtcgccattcatgacgatgcgcttgccgccctgctccatgacggcggtcttggacacgcccacggtgatgggactggcttcgcgctggccgacggcccgcggttgggtgatgtggtacgaatcgtcgtcggggaaatgctcggcgtaatcgccttccagccggttgatggggcgaccggtcgggtcggtgcgcagcatcacgaaattgcgcgaccaggcgtccatttcgtgcgtgacgcggcgcggcggatccgtctggatggcccgttgcgcgtagtcggcggcccaatacgtgctggcgaccagcaccagcagcaggaacagcgcgatcagggaagggaaacgatctttcatcaggtgtgcgaagcgaggttgggggcgcgcttactggatggcgcccgggccgagcagccccggcgcggccaggaatccgcccagccggccctgggaagccagcagcaggtcgcagcactcgcggaccgcgccaccgccgccaggttgcgtggcgatccagtgggccgcctggctgacatagcccggcgcattcggcacgctggcggcgaagcccgcgcgttgcattgccggcaggtcgatgatgtcgtcgcccatgtagccggtctggttcagttggaccgcgctgcgctgcgcaagttcggccaatgcggcacccttgtcgcgcacgccctgcatgatctcggaaatgcccagttcggcggcgcggcgcgccacgatcgggccggagcggccggtcatcagagcgaccttcaggccgccttccatcagcaggcgcagcccgtggccgtccagcgcatggaagcgtttctgcacttcgccgcttccccgtaa

SEQ ID NO: 60257 - DNA, 237 bp, Glycine max
  Peptide Sequence Number=SeqID_177035
atggattgcgaaatatacctccttccgatttccgtcacagcacggaattttcacggatcgcgtaagcctgcttcctttggattttcggcacgtctcgggacttcacatattgtgcaacaaagggtgccaaacatctcgaagcggccaatcaatggttgtatatcatcaaattataatccccggacgaaattagggtatgacaattgcccctctttacttacctctcatcggagataa

SEQ ID NO: 60258 - DNA, 302 bp, Glycine max
  Peptide Sequence Number=SeqID_177036
aagaaaggagaagattcctccttagccccaaaatgctatgaatgcgatcaacctgggcacaggagattcaattgtcctatctttaaaagaagaatggaaaaatccgacaagaggaatttcaaagaaaagaaagcatacatcacttgggaagataataacatggattcttcaagtgattcagaaaatgaaatcataaatatgggtctcatggtgaaagactatgaaagcgaagaagagataatgtcttctaactatgacttatctatttcttttgatgaacttcaagatgcattgaatgattt

SEQ ID NO: 60259 - DNA, 267 bp, Glycine max
  Peptide Sequence Number=SeqID_177037
atggccacccctatgagcactgcttgctacttggataaagatgaagtcggtcaatcagtagatataaagaaatatagaggtatgattggatctcttctttatttatcagcaagtagaccagatattatgtttagtgtttacattgatgcaatcctccctagaaagggaccagtcactagagccatgagcaagaggctccaagaggattgggctagagctgctgaagaaggccctaggattctcatgaacctcagggtagatttctga

SEQ ID NO: 60260 - DNA, 393 bp, Glycine max
  Peptide Sequence Number=SeqID_177038
atgtctcttgcaactctttttgggaaacttcaagaacatcaaatggaacttatgagactcaatcaacatgaagaaaatgacaagaaaaagaaaggaattgcacttaaagcctcatcttcaattcaagaagaaagtgacaaaaaggacttgaatgaaatagaagaagtttattgtcctagtttcaagaaaagaagggaaaaatctgacaggaaaaccctcaatgataagaaagcaaagaaagcttacatcacttgggaagataacggtatggattcatcaagtgattcagaaaatgaaatcataaatctgggcctcatggccaaagactatgaaagcgaaaaagagatgcattcaatgacttgcataaagaatctgtcaaacttgccaaattag

SEQ ID NO: 60261 - DNA, 237 bp, Glycine max
  Peptide Sequence Number=SeqID_177039
atgacgagagtgatgagcaaaatgacggcgacagcgacgaagtctatttcgttgaagcctttgggaagagacggcacagggaggtgccatttggtggaggagattccgattgtggtgcctaggtacgccgtcaagcctctggcgagggtgacattggaaagcacggaccaaagatttacctatactaaaaactgtaagtataagtctttgaatttaacctacattaaacaagggtag

SEQ ID NO: 60262 - DNA, 336 bp, Glycine max
  Peptide Sequence Number=SeqID_177040
atgacagtcccttttgactttgagccctttgtcaaagtcaagagatccttctctatcggtgtgaatgtagtctcctctttcggataccacaaagagagggatggctcttgggtgaagaaagatgctctagtacaggccacagaagaccgctctccatcaccaccgcctcagagagatgattcttcatcttttatgcacagcatacttgacaggttggatggactccacacttttgtaggagagcgctttgactcgttggatagccgtattgatgccatggatgcacgatttgcagggatggacacacgcattaccaaacttgaggaggatgtctag

SEQ ID NO: 60263 - DNA, 237 bp, Glycine max
  Peptide Sequence Number=SeqID_177041
atggcagaaaatcttcacggaatcatccacggaaacgtttcggacgtgttacggaaggattacacaatcatcccttttttggctttcggaatagtacggaacctcacggattgcgtaacttctggcacgttgtggaaatttacgtattgtgcaacagcgggtgctaagtacctcgaagcggtcaagcaaaggttgcatgccatcaaaaaatggtccctggatgaaattagggtatga

SEQ ID NO: 60264 - DNA, 204 bp, Glycine max
  Peptide Sequence Number=SeqID_177042
acttatattcataaggagacatgctttcggtgtcggtctttgaaggagattaagaattacgagaaatatggaagtcctcctcgacgtcacaaagtgaaaacacaagccaaagaagaaagcaatgacaaaaccaaaaatgaaacagaatattggttaaagtttactgacaactacaagctcatgagtaggactgaaagtgattaa

SEQ ID NO: 60265 - DNA, 600 bp, Glycine max
  Peptide Sequence Number=SeqID_177043
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaattga

SEQ ID NO: 60266 - DNA, 271 bp, Glycine max
  Peptide Sequence Number=SeqID_177044
atgtcccacgctgttaaggatagtcgaggcaagtgggccccgaattatgaaggaaatttcatggtgaaaagagctttttctgggggtgctctgatactcaccaacatggatgacgaggagctgccctcgcccgagcagaatggtctcaggccacggtcaaaagtcaagacaagtcaatggcagaaatcgaccaacgataggatcgcgaccgaccgatcgttgccccttcccggcactaaacaagcagagaacgtcgctgcaaggcagccca

SEQ ID NO: 60267 - DNA, 249 bp, Glycine max
  Peptide Sequence Number=SeqID_177045
atggacgaatacgcaagcatacgtgtcatgcttgtctgggtaatagcaatgagattccccaatatcatgctaagaatagctaggatttccagaagaagatgccattcgtctgatgagaaatactactttcgaagtaacagaaagaaaagcaacgactggagtgggagagtcagagtcgaaaagaggattcctcacttctttctctcattcaaaaccgtgcatgagactttcatctcgcacggctcctaa

SEQ ID NO: 60268 - DNA, 137 bp, Glycine max
  Peptide Sequence Number=SeqID_177046
cgtccactaagcgtaacactcctgggctaagcgcgaggaagactctggaagaagatgagctgtacagactagagcttgaagcaggagccgatttgagagcttcagatgagtttgtgagtgattgtgagatcatagag

SEQ ID NO: 60269 - DNA, 408 bp, Glycine max
  Peptide Sequence Number=SeqID_177047
atgatccttgatgcctcaactggtggcactatgatgtccaagagtccagaggaagctattgtaatcattgactccatagcagccagtgattatcaaagtcatcatgatagagctccgactcaaagaaaagaagagaaggcccattatctgcaaaatcaagccagacctcaacaaaacttccaaggaagctaccaaggctatagaggtggctcaggttcaaatcaaccttatggtcggagaccacaaaattctagtcccactaacacttcttgcgcaggtccttctaacaactcttatggaggttcttcaagtaggggtccacaacaacatcaagctcaaccagatagaatgtcaaagatggaagatactttaacacagtttatgcagaagtttgggttggagaactga

SEQ ID NO: 60270 - DNA, 1674 bp, Glycine max
  Peptide Sequence Number=SeqID_177048
atgatagcactgggagcaataaaaagggtagttcctggttggttaagagaaaaacctgtcttgtcaccaagcgcccaatgttgtaatcaacgaagcagtgtcagggctctctctctgggttttgggagacatcgaactaccgtgtcggagagggagcttttgcgttgcgtggccaccaccacctcgaaccaacaacaacaacaactcacttcctcttcgaaacttcttcattccccattattccattccaaaaatcatgctcctcttcttcaggttaagtgtgttactggagtcttactgcttcaattacatgaaagtgtggttcagatggcgtggacggaagataatgatgagaataatgggagggaaaagaagatggttggggaaaatgggtttttgatagtgtctgagccttctcctgctggttctggtggggatggggtttcggtgagtacgagatatgaagggaaggatgatgttttgtttgccaacattctgcgatcgaggaacaaatttgtggatgctcttgcactatacgaacgcgtgctggagagtgatggcgggaatgtggaggctcttgttgggaaagggatatgtttgcagatgcagaatatgggtaggcttgcttttgagagttttgcggaggctatcaggatggatcctcagaatgcctgcgctctcacacattgcggtattctttacaaagacgaaggttgccttgtggaggctgctgagtcatatcaaaaggctttacaagtggatccttcatacaaagcagctgctgagtgcctggccattgttttaacggatattggtaccaacataaagcttgcaggaaatactcaggaaggaattcaaaaatactttgaagctctcaaaatagatccacactatgctccagcatattataatcttggtgtggtctattctgaaatgatgcaatatgacatggccctcactttctatgaaaaggctgcatcagagaggcctatgtatgctgaagcatactgtaacatgggtgtaatatataaaaatcgtggtgatttggaagcagctattacttgttatgagaggtgtttagctgtttcacctaactttgagattgcaaagaataatatggctatagctttgacagatttgggaacaaaggttaaattggagggtgacatcaaccgtggtgtggctttttataagaaagctttgcattataattggcattatgctgatgcaatgtataatcttggggttgcttatggtgagatgcttaagtttgatatggctattgtgttctatgaacttgccttccacttcaatccgcattgtgcggaagcttgtaacaatctaggtgttatatataaagatcgtgacaaccttgacaaagcagtggaatgttaccagcttgctttgggaatcaaacctaacttttcacagtcattaaataaccttggcgttgtatacactgtccagggtaaaatggacgctgcggcgagtatgattgagaaagctatcattgcaaatccaacatatgctgaagcatacaataacttaggagttctttacagggatgctggtgatatctctctagcaattaatgcttatgagcaatgtctaaagattgatcctgattctcgaaatgctggccagctgaaagttgccattgctggtgctacataa

SEQ ID NO: 60271 - DNA, 952 bp, Glycine max
  Peptide Sequence Number=SeqID_177049
gcatgttgaagagttagttcgattaccagatagcttcctttgttacactccttcccctgaggctggtcctgtttgtccaactcctgctctttccaatggctttgttacatttggtagttttaacaatcttgctaagattacacccaaggtactgcaggtctgggcaaagatactatgtgcaattccaaattctcgtcttgtggtaaaatgtaaaccgttttgctgtgatagtgtgagacagaggtttctttcaacactagagaagttaggtctcgaaccactacgagttgatcttctgccccttattcttcttaaccacgatcatatgcaagcttattctctaatggacatcagtttggacacatttccatatgctggaacaacgacgacttgtgaatctttatacatgggagttccatgtgttacaatggctggttcagtgcatgcacacaatgttggtgttagtcttcttagcaaagttgaagttattggatatgaagtcaatactccaaatagtttgggcaatttgattgccaaaaatgaagatgaatatgtaaaattggccttgaagttggcttctgatatttcggcactacaaaatttgagaatgagtcttcgagagctcatgtctaagtcccctctctgcgatggagctaaatttatccttggtctagagtcaacatataggcaaatgtggcgcagatattgtaaaggagatgttccggctttgaaatgcatggaactgttgcaacaacctgtttcttcaaataacccatccagtaagaactccgagccaacaagggccacaaactcaagtgagggaagccccgaatctgtcaaggccaatggattcagttcaactcagccaccaaagcttaattttctcaattgcgaagaaaatggtgggtcgttgaatcacagtagtaagcaagggattgtgggttcaagttga

SEQ ID NO: 60272 - DNA, 117 bp, Glycine max
  Peptide Sequence Number=SeqID_177050
atggctctagtgggtggctaccttgtgctatccctacctttctctattgtagccatcgttcgccctcatgcagttggaccacggctttccctcatcatcttagacactggtaaatag

SEQ ID NO: 60273 - DNA, 402 bp, Glycine max
  Peptide Sequence Number=SeqID_177051
atgaaccaaatcacggcaacgacaccaacatctgccaccaccttcgtagatctaaaggtactgcaatcaccaacatctacagccataaactcatctgtgaccagcacactccgtcattgctcctgctcaccgtcgttgccaccagggtgtgcatcttgcacgatggtggtggccaatcaacttgatctacttgaacaggccatattttgttgtgtttctgatatgagaaaggatggaattgtggtatcaagatctgagagagggagagttgttatcattttcgtcgctgctggggagggtttacgatgttggttgttagtgggttttctggttcttggtggtgaggatgcaatgtgcttgttgttggtgggtggaagagatgaagacaaaaggacaaagtag

SEQ ID NO: 60274 - DNA, 240 bp, Glycine max
  Peptide Sequence Number=SeqID_177052
atgactatttacccatttataaaagtgtttcttactctagccactgctggtggtgcttcagctgctgccatagtttacttggcacacaacggggatcaggacacgaactggttagccatatgcaaccaatttggtgacttctgtgcgcagaccagtgcagcagttgtctcatccttggttgctgtgcttgtcttagtattgctgattgtcatgtctgctttggctattgggaagccttga

SEQ ID NO: 60275 - DNA, 603 bp, Glycine max
  Peptide Sequence Number=SeqID_177053
atgtcaaccaccattgatgtccctgcagaaacgacaagcaagaataatattggcaatggaattagaaaagttccaggtgcacccccaaggccagaaggagggtggaagaaagggttagccataatagactttgttctaaggttaggtgctattgcatctgctcttggtgctgctgccaccatggcaacgagtgatgagacactgcctttcttcactcagttctttcagtttgaggccagctatgatagcttttctactttccagtattttgtgattgctatggcatttgttggaggctacctagtcctatctctacctttctctatagtcactattatacgtctccatgcggcaggaccaagacttttcctcattatccttgacaccgtgttcctgactatagcaacctctagtgctgccgctgctactgccatagtgtacttagcacacaatggcaatcaggattcaaattggcttgccatttgcaaccaatttggtgatttttgccaagcgattagtggagcagtggtggcatcgttcgttgccgtggttctcttcgttttgctcattgtcatgtgtgcagtggctctccgaaatcattag

SEQ ID NO: 60276 - DNA, 588 bp, Glycine max
  Peptide Sequence Number=SeqID_177054
atgtcaaccaccattgatgtcccagaatcaaacaatgttgctaaagaaaaagtacttttattaggtgcacgtccaaggccaggagggtggaagaaaggtgtagcaataatggactttattctaaggttaggtgccatagcagctgctcttggtgctgctgccactatgggaaccagtgatcaaacactccctttcttcactcagttctttcagtttgaagcaagttatgatagcttcactacttttcagttttttgttattacaatggcacttgtggctggctatcttgtcctgtcgctacctttctctatagtagtcatcatacgccctcatgcagttggaccaaggctttttctcatcatcttagacacagtgtttctgactttggccaccgctagtggtgcttcagctgctgccatcgtttacttggcacacaacgggaatcaagactcgaactggcttgctatctgcaaccaatttggagatttttgcgcgcaaacaagtggagcagtggtttcatccttggtttccgtggttatttttgtgttgctcattgttatgtctgctttggcacttagaagaaattaa

SEQ ID NO: 60277 - DNA, 270 bp, Glycine max
  Peptide Sequence Number=SeqID_177055
atgtacttagtagattttgtacctacaagagtatcaaacactactataaaagcggttctacgtcgcgttggcgaagaatcgagccgacaaccacgctctgatcggcgagtccggtgcggtggctgctctgattccgctactccgatgcagcgaaccgtggacataggaacacgcagtgacgacgttgctgaacctgtctcttctggaagagaacaaggcgcttataacgaatgcgggtgcggtgaagtcgttgatgataataacatatag

SEQ ID NO: 60278 - DNA, 1725 bp, Glycine max
  Peptide Sequence Number=SeqID_177056
atggccccagaccccgacaaaattgaagctacactatcctggccaactccaacatcccccacgaccctttgcagtttcttgggcttgatggggttctatcgcaaattcattagaaactatgcagctgtagcttcacctcttactacgctcttacggaatgaccaattttcttggtcgccagctgcggagcatgcagttcaccatctcaagcaattgatgactcaagcccctgttctggccactccaaacttctcgcttccttttaccattgaaatagacgcttcgggctccgccatgggtgcagtattacttcaagatggccacccaattgcttattacaataagtataaaccagggtctgctaatatcgtcgttgatgcgttgtccagaattccttcgtcagaggccatttgtttatctttgattatgcctcacctcacctttctagataacctctgtcaatctcttttacaagatccccaatatgttgatctcttgcatcaaattcaagtgtgcctagattcttattctgacttcaccattcataaggatcttattttccgccaaggccacatctggatccctttcccgacacctttcattgctttactcttggaggaattacattcttctctgataggcggtcacacaagtgcaaccaagacgcttcatcatttacgccagaattttgactggccacatatacggcagacgttgctccaacctcttcctattccttcccaagtatgggaagatttgtccctcgatttcattacagggctaccatcgtctcaaggctacacagtgataccggtggttgtggatagattttccaagggggctcatttcagtgctttgcctactcatcatactgcatacaaggtcgcatggctattcttcgacatagtatgcaaactccatggatttccccgaagcttggtcttcgacagagaccttatttttatcagtggcttctggcaagagctattttgcctatttggcactaagcttcgaatgagcactgcttaccatccgcaaaccgatggtcaaacagaaattcttaatcaaaccttagaacatgcgggagtttcgcctttcaaagtcatttatggaaaaccaccgcccacaatcattcaatatatacaggggacctcctccatttatgttgttgatagtctgttgactactagagatgcagccttgcagcgtcgtttgcgcaaagcacaggaggttatgaagaagacagctgataagcatcctcgtgatgtccagttcgtcggcaacgactgggtgttggaacggattggacctatagcgtacaaattacaactatcggcatcatccggattcacccccaatcatccacttattactcccttaaccattgtggactggaagtacgatgagtccgtctccccaccaatcaagaaggtcctagtacaatgggatggtttggcacctaaagatacttcatgggaattgtgggacgaattgcgccatacgtacaaccttgaggacaaggccaaagagaataacaaagaagcccaattaccttcaggaggattttcagagattcctctagttcttttcttggtggtttttttggaaccaattggtatctcaacctcttttcaagaagagcttcttgctgacatgaaagctattggaattgcatataacaaaggttgtctacacctttgggtgaatgtgactcatcccttgtag

SEQ ID NO: 60279 - DNA, 375 bp, Glycine max
  Peptide Sequence Number=SeqID_177057
atggtcgttgaaatttgctcagagcttcggttttcaattacgagcgtctcgatatataacgagactcattgggacatccgattaaaaagtaatggtcattggaatttgctcagagcttcggtttccaatttcgagcttctcgacataatatgggactcaatcaaacatccagtaaaaagtaatcatcgtttgaattttctaatagcttctgttttgaatttcgagcgtctcgatatactatgggacacaatcggacatacgagtcaaaagttattgtcgtttgaatttgctcagagcttctgttttcaattacgagcgtctcgatatattacgggactcaatcggacatccgagtcaaaagttattgtcgtttga

SEQ ID NO: 60280 - DNA, 573 bp, Glycine max
  Peptide Sequence Number=SeqID_177058
atggaggcaaaatcacattcacaaaccctagagatcacagttatgtcgggagaaaacataagcgtggatcaaagttcagtggcggcgaacgtgtacgttgttgttggtgctgaatctcttaattcttgcacaaccaaaatggtgaatgaagatgggggagtgcatgcatggaatgagacattcttattagacgttccatcatatgcaaggtcagttacatttgaggtgcaatgcaagaagtataaaggggttcgccctattggggtagcaagaatagcactttcggattttctgggtggcaataatgttgtgtccgaaagtgtgcctcaaatgtattgttacggattgaggaattgggaaggtcgacgaaacggggttattcatttctccgtgagggtggtgacacttggggataatttgtgttcagagacaaaagaagaaaaagaaacaaagatggtgaattctaaagaaactgagcatgaggttatgggatttcaggtgaactcgaagaattcaaatgatgttgtcattggcattccagttcggtggagttaccaaagtgctattgtttga

SEQ ID NO: 60281 - DNA, 381 bp, Glycine max
  Peptide Sequence Number=SeqID_177059
atgaaccacttcttccggaaaagttcccggaagaggtttttccggtccggaagacgtttggttacttccggaagaacccttcttccggaaactttccggaagaacccttcttccggaaactttccggaaaatgttcttccggaacttccggaagaacccctaacgggtcttccggaagtctccgccgtcagcctcctttccccattttttccggcgtcctctcctctcgtcttctaccctaaggttactatcctaagcaaaggggagttagggagactaacctcgttcgcggagaagaagaagacgaggttcgcgcttgccttgccggagaagaagaagcagttcgcggagaagggagaacaagcttcgcggaaggaatga

SEQ ID NO: 60282 - DNA, 141 bp, Glycine max
  Peptide Sequence Number=SeqID_177060
atgaagcatttacagggaaccattcagacgttggcatgtgtcattgacacgtggcagtcaacgtctgagggaacttcctcatttactcctcctaaagtctgggacttaggaggaaaagctaagtcctgcactttggtttag

SEQ ID NO: 60283 - DNA, 210 bp, Glycine max
  Peptide Sequence Number=SeqID_177061
atgagggtgattgacccatcaatcacttgcagttatcatcactgttcccaaagtaatgcaccagcagggaatcaaagccaggtctgtaccgtggcagggtactattctaccactagacccagttttgtggactgctatccttggttgccatatggagtaaaccataaatgcaaagcactcattgatgggtgtcacaggattagtagttga

SEQ ID NO: 60284 - DNA, 550 bp, Glycine max
  Peptide Sequence Number=SeqID_177062
atgccgcgcgctctttcttcgccgactccttcccctcctcgcactcactttcctccaataaaactactttttcttcaaacgatcctaaccgcacgccagaactcatctcagcctggagaccgaaaccgtgaccgggtggttccggtgctcgcctttcagaatcgacctggtcgacccgaagcacgcggtgaaaacgggggtgaagtacccggtcgacgaggacacgtgtcgggagctggaagaaagcctgaggctgacgtggattttggtggaccccacggggaaacgtgcggtggatgtctcgagtggaaaggtagtggcgttggagaaacactggctgagcggggaggtggtggtgcggacgtggatggggtgcagatgaacgggagggatagtttggtaattttacaaggtgtgttggagggtgagagaaggtggaagaagaagaaggaagagggtggagaggggtatagagtttttttgaagagaaagaaagagaggaaagaagggaagatggcatcactaactaaccttgctagacaactaggtg

SEQ ID NO: 60285 - DNA, 759 bp, Glycine max
  Peptide Sequence Number=SeqID_177063
atgctgttcaaaagtgatgccgggatccagttccctatgaagcacggacaactctcttgtttgaagtgtcacaatgtcggacacgtttctgatactagcactctactccacagttgggacttgttttacatgtgtcaggcacttttcattagtttgctaaggctatctgctcccctggagagtttaattagagaaaaattatcagccaaacaccctgaagcatatgaatggttttggtctgagcaagtaccagctgcagtagcatcctttgttaataagttagaaggggatggacgctttactgctgccattgcattgtctggaaaaaatatgggtttaagcagtgcaagtgacatatcacttcttctgcttgcactaacatgtattgctgcaattgctaaacttggtccgtcaagagtttcttgttcgcaattcttttcaatgatcacagagatatccggtagtttgatggacatgatggttggtttgattcctgtaagtcaagcatataattctataaaaaatattggtctgcacagagaatttcttgtacattttggtcctcgggctgcctcatgtagagcaaaagagaagtggggttcagaagaggttgttttctgggtaaatcttgctcagaagcagctacagcaagctattgataaggaaaaaatatggtcaagattgacaacatctgaaagtattgagttatcaatcccagatagcggcgcagagaggctgactccaaaatcgatattctaa

SEQ ID NO: 60286 - DNA, 192 bp, Glycine max
  Peptide Sequence Number=SeqID_177064
atgcagaaattgattaaggaaaggatggaaaataatgtggttaatttcgtgggtcttaataaggttaagtggtggctggacagaaatatagaaatggcaataacggaagctacagggctccaaatgaggggattccaaaacgaggtgaaaggtctcgttttgaaattcaatttaggctcaagaatcacttaa

SEQ ID NO: 60287 - DNA, 1044 bp, Glycine max
  Peptide Sequence Number=SeqID_177065
atgtcaaataatcatttgaagaggtgcccatacgcaggcagtgaatatggaccgcgagtctgcgacgcacaaacaacccaacccaacccgtgggtgggcgttttcacaaaggcagtactgcaactccattctctcactccgattctgcatcggcttcatggcagttacactgcgcagcaccaacaacaacttgcttccgttaaggtgatcgatttctctctctctctcttgctggttgcgaattacgattacaattacgattcttcttcgctgaggagaaaagtgtcagacttacattgcgtactattgagtaaatgggggagttcaagaaagggatgcctcatacgacatgatgttttatcgagcagtaattatggtctgttgggctttagaaaatgctatttggttatttctaaacctagaaggggggcgcacctgttaccatttgcctcctctgatgatggtgtgactgtcaatgggagcctccaagctagcaccggtactgacctagaaaaaatgagggtggaactgaatagatcactggaagatgaagagttttgcgatggacttgtccaagctttatatgatgcagccagggtttttgaactggcaattaaagaacataaatcgttctcacgaatgtcctggttatcaacagcctggcttggggtagaccaaaatgcatgggtgaaggcactgtcttgtcagttcttgcctattctagttggcttgcctgtattggcagacatctgtggaggggggggtgttaggaagttccacatcgtctacctcagttcttgggatacaacttatatatctgttggacaacttcacttagtgccaattggttttaagttgaaatctaacagttccatggtttatggaggggatattcatagtttccactacatatcacttgatccgacaatttttggtgtaggggagggcattgaaaagtcccatattgtctacctcagccacaagggtgtgatttatatacttgttgaactacttaacttgatctggttttacgatgaaatctaa

SEQ ID NO: 60288 - DNA, 618 bp, Glycine max
  Peptide Sequence Number=SeqID_177066
atggatatgtggccaatcgtcatccaaaaattcaagaaaaaattggctctttggaaaaacaagcaaataggggattcaaaggaggttcctttcgggggagggggggatgaggagaaaagaaagattccttgggttgcttgggatgatatttgtaaaagcaagaatgggggtggtttaggggttaagaacttaaaattctttaatgaggctttgtttgaaacagtatgccctttccgccaactacaacctgagagtgttcaacacttattcttatcatgtggtgtcgtgagcaatatttggaataaatgttattcatggatatctctgaactttggcactgtcaaccctgctatgttggaaggtcatttctggcacataacaggcttgggaaggtctaagtatgaattggaagtgtggaagtctatttggagtaatgttctgctgtgtatatggaataagagaaacaaatgtatttttcagcaagcactcgtggattggaaactgatgatggatgagctcaaattcactgcatggtcttcgctttacaataaatactcatcttttaaatattcatttgtgcaatggaattacaacacctctacgtgcctaattggttga

SEQ ID NO: 60289 - DNA, 435 bp, Glycine max
  Peptide Sequence Number=SeqID_177067
atgattttgttgtatcgtttcaacataattgtgtggctaggtgatatagtgggcgcggggtggggcgtggctccatggtatggtggggatgggggtaatgcaaatgtgtgtcggcatattggtggtgcaaaggagtcgcagtggactcattacggcacagaaaaagttggctttacgatggtgcagtggtggttggactgtgttagaggggggtcgcacctgcacaggtttggtcgggctgacggggtcatggttgtgttatgcgtagctcgtgttgggattgctggggtgggggtgacaggtgaaaaagggggttggggatgtagggaatggggaagggtgaaagagggttgggggcatagggaaattcagatcttgggggtgtgtagaagggttgggggtgctgggaagggaataaggaagggtttgcactga

SEQ ID NO: 60290 - DNA, 2017 bp, Glycine max
  Peptide Sequence Number=SeqID_177068
cgttacaaaacaatctcatatgcatagaagtaaacatgaaggtcctcccaatgctgaagcagtgcgccaagcttttgatgtttgctctcattggatgcagagctttattaaatacagtacatggctggagagcccttcaaatgtgaaagcagctgagtttctgtcgacagggcacaagaagttgatggaatgcatggaagaacttgggatgattagggataaggcattggagaccgaaggcaagaaagcagctcatagacgtagatctacagttcagtcaactataaaagagtcaggttcttttgatgaggcattgaaaagtgttgaagagactgttgtaagacttgaaaagttgcttcaagagttgcacgtatcaagctctagttctggaaaagagcatttgaaagcagcctgttctgatttggagaaaatacgaaaactttggaaagaagctgaattcctggaggcatcttttagagcaaaagctgattctctgcaagagaatgacatacaatcattctacttcacccgattccctgaggatgcgacggagaaagaactgtggcttcatttcaaaaagtttggtgatgtacgggaggttttcatatccagacaaaggaacaagaacggtaaaagatatgggtttgttagatttaaagggatggaagacgtgcacagcttagaaaagaagctagacaacatcatcttcagtgggctgaagatgtatgttaacatcccaaaatatgggagagtcagggatgcacagatagtaccagaagctaaacgaacagaagagaaacaacaaaagggaaaggaggaaccttctcgaagacacccattcccgagaacgactcaagggtcgtggccaggaacaacagacacccagctccaatgggaagaccaggtagtcaaaaccatagccgtgaaggatcatggtcttcgagttgaagacgacttactttggggcatcgaagctgacatatcgccaaagtacatgggagacgatattgtactcttactaggcctcacggacgatagagctcagcagatggtggaagaagaaatagaaggaggagtctcttcgttccactcactggaaaagtggaacccgaaattgcgtcctggatgccagctgacttgggtgaactgttggggcatcccattagtggcctgggacacggaacaaattaggaagatagtggttggtattggagaagtggtggacgtggacgacgatgtcgagatgcttcggaggctggacagggcacgagtcctcattaaaacaccatggaagccactcatacaacacaccgtcaatgtacacatccaaggtgaagtgtacggtgtgcatctagtggaggaaggtgggatttgttcagagatgcatcattgccggcgcgggagcgagtacgggtcatcggaagaaatagaaaccgatgtaagtgacgtcggaatgccgctcaaagaagacagaagaagatcggcgttggaagatggccttaccgtgaatccgacagaaaaccaggcccagacagttgcgcccgagtttgtgcaggtggcacacaagggagcgcagctcgcacacgccgcgcatggcgtcgcgaaggttgctgacgtcatgacggacgagacggggatgacgaagaccagcgcgtgcaagccaggcaaaaaggaagcacagtggattccatattgggcatggacgcagaacgagaggcacaccaaccaatgtggactgaggtcaaccattcagaggaaggtagctaagaagagggggaatttagatggaagaagaaagaggaacgtgaccaccacctggaagaggaaagctgtagtggagattgcagaccaaggagaaaacatgaagcaagctgcaacagatatatggaatatagcaaaacaattgggggtaacaggagctgcagatcaggggaggtttgttgagaaaatcttgataatggaggaaagagataggaaagaggcagagagattggggaagaaaagtgataacccatga

SEQ ID NO: 60291 - DNA, 411 bp, Glycine max
  Peptide Sequence Number=SeqID_177069
atgaggtttcaggaatacaacctgacagtggagtactacaggacacccttcttgtgtgttataggtcgtccaccacaaaactcatcaagtaatgtccgaagtactatcaggcttgacgagttgcactggtattttaataaatgggtagaagcagatgttcttgttttcaactctgggcattggtggaacccagacaaaactatcaagttgggaatctacttccaggaaggagggagggtaaacaagacgatgaacgtgaaagaagcatttaggagatccctacagacatggaaatcatggacattgcataatctcgatcctaggagtttcgtcttctttcgtagctattcctccgttcatttcaggcaagtgcataaacacaattcatcatcaaaagcgtgtttcatgtag

SEQ ID NO: 60292 - DNA, 165 bp, Glycine max
  Peptide Sequence Number=SeqID_177070
atggctgtggccgttagacttgacggagaaatgaatgtgtttgacgacgtttccaagaccaagtcaactgcccctgtcattgttcagaaacacaacaggcttgactgtttctttgtggacaataagggatatgtagacagagaatctgcaagtaaacaagaatga

SEQ ID NO: 60293 - DNA, 1896 bp, Glycine max
  Peptide Sequence Number=SeqID_177071
atggaagggttactgaattctttgcataaccaaagttgcttaaaaccctttggtttcactcccagacttggttataccttccccgtgatcacaagaactgggcatttaaatcgaaaacccgaatcctgcaccttgagaagtaactgtgcacaattaggtagagacaccagcactagctctagaggggctattgttgctgcattgtatagtaatgataaaggagagggttctaatacagactgggaatcggagttcctcggggaacttgatccgtttggttaccgagctcctaagaaaagggaaaaagaaaagaggtcaatgttgcttgaagccactgacggaatggattggtgtgtgagggcgagaaaggaagcactgaaatcaattgaagcaaggggcatggctcatctgatggaaaatatggttactgttaagaagaaaaagaagaaggataagaaaaagttggaaagcaagaagaaaatagttaagaaaattgagaaaatagaagatcttgactttagtttggaggaagacttgccacagcctatggaaactgagattgatgttggtgatttgaaaaggagagtgagtatatttaatgatggaatgtttatagaaaagaaggagaaaacaaaggaagaatttgtcaataggctttctcagttctctgggccatctgatcatagaaaagaactcaacttgaacaaagcaattacagaagcacagactgccgatgatgtgttagaggttacttatgaaacaattgttgcagttgcaaaaggccttattccctcacctctatccccattgaacattgccactgctcttcatcgcattgctaagaatatggagaaggtttctatgatgagaactcgaagattggcttttgctcgacaaagagagatgtctatgcttgtgagcattgccatgacagccttacctgaatgctcagctcaaggagtctctaacatatcttgggcattgtccaaaattggaggcgagctgctttatctttctgaaatggatagaattgcagaggttgcactgaccaaggtgcctttgctgcaatgcagcattctgctcctgatcttttctcagagttttcaaaaaagggcttcagacataattcacactttccaagaacaagaacttgctcagcttttgtgggcttttgcttctctatatgagcctgctgaccctatatttgattctttagacatagtcttcaaagatcatagccaattgagaggttgcataggtgaaaagacatcaaataatcatgaacaaataagtgttgatagaagtggtgcctcaaatggatctcttggctctcctgtactaactttaactagggatcagcttgggactatagcttggtcctatgccgtctttggacaaatggctaggagtttcttctctcatgtctggaaaactctcagccattatgaggagcaaaggatttcagagctgtatagggaggatatcatgtttgcttctcaggttcatcttgtaaaccagtgcttgaagcttgaattcccacatcttcagttgtcattatgtggtgagcttgaggataaagttgctctttctggaaaaactaaaaggtttaatcagaaaataacttcatcatttcagaaagaggttggacaccttcttgttagcaccggccttgaatgggtcaaagaatttgttgtggatggttacactttggatgctgtgattgttgataagaagcttgctctggagattgatggtccaactcatttctcaagaaatactggtgtaccattaggacataccatgttaaaacgccgatacatcactgctgctggttggaaagtcgcatcaatatcctatcagaagcatatagaactcagtaacaagactatagtctag

SEQ ID NO: 60294 - DNA, 234 bp, Glycine max
  Peptide Sequence Number=SeqID_177072
atggcgatacaagccttgcaagctaatgccgccaataccaatggcgggacatgtgccaacgtggacagtcccgtcattggctcttgcgatataccctccatgagcccatgccgccagagactagggcacgttattgctttgcaggagactagggcattgttgttgcattggttagggcaatcagaagcatgtagcaggtcacatgcattgcagatagcttcagctttggtgtaa

SEQ ID NO: 60295 - DNA, 636 bp, Glycine max
  Peptide Sequence Number=SeqID_177073
atggccaccacttctgcttcattcgcgagcttctccgtcatcttgcgaccttcttcgtccaatccccaattcttcctcttcaacgtcgctccccgaaccggaacctctcattcccgaacccgttcgactcggttcaggtgctcggccggtcagaccgggttcttcacgaaactagggcggttgataaaggagaaggcgaagagcgacgtggagaagcttttctcgggattctccaagacccgcagcaacctcgccgtcatcgacgagcttctcctctattggaacctcgccgacaccgatcgggtcctcgacgaactcgaagaggctcttttagtgtctgattttggtccaagaatcactattaaaatagtggagaatttgcgcgaggatatattttcagggaagcttaaatcagggaatgagataaaggaagcactgaagaggaatgttttggaattattaacctccaaggggagtaaaactgaacttcaacttggatacaggaagccagctgtaataatgatagttggtgttaacggtggagggaagactacatctttgggaaagctggcctatagattgaagaatgaaggggctaagctgtttgttggtcaacaggaagtcccatttagctga

SEQ ID NO: 60296 - DNA, 2369 bp, Glycine max
  Peptide Sequence Number=SeqID_177074
atggcgtcaaccccaacaccccgaccccacttttcctccgttcccccaataccctccaacaacaaccagcgccaccaccataaccaaaacaggagccatcaccgccgcaacaacaaccggaaccggtggtcttcttcttccaccaggttctattcctcacctgcatcaagtgctggtgcaggtgcaggtgttccctctgctgctgccactgcctctgctgcattttcatcctccctgagtccgtggcttggcgcccagaaaacccggctggcgcccgagttttccggccggcggtccaaccggaacccggggaagatgaactccggcggccccagggccgtccccaacaatcagcagcactcgaaggctgccgaggaggtcctgcatagcctcaccaatgctggtaatgatgtttctgccatagatagtgtgttgcttcattataggctttatgttgctgaggattatgtttatttgcttaaggagtttgccaatactggtgacctattgctagccactaggacctatgattttgctatgagtagggctactgataatactttcatggggaagttgaccagcaacatgattaggacccttggcaggttaaagaagattgagcttgccttggatttgtttgaagagtctaggactagagggtatggaaacactgtctattccttttctgccatgattagtgcacttggcaggaacaatcgcttttcagaggcggtgagtttgttgaggagcatgggaaagtttggcttggaacccaatttggttacctacaatgccattattgatgcaggggctaaaggggaacttacctttgaaatagttgttaagtttttggaggagatgatagctgctggctgtatgccggatcggcttacttacaattcacttctcaaaacttgtgttgcgaagggtaggtggaaactgtgtagggatttgttagctgaaatggaatggaaagggattgggcgtgatgtgtatacttataatacatatgtggatgcgctgtgtaaaggtggacggatggatcttgccaggcatgctattgatgtggagatgcctgctaagaacatttggcccaatgtggtgacttatagtacattgatggctggatattctaaggctgagcgctttgaagatgccctaaatatatatgatgaaatgaagcacctgctgattaggttggacagggtgtcttacaatacactggttggactatatgcaaatcttggttggtttgaggaggcagtgggtaaattcaaagagatggagtgttgtgggataaaaaatgacgtagtaacttataatgcactgatcgagggatatggcagacataacaagtatgttgaggtccaaaaattatttgatgagatgaaagcaagacgcatttatcctaatgatctaacttactcaacattgattaaaatatacactaaaggtagaatgtatgctgaggcgatggatgtttatagagagctaaagcaggaaggcatgaagacagatgttgtattttacagtgctctaattgatgctttatgcaaaaatggtttgattgaatcttctctgaggctgctggatgtgatgacagagaaaggaagtaggccaaatgttgtgacttacaactccattattgatgccttcaaaataggacagcagctgccagctctggaatgtgctgttgatactccttttcaagccaatgagcatcaaattaaaccttcatcttctaggcttattgtaggtaactttcaagatcagaagactgacattgggaacaatgatgaaatcatgaagatgttggagcaacttgctgctgaaaaagcaggtcttacgaagaaggataagaggagcagacaagacaatttcttcatagtgcagatctttcaaaaaatgcacgaaatggaaatcaaaccaaatgttgtcacattttcagccatcttgaatgcttgcagttgttgtgagacatttcaagatgcttcaaagttgttagatgcactccgagtgtttgatagtcaggtctatggcgtagctcatgggctacttatgggtcacaggcaaggcatatgggatcagactcagacactatttgatgaactagagcacttggattcttcaacagcatctgcattttataatgctctgactgatatgttgtggcattttggtcagaaactaggggctcaaatggttgtgattgaaggaagaaaccgaaatgtgtggaaagggggttggtctactgaatccttggatctacatctaacgtcctgtggagcagcttgtgcaatggtgcatacatggttgcttgaattgcgtaccactgtttttggaggccagaagctgcctccaatattgag

SEQ ID NO: 60297 - DNA, 276 bp, Glycine max
  Peptide Sequence Number=SeqID_177075
atgccatgtttggggagatatggccatgagccatataaaacaagaatggaagaagcccggacaattgacgaggttgcgttcaatgttcgaggcctttcaatagattgcttcattccacctgctggtttgagaacaacttctatcagtgaagcttgcgaacttcctcagtatgaaagagtaaagaactcactagcagtacatcgggccaaagttgttgtgttggagaaatcacataattgcagcattgatagtatgatttggaagatggaaatctaa

SEQ ID NO: 60298 - DNA, 315 bp, Glycine max
  Peptide Sequence Number=SeqID_177076
atgaagaagattttttttataagcaaaaatgctcaacgttcaacaacacctaacgttcaaaaagcaacgttcaaaaatgcagcatgcaagcctagggttgaaacctaccccctgcaacactgcacccttgcaacactgcatgcaagcctagggcagaacttgtctcgccaatgggacaggcgagacctgctcacgggatgccaagtcagtagggttctcgctagcagcaatggtggttcctacgtggactacgtctcgcccgtcacaatggcggcatcaaaccagtttcctacgtggactgtgtctcgcttgtaa

SEQ ID NO: 60299 - DNA, 339 bp, Glycine max
  Peptide Sequence Number=SeqID_177077
atgtataactccccaggaattttaattgcacttttattcatcacagtaggaattggattcaacaccaagcaaccagcaagacgaagcagcaacgaacaccaagcaacaaccagcaatcaacacccagcagcaacgaagaagacgaaccagcagcaacgcgcgacagaggaagaaacaatgtgcgtgagaagaagcaaaaaaaacgaagaaaaaagaagaagcaaaggaaaaacgagaggaagaggaagaagacagaacagaagaggaagaagacgaagcagaagtgaagcggcgcagaggagaaagggagaggatgagtcactgttccttatgtattaa

SEQ ID NO: 60300 - DNA, 249 bp, Glycine max
  Peptide Sequence Number=SeqID_177078
atgaggtttattccgttatcaagcatactgcagccaaatgaatggtcggtcacaaatatgtttagttttcaggttgtgggtgttactgttttaattttgaccaaactggatggttctgctagaggtggctgtgtggtcagtgtggttgatgagcttggaatccctgtaaaatttgtgggtgttggtgaaggtgttgaagaccttcaaccctttgatgcggagacctttgtcaatgccatttttatttaa

SEQ ID NO: 60301 - DNA, 390 bp, Glycine max
  Peptide Sequence Number=SeqID_177079
atgtgcaactgcaatgtaatgcttgggaaggctggatgggtagcaatgtctaccagcggcgatgaacaagaagaggctatgaaagaagccaaagaaatgatggagaaaatagaagagattaagggaaagaattattttggaggagacaatattgggtaccttgacattgcacttggatggattgcttacttggttcctgtttgggaggaagttggatcaatgcagataatagacccattgaaatttccagccaccattgcatggatgaccaattttctcagccaccctgtgatcaaggacagcttgcccccaagagataagatgcttgtttactaccacagtcgcagaaaggaactttcttcaacttctctgggcttgttcaaggtttaa

SEQ ID NO: 60302 - DNA, 273 bp, Glycine max
  Peptide Sequence Number=SeqID_177080
atggcctctggtgtttctatcactcatccccgagcagctttggtgaccaccattcggtcattcatggataaagattggtgcttatccttccagcatactttgagggaaggaaactttgtagctgatgggaggccccaggcaggaccccttcttgcttcacgactcaacgacgcacgcaaggaacaaggaacagggggactccacgatgctaatggagatagaaccaaagcgatgaatgttcccatctgggaccaagatccgccatataagtaa

SEQ ID NO: 60303 - DNA, 525 bp, Glycine max
  Peptide Sequence Number=SeqID_177081
atggaagaagtatccattgttacctcacaatccttatcaaagaacatttactcgattttgggcaacctctgtgaaatgatcatcaatttattgctgttagagcttttgaggcgctggaagccagaaagcaaatcctttctaattcaagacaggccagagactaagaaattcccccgggtgctgcattggttggaaaagacatacttcacggacaaggacttgaagtcaaaatttaatgaatctcagttcgtggaaacattgtccccctttgaccatgagttgaaaattaatgttgtctgtgaggcatttgcttcaatgccggattctgatggagaaggcaacattggggcattagaatggtgtgaactgcaacctgctgaaaatttggaagtggagcagcaccaggaggaggtggagataatgcagcagctggctgttgagcaacaccctgatgctacagatgatttggaagagagttatttatatgccttagccttggctgtgaacatcttcgttttcacttaa

SEQ ID NO: 60304 - DNA, 234 bp, Glycine max
  Peptide Sequence Number=SeqID_177082
atgagtgagtgggaccgtaccaccactccaccttcgctcatggttttggttcaatggcaaggttttgctctagaagacacctcttgggaggattggaatgctcttcaatcagcttatgacctcaaggatgaggtcacatttggtgggaagggtattgatagcaattccaaccaagggaataacaggcccaagagagacatgagaagacccacttaccttgaggattacgcatga

SEQ ID NO: 60305 - DNA, 468 bp, Glycine max
  Peptide Sequence Number=SeqID_177083
atgcctggagatgtggtcccgcaaggatgcgtagacctaggcgagactccggggaaaggatggcgcacgcgctgccacgcaccagcaaaaggtgctgtttggcgcatcaaaggggccgcacgtgagggctcctacgccaacgtggtagccgatctgtgtagatccgcaaaaggcaagtccgatggtgtagtcaccaatcagaaaggttgccgacacggtggcggacggcagttgccagaaaagccggtgatgaccggaacacttttcaggaaaggagaaaagggtcgtcgcaaagcggaagcaagtcgccagaataaatgtgacgaccataaaggtctcccagaaagcgaaaacataggaaagaagtttgccagaaaaggtgtggcgagtataaagatccaccggggacagcaggtccccgatggactgtccccagtagggacggttttctttactccctcaacttag

SEQ ID NO: 60306 - DNA, 141 bp, Glycine max
  Peptide Sequence Number=SeqID_177084
atggaagttgccacatttaagaataacacactaattgtggagacgatggtttgcagctacccataccataatttccatggtgacttgggagccgaactgtcagatttgccactcattgttaatgatgctccaaatccttga

SEQ ID NO: 60307 - DNA, 240 bp, Glycine max
  Peptide Sequence Number=SeqID_177085
atgtggagcataaaagtgaattggtatagtgcacatgcagtagcaggccagcaccccaattggggagggtggctgtaccctacaagcaccaaatggaccattcaactttcaagaacaattagaggaggccagacagctcagatagggcatccacgtgatgcaatcagcggtttagaagttctaggtcattctaacagctgcaccagcacctacatctcaccgagagatttcttgctctag

SEQ ID NO: 60308 - DNA, 990 bp, Glycine max
  Peptide Sequence Number=SeqID_177086
atggacttcggtgttcaatgggtggtgggggtaaatttacctgctagccctggagttaattggcattgtattcatgctcttggcacatcaaagcttgtttcttcttttttaatatacttctattccagccatagccatagcctggctagtggttatgtcctaggaactgccaaaaatatggtcattccttatatgcctatgttggttccaccagtcaactggtcaggttatgacaaaggtgggcacttgttcttaccctcttatgtcatgcgtactcatggagccaggcaacaacgtgaagctgttaagagggcccctaggaagcaattagagcctgtgtttgaggaattatggaaggatttttttcataaaaatactcatgatcaggctctggatactcttgggcatacgaaatggagggtaaataagaaggtactgagtgttgtagacaggatatgggctagtggaggccgtattgctgatttggtggaccgcgatgatgttcctttacctgacaagccagttaccgatgatgaagagaagataaagaaatggaagtggaaatgcaaatctctgcagaaagagaacagagagagatattcacaacgttgtgacatagaacttaaacttgctgttgcacgaaaaatgaaggatgaagagggtttttactacccacacaaccttgatttccgagggcgtgcatatcccatgcacccacacttaaatcaccttggttcagatttatgccgagataaacctctccaagggaggcgatggtggttgaaagcagaagatccattgcagtgcttagctgtgtgcataactctaaccgaagctttaagaagttcttcaccagaaacattcatctcacatattccagtacatcaggttctattcactgaaataaccactttgtttatgggtaatactgcatgtatctgtccctccccatacccacattgttgggagccttgtgcactagggcactag

SEQ ID NO: 60309 - DNA, 372 bp, Glycine max
  Peptide Sequence Number=SeqID_177087
atggaccttgggggaaatccattgtacaaggtcaatgctacccttttaaggggcgttgggaagacacaagacaaaattacatcgtcattggtgtacgtatttgcttgtgtgaggaaagaatccagatgttcatctagatcagtggtctcatcatatcactcaagcttccatgatgcggtcgacaaaggggtgttgacgagtagttcgccctgttggatggtgtatgtgggagagacttggatcatcttgagtgttgattgtgcattaggaatgagattccccttgagtgcactcaatcaatgtgcgagcagagtgctcttcacccttggggtgtctcacacgaactttgagctgatcgtggtcagcatttag

SEQ ID NO: 60310 - DNA, 348 bp, Glycine max
  Peptide Sequence Number=SeqID_177088
atgacatatgtcgcattggctagtctgcaacaaacaaatgatgaatctctctggaaattcatggataggtttggatgcattgttgtccagatccacaatctcaacccagaggtagcattacactccatgctcctcgctctaagacctgtagcatggacgagttgcgcgaacaagtcaaaggttacatctagatggaaaagatgtccaagttcaggaacaaggtgcgacaagctagacaaaagtgcgacaagcgagaatgaagcaccaagaccgactcacacaagtcagacaaaaggcacaagtcggacaagcgctagcctctaccaaaagtgtggcgtccctaaataa

SEQ ID NO: 60311 - DNA, 1242 bp, Glycine max
  Peptide Sequence Number=SeqID_177089
atgtggcggcacgccgccaaacacgcctgccgcggtagtattcgccagagcttccacccttccaggctcctctctctctcccacggctccattttctcccccaaaagggaggctttcttgtacagcgtggcaagactaaactgtattggtcgtggcgattttcagtttcagtttggtgccaaagggtattccggtgttgccgaggcggcttcttccactgatgtggaggaagatggtgtttttgttgatgaaattcagcaacttttattgcaggagatgaatgatgaggtggagagtcaattggtggaggaagagggtgccccaattgatgaaattcagcaactgttattgcatgagatgcataaagaagagaggaatgaattggtggaggaacaggctgccccaggtgacggaattcgaggactgtttcaggggatgaagaaagagaagcagaagaaggtggttggatataataggtggcagaatgaggggaagggtgtggggcagtgtaggtaccaggagctgagaaggaggcaggttaagattgagactgagacgtgggaagaggcggcaaaggagtatagggagcttttgatggacatgtgtgagcataagctggcacccaatttgccgtacatgaagtcgctctttctcggctggtttgagcctctgagggatgccattgtcaaggaacaggagatgtatggtgaagggaagaataggacggcctatgtgccatactttgttcagttgccggcagacaagatggctgttatcgcaatgcataagttgatggggctgttgatgacaggaacagaacatgccaccgttggcactgccagggttgtgcaggctgcgtgtggcataggtgatgccattgaaaatgaggttagaatacacaagttcttggagaaaactaagaagaaaaagggtgatagaagcaagaaaaataaagcaagtgagtctgtcgctgacatcaaagaggaacaaaagctgcggaaaaaagtcattgatttgatgaaaaagcaaaagctagttgcagtgagggggctagtgaagggcaaggatgatacaaaaccgtggggagcagccataaagacaaaggtaggaagccgtttaattgagctcttaatgcaaacagcatatatacaaccaccaccagatcaattactggatgctgcacctgatatccggcctgcatttgttcattcatttagaacagtggcaaaagtgtcagcgtga

SEQ ID NO: 60312 - DNA, 291 bp, Glycine max
  Peptide Sequence Number=SeqID_177090
atggaaaattgggagattgctggtcagagaaaacagaagaggataatagagataataggagatttaaacagaactggtattatgcttcatagaattctagcagacctcaataggagtagcttatacaagccaagtacttttcagagcttctcaattggaaatataaaacttttctccttggagaaactctcaagagcatttctagccttgtatccaaacatgctctatttcacaaatggattggatcaaaacgaaggtcaatggagcgtccaaagggatcaacagccgtag

SEQ ID NO: 60313 - DNA, 909 bp, Glycine max
  Peptide Sequence Number=SeqID_177091
atgtctccgtctattgttgctcttgctgctggagaagggggtcaactggctgtcgaggttggccctattgctggtgttgttgaggtcgcccccgatgatccttcctctgttttggctaagaggaatcaagatgatggtgctggggtgttaggccataagaagtcaatggccttttttagcctttgtgccctgaggcaagctacaggactgacacttggttcgattcgctcttcaaagattgttccgattgctaaactcgatgcaccagctgctttggctggtcttatcgtgactccttcgtccacctttgctgagtgccagtgtggtgctcccgagatgtcgtctcctccttcttcaactacctggattcctacctcgaccgtgttggcatcgattctgaaaatctttgacaaaaatgggcaaaggcaccaagaggtgctaagtaaagtggcatccttggaggcggagattgccaaatggaggactactgctcgcacggtctggagaatggagcgccctaaggtagccagtgccaccgttgccttcactgaagctatgaattcgaaccaccaattgtcttccaagatttgcagtgttttggccaagttgttgcgcattaggttgggcggtgatgaactgctcgaatgctccctcgaggattggctgaaggaatcgaagtccaagattgaggagttcgagctgcgagcgacacgggagagggaagccagcaaggaacttgaagaagggttgttgatgtacaagaagaaggctgaagacttgggtcattttgaccctttcaaggatgtgaaggatggtgttctgcttgacgaggaagatattgcagctgaggaggaggatgtcgatgaggagcaggatgttaaggagcaaggtgatgatgccaatgtttag

SEQ ID NO: 60314 - DNA, 357 bp, Glycine max
  Peptide Sequence Number=SeqID_177092
atggggtcatcttgcttgacgggtttgatacccttgaagtctctatcagtgaaagtgataggagtcaatgtcttggatatcatgaaggtgatgcttgcgagactagttggactaccctctataggagaatccattcgcaatggtgttgattacacctctaatttgctaggtgggttcatttttcccgttcttgcaaatgttgtcgatcgtgtcttgttggtggtgtctctgtcttccttgatcttctacttcatctcttcttctgtctgtgtcttgatttctatgttgatcctcttggtgtccttcaggtctcactcctgcttggtggatgtttggcctcttaacaaattgtgctag

SEQ ID NO: 60315 - DNA, 324 bp, Glycine max
  Peptide Sequence Number=SeqID_177093
atggggtacgaagtgttaggggtcacgtgcaactccttgagtggagctaggtcaccctacgagactgtggtggcaactacagaatctccaagagaagcaatgacaaaaaaagatgcaaagaagatggcggatagggtaccagggaatggccactttgatgacggcgacggaggacatcagtgtaggttgcaggtgaaccatatgagggttggggttacaggaaaattagtgtcgagaataatgggggaggttttgggtgagagaagaggtagccgccataggatttgggagaagagattgtggcaatggaggggtttggtttga

SEQ ID NO: 60316 - DNA, 991 bp, Glycine max
  Peptide Sequence Number=SeqID_177094
tgggtgcggatgacgtcacggggaagctgaagatgacgggggtggccactagggaaaacgtcgacgtattgaagctttgcacgagacgagggaacagcgtggtggccatgtacattagaaacccttccgcgtcgttgaccatgctctattcccacggcaacgccgccgatctgggtcagctctacgacttgttctcccaactcagtctccacctccgactcaatctcctatgttatgactattctgggtatggccagtcttctgggaagcctagtgagcagaacacgtatgcagacatagaagctgcttataaatgcctggtagaaatgtatggggcgaaagaggaagacattattctgtatggccaatctgtcggtagtggacccactacagatttggctacacgtttaccaaaccttagggctgtcattctccacagtcccatcttatctggtcttcgagtcatttatcctgtcaagaagacatactggtttgacatttataagaacattgataaaattcccttggtcaattgtccagttctgggaacagctgatgatgtagtagattactcccacgggaagcaactttgggaacattgcaaacaaaagtatgaacccctatggattaaaggaggaaatcattgtaacctggagctttaccctcaatacataaagcacctcaagaaatttatcacagctattgagacgtcatcgcataaaaaaactggatctggacctgttcctgatcaactggacagaccaaggaatagcacagattttagagagaaacctagactcagcatggatctaagggagactttgagacgaagtattgacttcaaagaaaagcctaggacaagcacagaccataaagaaaagtcaagagctggcccagataagaaagataaatcaagaaagagtgtagatcgctctgagaaagcatgcaatggagcagaaattcctgagaaagctagaaatagcattgaccg

SEQ ID NO: 60317 - DNA, 204 bp, Glycine max
  Peptide Sequence Number=SeqID_177095
atggctttcaaggttctcttccctgttatgcttttccaagcacaacactttttacaagcattcagtgttttcttcttcttaacgtttaattcattgcttaatttgcggctgatgccgattgcgttccctttgagcctcaaggccttagcatttatcaataaaaaacaggaaacatggtacaaggcatgccagagtggaaagtga

SEQ ID NO: 60318 - DNA, 471 bp, Glycine max
  Peptide Sequence Number=SeqID_177096
atgtggcacttgggtttttccaagtgcgtggataatatggtgtgtgactcatttaatgaatctaggatagactttgatatcatcttagaatgcagtatattttcatgtctgagaaatgctgaaatattgggagcattaatttcagcacttaaaattttgggaattggctgtatatttcgtacaaattttcctgaataccaaggacctgagaagattgtcatccgacgttacagtgactttgtctggttacgtgatcgcctttttgagaagtacaaaggcattttcattccccctcttccagagaaaagtgctgtagagaaatttcgtttcagtgctgaatttattgaaatgaggcggcaagcattggatgtatttgtaaataggatagcatcacatcatgaactaaaacaaagtgaggacctgaggttgtttttgcaggcagaggaagaggtgatgcctcattctcagtag

SEQ ID NO: 60319 - DNA, 309 bp, Glycine max
  Peptide Sequence Number=SeqID_177097
atggaacaacaacaacagcagagaactctctccggttcgtcacagagccctagatctccgtcttcgtcgtcgcaaccttttctctccgtctccgtcaccgatcccgttaagctcggcaatggcgtccaagcctatatctcctaccgcgtcatcaccaaattttggattggaaatttctcgttgaatctaagtcgagttttgattttgcgtgttgacggaggtcgttggagtttcggttcaactcaacttcgaccgcggctgttaatttcgaagagtgtggaagacgagatcgtggttttgtgtgattga

SEQ ID NO: 60320 - DNA, 357 bp, Glycine max
  Peptide Sequence Number=SeqID_177098
atgggtagtaatcttcccacacaccctcataggccaattgatctaatgggggtagttttacaaactatttctccatataggtcttttttgaagatattacgagggggtgctgttttttacgtgattttcacgctgcatgcaagccaaatcgccatgcacgctggcgatttcacgagggaagggtacgtggcttctcgccactgccactggcaacatagccagtggttatcgccacggttgggcaggcacaggggtgcaggaggcgcaggagttgcagagggaatcaccattgtgactagcgatttgcgcttcgggtatcgccactgctgctggcaatttgcgcttcgtgaattataa

SEQ ID NO: 60321 - DNA, 420 bp, Glycine max
  Peptide Sequence Number=SeqID_177099
atggcagagcgtggccatggaatgtattacacaccaccaacattttctcagtatccaacacagatgtatcagtatcctttcaaaggtcatcacactgatatttctgcaagcaaacactcgtttggtggtgttgcggaaacacatcttcatttttcatggccaactatgaccccttcacagcaacatgatgccccaattccaacacctaacgccccattaggtacgcaatggaatgtacccagagcaatacctgatataggtgacttattaggtgctgatttgcatcaccaattttctgttgaggctgaccaagtagaaacggggagacatcgggacagaagaaatcctgatcgccaagcgcaacgatgggatcgatcatgtgacacatcctcacgtcatcacggatatcataatgaatga

SEQ ID NO: 60322 - DNA, 216 bp, Glycine max
  Peptide Sequence Number=SeqID_177100
atgaagttacacttacggattaacttcatccgtatgaatcatacggatgaacgttacagattaattaacactacggatgaacttcatctgtaccaatacagaaaaggaaatgcaagcaacgccattaacggagatgtgaagtttacctcgacggtggaagaccaaagcacaacaaaagtcctcaatgccttgaatcaccaaatgcgacgcgaatga

SEQ ID NO: 60323 - DNA, 222 bp, Glycine max
  Peptide Sequence Number=SeqID_177101
atgaccttggacctcctgttcgtcatggacaggcctgtcacatggaacattctagatcagggtgttgagccacaatataacctgttgcatgttgatggatgggctgttggacaggagggtgaagccccactgcctaggtcattgttgacactcggcttgcatgtatctgatgccgaagtagaagtcactactcttatactcggaccaccgggttcagagtag

SEQ ID NO: 60324 - DNA, 339 bp, Glycine max
  Peptide Sequence Number=SeqID_177102
atggaggtggcgataaccaccggctatgttgccagtggcagtggcgagaagccactaacattggcaaaagggagcataacatggcaaaagggaagatttggtgaaaatacaatcatcagtaacattgatataggttttgtgggtaatgttgggtcctgcacaaagattaataggcccgtggacattatcacagttgtggggggtcaaggatactcattacatgtagatatacagtatcttgatgctagatgggaagttcttgttgtgcttcctctgcgtgattgttttgcccaagagatcaacatgctatgccgccttgatgggtttgtagtcctctag

SEQ ID NO: 60325 - DNA, 516 bp, Glycine max
  Peptide Sequence Number=SeqID_177103
gctgttccttcttccaatcttcattcatatcagattctcaattcgtcaagctctatcaatgggaactgcatgcttccaaaatccgaggaattagaggacatggattgtgtagggcattcttctgaatcaaggtctggagtttgtgttgcccaatcagtagaaaatggaggttttggtggaggtgggaggtgctgtaagcaagcttcccctccaaggagtggtgggtctagaaatactagtccaatgagccgggccgggtccaggaacacgagcccttcacggcagaaggttgttaagaccaagcctaggggtttggatgaggaaacacttgccacatttggtaaggtagtgcatgctgatattcagatggaggataatatatgggcaatgttgcctgaggacttgttgcatgagatcttagctagatgtcccatcacatgggccgtgtctccttacgttttggaagaacatgcagaccccccagtgttcagtcttcagcttgccactgaaagcttg

SEQ ID NO: 60326 - DNA, 369 bp, Glycine max
  Peptide Sequence Number=SeqID_177104
atgtttcacacacctgacaactctgccaaaccgagtgaagcagtaaaatatgcatcatttcaagcacttcatgaatctcgaagtcatgtagacgacaagaaagtcacctcaatgttgtcaccatcaccatcacgactgatgttgcgacccaggtcatctcgggtgacacttgacctcttgtccatcatggaggagcctgtgacaacaatccgaattttgggtattgagattcaaccttacctcccaccaccacctgggtctgtccgaattttgggtgtagagcttcgaccttaccttccaccacctgggccattgttggaaatcgacgctcctgtatccaacgcaaacatgaagcgacaaccctcataa

SEQ ID NO: 60327 - DNA, 534 bp, Glycine max
  Peptide Sequence Number=SeqID_177105
atggcatattgtgactccagattgtacttggaaaccctttcaccacttggtttgatgatgtatagactagacacaggtcattgggaacatattccggctaagttccctcgatctttgttggatggttatttggttgctggtacccagaagcgtctttttcttgttggaaggattggcctttatagtactctacagagtatgagaatttgggaattggatcataacaaaattacatgggtggagatcagtaggatgcccccaaagtatttccgtgctttattgagattatcagcggagagatttgaatgcttcgggcaggataatttaatctgcttcacctcttggaaccaagggaagggccttctatatgacgtggataaaaagatctggtcatggattggtgggtgtgctctgcagtcatacaacaatcaagtttgtttctatgagccaagtaaaatatcttactcacaagctgtaatgaacagcatgcctgactgtgaatgctggttcagttccatagacagatttttgtga

SEQ ID NO: 60328 - DNA, 162 bp, Glycine max
  Peptide Sequence Number=SeqID_177106
atggggctgttttgtttgactggcgatttgcagcaggctagggcacggctttccaaacttttcagatttcagatggcagtgcttttttcaaatggccgtgctttagacggtgtcaatggatatagcaagtggtgttggcgagatcatgcaatatggatatag

SEQ ID NO: 60329 - DNA, 288 bp, Glycine max
  Peptide Sequence Number=SeqID_177107
atgtcaaggtatatgtgctatgcaaaagtgcagtcactagcacttgctattatcaaagtttccaacactagtggagttgataggaaggtcctcgtctgggacttggaagatgtgttaggggtcacgtgcaactccttgagtggagctaggtcaccctacgagactgtggtggcaactacagaatctccaagagaagcaatgacaaaaaaagatgcaaagataatggcggatagggtacctgggaatggccactttgatgacggcgacggaggacatcagtgtaggtga

SEQ ID NO: 60330 - DNA, 447 bp, Glycine max
  Peptide Sequence Number=SeqID_177108
atggacttgaaagaaaattgtacttatgtcatgcacaattttaaagtgctaaaaaacaatggtcagtacagagtgtgtgatcatcaatttaaattggtgtttattggggttactgttgtgagggagtgtgttctaggggacatcccttttagaaaatacaggtttactggatttgcagatgttgtggctggccagtttgaacgtggactattggttgatattattggtgtggtggaggaggttgtctttcagcaagtttcaggaaaaggtagaagggtagtcttcaaactaaagaacttgagccagcaattgctatcttgcactttgtgggatgattattgcttgcagtttttgaagttcttagatgattatgaaggtgatggcccaattacagttctattgagccattgtaggatcaaggaagcgcagggtatatcctcatcttga

SEQ ID NO: 60331 - DNA, 240 bp, Glycine max
  Peptide Sequence Number=SeqID_177109
atgccgcagccgttctccacggacaccgagatcagtggctacctcttcgacttcctcttcgcggcgcaggacgcatccacttcgtcacttctgtgggcggtggcgttgctcgaattgcacgcagagctgctcgcaaaggtgagggacatgacactcaggcggtggcacagactcttgactaaattagtcattgtctcaaataacagtgtaatggattgtgagatatatgtaattgattaa

SEQ ID NO: 60332 - DNA, 450 bp, Glycine max
  Peptide Sequence Number=SeqID_177110
atggagcttactgcaatcatatggtccaaagaggtggggggggggggggagcaagatgaggatttggagacgattggaaaaaatttgtttaaggagaagctaaaacttctaaaaacaaaactctggggttggcatgtggaggtgttcgatggtttgggtgctaatataaattctaaagtggaggagctggaggtggtgaagacaaggttgtgtgtgagggttgaagatgtaggagggaggaggttgattctttctaaagaattttggagatcgttgaagaaatggcccaaaaatatagggttcatctatctctatgagatacaagcaaaaagcatgaaaataaaggttttggatgatagccaatgtatagtcattgggcgatactgcctcaacatccagtcctcagaagaaaagtgctttgacacttcgctcatagtacaaaggcaatga

SEQ ID NO: 60333 - DNA, 609 bp, Glycine max
  Peptide Sequence Number=SeqID_177111
atggggctgttttggtacgtaaaatgcatgcaaaccaacagtttcattggcgagttcgccctagctgcgacacgtggcgaaaatgccactgccattggcagaatgcagtgggtatatgaagagaatgatggtgtaatatttgaatgcagtaaaaaagcgattcagattaaacgtagaattagtttcaatgctttgaaaaaaaaattggagataagatttttagtttctggaaaatatgttgctttgcaaatttgtgatgacgaagatgttgaaaccatactcgaaagttttcaacaacaagatcaaatgtcagatatggaattatacatagaaaaggatgtggctggtggttctatgtttcattctgcaaattctcttacatcatgtggaaataaattatctaataatgaggcgcaaccgccaagaaatgtgagcaatttacatggtgatgaagatgatgatgatgattatcttgtgtctaactcatacgttgaagagtctttagacgaagatgatagtgttgacggtatatctgatactgacgatgaagtcaccgacatgattcaaccagtaagaattgttcacccagcagaatgtataatttattaa

SEQ ID NO: 60334 - DNA, 477 bp, Glycine max
  Peptide Sequence Number=SeqID_177112
atgggaaaactacgaaatcaagtcagacaacacaaaggcaaactttactttgctgatggcctaacaagattgaggacagaactgcagatttatgaatctgtcacgataaatttcctggcctacgaccacccctcaaaatttgacctccacttcactccaccattagaccagcagaaatgcaaaaggcgccgtgcaacaagaaaacacatctggacatatgaaatcacccaatcaatgctaggcgcaccatatccactgcaactttcagcctctgtcacacaatgcctaatccactgtggtgatcatatgacaattctcagaagattcggacctccactgcaatggaatgtagttgtgcttgacaaaggcatcggtgataagtatgtcactctcccttggtataaattccttcaagaaggtgattttagccatggagacgagctctcattctactataggcgtgctgagaagatctag

SEQ ID NO: 60335 - DNA, 483 bp, Glycine max
  Peptide Sequence Number=SeqID_177113
atgaaaagaagaaacactgatcagatgatgaagatcacgttgctctcaacccttttactaggatgtctcttggtcatgactgtccaaggagattcatcagcaggagttgttccagcggtaactgtagttgaggaagggaataaaaacaagcttggagtgtcatctcaaaaggaaccatttgtgagaagtggagctggtcacgtgaggaagctggggcttggtggaaagaaatttggcacaaatgaggtgacaagtgtggactctaagaatggaaaaggagcatatggaggagagacttcaaagatttcaggtgcaacctattctgatggaatatgtgactttgatgaaagggagggagatcataaaatagtaaaatgtaaagggaagaaaagtataaaatcaagaatgctcaaaatggatggttatgttgctttcactgatgattatcatgggcccaggcaccaccttccaaaacataactga

SEQ ID NO: 60336 - DNA, 970 bp, Glycine max
  Peptide Sequence Number=SeqID_177114
atgaacattcacgaatatcaaggaaaacaaatactaaagagctttggtgtgcgcgtacaggaaggtatcgtagcagatactccagagcaagctgtggaagcggctaaaaaaatgaaagaagactacaattctgattgggttgttgtcaaagctcaaattcacgctggtggccgtggtaaaggtggtggtgtcaagttagctaagaacttagatgaggtcaaacaacgagctactgacatcattggtatgcaattagtaacgcctcaaactggacctgaaggcgagagcgaaacaaaagaattctacatgtctgtattactagaccgtgctaaaggacgtaacatcgttatgtactctacagaaggtggtatggatatcgaagaagttgcagaaaaaacaccacacttgattttcaaagaagaaatcgatccaaaagtaggcttacaaggattccaagcacgtaaaattgctttcaacctaggtctttcaggtgctgcgcacaaagaaatggtaaaatttgttgctgctctttacaaagcatacgattctacagactcttctatgtttgagatcaatccggtactgaaaacttcagacgataagatcttagcagttgatgcgaaagtaaatcttgatgagaacgcactataccgtcaccctgattacgcagcaatgcgtgacgtgactgaggaagatccaacagaagttgaagctggtgaatcaaaccttaactacgttaaattagatggtaacgtaggttgtatggtaaatggtgctggtttagcaatggcgacaatggatatcatcaaattggctggtggtgaacctgcgaatttcttggacgttggtggtactgcaaatgctgaaactgtgaaagctggtttcaatatcatcttaaaagaccctaatgtaaaagcgatcttaattaatatcttcggtggtattgttcgttgtgaccgcgtcgctcaag

SEQ ID NO: 60337 - DNA, 580 bp, Glycine max
  Peptide Sequence Number=SeqID_177115
aggatcccgctctgccccagccattctgggtaaacacgaagccgtccaggttctcgccgaaatactccaccatatcgttgcgctcggcttcaccgtgcaccagcacgtccagtccgaggcgctcctgctcgacgatcgcctgtttgatgtgctcaccgatgctggtgcggtagttgttgccgtccaaacggccctgtttgaagtccagacgcaggccacggatctcggtggtctgcgggaacgaaccgatggtggtggtcggccaggccggcaggttgaaacgttcgcgctgcgccctggcgcgctcggcgtaagcgctgtggcgttcgctgtcctgcgcggtgatcgccgccaggcggcgctcgacctgtgggttgtgcacgcggctcgactgacggcgggcgcggatcggcgcgctgtaggcgtccagttcggcccgtttcgtcgcgtcaggcgcgttcagcgccgagctcaacagcgccagctcggcgcatttttgcagcgcgaaggcgaaccagcttttcacttcttcgtccagacggctttccacgctcagatcgatcgggctgtgcagcagtga

SEQ ID NO: 60338 - DNA, 517 bp, Glycine max
  Peptide Sequence Number=SeqID_177116
atgaccactcttacacagatatggatgacgttgctacttagcaacattctgcccagcgaccacaatgccgatctccccctgtggaaggatcgcgcccacaagacacccagtggacccggagaagtccaacagggccctggggtttccagctctggttacgggcctcagtcagtcctacagggtgcccgtcccccccagcaagggattgcccccgtaagacacctagtggacccggagaagtccaacagggtcctggggtttccagctctaattatgggcctctgtcagttctacagaatgcccttcgcccccagtagggtcatcagtcccctattgtcgcaacctaccctttggcgggagggcaacgcgagggctcatggatacatcttccatgaaaggaaaatgcgcggagtcgccaccaacttttattcaaggaaaatgtcgaaaaaaccggaaagacgtggtctacgaactttaagtgtgaaaggttcgggagttgtatttatgcacggggaag

SEQ ID NO: 60339 - DNA, 143 bp, Glycine max
  Peptide Sequence Number=SeqID_177117
aattgcacagatggaggcctagaagaaggttgaagaactggagcagtgctctcagcgcatcgacaaccgctcagtgcgaggagccaacttggaggccaggcttagcccgcatctggcggcttagtgcgcatttggtgacttag

SEQ ID NO: 60340 - DNA, 838 bp, Glycine max
  Peptide Sequence Number=SeqID_177118
ttatgatgataaagggcctgccatagatgctgttgtctggtatgatggagaggtttggagggttgctcttgacacacacagtcttgatgatgatccagattgtgggaagcttgctaactttatacccttaaccaattatagtgctcttggtccatggcatggagtgattgcaaatgatgcttgtgtgcgtctttgccttcatgcttgggcaatgcagtgcatggaagctcctatgtttttggaaaatgaatgtgctttactgagggatgcatttggatggtattgctttacgctactgtgtataatccatgagtataaacaagtgttgtacacggagccacccctttctactaccgaaagatccgtagtggaggctgggccaaatgcttcttacctaaccaaaaaggaagagtcagcattcaaagacggtgcttacctcaacaacgtctttgaaagtggacattcaaagacggtgtttacatcagcaacgtctttgaaagtcagcattctaagacggtgcttacgtcagcaacgtcttagaatgcctacattcaaagacggtgctgaggcgtttccgggatacatgagtttcatggaatctctagctaagaagcgaaaatgcaaggaagatgtgttctatgaggtgaagaaaactgtaggaatgtcttgcatgagtcaagtgataagaagtgagcaaattcctatacaagtgtcttgcccaggagtccaatttccttttgtagggggtgatacctttggtactgataatgatgctgctgcagagagtagagttaatgatgattacattgtggatatcactgctacccaggaagcttag

SEQ ID NO: 60341 - DNA, 538 bp, Glycine max
  Peptide Sequence Number=SeqID_177119
atgttgagaatatatggcgtcgtttacaagggttgtgaccacgtctccaacgagaccatcacgttgaagaagatttgcagggactgttatcctaatgcaaatgttttagccttctacgacgaggatgacgagtttgatggcaatgatgttgttgatttgcttcctaattcgtttgatggcaatgatgttgttgatttgcttcctaattcgtttgatcttgttgctggtgaggatctttttgaagagtttattagatcttctgaatcccaaggatatcttcatggtgctattgtggctgtggttcttgggatcattattgacatgcctgttataccagttgttgccatatttaaaggcctttacatgctttttaaagggtggaaacgtttgtttcatgatctgataggccatgaaggccctttcttggagacaatatgtgtgccttttgctgaccttgctattgttctgtggccattgactgttgttggggcagttttggcatctgtgttagcgagtttcgttcttggtggatatgcag

SEQ ID NO: 60342 - DNA, 510 bp, Glycine max
  Peptide Sequence Number=SeqID_177120
atgatgcctacaggagaggtggtagctgtgaagatgcttggacccaattctaaacaaggggagaaagaatttcaaacagaggtgcttctgctaggaagactgcatcatcggaatcttgtaaatttgttaggatactgcatagataaaggacagtttatgctggtttatgagttcatgagtaatggaagtttagaaaaccttttatatggtgaagaaaaggaattgagttgggatgaaaggctgcaaattgctggtgatatttcacacggaatagaataccttcatgaaggggcagtcccacccgtcgtacatcgtgatttgaaatccgcgaatatattacttgatcactcaatgagagctaagagttggcacaagaaaccaagcataaccaccaaacaagaagatgagcacgataaccaagtaagccaaacaagaagagtgatgcaacaaatcaacatagtcatcaaagaagaagaggggtgcaacaaaccaagtgtgattttcaagtaa

SEQ ID NO: 60343 - DNA, 1881 bp, Glycine max
  Peptide Sequence Number=SeqID_177121
atggcggttgcaacctttaaaggacctcctagtgagtgttgtgggaatgggaaaatggaaagaaagccttctgggaggagacgtgtgtttgttcagactgaaactgggtgtgttttgggaatggaattagatagaagggacaatgcccatactgtgaaaaggaaattgcaggttgccttcaatgtcccaactgaggcaagctcacttatatgtggggacatggtcttgaagaatgacctaagtgtggttagaaatgattctccacttctactcactaggacctttttacataggagttcatctaccccttgcctttcacctactggcagggatcttctgcagagggatcagagtggaccaattgaggttataggttgctcagatatgttttcaggaaccaaacagctggttaaggatattatgaaggcaataaaagttggcattgaacctatccccattcagagtggattaggaggtgcatattattttaggaacagcaatggtgaaaatgttgctattgtgaaaccaactgatgaggagccttatgcaccaaacaatcctaaaggttttgttggcaaagctcttggacaaccaggactgaaacgttcagtgagggttggggagacaggtttcagagaagttgcagcctaccttcttgaccatgatcattttgccaatgtaccctttactgcccttgtaaaggtcacacattctatttttaatgttaatgacagggtcaatggtagtatgcatcataacaaaaagcaaataagcaagattgcatctctgcagcagtttattcctcatgattttgatgcaagtgatcatggaacttctagtttccctgttgctgctgttcataggattgggattttggatgtacgaattttaaacacagacagacatgcaggaaatcttctggtcagaaagcttgaagggtttggaaggtttgatcaagtggagctttttcccattgatcatggtctttgtctccctgaaactttggaagatccttattttgaatggatctattggcctcaggcatcaattcctttctcagatgatgagctcgactatatatatcacctagacccatttcgtgattcagaaatgcttagaatggagcttcccatgattcgagaagcatgcttgcgggttttggttctctgtactatcttcctcaaggaagcagcagcttttggtctttgtctagcagagattggtgacatgatgagtagggaatttcagggtctccatgaagagccaagtgagcttgagcttatctgtattgaagcaaagaaacttttagatcaggaagaattattttcttatgaagcagaagtagaagacaaagatgtgattcagtttcagctagattgtgaggatcgggatttggatttcactacaaacatagaagagaaactgactgtaatgccaccatttcaagttggagctacaaatggaatcattagaaacacactttctagactagaggaaagtgtgatggaggacgaggctgagagtgaaggggagttgccctttggtggtgacgaatacaatggtcctgtaggaaatggtgtgcctaatgtttcaaggctttctgtgtctgtgaaaaacacgagaactggtgagaaaagtaggcagcagatgggtgtaaagcaaaagagtggctttttggctgggacatcatctggaaacacaactgtgaatgagttacctgcaagctcatgtttcgtgaagctaacagatatggatgaagagaggtggaatcagtttcttgagaatttccagaggttggtgatcccagcttttgttaattgcaaacgaggaaatgtgagcaagaagcagagacagagacttggaacttcatgccagttttag

SEQ ID NO: 60344 - DNA, 779 bp, Glycine max
  Peptide Sequence Number=SeqID_177122
gagacaaaggtctctgctattactgcgacgacaaatgggccacgggccaccgctgttcgccccgaatccaccttctcatcgccgaggacgacgttacacttccgccttctcctgactcccctcacgagtccagcccttcctccccaccaccggactcccctttccaattaagcctcaacgctatgtcaggcatgcctgctccgaagactttccgcgtctacggctccgtgctccgccatcgtttctccattttgattgatggaggtagcacgcacaattttgtgcagctacgcgtggctcgattcctcggcttacgtgctgtcccgatctccccgcttcctgtcatggtggggcaccaccttcctcacagaccttttcgggttggacctccagggcgccgatattgtactaggagttcagtggttacgcgaattgggcctgttcacccacatgggcctcccagtccgtttattggcggacgttcctgttacaccacccacagcttcggcccatcaattgaaacgaatgcttcagacccaagcagtttccaccctcttccatttgtcccttgcacccccctcttcccccacaccctcatcccctacttcttcctccctcgtccttctcgaatctacctccctctccccagacctcacctccttattcaccaaatttcagcacctctttgccgaacctacccaattacctccccatcggaccatttcccatcatatccacctactcccggactccaaacccagtaccgtcaaaccttatag

SEQ ID NO: 60345 - DNA, 2493 bp, Glycine max
  Peptide Sequence Number=SeqID_177123
atggccgaggaagacatacccaagattgcatttcgtacccactccggccactacgaatattgcgtcatgccgttcggcctctgcaacgctccggcgactttccaggcaaccatgaacgaactccttcgccctttcctccgcaagttcgtcgccgtgtttttcgacgacatcctggtctatagtccctcttggaatgagcatctccggcatctggaatttgtgtttcaggcacttacagacggatccttcttcctgcgtgcttccaagtgcgtctttgccaagactaaactccaatacttgggacacgtcatatccgctacgggggtcgatccggatccttccaaactttcggccatgcaggactggcccatcccaactaccaccactgaccttcggggttttctcgggttaacgggcttctaccgccgtttcatacgcggttacgcgctcttggatgccccattgacttccctgcttcgcaaggataactttcattgggatgatgatgctcaatctgctttcctcaaactcaagcaggtgatgaccaccgcccccgttctcgttccgccggatttcactatccccttcgacgtcgagacggatgcttctggtctcgctatgggagctatgctttctcaaaacgctcatcccattgcgtttttcagtaagattttttgccccaagcttcagtgttcctcaacttatgtgcgtgagcttcacgccattgccgccgccgtgcgtcaatggcgacattacctcctcggacacccctttactatcattacggaccatcaaagcttgaaagacctgatgaaccaagccatccagacccctgaacagcaacattatttggccaaacttctcgggtacgagtacactatccgttatcgaccgggttccggcaacggcgccgccgacgctctctcgcgtcttggcccacctgggaaatgtcttattctttcggcccctcaacttgattgcatgactgaatttaaaaattccataatccaatcccctgagtatcgcgccttacgtgagcaagtgctccaagaccccacgcttcaccctgattatgatctctctgctgactggctccgtttccgaggtaagatttggattccggcgaacaacccttttattcctatgcttctgtatgagtaccactctactcctctgggtggacatatgggcatcaccaagacccttcgtcgactccgcgacaccttctattgggcaaccatgtctcgcgacgtgcaccgtttcatctcaacatgttccatatgtcaacaggttaaatccccttgtcgcaagccagctagcctccttcaacctttgccgattccctcggggatatgggaagatttatcccttgattttatctccggtttgccgtcctcgcacaattttaccaccattttggtggtcgtggatcggttttccaaaggcacccacctcggcgctctcccttccaagtattcagcgcataaggtagcccaattgttcatcgacactgtgtataagcttcacggcttccctcggagtttggtctccgacagggaccctgtttttctcagtgctttttggcgcgagttatttcgcctctccggcacgaagctccgttacagcaccgcgtatcatccggaatccgatggccaaacagaagtcctgaaccgcacactcgagcagtatttacgatccttcgtgcatgatcgtccgggcacatggttctcttttctctccctagctgaatggagttacaacacatccgcccttaccagtaccggcatatccccttatgagttgacttacggcaagcctccaccttctttaccccctttcactcccgggtcatcacccattgaagttgccgatactctcctgtccactaggcaggcaatgcatgctaagtttcaccagcgtctcctgaaggcacagtccaccatgaagctatatgctgaccgcaaccgccgtaacgtctcctttcaggttggagactgggtttacctgcggctccgcccttatcggcaattatctctccgcccacactactctaagttggccaagcgtttctacggtccttatcaaatcctcgaaaggatcgggcatgttgcttaccgccttcaattgccgacagattctaagcttcaccctgtcttccatgtttctttgttgaaactccatcatggtcctcctccggccgacggtgaccccctaccccctaacaccgtggatcatcatccccttgtggagcctctcttgctcctcgactggaaatggaacacagaccacacccctccctctcgcatggtcttggtccaatggcgcggcctcgaccccgaagacacctcttgggaggactgggactcccttcggaccacatacaacctcgaggacgaggttgactttccaggggagggtattgatagcaatacggcccagagcagacccaagagaacccacaggatacctgcacgataccgtgactctgcgtga

SEQ ID NO: 60346 - DNA, 561 bp, Glycine max
  Peptide Sequence Number=SeqID_177124
atgtaccccgccatataccgtcacaacagcaaagactcattcgatggagcctctgcctctactttcacctcaatctccaccaccgccaccgccaccgcgacaagattcttctacggcagaagaaacatagatgaaggttcaaccactccaatgataattgaatgctatgagttaagcgaggtgagcatcgagtggaggatgaccactgtggaaggacacaatgacatcgttgtcgaagaaaaatggaagcgaaaaggtggaaacaatttgtttggtgagctattggtgctaggtcatcttcgtggttccaaaattcactgctttagaagctttagccttggcttcaactaccaaatggggataataatagcttttggagttgaatatgttgtttcattgcctgatgggaaagctttaaaggtgaaagaggaaagtttgctaccagccaatcttgatcttcttgatggagtgcatggcctcatgcaaccaagtggcaaagacacaagtgcaaacactctttcgtggttcttctacatgctctgcaagaaccctcttatatag

SEQ ID NO: 60347 - DNA, 588 bp, Glycine max
  Peptide Sequence Number=SeqID_177125
atgtatgatcagttagatgaggcttctaggaccaccacacgacagattgcgagtgctggatctatgagcacttccctagtgcaccagttcgtgacagatgatacataccaggagacctccccacgtgcttcctggtggttgacgtcaaaggcgcacatgaacggaatcacaggagcaccttacagggcacgttgtgatgctttgaccatcacatatgtgtcctggttgccatacactgagcatcggggggttagggcctttgagctgatttcatcattccagggtcagctaagatggggtcctatggtggtcacagctcgaccggagagggtggtatctgcggattacatggagtggtttttccgcatatctcacccatttatgataccgacccaggcaggtgaccagcctagagatgcaccagccgcagaccctgaggagtacatacagtcgcccagcccccaggttccagtggcatttgacccgcctcgacatgtagtggatgattacgacggatatgaggtgattgcacagaggttggagcgtatgctcaaccttaggatggtcactgcaggcactgagttataa

SEQ ID NO: 60348 - DNA, 561 bp, Glycine max
  Peptide Sequence Number=SeqID_177126
atggcatcaaagaagagaaaggaacctgccacaccttcccaggttcgatatgatcgatctaggttcacttctcctgaggcctgggaaaggtacattgatattgttgtaccgaggaagcttcttccagaaagaaatatggtaatctaccacactgagtttgatgagttaaaggaagaactggagagaagaaaacgggatgaggaattgagcagttttgatgaaggcagcattgatgttgccattgtgaaagagttttatgctaacctctatgatcccgaggataaatcacctaagcggaatacattcttgaagagccctataatcatcaaggagggggtaacattatcagcttactctagatttacactctcgaggcctgatcctcaagagttggttgttaagctctacatgagtttagccttctccttctggaggggtgaggactccgcagcccaagagcttgtgccagcagaggagcctgtgccagatctagaggatgagccttttcctcctgaaccatttatctttgagattgatccagtcgctcaagaggaagcagca

SEQ ID NO: 60349 - DNA, 2033 bp, Glycine max
  Peptide Sequence Number=SeqID_177127
ctcaaggagtggcccctgaccccgataaaattgcagcaatgcttgcctggccggtgccaacatcaccaaccgcgttatgcgggttcctcggcctcactggattttacaggaaattcatccaaggatacgccttggtcgcctcgcctcttagcaaccttcttcgcaaggaccaatttcaatggtctccagccacgaacagtgcctttcaacttctcaagtcttcgatgaccaaggcacatatcctcaccacctctgatttttcaatcccattcacgattgaaacagatgcctccgcgtctgccattggagttgttctcatacaggattcccaccccatagtgtattacaacaaggtcttatgccccagattgcgtagagcttcggcttatgtcagagaattacacgccattacatctgcggtccggaaatggcatcattatttgttgggttcttctttcacaattcttactgtccataaaagcctcaaggatcttatgtcgcaagtaatccagacctctgagcagcaaacttacttatcaaagcttttgggatatgattatactatcaagtataaacccggcaaggccaatgtcgtcgctgatgccttatctcgcattgctccggcgggaacctgtttatcattatcagtacctcattatgatttcttggataaattgcatgctacactcctgcaggatgcacaatatgttgaccttataagtcaaattcgttcagaccccgcttcttaccctgatcttttgttgcataaggacctcatcctcaggcagggtcgtatctggcttcctttttcgacacccttttcctccatgctcttggaggaatttcactccctccctctcggcggccacaccggaatctcgaagaccctccactgcctgcgtcaaagcttcgactggccattaattcgagcggatgtccgctgttttgtttcacaatgcccaacttaccaacaaactaaatacgaaaataaacgtgttgccggtctacttcaccccttgcctataccttccaatgtgtgggaagacttgtccctcgatttcattaccgggcttcctcagtctcacggattttccaaagcagcccatttcggtgctctgccagctcaccatgcagcttataaggtcgcattgctcttcattgatatggtctgcaaacttcatggatttccacgaagtctagtctctgacagagactccattttcatcagcagcttctggcgcgaattatttcgtttaagcggcactaagcttcgaatgagcaccgcttatcatccgcaaacagatggccagacagaggttctcaatcggatcttagaacaatacttgcgcgcttatgtccatcatcgcccttcagactggttccattttttatctctcgctgaatggtcatataatacaacatggcattccagcttaggcgtgtcacctttcgaaatagtttatggtaaagccccacataccattgcccagtatgtacaaggtacctcccctattgatgtctttgatcacatgctgaaggataggaccgagcttcatgccactctgcaacgtcatttttgcaaagcccaggaagccatgaaagcctcagccgataagctttgccgtgatgtgcattttgaaattggtactggatcacataggcccagtggcttacaagcttcagctgccactttcttcccgcatacatccagctttccatgtatccctcttgaaaccgcatcttgggccatcctcgactacaactgccacattgccatctacagggaacaaccaccaactcttgcatcgaaggatacttcatgggaactatgggacaagctgcgtgttgcctatgaccttgaggacaaggttgttttcaaagaagggggtgttgatagcaacaacaaaataccagacccacagacagagaccaacaacagcattagcaatataccagacccacagacagagaccaacaataacattagcaggccaaagagagatacaaagaagcccaattacttgagtgactac

SEQ ID NO: 60350 - DNA, 237 bp, Glycine max
  Peptide Sequence Number=SeqID_177128
atggctaatccaggtatgcatgattttgagtatggaaacacaataggggtaagaaaactcaccaagaaatgggccccaagtgcgacggcagccgacaagtcacaaaccttgtgcggtggtgcgacaatcttcatgcaacaggcgacaagcttgcaatgcggtggtgcaatgaccaacgatgagcatgaagatgaagagaagggaagagcgtggtggtgtgaaaagcgtgagctgtga

SEQ ID NO: 60351 - DNA, 2034 bp, Glycine max
  Peptide Sequence Number=SeqID_177129
atgaagtcaaagatgaaatgggttggtctgctcggccttgtgctctcggctttctctatcttcattcatttcctccttgctagattcactcaaatgggtgttgcagaatatgagtcctctgttacaatcttctcttggagacccgtctttgagaaaccaattccccccacaaatactccctcttatagaaaattatggggtccggtgaagcgtcttgaatcactatatccggattcaaatccacgaggacattatgctgatcctgtttcagaaacaaatgggtttatttttgtccggatacaaggtggttttcatgagatcaggaattcgatatgtgatgttgttgtggttgctcgacttctcaatgctacattagctatgcctgagatccaatcaacgaccagcagcaagggaataagttctcagttcaagagttttgcatacctatataatgaagagcaatttgtcctctcattagcaaaagatgtcacagttgtgagaactcttcctaaagatctgaaaggtgcaaggagaaagaaggaaattcctgtttttaaagttccatattcagcatcacctttttattattttcaccatgttctccctgtattaaagaagcattcggtggttgaactagttgtttctgaaggtggatgcttgaaggccactcttcctcccaattttgaagaatatcaaaggctgagatgtagagtttcttttcatgctcttcagtttcggcaggaagtccaggaactttctgctaagattttgcagaggcaagaggaatttcattgccacctctctttcaaattgcgagctcctggtcgtccattcattgcatttgaccctggcatgactagagaatctttaacgtatcatggttgtgcagaactattccaggatgtacataccgaacttattcaacacaaacgatcatggatgataaaacgtgggattgtcaaggggaagctttcagtcaactcagctgaagaaagactaaaaggctcctgtcctttaatgcctcaggagattggtattcttcttcgtgcttatggatactcgaaggatgcaattatatatgtatctggaggagaagtctttggtggtcaaagaacattgattcctcttcatgctatgtttgaaaatgtcattgatagaacttctctaagcactccttgggagatgattaggctctatgggaaagaggtgaaccttgttgatactcctggaccgccaccttttgttgaagaagtaaccaagcatgcagcttggaaaagtgcaggtccacgtcctcgaccacttcctccacctccagctaggccgaaatcatacaacatagaaggttggtggggttgggtagctgagagtgataatgagcctgatagtacggttatcgaactgaggaccaatgcccataaattactatgggaggctatcgactacgtgatttgtgttgaagctgatgttttcatccctggatttgaccgagacgggaaggggcatccaaattttgctagcttggtgatggggcacaggctctatctgtcagctgcatcaaagacatttagacctgacagaaaggaagtggctaaacttttagatgagattcgggaccacgggcatcatgcaaatcatacatggctagaatcagttcgcaggcatctgaaaaaaacattacttgatggaattatggaagcatcaaataaatcaaaactactatcctttctctctcatccagtccctgaatgctcttgttcacgtgattcctttgaagtatcaaagaattcttctagccctcttacttcccaattagtgacatctcttggtgttgctcaccggtgtcctgcatggatggacactggtccaatttctcaatcaaaagataaggaaaatgaggaggacgtatatgaggatgattctgtatctgagttattctttaaacaaaatgctgaaaatcatgaaggtgattcagaagtaaacattaaagaagaaaatcaatttgaggatcaagaagatgacagtggggaaagatga

SEQ ID NO: 60352 - DNA, 399 bp, Glycine max
  Peptide Sequence Number=SeqID_177130
atgaatcgctccaaaagggaatcgatcttggcattgagggaggagtggatggaatccatttttgtgtttaaggctgagtggttatgggttaagcggtttacggcctcctctaatctctcgatggtggcttggcaggtgttgtgctctggcatggtgggcagaattacaatttggaaagtgataactaagcacgtgatggaattgcgcaaaatagaatcaaggctgagtagtggaagtgtgaatcaagttgatcagattcaatctactttgagagagtctgagacagtcttgttactttggttccaaaagttggggtctaagtggcatgtgcttggtgatccagactcaagctattttcatggtgatcagattcaatctacttcaggacgagaatggtga

SEQ ID NO: 60353 - DNA, 5847 bp, Glycine max
  Peptide Sequence Number=SeqID_177131
atggccgaagttgcagctgcacgtcctcgtaactggcaaaagtactgtttaaggcatggagatattttgtctttcctgatgaatggaatattttatttcggtgaagagtctgttattcagacccttaaactcctcaattttgccttctatacaggaaaagatgttggtcacactccacaaaaaatggagtcaggagacataagttcaaacaaatcaggtactgtatctcaagaatcaaaaaagaaaaagaaaggtgaagatggagctgaatctggttcagaaaagtcctatttggatatggaggcagcagtagatgtcttcactgacaagagtagcaatattttgaaacagttcattgattgtttccttctggagtggaattcaattaccatgcgtgcagaggctaagttagttttatatggtgtctggcatcatgctaaaccaacatttaaggaaaccattctaaaggaactcttgcagaaagttaagttcctcccaatgtatggtcagaatattgtggagtatacagaacttgttacttggttgcttggaagatcctctgatactagttcaaaacacaagatttctgaacttgtggaccaatgcttgacacctgatgtaattagatgcatctatgagacactccattcacagaatgagctgttagctaaccatccaaattctcgcatatataatactttgagtggcttagtggaatttgatggatactatcttgagagtgaaccttgtgttgcctgcagcactcctgaagtaccttacagcaggatgaagctagattctctgaaatctgaaacaaaattcactgacaaccggatcatagtgaaatgcactgggagttacacgatccagactgtgacaatgaatgttcatgatgccagaaagtcaaaatcagtgaaggttttgaacctatactataataacaggccagtcactgacttatctgagttgaaaaataactggtctttatggaagcgtgcaaagagttgtcatcttgcattcaatcagacagaacttaaagttgaatttcccattccaattactgcttgtaacttcatgattgaactggattcattctatgaaaatcttcaggcattgtctcttgaaccattgcaatgtccacgttgtagtcgtccagtcacagataaacatggtatatgtagcaattgtcatgaaaatgcttatcaatgtaggcaatgtcgcaacatcaattatgagaatttggattcttttctatgcaatgagtgtgggtacagtaaatatgggcggtttgagtttaacttcatggcaaagccaagttttacatttgataatatggagaatgatgaagatatgaagaagggactggcagccatagaatctgagtcagagaatgctcataggagataccaacaacttttgggcttcaagaagcccttgctaaaaattgtatcaagcattggtgacagtgaaatagactcacaacagaatccttctgtacagcaaatgatggtttctttacctggtccgtcatgtaagatcaacaggaagattgctcttcttggagttctatatggtgaaaagtgcaaagcagcttttgattctgtcagcaaaagtgtccagacactgcaagggctacgtaaggtattgatgaattatctgcaccagaagctttccgataccagtgtgggttcaagatttgtggtttccagatcaccaaataattgctatggctgtgcaactacatttgtaacacaatgtctggaactattacatgtgctagcaaggcatccaaattctaagaaacaacttgtttcagctggcattttgtctgagttatttgagaataacattcatcaaggtgctaaagctgcccgcgtccaagcaaggatcgtactttgttctttatctgaaggtgatgtaaatgcagttaatgagttgaacagtctgatacaaaagaaagttttgtactgccttgagcatcatcgctccatggacattgcagtgactactcgtgaggaattgttgttactttctgaggtgtgttctttggctgatgaattctgggaatcaagattacgtgttgtgtttcaattattgttttcttccatcaagctaggtgccaagcatcctgccatatctgagcatgtcattcttccttgtctgaggattatatctcaagcatgtacccctccaaaacctgaaacactggacaaagaacaaagccttgggaaatcttctgcaaatacaaaggatgagagtaatcaaaatgtatctgggtccttgactggtgctgtcactgtcagtgggacaaaaacattcccagactcatcagaaagaaattgggatgctacatccaagactcgagatattcaattattgagctattcagaatgggagaggggagcttcctatcttgattttgttagaaggcaatataaagtgtctcaggcagtcaaaggtactggccagaggtcacgaccccaaaggcatgattacctggcacttaaatatgctctgaggtggaagcgtcgtgctggtaaagcagctaaaagtgacttatcagtgtttgagttgggatcatgggttaaagaacttgttttgagtgcttgttctcaatccattagatcagagatgtgcacactcataagcatgctttgtgctcaaagttcatccagacaatttcggttgctgaacctagtggtttcattgttacctgccacactttctgcgggtgaaagtgctgcagagtattttgagttgctattcaagatggtagattcagaggaggctcttttatttttgactgttcaggggtgtctacggaccatttgtactctaattacccaagaagtgagcaatgttgagtcgttggagcggagtctacacattgatataacccaggggtttatccttcacaagctcatagagcttcttggtaaatttttggaggttccaaatatcagatcgagattcatgcgagatgacttactttctgaaattcttgaggcccttatcgtaattcgtggcttgatagttcaaaagaccaagggatcaatgactaagaatccatattcgagcgttgaaattggcccattaatgcgtgatgttaagaacaagatctgccatcagttggatttgttaggtcttcttgaggatgactatggaatggaattgttagttgctggcaatattatctctcttgatttgagcattgcacaagtttatgaacaagtctggaaaaaatcaaatcaatcatcaaatgtgactaattccaacttgttgtctccaaatgctgtcaactcatccagagattgcccaccaatgaccgtgacttatcggctccagggattggatggtgaagcaactgaacctatgattaaagagttggaggaagatagggaggagtctcaggatccagaggttgagtttgccatagcaggtgctgttcgtgagtgtggtggactggagatactattggggatgattcagcgtctccgagatgatttcaagtccaatcaggagcaactggttacagttcttaatcttcttatgtactgttgcaaaatcagagagaacagacgtgctttgttaaagctaggagctttaggtttgcttcttgaggctgcaaggcgagctttctcagttgatgccatggagccagctgaaggcatacttttgattgttgaaagtctgactttagaggcgaatgaaagtgacaatataagcatcacacaaagtgcccttactgtcactagtgaagaagctggcacaggtgaacaagccaagaagatagttcttatgttcttggagagattgtctcatccattgggccttaagaaatcaaacaaacagcagaggaacacagagatggttgctcgaatattgccttacctaacctatggtgaacctgctgcaatggatgctcttgtccagcattttagtccttacttgcaagattggggtgcatttgaccatttgcagaaacaacatttggataatccaaaggatgatcatattgctcagcaagctgcaaagcagagattcacactggaaaattttgttagggtttcagagtcgcttaagacaagttcttgtggagagagattaaaggacattatcctagagaagggtataactaaaactgcaatgacacatttgaaagatagttttgcctatacagggcaggctgggtttaagaacagtgctgaatgggcacagggtttaacactgccatctgtccctcttatattgtctatgctgagaggtttgtcaatggggcatctgctcactaaaaagtgtgttgatgaagaaggtatcttacctttgttgcatgccttggaaggagttgcaggagtaaatgaaattggggcaagggctgaatatttgttggacacactatctaacaaggagggaaaaggagatggattcttggaggagaaggtctgtaagctgcggcatgcaactaaggatgaaatgaggcgtcgagctttgcagaagagagaggaattgcttcagtctgatttcctgttcccttctgaattgtccttaatatctgataccaggggcttggaatgcaccgagaactgttttcagatggaggcgaacgcattgttgtgtcccggccggtcccaggaaggatacagtttaagacctgctgatttattgggtgcttactcttatagtaagcgtgtgaatctaggtgttggttcttcaggaagtgctcgtggaggagagtgtgtttataccactgtaagttacttcaatattattcatttccagtgccatcaagaggccaagagagctgatgctgctttgaagaatccgaagaaagagtgggatggagcaacacttagaaacaatgaatctctctgtaattctttattccctgtcagaggtccatcggttcctctggcacagtatgttcgctatgttgaccagtattgggacaaccttaatggtcttggacgtgctgatggaagtagactccgcctgctgacttatgacattgttctgatgttagctcggtttgcaacaggagcatcattcagtgcagatagccgaggtggaggacgggaaagtaattcccgattcctcccatttatgatccaaatggcacgccatctcctagatcaaggaaacccctcccagcgtcgaaccatggcaagggccgtatcagcatacatatcctcttcttcatcagatctcagaccctcttctccatctggcacccaacctaccccggggacagaagaaattgtccaatttatgatggtaaactcatttctctcagagtcttacgagtcctggctgcagcatcgtcgtgcttttctgcagcgcggaatttaccatgcctacatgcagcacacacattctcggtctgctatccgtgcaccatcggttacagctcctgcacacggtgtggaatctggaagcatgggccaaagtgctacaacagaaacagggcagagtgatgatcttttgtctattatccgtccaatgcttgtttatacaggcttgattgaacagttacagcatttcttcaaggtcaagaaatcaactggtgcaacaccacctacaaggactgatggggcatcatctaccacagaaggtgaagatgaaagtggaaacctggaaggctgggaagtggtgatgaaagagcgactattgaatgtaaaagagctgctcggattccccaaggagatgctgtcgtggcttgatgagattaattcggccactgacttgcaggaagcctttgacatagttggtgttctagctgaggtgctctccggggggttcacccaatgtgaagattttgtgcagggtgctattaatgcagggaaaagctga

SEQ ID NO: 60354 - DNA, 1500 bp, Glycine max
  Peptide Sequence Number=SeqID_177132
atggtgttgaaatggggaaaggactactgctgtgacactaaggggataaagatggagctcaaagttgagaagcatgagactttgattataaggcctagaatcaagatgtggatggctagggccattacaattgtgctgctttggactagtcttgttcagctgattgcactgggagaattgttgggaccaagtttgttaaggggcatgccttattgtttcagttctccatctgtagataagtttttggctccagccaaggcagtgctcccacccaaaaggatttataggaataatggttatcttctggtttcttgcaatggtggactcaaccaaatgcgatcagcaatatgtgatatggttgctattgccagacacttaaatgtcactctcatagttccagagctggataaagcctctttctgggctgattcaagtgacttcaaagatatatttgatgtagatcatttcattacctccttgagagacgaggttcgaataataaagatactgccacctaagatcaagaaaagagttgaactaggattattatactcaatgccacccattagctggtctaatatctcatactatgaaaatcaggtccttcctctgttgctgaaacacaaggtcatacacctaaatagaacagatgctagacttgcaaataatggactacctgctgagattcagaagctacgatgccgagtaaacttcaatgctctgaggtttactactcagatagaagaacttggcagaaggatagtcaaggttttgagggaaaagggacctttccttgcacttcatcttagatatgagatggacatgttggcgttctctggctgtactcatgattgtgacagcaaagaggaggaggaactcacaagaatgagatatgcatatcctggctggaaggaaaaagttattaattctgagcttaagaggaaagaaggcttgtgccctttaacacctgaggaaactgccctagtattgtcagcacttggaatagatcacaatgttcaaatttatattgcttctggagaaatatatggtggagagaaaagaatggcaagtttactaggagagtttcctaatctggtgaggaaagaaactctgttggaaccttcagagttgatgtatttccaaaaccactcttcgcaaatggctgcagtggattatcttgtctccctagagagtgatatatttattccaacatatgacgggaacatggctaaagttgtggaaggccatcgcagatttctaggattcaagaaaactatactactggatagaaggcttctggtaaacctgatagaccaatactataacgggttgttaagttgggatgagtttttcactgctgtgaaggaagctcatgcctatcgtatgggaagtcccaagagaagaattatcattccagacaaacccaaagaagaagactatttttatgccaaccctcaggagtgtttgcaattgttagatgaaccattagaaagcacataa

SEQ ID NO: 60355 - DNA, 207 bp, Glycine max
  Peptide Sequence Number=SeqID_177133
atggagttcatccgctttggtgtcgtcagacccaccgccatcggtgccatagtcggtcttctggaacttcctctcattgaaaatctcggtcttcttgcacttcctcaaatcttcgaggacaccgaatcactctcttctttcacctctattttcaaactccgaaacattaaaacccccaaatggccaaaccctcaacacaattggtag

SEQ ID NO: 60356 - DNA, 789 bp, Glycine max
  Peptide Sequence Number=SeqID_177134
atggctgattcactatcggttaattttgattcttcaatcaagtctgaattctccaccgaacaagcacacaaaactacccatgaggctaaacactctccatctaacatccaaaaggctattgctgaggttgttggtacatacattcttatatttgcaggatgtggagctgctcttgtaaatgagaagttgccccttacaatagtaggcatagcaatggtttcgggtctaggtctaacggtggctacatattctgttggccatgtctctggtggccatttcaatcctgcagtcacaattgctttggctgctgtcagaaaagttcaatttaaacttatgatgggtgctacactggcccctctcaccctcaaagtgttgtatcatgacaaggcagatattggagtaacagtgactaaatacttgagctcaacttctgatctagaagcaatagtgtgggaattcatcaccacatccatactaatgctcaccattcgcggtgttgccactgatcacagagggagcaaagatctcactggagttgcaataggcatttcagttctgattaacgtcatcattgccgggcctattactggagcttcaatgaatccagcaaggagtttaggtccagctattgtatctggtgattacaaaaacatttgggtttatatcataagcccaattcttggtgcagtctcagcaagtacactttacaaattcctagaagtaaacaaaccagttaaacccgaaccatgccattgtaacatatgcaatcataatcatttacctttctaa

SEQ ID NO: 60357 - DNA, 1812 bp, Glycine max
  Peptide Sequence Number=SeqID_177135
atggttggttttcgagttcatgtgggaaatacatcagcgagtcacataccgtctagcatttctattttccaaagggttgttaaattcgatgaaggaatgaggtcctggtatgatattccatttactgttgcagaatctcttcttgcagatgaagaatttacaatctcagttgggccaacctttaatggctcaacactccccagaatagactcgcttgaagtttatggccgagctaaagatgaatttggttggaaagagaaaatggatgcagttttagatatggaagcaagagtacttggttcaaattcatcacttagtgggtctgcaaagaagcgccgatcgatgcagtctgctcctattcaggagcaagtaatagcagatggactcaggctaattactaagttctactcatcatgtaaacaacaggattgctcaaggtttgaggaagccaggacagagcttggaaaactcaaatgcaagccattactagaaataatattcgagtgtgatagggaaccaattctgcaggcttctgctagtcgtgtcttacaagcggtttttcctaagaaagagatataccatcaagttaaggatactatgaggcttcgtggagtagtaaaatcctccttactactatcatcaaggcttgggataggtggtgctgcaggaagttggatcattgaagagttcaccacccagatgcgtgcagtctgctcagaagtggtggatgtacttgtgcaagttttatggggaattttggattttgagcagcctgacacacaaaccatgaacaacattgttatgtctgcagttgaacttatttattgctatgctgaatgcttagccctacacggaaaagatgcaggagtgcattctgtggcacctgctgttgtgttacttaagaagcttctcttttcgtccaatgaggctgttcaaactgctagcagtttggccatatcttcaagattgcttcaggtcccttttccaaagcaaaccatgttggctacagatgatgctgttgacagtgtggtgtcagtttctggccctgctgacccaagtactggaaataaccaaatcatgattgaggatgacacaattacttcatctgttcagtattgttgtgatggttgctctacagtacctatactaaggcgaagatggcattgtactgtttgtcctgattttgacttgtgtgaggcttgctatgaagtactagatgcagatcgacttcctccaccacactctagagatcatcctatgacagcaattccgatagaagtggactcagtgggagatggaaatgaatttcacttcacagctgatgatgttagtgaccagaacttgttgcctgtacctgttgatagcaacatgcagaattcttctccatcaattcatgtcttggaaccaaatgattctggggattttgctgcttctttaactgatcctgtctcaatctctgcttcaaaaagggccataaattctttacttctttctgagcttcttgaacacttgaaaggatggatggatatgacctctggagttcaggcaatccctgttatgcagcttttctacaggttgtcatctgctgtaggtggaccttttataggcagctccaagccagatagcttagatttggagaagctaatcaagtggtttttgcatgagaaaaatctcaacagatcattagtagccaaaacccgttcatcatttggtgaagttgcaatcctggtcttcatgtttttcacattgatgcttagaaactggcatcaccccccaccgcgatggtcccatgccaagacagagtggaactaa

SEQ ID NO: 60358 - DNA, 1000 bp, Glycine max
  Peptide Sequence Number=SeqID_177136
cagacgagactctcgccattctaaggataagaaaatcagtttgggtgaagacaaggtgatttctcatggcattgatctcttgcaattaaagaaagcatacaaaagtggatcatttgatctcaagataaaggttgattattcaaattccaaagagcttaaatcacatttagcaagtggttctcttgtgaagtccttactcagtgtgagtggacgaggtcgacttgccgctggtgaaggtgataaagttgctatatatgatgttgggcagttgattggtcaagccaccattgcacctgtgacagctgacaagaccaatgtgaaacctctttctaaaaatattgtccgctttgaaattgtacaacttgcattcaaccctgttgttgagaactatcttcttgtagcaggatacgaggattgccaggtcctgacattgaatcctcgtggtgaagttattgaccgccttgccattgaactagctttgcaaggtgcatatattagacgggtggattgggttccaagctcacaagttcagttaatggttgtgactaacagatttgttaagatatacgacctgtccttggacaacttcagtccaatgcactacttcactttgtctgatgatatgattgtggatgcagttctttgtccggcttcccaaggaagaatgtttctcctcgttctttcagaaaatggaaacatactcaggttagagttgtcagttaagggtaatgctggggctgtaccactgaaagaacttgtacaacttcagggaaaagagattcatgcaaagggatcatcattatacttctcttcaacttataagctactctttgtatcttttcaagatggcaccacagtggtgggtcgcccaagccctgatgcagcctctctagttgagatgtcttctgtatatgaggaacaagaaatgtatgcgacattcagtgggttcaacctcacctatagttggtatgactgcatacaaaccactatcaaaggataa

SEQ ID NO: 60359 - DNA, 1275 bp, Glycine max
  Peptide Sequence Number=SeqID_177137
atggccactgcagttgaggatctaattgttgaacgatatgttttctccctttgttgggatattccttatgtaggctctgaagctgaccatacaattaaatcctgggatcaagaccaccctgtggatccatctaatatgttgcattttttccacttcagtcatttactccatggccatccagagggcatgggaaagttcactatttctccggatgttatattgagcctgcttcagcatttaaatgctgctttgcccataccagaaggcattgagcaattaggttggtatttcctcagaagtggaatgtggctgtctctggtgatctccttcattaacgttggcatatggagatattatatggataatggtatttctggacatggtctaacctggactgggaatgctatgggggatgagaaatacgttaaagttgctggaagcatgatttcctccatgattgagtctggccaatttccattgcttgtaaaactgttctcatcattgctgaacaaatatttacaagtttgtcagaacgctttccttgatatccttaatgacaagcaaaagctgactcctggattttcaccattcttgcttctgaaacatactgaaatggaccaaagcctacaggatgagctcctggagaggagtggttcgaatgcaggtgagctgcagtttgttcttagcctcatttcgaggttggatgctgttgttgataaaaaagcttctggaattctttctagagcttcgtgggagtgcctattgcatggctttccttttaatctctctactcctagttctactatgttttcttgtgtccttagcataagaggaattgtctttgtcttagatgggttacttagaataaaagaagcaggcagtattattaacttggaggatgaaatccttggacaagttcttgatgcagtaatgatcatcaagtatgataggacctttgaaagtgttcatgggaaatgtgacactatctatcacagcttgagtgctgaactggatttgtcgtgttatgaagatttaattctaatgaagcaaatggaagggtttctgatggatgttaatgctggaggagcaagtgattgcagtgttcatgaatggataatctgtaaaattattgaaatattaaacagcctaagaaaagacccttcaaagtctgttatatttcatttttatcttggggttgaaaatgtgcctgagaagatgaataggcttttgcatttgcatcttggtgactgtttggttctagggaagatgctttag

SEQ ID NO: 60360 - DNA, 1798 bp, Glycine max
  Peptide Sequence Number=SeqID_177138
atggccgccgatagcctcgccgtcctcgccgaggctctgtcgccgccggtctcgcccggcgactttctatccaagctccgctccgacgacgccgtcctgttaggtctcaacgcgttctgctccgttctccgccgcggtctccaatcctctgatgacggaacctcgctcttcctatcctggaccgacgcgcagattcatgcgatttcctcgcttgcccacgcaatcgcctccgcttctcgatctttgtcagtggagcaagcggagggggtgctggttgcgattgtgcaacagtctatagaatttgctctgtgctatttggagaattctggagtcactagtgacgatctaggaattcagaacaacatgatacatcttttagagatggctttggttgatggaataaatatggtagcggacatattgcaacctacaactgctagtgccttgatagatatgttgccaatggttgatgattgttgtggtagttttgtggatgactacaaaaaatgccatctagaaggtttcaaatgctcaaaggaagaaaaatcaatggattggcttttaaagactttggcttctgaacatgtgcctcatgataggcaagaatctggattcattgaacagacttattatcaatatttcaataattttgtctttctatcccagcactgggcagttgtccatggaaaatgcactcctcgcttgatcttgctatgcaataagctagctaaagtaaaagatgtatttgatgagagggccgtgagtcaaaattttcgaaggagactgtcattcattttgaggatgttaaagatacttggaagtctcttgaaggatgttccatatgttgactatgatgcctctttgatgggggcagttgccacattttctaatactctgtctagtttgtttagaattaaatttgagtttgtgaatacctgtgctactactgagggaagttttgagagcattattttaatggttatagaagaatttcttcatagtgttcaggttatttttggcaatagcaatgttgcccagaatatccaaacatgtattatagcagctatattggagagtttggattcttctgtttggacatatgacaaatctgctcccaatttgaagccccccttagcttacttcccccgatttgttgtgtatacactgaaactcattactgatctgaaaagacaaagacatctagttccttttgagtggaaagactttgacgtggaacttgttggcagttctactgactcacagatcggttctccttcatgccttgttcatctggagcctgttcctttgcttaagggatttacttttgaagagcttctaaaattaatatttcctgtgtcgagccaatggattgccaatttgatgcaacttgctttgttccttcattgtgaaggtctgaaattaaagccaaaattggaaaggtcccattctagtttggctaaagttgctgggacgtctgaagttgaaaatgcagtgtgccatgaggatgaggctctttttggagatcttttttctgaaactgggcgttccgttggatctacagatggatgcgaacaaccacctgttgctgctttaatttctagttccagctatcaaaatatgccaacacaagctgctatagaacttttgaactttcttaaaacgtgcatcttctatactgaatggcatccttctctttatgttgatgcctgcaacaaactcagtagtagagacattgatattttgctttccctactcaattgtcagggttgttgttctgaagataatatgtctgatagtt

SEQ ID NO: 60361 - DNA, 1187 bp, Glycine max
  Peptide Sequence Number=SeqID_177139
tggcactcgctgtcaccgcacgataatccgcaggatgtcagccattttgagcagcaggcgctggcggcggagaatattgccctgagtgccgtgccgccgcgctatcgctccagctacttccgtcatatctggggtggcggctacgcggccgggtattacgcctatatctggacgcagatgctggccgacgatggttatcaggcgtttgtcgagcggggcggtctgacgcgcgaaaatggtcagcgcttccgtgagcagattctgtcgcgcggtaacagcagcgatctgcagcatctgtggctggcctggcgcgggccacccagcggtgcagctggctggcctgcacgcttatcccagcggaccgccttcaatggtgtcgcacatgccggccagcacgcgctcgccggtttcctctttcagtccggcataccattccgcggtgaccgccgcatctttggcgtgggtgacatcacaacgcttgcgcgctttcagcaccaaatcacgggtgcgcgccacgcgccgcgcctcatagcgcagcaggccgtcctcaatgcccagcgagtgggcggtcagggtttgcgccagtaccaccgcatcttccatggccgcacagccgccctgaccgatatccggcgtggtgctgtgtgccgcatcccccagcagcgccacacgccctctgacaaagcgactgaagggttcgatatcatgaatctccacgcgattggtggtttgtgcgtcaatgctggcgatcagccgctggaccggttcggcccagccggcaaaatagccgcgcagatcgtcttttaccgttgcgcgatcctgcgccagccctttcggcagcgggacatcaaagaaaaagtagaagcggttaccgctcaccggcatcagcgagacgcgcttgccctcgccgacaaacgtggtccactgatcggcgggcgcgatgctttcatcgatagtgaccaggccattccagttgacgtagcctgcgtagcggcgctcgacgtgttcgcccagcacgtgatggcgaatcaccgagtgggtgccgtcggcggccaccataaaatccccttcagcctggctgccgtcatcaaaccaggcggtcacgccgctggcatgctgctccactcgcacaacgcgtttgccaaagcgaatgcgttcgcggccgtagctgtcgatcagcagcgcct

SEQ ID NO: 60362 - DNA, 369 bp, Glycine max
  Peptide Sequence Number=SeqID_177140
atgtacccttccttgttctctttgaacaacctagtgggtgtaccctccactagaactgatccacaagagatgtaccctctcttgttctcagtcacaacaacccaagtagatgtatcctctacttgtaccacaaaggatgtaccatccaatgtgttaagacaaagttctcaagcggttagtcctttgaaattttgtgaatggggaaacaaaagaattctcaggcgggagaagggagacacaaaagaattcaagcggttagtccttcgttcttttggaaaagagataagagagacacaaaaagaatttaggtggttagtccttggcgaattctttttggcaaagggagaagggaatgaaaaagatgaatag

SEQ ID NO: 60363 - DNA, 837 bp, Glycine max
  Peptide Sequence Number=SeqID_177141
ttatttgctggaaatgatgctgatgaattcggttcaattttgaatcaacaacaaactcccaagatattaatcaccacttgccgcttccattctacttcctatgaagcacggacaccgcagtcccttgccgtgtccggtgtccgacacgcgtccatgtcagtgtccgacaccgacatgacacccaggggacctgcctttatatcggagttgctttcagttataccaaatgcacattacttcaagagaggaacatatgatctgaaaaagattgtagaatatgcaaagaagaaggacttcacctctgttatagttgttcacaccaatcgtagggaaccagatgctcttttaattattggtgtacccgatgggccgactgctcatttcaagctctcaaagcttgttttgcgcaaggatatcaagaatcatggaaatccaaccggtcacaagcctgagcttgtattgaataacttcacaacacgtctagggcatcgagttggaaggttgatacagtcactttttccacaagatccagaatttaaaggccggcgagtagtcactttccacaaccagagagacttcatattcttccggcatcatcggtacatttttgaaaccaaagaagttaaaaaaacagagtctaaaggtaaaaaggacaaagaaggcaagagtgagaatgttcccgaacagaaaacaattgcccgacttcaggaatgtggccctcgtttcacattaaagttgattagcctgcagcatggaacatttgacactaagggtggggaatatgagtgggttcacaagccggaaatggacacaagccgaaggaggttcttcctatga

SEQ ID NO: 60364 - DNA, 1284 bp, Glycine max
  Peptide Sequence Number=SeqID_177142
atgggaagtgtagcagaggtgactttgagatggaacatgtctgacaaattggggaatctgaagcacccacatcagacaatgatgcaattgttttacttaacggcttggtcagtgtttctgctattttaccggaatgagttcaatagaacaagcaattggagttacgttaagcgcggtggatttagtccaagagcggataaggagaatgaagaagcacactcagactctccctctggagttgatcagagaagttcttctgagattgccggtgagatccgttctgcgtttcaggcagagcttgagaaagactcaagtgcagtgcatttgattctccccccttcatcacccccacgccatcgcttcgaatatgactattatgctgactctcacgataagcctgatattttgggatcatgcagaggcctcatacttttatactacccgagaaacagtgatcacattatatggaatccgtcattaggtgtccaaaaacgattaccatacttagcatatgatgtaaccttttgtcctctatatggctttgggtatgacccttcaactgatgactacttgctaatcgtgattggattgcacgactctgaacattataagtatgacactgatgggtctgaagatgatgagtgcaaaggaaaatgccagattttctcctttaaaaccgattcatggtacattgtggatattttcgttccctataaggatctcggcggtaaattcagagctgggtcgctctttggtgacatacttcattggttggttttctccaaggataaaaaggttcctgtcattcttgcctttgatctggtgcaaaggagtttttctgagattcctctgtttgataatttcgctatggagaaatatgaagttgatagcttgagaagggtaatgggaggatgtctcagtgtgtcttgctcggtccatgacggtgcaacggatgaaatatgggtgatgaaagaatataaagtgcagtcatcttggacccggtccgttgttatccctagtagtggcttttcccccatatgcatcaacaaagatggtggaattcttggatcaaatatttgtggaagactagagaaacttaatgacaaaggagaactgcttgagcatctcatttatggtggagaacaatgtttgtgctctgccagactacagtctgctgtgtatagagaaagtctattgtcgctccacagtgtcattggggtaacaaggattggggtaacaaggaaagacgaccatgaggaaacaactgaacatgaccaacagtaa

SEQ ID NO: 60365 - DNA, 1977 bp, Glycine max
  Peptide Sequence Number=SeqID_177143
atgtgggtgcttcagattccccaatttgtcagacatgttccatctcaaagtcacctctgctacacttcccatgtctcctcaagagtgccggtctcttttgtttcattgaacccttcagccaatctcatcaatgacataaacagcaacaacaaccagttgatacaatcattatgcaaaggagggaaccttaagcaggctcttcatctcctgtgttgcgagcccaatccaactcagcagacttttgagcatttaatttattcttgtgcacagaagaactcactttcctatggccttgacgttcatcgctgtcttgttgatagtggttttgaccaagacccttttttagctactaaactaatcaatatgtactatgagcttgggtctattgaccgtgctctcaaggtatttgatgaaactcgggaaagaaccatatatgtctggaatgcactcttccgagcactggcaatggtgggtcatggtaaggagctgctagatttgtatattcagatgaattggattgggaccccatcggataggttcacatatacatatgtgcttaaggcttgtgttgtttcagagctgtcagtctgccctctccggaagggtaaggagattcatgcccatattctgcgacatggctatgaagcaaatattcatgttatgacaactttgttggatgtatacgctaagtttggcagtgtgtcgtatgcaaattccgtgttttgtgcaatgcctaccaagaactttgtctcatggagtgctatgattgcatgctttgcaaagaatgaaatgcctatgaaagcactggaactgtttcagttaatgatgtttgaggcatgcaattcagttccaaattcagttacaatggttaacatgcttcaagcctgtgcaggtcttgctgcattggagcaagggaagttgattcatggctatatccttagaaggcaacttgattctatactgccagttcttaacgcccttataacaatgtatggaagatgtggcgaggttttgatgggacaaagagtctttgataacatgaagaaacgtgacgttgtttcatggaattctttgatttctatttacggtatgcatggttttggaaagaaagcaatccaaattttcgaaaatatgatccaccaaggtgtttcaccgagttatatatcgttcattactgttctgggtgcttgcagtcatgcaggccttgttgaggagggaaagattttgtttgaatccatgcttagtaagtacaggatccatccaggtatggagcattatgcttgtatggtggatcttcttggccgagctaacaggttaggtgaagcaatcaaactaatagaagatatgcattttgaacctggacctacggtttggggttcccttcttggatcttgtaggattcactgtaatgttgaacttgcagagagagcaagcactgtgctttttgagttggagccaaggaatgctggtaattatgtgcttttagcagatatttatgcagaagctaagttgtggagtgaagcaaagagtgtgatgaagctattggaagctcgtggcctgcaaaagcttccaggttgcagctggattgaagtgaaaaggaaggtatactcatttgtctctgttgatgagcataacccacaaattgaagaaattcatgctttgctagttaaattgtcaaatgagatgaaggcacagggttatgtcccacagacaaacgttgttctctacgatcttgacgaagaagagaaagaaagaattgtattgggacatagcgaaaagcttgcagttgcttttggactcattaatactgcaaaaggtgaaaccataaggatcagaaaaaacttgagattatgtgaagactgtcatgccgttacaaaatttatttctaaatttgctaatagagagattcttgttagagatgtgaatcgcttccatcattttagagatggagtttgttcctgtggtgactattggtag

SEQ ID NO: 60366 - DNA, 591 bp, Glycine max
  Peptide Sequence Number=SeqID_177144
atgcagtgtcatttaactaattttgttcctcattgtaacagcaatcaagttacttgcttagcatatggcacaagtgagaatttgttaataactgggtcagaggatggaatggttcgtgtttggaatgcgagaactcgtaacattgttcgcatgtttaaacatgctaaaggacctgtaaataatattctggttgttagacgagaaaatgactccagtaatcacatatcttctaatgtacaagcatcatcaagaaagcaggggtctaatttaccccctccattggaaaaatatgcaaattcaattgatgacgacttagatatgaagactatgatcagccttgggggtggtaggagatccgtggatccttcatacctcagctctcatgtgatatctaattacattaaggaacttcagcatcaaggttcagctgctgcttctgaaatggagatggagaaactaaaacatgattaccaaaagtcagtgcaaatggctaaccagttgaagaaaatgaatgaaaacttgcatcaattctgtgtaaaggagctgttggatggtggtcaagctagaaccttagatgaagatcagaattaa

SEQ ID NO: 60367 - DNA, 336 bp, Glycine max
  Peptide Sequence Number=SeqID_177145
atgaacttccaccggaaactagataagtccgtcctcgctgaggaacctctcacgatggtccgtgccaccatcagcactgatgacacatgtgttcttgcaacaccgacaactcaaacaagaatgatccaccacaaaagaagaaggagaagaaacacagtcgaagtaggtggcgatgggattgaaggaccacaagggcacccattgatttttggaagcttaaacctcttgctcctttgctacgttggtttgcaccggccaccacccatagtacaatctgtatatgctaagaccttaagcttggaaataggaacgaggttaagtgaagaaatgaattaa

SEQ ID NO: 60368 - DNA, 396 bp, Glycine max
  Peptide Sequence Number=SeqID_177146
atggggggaaagaggaggaagagcgatgatgatgatgacgtggaagctgaggcttcagcttcaggttggaagaagaaaacgagaacgacggagaaggaggagaaggagaagaaggagccattgcgtccttcgatgataaagaacaaggagaagcgatcggagctgcacgccaagctgaagcagcagaagaagctcgacaagcgcgccaaggccaaggctcgagacgctgctctcaagagagctctcgacctcggcgaggagcctccggagaagaaggttcctcgcaccatcgagaacacgagggaactcgacgagaccgtttgcaagcccgacgatgatgaggttttgatagtagttttgtatcagcaggagtggggattgtggggccaaaaatag

SEQ ID NO: 60369 - DNA, 1031 bp, Glycine max
  Peptide Sequence Number=SeqID_177147
gagataatatatttgggtatgattcctcggattcagctacatcattggatgctgcatttgctcctgcaattgcatcaaacattccttgggtggctgttttggggaaccatgaccaggaaggaaccctctctagggcaggggtgatgaaccatattgttgggatgaaaaacaccttatctaaattcaatcctccagaagttcatataattgatggttttgggaactataacttggatgttggaggagtacaaggcactgattttgaaaataaatcagtgctcaacctgtactttctcgatagtggagattattcccaagtttctactatttttggttatgattggatcaagccctcccaacagctttggttccaacgaacatctgcaaagcttaagaaagcatacataagtaaaccagtgcctcagaaagatgctgctcctggtcttgcatatttccacatccctctgccagaatatgctagttttgactcatcaaacatgactggtgtgaaacaggaaccggatggcaatggcattagctctccttctgtgaactccggcttcttcacaaccttacttgcagcaggagatgtgaaggcagttttcactggccatgatcacatcaatgacttctgcggcaatctaatgaatatacaactttgttatggtgggggatttggataccatgcgtatggaaaggcagggtggcctaggagagcaagggtggtggtagctagcttggagaaaacggggaaaggaagttggggagatgtcaagtcaattaaaacatggaaacgccttgatgatcaacatcttactggaattgatggtgaggtcctgtggagcaagagcactggtgctcaagagacaagggggttagtagatatggaagaatatcgtgctgtccacagaaagattttcaaggagcttaggaaaacagtattagaagtacaatctgagtttaaaagcatattactgtggcaaagtaaactatatacttggaagaagatgaatgtaaagaagagatgctaa

SEQ ID NO: 60370 - DNA, 819 bp, Glycine max
  Peptide Sequence Number=SeqID_177148
atggtagcaacaggaaattctttggcacttaatcgagatatcaggaggaacagactgtccagcccgataccgtcaagaatttcttacgattgcatgggaacagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatcgattattacgagctatacttggcattcag

SEQ ID NO: 60371 - DNA, 297 bp, Glycine max
  Peptide Sequence Number=SeqID_177149
atggccagagggtcagtatttgttggaaaggagaacaatgggtgccacttcataacagagtgcaagaatgtgaccgagaaagcaaaaattaaattaaatgataggaagcaagagaaagagggatacagcaaagtgtgcgagattaacgatggtccaagcgatgccaggagaacaaccgaagacagagagtacgaggatccaagaaaagaaaaggatgaggatgtaactggtccaaacgccagggtacgtgaaccaatccgtgttcctgttcagatccgccggtggcaccgccttcac

SEQ ID NO: 60372 - DNA, 348 bp, Glycine max
  Peptide Sequence Number=SeqID_177150
atggagtttatcacaactgatccagatcaagtggaggtttttaagtgtttagcttcctggagagcttttgagtgggcaaaaacagttattttccaagaattaatcatttccaaaagtgccctaaaagggtacatccatcttgtttttcaactgagaagttcaaaagcaggagggccaacatctactgaggaaaatatagtagaatctcacctaaggtggtttgaccatgtacttgatagcctcacacacaacagactatcagaatccaatgttcttattcaacactgttgcagtgattgtgctggttgttgcaaagttcccccacatgcacaaggtcaggatatttag

SEQ ID NO: 60373 - DNA, 1818 bp, Glycine max
  Peptide Sequence Number=SeqID_177151
atgtcggctcgattgatgaagaaggttctgaacgaacagcatcaccttccgcaacacgtgagcggagaagaagaagaagaagaagaagagaacgattctgaacccatcactcgttcctccatcaaccccttcgacctcctcaacgacaacgattctgagcccgaaaaccagggagatgagttgatgtccaccaatgaaaggttggcgagttatgatgatgaagaggagtcatcttcattgaaacctactgctgaggtttctacatcaaacccaaaatcgaagaaaaagaaaaagaagaagaacaaggatagtgctgttgcgaataaaacgggagaagataaagaattggacttgattctagaaaatttatctctgaatgtcaactcttcagctgagcaacctgtttctaccaaagacaaaaataaatctgttaaacagcaagcagcctccatattgcaagtggatcctaaatgtttgaatgcagaaaatgagctgagaagaatatttggatctaaggttgtgaaatcatttgtgagtagcaatcaagtgggcagttctaggcagatgcgaggggtgagggggcgtgtacattataatcttaaaaagagtgttcttgtcactccatcagacagttggctccgctgtgatgattctttgtccatgcaatttttggagataaaaaatggatataactatttcagatatgtacactcgccatcctactcccaatctcagagagcatttgaagctgccaaagcaattaatgacataaatggcatagcgagcatattacagcaccatccttatcatatagattcccttctaacaatggcagaatattttgcggtattgggtgaacaacagatgtctgcagatgctattgccaggtgtctatatgcccttgaatgtgcatggcatcccatgttcaatccattgcagggaaattgccggctgaagttcaaacatgatacaaacaaacctatattcacagctcttttcacccacatgaaaaacttggacaggcgtggctgtcatagatctgccttagaggtctgcaaattgttgctttcgctagattctgatgatcccatgggggctattttctgcattgactactttgctttaagggctgaggagtatgcatggctggagaagttttctgaagaatataaaagtgataactccatttggttgtttccaaacttctcttattcccttgccatttgtcggttttaccttgagcgtgaggcctgcaaagatgattgtatggatgctgaaaaggcttcttcatctgatcttatgaaacaagcattgatgcttcatccttcagtcataaagaagctagtcgcaaaagtaccattgaaagatcgcacatggacagatattctcaagcatgcttttttctggcttcctgatctgcaaaaactgcttagtggtgctgcaaaactagtgattgaaacacttgaaagtaataaaagtgaacttaaggattgggcttgtgtcagaaaagaagcattttcatctgagaaaaatgagtatggacatttgttggtatccgagttctctgattcactttcatcgattcctcgagaaaatctgcaacaatttatgggtgttccaaggatgatggagggtatgcaggatgagaaccaatttgctaatctgcctggcaatggccatgctcctcgtggtgttgcaaataggaatgcattagctgtcttgtttgagtcaatgctgccgtgggttacttacgaggatggagtggatggtgaacctgatgataaccaacacgatgaccacaggcaagacaatcaatga

SEQ ID NO: 60374 - DNA, 999 bp, Glycine max
  Peptide Sequence Number=SeqID_177152
atggctagtggccgcaatttgaagaacgctgtgattgcattcttggttcctcttccctccatcttcttctacctctcattcctcaaccactacgactcagcaaaatccccatctttttggtcaactctatggtcatggtgctatcaccaccctcttctattagccaacgctctcttcttcctcaacgtcaatgtcctcttctggctcataggcctaatacaatccagccactggatgatcgacccctattggactgtgatacctgtgatgcttgttcactactatgccactcatcctttggctccctatgatttgtggaggtccaagatcgtgattttattgacttgggtgtggagtgttaggctcactcacaactatttcaggagagagaggtggcagtggggtgccagggaagattggcgtttcactgagatgagtcaacagtatggaaagcaatggtggtgggtttcattctttgctgtctatgtctcacaacagaacacctcgaacctgcttgttgaattacctgtttggtttgattgctgttccattgacttgagtgtttttcttatgcctttgaacatgtgggacttggtggctactgttgtctgtttatgtggcattgttatagcatattttgctgatacacagctctatgagtttgtgagtagaaacaacaagctgaaggggcttggtaaacccgtggtttcggtccttgacagtggcttgtggtattactgccgacatccgaattactttggcgagcagctgtggtggtgggggctggttgtgtttgcatggagcctgggagtgggatggaccttcattggagcttttgttaatactatgtgtttggcttatgtgactaggcttgtggaggaccgaatgttgaaacaagaaagtagagcagaagcatttagggtgtatcagaatacaacttctgtgtggataccttggttcaagtcctctccttcaggggttaaaaataagaatgcttga

SEQ ID NO: 60375 - DNA, 198 bp, Glycine max
  Peptide Sequence Number=SeqID_177153
atggagagaagtttgatagatgctgccagtggtggagcccttggagacatgacccctgctgaagccaaaaatttaattgggaagatggcttcaaactcccagcaatttagtgccagaagtgatgctattgtcattagaggagtgcatgaagtagccacgaaatttatgcctcaaatcagctatggttcaacccactaa

SEQ ID NO: 60376 - DNA, 885 bp, Glycine max
  Peptide Sequence Number=SeqID_177154
atgagagccaaattgtttgtgttcccaatacgaggcaggaactggtgcttctccagaaccatcgatcactctctctccgcttcccatgcttcctctcaatccccctcaaccctcaaagacttgtggaccaacatcaacgttggtgataaacccctgaacaccaaaactgagctctttgtcgattacatcgccaacaagatgaataatgcttggattggcttggagaaggcgccggaggggtctttcaagaacaagattcatgggttggggttgcggctcttgtcgcgggttaagccctctgagatatttttgaagtctatatcgaaggaaatcactagtgttgaaatcatttatccatcaagtttgaatgctcaacttgttcgtcgaagactgagacatattgctgtgaggggagcaattatccacaggaaatacttctatggttcagttttgttaatcccattgagtgcagcatgtggcattttacctttgcctaatgtcccgttcttctgggttttatttcgcacttattctcactggagagccctgcagggaagtgagaaattgctccaactagtctcagatggcaacaaaacttcaaacacttacacacaaactgagcataagaactctaaaagtcaaagccatagttcgaatgaaccctgttggatgttgggatgtgaaagtgatttcaaaggtgggttgaacacaatcttacaagtaggcaccaattataagttggattgcttggtgttgaagccctccaaagaactagataatcttgtccgtctagaaggtcttagtcaacatgctatcgtaaacatttgcaagatctatgacttgaacaccaaagatgttataaaataccagaagtctattttttaa

SEQ ID NO: 60377 - DNA, 864 bp, Glycine max
  Peptide Sequence Number=SeqID_177155
atggtgatgatccctgtggacagtcttggcaaggcatcacttgctctggcaatcgataagttacctggtcgttcactttctggatctttgggttaccagctagaacccttgtcatctgtcacaaacctagacttaagtaacaacaatattggtggcaccataccataccaacttcctcctaatctgcagtacttaaatcttgctaataataatttcaatggggcaatcccttattccctttctgaaaagacttcgcttgtaatcctgaatcttggtcacaatcagctccagcaagcacttaatgttgattttcaaaagctttcttccctctctacattggatctctcgttcaattctttgacaggtgacctgcctcagactatgagctcactttctagcataagaaccatgtatctgcaaaacaaccagtttacaggcaccattgatgtccttgctaatctgcctcttggaactttgaatgtgggaaacaatcattttactggctggataccagaacaattgaataacataatacaaaaggatggtaatgaatggagctcaggacctgcacccccacctcctcctgggacacctccagtagtatcaagaaatcgaaatcacaaatctgggggtcatagcccatcagatgctggctcaagtgacggtggaggcaaaaaatctggtataggaggtggtggcattgctggaatagtgatctccatcttggttgttggagcaatagtagcattctttctggtgaagagaagatccaaaaagtcatttaatgatgttgaaaagcttgacaatcaacccttggctcaacatgaagtgcacggtccacattttattcttgcatactattga

SEQ ID NO: 60378 - DNA, 147 bp, Glycine max
  Peptide Sequence Number=SeqID_177156
atgaatgatgtcgattctgatggagatacaatgactttcaccaccagaaatgtagcagtggcccttgttactgatgagccaaacgtatttgctagtgtcatcagaaccatcatgttgaaggaggacaaactagttgtgaagggctag

SEQ ID NO: 60379 - DNA, 2435 bp, Glycine max
  Peptide Sequence Number=SeqID_177157
atggcccacgatgcatcaatctctgatggtgctctatccttcaacatcatgattcatatgttgaatattcgcctcaccccatcaaactttatactgtggcgtcgccaacttcaaggacaagccttatacggtcatattgatggcttcactcccgcccttcctgccatgttaacctctgccgatggttctccatcctctattgtcaatcccgcatttacctcttggaaacaacaagaccaacaacttgtcagtctcctcctagcttccctcaaggaagaaaccttggctgaggttctccattgtgagacttctcaacaaatttggactacccttgaatctctctttggcggtgattctaaaatacgggagatcgcaattcgcgaccaacttctgcatctcaaaaaagactcatcctccgttctcatgggcagacctataaatgatcttgatcaattgcactggttcctgcaaggattgggtccaacttttactagcttcgacacatctcaactggtcatgctcccactccccactttcagatatttagtatctgctgcagaaagctttgaattttacataaatgcgatggaagttgttccttctcaagctgctttctactcctacactcatcgtccatcacacccttctcacacacactcatcgtttggagatcattcctcatatggttctcgtgctccctatagtggtcaaaagggacatgggcgtggtggtcgtggatgtggaaaccgtcatccaatttattgtcaaatctgtcgaggtgagggtcactatgctaccttatgtccccaacggtataatggtgctcccccatcttctgctaatattgttgaatcctttgttgtgtcttgcaatattgcttctcctaacaactcggattggtacttggacaccgatgcttttgctcacgtgacgccaagttcttcaacgttggatgccatggagccatattctggtaatcacaaagttcttgttggaaatggtaatgttctgcctatctctcatattggttctcatcgcttcaattctaccctccatcttctagatattttggttgttcttggtttgcagaagaacctcatttctattagtaaactcactcgtgactttccagttgatgttattttcactaacaactcctttctacttcaaaaaagggacacaaaggaaatcttggcccaagggaggcgtgaacacaacctgtacgttctggagcacgaagacacttcccctattgttcttgcgcctccagatgagcctcaatctgatatggttcgtaccgttccagcaggtcaccctatggtgactcgtgctaaagatggttttaaatctgctgccaagcatcctggctggcttgctgccatgaatgacgaactcacgaccttacactgcaacaagacttgggaacttggatttactcagactcctggtcttgattatgatcatacatttagtcctgtggtgaaggcatcaactgttcatgttattcttactctagcagtcatgcaacattggccccttcatcaactggatgttaacaatgccttcttgaacggactcttgtcaaatccagtctacatggagcaacctcctggattcattgatcctcgcttccttcaccatgtttgtcatcttcagaaagctctttatggcttgaaacaggctcgtctagcatggtttcaaaggtttggctccttcttacttcatcttggttttgttagcagcaaggcaaatccatctctcttcatctatcatcataacactgcaactctttaccttcttgtctacgtcaatgacattattttgaccggtagtaatcaattttccatccaaaccatcttggctaaaatccgagtcaagtttgccatcaaggatctaggccgtctgagttattttcttggtcttgagcccattgcctcgcctcttgcttctggtattcaattgacaagcactggagacccatttcctgatccaaccctttatcgctctcttgtgggagcattacagtacctcacaatcacttgtccggatctcttatatgttgttaactctgtcagccaattcctgccagctcccaccattgatcatttccaagctatcaagcgaatattgcgctatgtcaagggcaccttatcctacggcctatccttcactcggggatcctctcttcttgttcttggttactctaatgtcgaatgggctcattgtgttgagacgcgtcactccacctatggctactcgatattcttggaagcagctaagctaatgtggttcactcatttgctgcgcaatctgcatgtttgctctgctccccctactcttctttgtgataacaaaagagctacatttctttcccagaatccggttgctcacaagcgtgccaatcatgttgatattgactaccactttgttcacga

SEQ ID NO: 60380 - DNA, 910 bp, Glycine max
  Peptide Sequence Number=SeqID_177158
tctttttgcaattgctcaggagaccctagtgaagttcctttccaaagctactggaactactatcaactgggtccaaatgattgggatgaagcctggtccgaattctattggaattgttgtttcccgcaactgtagtggcgtagcggcaagagcctatggacttgtgaggctagagcccaccaaggttgccgagattctcaaagatcgtccatcatggtattgtgactgtcgatgcctcaatgtattgagtgtagtctcaacagggaatgggggcacaatagagcttatgtacatgcagacatatgcaccaacaacattggcagctgcaagagacttctggactttgagatacgctactagtttggaagatggaagtcttatgatttatgagaggtccttgacttcttcaactagtggccccacagggccagctgctttaaacttcatacgagctgaaatgcttcccactggtgaaagtgacttgaatgactacaaccttaggttggtcctcacaattgcattccaatttacctttgagaaccatttgcgggacaatgtgactgttatggctcgccagcatgtgcataatgttgtgcgatctattcagagggttgccatggcaattgctccctctaggctcagttcacagttggggtcaaagtcacttcctggtccacccgaggctcttaccttagcgagatggatctgcaaaagctacaggctccacacctggacagagcttttcagcgttgagtctacatccggtgatgcaatcttgaaacaagtttggcaccatccagatgcagtattgtgttgttctgtaaaaacagatgcatctccagtgttcacctttgcaaaccagctggacttgacatgcttgaaaccactcttgttgctttttaagacataa

SEQ ID NO: 60381 - DNA, 834 bp, Glycine max
  Peptide Sequence Number=SeqID_177159
atggtaggtcaaggaggcaaactgttaagaagtatgggcggcccccattttgtgcaggttcaaaacaagcattccttcccacaatacggcttgcctcccaactatacgccactcaatgtggcacacactcccaatgaggatgacaacaactctgcatctatgcccattgagagccaacaccctcaatatgatcatgcgcatgtctctcaacccataggggagacacatgaagcatctcgagaccacaatctagtcgactccgagccttgcctcgaatatttcactgaggggcaggcattttgtggcgtacccttaccaaaaagtttggagggccctcagtacctcccacaaccacaacccttgccttttgtaatgggaatagtccctcttgccatggtggaaagggaaaaattcaatcatatagaggaaaggctgagggccattgaaggaggcggaggtcatgcttttgctgacatggcagagttgtgccttgtacccgatgtcatcatccctccgaagtttaaggtgctagatttcgataagtacaaagggactacttgccccaagaatcacctgaagatctacaacaagaaaatggggtcatactcgaaaaatgaaaaattgttgatgcatttcttccaggaaaatcttactggggcaaccgtcacctggtatgctaatctagaaccttcccgagtccattcttggaaggacctaatggtttccttcattaggcagtatcagtacaattctgatatggcttcgaatagaatgcaactacataacttgtgcaagaagaagcatgagtcgttcaaagaatacgcccaaaggtag

SEQ ID NO: 60382 - DNA, 636 bp, Glycine max
  Peptide Sequence Number=SeqID_177160
atggttattctacgccctttgtcattcaggcacagtaagtcgagaggtgggcagagacaaattatggtcattccccacaccttttcgccatccaggctcgattgtgtccgagggcacgcagagacaaattatggtcattctgcgccttgtgtcaaccaagaggaacgaactcggcagtatcaggatgatgttggtcgttcgccagagaatcttcttctggacttaaatggtgttctgaaagttacagattttggattgagtacatatgcgcaacaggaggatgaacttcttcgaactgcttgtggaattccaaattatgttgctcctgaggtgcttaatgatagaggttatgttggttctacatctgatatctggttatgtggagtcatcctctttgtgcttatggccgggataaaagttcctgaacttttaaaagatgaatggttcaaaaaaggatacaaacaaacaacttttataatggaagaggatatcaatgtagatgatgttgctgctgctttcaatgattctaaggaaaatcttgtgacggagagaaaagagaaaccagtgtcaatgaatgcttttgagcacatatctaggtcacaaagcttcaaccttgaaaatttgtttgagaagcag

SEQ ID NO: 60383 - DNA, 237 bp, Glycine max
  Peptide Sequence Number=SeqID_177161
atggctgagtttcaaaactacaacaagtgcaagcaagtaactaataaggttgttcaagcaaagagaaagggatatgggattagcagcaagtgtgcttctttggtgaaggagcaacgtgctcgtctctatatcctacgtcgatgtgccaccatgctactttgttggaagctccttgccatgcatggtttgccagcacagttgggttgggctagcttcactgtgggtttgtcattttag

SEQ ID NO: 60384 - DNA, 608 bp, Glycine max
  Peptide Sequence Number=SeqID_177162
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtgaatcaaacgagcttttaccttttgttccacacgagatttctgttctcgttgagctcatcttaggacacctgcgttatcttttaacagatgtgccgccccagccaaactccccacctgacaat

SEQ ID NO: 60385 - DNA, 312 bp, Glycine max
  Peptide Sequence Number=SeqID_177163
atgaacggggctaagcgatctgccgaagctgtgggatgtaaaaaagaatcggtaggggagcgttccgccttagagggaaggacccgcgcaagcagtgctggacaaagcggaagcgagaatgtcaacttgagtaatgcaaacgttggtgagaatccaatgcctcgaaaacccaagagttcctccgtaagccaaagttcgagtactaggcattacaacactgaagtaatccatgccatactcccaggaaaagctcaaacaaccttcaacaaatgggagcttgatgaaatcctaccccgcaagggcattggatag

SEQ ID NO: 60386 - DNA, 477 bp, Glycine max
  Peptide Sequence Number=SeqID_177164
atggcaacaccactaggcgtagccaaagaagaagaatggtacatcgtaattgtgaagaagaattgcacaactgttattcgtatattgatttatggatcacctgctgacaatatggataaatacgttcgaatgggtgaaacaattgcagtggaatgcttggagcgatttgtatcagacatctgcactatatttgggaatgagtacttgaaaagatcaaataacaaagacaccaaacgactactaaaaatgggagcgacatgcggattttcaggccatcaaatatgcaagaatgtcactttcctacaaatggtgacacaactagcgaaaggcatagcactgggaagaaaatggcaatgttggtgcagaactagtgatgtagtttcatgtggagcttgtaggccttggatcttcttcatcaatggagtcatttgcttcttgaagtttaatggcagtggaatgaagaaggaagaaagatga

SEQ ID NO: 60387 - DNA, 1386 bp, Glycine max
  Peptide Sequence Number=SeqID_177165
acttatcaaggtaatccttgtggcgtctatccttacttatcttccttcactggaagtggcgtcttccaaaactccgtagcctatatcaaacgatccactcctagtcaagttcacatcaaagagatagggtttaagagatggggtgggttattgaaaagaagaggaagtttggaaaatgggggagggggtctcaggtggtttaaaagtgagggaaatctcttacggaatccttacattacatatatcgggttctctctgtctctccgtctcgtagcagagaagcagcatggagaagcacactttgtctgtgactctgcctctggaattgatcagagaaattcttctgcgatcgccgatccccaatttacccattttgacctagctgcctcacccacccatcgactcattctcagatcaaattattatgataactttaactatattgaatccattgatattgaaagtctgattaaaacatgtcgccagcacatagtgtattttccatcacctccacgcgaccaccatgatgatggtgaatattatgatgttcacaatcaaccccagattttgggttcttgcagagggcttgtacttttacactactgggggagcagcgaagaactcatcttatggaatccctcactaggcgtccacaaacgattcccaaaaacatactttccatatgggatacacgacgaatatgtatatggtttcgggtttgacgcatcaacagatgactacgggctaattcttattgaatttcccgagtttagcttcggcgaaactgcagtcttccttttctccttcaaaactgggtcgtggaaaagagacattcctgttagtgcttcatacaacgatctcgatgatatattcagtgttggggatgaattcaaagctgggtcactcctcaatggggttcttcattggctggttttctcgaaggaaagaaaggttcccgtgattattgcctttgatttgatacaaaggagtttttcagagattcctctgttcaatcatttgactacggaaaattatcatgtctgcagattgagggtagtgggaggatgcctctgcctcatggtcctaggccgcgaagcggctgagatatgggtgatgaaagaatataaaatgcaatcatcttggactaagtccactgttatccctacttttgacttctacccgatatgcgccgctgaagatggtggaatttttggatcaaattgtgaaggattagtgaaacacgatgacaatggagagctgtttgactatcacatcagtgctgaaggtcaaaggttgtactgtgccaatcctgctatgtatcaagagagtctactgtccctcccctgtgccaatcggaatgaaacaagggaagatgaccaacattaa

SEQ ID NO: 60388 - DNA, 309 bp, Glycine max
  Peptide Sequence Number=SeqID_177166
atgcctggaggtgttggcgccagacgcacgatgaccagtgtcggtgcaagccgtggtgggaaagaacggtgcaagccgcaagtgggaaggaatgatgcgtcggtggctgtagtggcaatgagcagcgcgaccgaggctgcaatggcaaggagggaagcttttggacacgctttttgttttggagagaaaacggcgcgaccgaggctgcaatggcaaggagggaagcttttggacactttttgttttggagagaaaagtttctctcaagaagaagatagaaagatgctgaagaagatagaaaggtgttga

SEQ ID NO: 60389 - DNA, 237 bp, Glycine max
  Peptide Sequence Number=SeqID_177167
atgtcactgatcttaatcacctgggaacaaatacaagggattaagtttgaaagggacatgagagatatatctcgggctagtatggatttatacggtatgctgagggaacatgcagtttcatccaatttggtctataaagcaattcgaagttctaaactacacctttacaggcagaacagcaaaacatcgattatcggttctgaaagtatcatattccatttcttcgcaaacaattga

SEQ ID NO: 60390 - DNA, 996 bp, Glycine max
  Peptide Sequence Number=SeqID_177168
atggaaaatcacactctccctatggatttgatgagagaaattcttctaagattgccagtgagatctgtttcgcgtttcaagtgcgtatgtaagtcatggctttctatcatctccgatccccaatttggcaattcccattatgacctcgcagccgcaccctcccatcgactcattctcagatcaaaatgttattctcttgaagttcaatccattgatacagatgcaccaccagacacatgttctgctgcaatgtatttgcttctcccccttcaatcacctccacctaaacccaatgactatgacaattatgatgatgactacttgctaattatgatcccgtttcattggaaaactgaaatccaggttttctcattcaaaactaattccaggaacagaaagatgattaaacttaatgttccataccagggtatcggctcgaaattcagtattggatcactcttgaatgagacacttcattggttggttttctctaaggataaatgggttgatgtgattattgcctttgatcttataaaaaggagtttatcagagattgctctgtttgatcatttaacaaagaaaaaatatgaaatgtttagtttaagagtaataggaggatgtctcagtgtgagttgctcggaccaagactgggcaatgactgaaatatggataatgaaagaatataaagtgcagtcatcttggactaagtcttttgtaatccctacatatggcttttcccccatatgcatcaccaaagatggaggaattttgggatcaaatatgagagaaagattggagaaacataatgacaaaggagagttgcttgagcatctcgcctgtgttgctgctgcaggtgaagagtactactgtgccaaccaagatcaacaatctgcaatgtatagagagagtcaactgtttcccaatctgggaagtgtgaatggtaacgacaacttagcatttgctggttgcacccaacctatggacaatataagttaa

SEQ ID NO: 60391 - DNA, 381 bp, Glycine max
  Peptide Sequence Number=SeqID_177169
atgaggttgatagtgaaactcgttgtaatgaaagaaattggggtggcgtgggggagtaggagatgcaccgcacgaagcaaacgtactgtatcctccccgccatgtataaatggtgcatctgtatcagagaaaggcatgctttatcgatctcactggcaatctgagaagaatttctctgatcaactccagaggctgagtctgagtgagcatgagatgaggtatgcgaggacttctcggtcctccgaggaaagggaaaaagtgagggtgaggtggcagggaggaaggaaaggtggtcgcatatggttggtggcgacggcgaaggagaggggtggacggtttctttgtggtagatttgattctctattaagagagcgatattga

SEQ ID NO: 60392 - DNA, 1194 bp, Glycine max
  Peptide Sequence Number=SeqID_177170
atggagaaccagactgagactctccctcgagacttgatcagagaaattctcctcagattgccggtgaaatctgttctgaaatgcaagcgtgtctgtaagacatggctttctcttatttccgatcccaaatttggcatttcccattatgaccttgctgccgcaccctgccatcgacttgttttcaaatcaaagggttttcttgttaatagcattgatgtagacgcaccccttttcatgaattccgctgaactgaatttcctttccacccctccatcacccccgcacggtgctgctcatcatcataataatcataaatatattattcttggttcgtacagagggatactacttttatacttcctgttccactatgatctcattctttggaatccatcaattggtgtccaccaaccattaacatactttaaatttgacttcaccaccattgccatacgtagctatggttttggctatgactcatcaacaaataaccactgtttagttctgattattttggatgagtctgaagatgatgatgatgatgatgatgatgatgatgatgatgatgatgattgcatggttgaaatccgggtttgttcttttgaatctgcttcttctgtttcatataaggatattttttttccataccattacattaacaacaaattctacgctgggtcattttttaatgaggctcttcattggttggttttgaccgacgatgaagatgttcctgtcatagttgcatttgatctgatacaaaggagtttatcagatactattcctctctttgatcatttcactgtggaaaaatataaagttcaaagttttggggtcatgggaggatgtctcagtgtgtgctgcttggtccaaggctgtgcaactgccgaaatatggatgatgaaggaatataaagtgcagtcatcttggactaagtacatggttatacctatttataaaattcctaattatcacttttcccccatatgcatcactaaagatggtcacattttgggatcaaataccggaagaagattagagaaacgtaatcacaaaggagaactccttgagtttctcacatatgctggaggtggagattggtgctgtttcaatctactgtctgctatgtatagagagagtctactgctccctagtgacatcattggggaaccaagtgaagatgaccaagagtag

SEQ ID NO: 60393 - DNA, 219 bp, Glycine max
  Peptide Sequence Number=SeqID_177171
atgggattaacaggggaaattcctgagtctttatcagaagtaaagaggttgacatttgtgggacttagtgacaacaacctcacagggactcatactttgaagttcaatgttcctccaactaagaggattgaagggcagggatttgcagaacttcaatacggtatactgaggtacatgggaaccatcacggatagtggccattttcattcgtgtcactaa

SEQ ID NO: 60394 - DNA, 1092 bp, Glycine max
  Peptide Sequence Number=SeqID_177172
ctagatgtttgggccaaggaaagagaagttgctggtttaaaggcaagcttaaataccttaatgtctgaaatacaacgcttgaataaattgtgtgccgagaggaaagaagctgaagattctctaaagaaaaaatggaaaaagattgaagagtttgatgctcgtagatcagaacttgagactatatatacggcactccttaaagcaaacatggtaatgttctgttatttcagtatttcctgtactagtgaaatacaactgtggcatatttacagcttatccttgggaatggatgctgcttcattttggagtcagcaaccattaactgcaagggagtatgctttgagcactataattccagcatgtgctgctgttgctgaggcttcaaataacgcaaaggatctcattgagaaagaagtgtctacattttatcgaagtccagataatagtctctacatgcttccttcttccccacaggcactgcttgaggccatgggtgctagtggaccacctggccaggaagcagttgcaaatgcagaaataagtgcagctattttgacagcaagagctggtgctcgggatccatcagcaattccatcaatatgtcgcgtttcagctgcacttcactatcctgctggcttggagggttcagatgcaggtctagcatctgtgctggagtccctggagttctgtttgaaacttcgtggttctgaagctagtgtgttggaagatttattaagggctattaatcttgtctatattagacgggatcttgttcaaagtggtgaagccttgttgaatcatgccaacctcgttcaacaagaatatgaaaagacaacaaaattttgtttgagtaaggctgacgaacaggagaaaactatcatggaagaatggttgcccgaacttaagaatgctgttttgagtgctcagcagagcttggaagattgcaaatatgtcaggggtttgcttgatgagtggtgggagcagccagcatcgacagttgttgactgggtaacagtggatgggcaaaatgtaactgcctggcataatcatgtgaaacagcttcttgcattttgtgacaaggagctattgtga

SEQ ID NO: 60395 - DNA, 834 bp, Glycine max
  Peptide Sequence Number=SeqID_177173
atggagtcattgtgccattcttcccttccatgtgatcctcttgaaggagatcaatttgacgaggaaacttattgtgttgcaagcactgaagcctttgcaaatcttagttctagcattagtttgatacacttgtattgctcacgactccctgcagatgggtactttaaaccgactacaaggtgggacaaagagactagaacattgtatgttcccaagagctgccctctacaacatattcgtgtagaaggagacaaaaaactcttaaagaatattgcatgccttgaagcatgcaaacaacttcataagattggagctttgtcagataatcttgttcctgatattgtcattgaagaagcaaaggtggaggaatttgggaatgaaccttatgatgaaaaccaaccaacttttgccccatttggattggttcttttgtgtaaaaaattccatgttactatacttataattctaatagatcataatatgaataagttgacaactggtttggacaaatgctatttggaagatgatcttgagattgattatcttctgcttccagctttgggtaaaaggcaatatgcagctgttaattggttagctgttaattctgtaaatccatctgaagttagctgtaactaccatgaaccccacataaggacaaaaaatggtttagtttgcagttgtaaactacaaaatgcattggtttgtacttcccaccctattggtaagattagtttctatattattaccggtataatggaattggatggaaactcacctatggaactaaggggtggtgggactactacgtacaagaagtactatcaacaacactga

SEQ ID NO: 60396 - DNA, 1038 bp, Glycine max
  Peptide Sequence Number=SeqID_177174
atgtcttggttccttgtaatactatttctcagtctcacatttggtacaactcattctgagactagtcaccacaagaaacttccctctgctgttgtggttggcactgtttactgtgatacatgcttccaacaggatttctccatgggaaaccacttcatttcaggggcatcagttgctgtagaatgcaaagatggatatgggaggtcaaagccaaggtttaggaaagaagtgaagacagatgatcatggggagttcaaagtgcagttgcccttctcagtgagcaaacatgtgaaaagaataaaaggatgcactgtgaaattaataaatagcagtgagccttattgtgctgtggcctcagcagctacttcttcctcactgcgcctcaagtccagaaagcaaggacaacacatattctcagctggctttttctcattcaagcctcttagacagccaaatctctgcaaccaaaaaccaagcattcaaaacatcaagggccttgattatgcgaaacacatatttcctccaaaaatagatccatcgtttcctcctccacttcaggatccaaaaacaccaggtggtcttcttcctcccattcctggattacccgacctcccaccattgttgccaccactccctcttttgccacccctttcaggaatattgtcaccactagtccctgcaggaatcactaatgagttcccaaatgttcagccttcagatcagaaactagttgaccctaataacctcatatttcctcctaacccatttcaaccaacaccctcagtccccaaccctcttcagcaacctcctctaattcctaacccattagagccatcaggcccatcaccacttgttcctaacccattccagcctccctcatcagcaacatcaccaccactgtttccattcccaacagtgccaggtttaactccatctccaccatcactagctcttcccattccttttcctccattattccctccacctagcagccctggcacaccctctgcttcctctgcaaagaatgcttctccttaa

SEQ ID NO: 60397 - DNA, 1299 bp, Glycine max
  Peptide Sequence Number=SeqID_177175
atgggctaccgtccgctcggcacctacgccgccggcaagtctcacctgccgtccgtcgactccatccgccggatttgccgcggcaacatgattccggtcttgaacttcctcgtcacccgcgccaagtccgagaagaccgtgcggaacatccgccggaacatcaccgtgcacggcggcgcagacggcgccggagaggcgaaggaggaggtcagggggaagggcgcgaggaagaaggagaggtcgctggccgccgtcgtcgatggttccgagacggcgacgacgagggaggcggcgctgcaggagcgggatttggccgcgaaagaggtggagaggctgaggaacgttgtgaggaggcagaagaaggatttgagagcgaggatgctcgaggtttccagggaggaggctgaaaggaagagaatgctcgatgaacgagccaattacaggcataagcaagtgatgttggaggcctatgatcgacaatgtgatgaggctgcaaaaatatttgctgaatatcataaatgtctctgttactatgtaaatcaagcgatggattctcaaagatcgggtgtggattcttctgttgaaatggccaaaagtgagaaggaagctgtttattctactgttaagggcagtaaatctgcagatgatgtcattctcattgaaaccacgagggaaaagaatattagaaaggcctgtgaatctcttgtagaccacatggtggaaaaaatacggagttcttttcccgcttatgaaggaagtggcattcatttaaatcctcaaacagaaacagcaaaattggggtttgactttgatgggcaaattcctgatgaggtcagaactgttattgtaaattgcctaaagagtcctccccaattgcttcaggcaattactgcatacactttgcggctgaaaagtctaatctccagagaaatagagaaaattgatgttagagccgatgcagagaccttgaggtacaaatatgaaaataacattgttatggatgtttcgtcatctgatgggagctctcctctacagtatcaactttatggcaatggaaagattggggttgatgtgcctccaggagggagtcaaaatcagcttcttgatagacagaaagctcatgttcaacaatttttggctactgaagatgcactaaacaaggctgcagaagcaagggatatgtgtgaaaaacttatgaaacgtttgcatggaggcactgatgtttcatcacgctcacttggtattggaagtaactcccaaaatgttggaagtctcaggcaacttgaggtattattatga

SEQ ID NO: 60398 - DNA, 537 bp, Glycine max
  Peptide Sequence Number=SeqID_177176
atgtgggatcgacacatgcttaaaggagtactcaaactggatgtatttacccctaaggccaagactccgaagagtccgtcaggacttctccctcctgattcaggttttccaagcattagagagaaggaaaagggattggagtctcaatttcactgtctctgtgagagcggatgtggaaggctattagctcgttggcaaattcttgaagcatggatcgatgaacgtaagggttttcaaagccacaatggcccaagcatggaaaatgaagggaggactagagaagaaagcagagacatggttatgaggctggctacatggaattttgataggaagctagtggttctaagtgatcttgatcaagacaaaagccctagcatggtttatctaaattgttgcccattctgggtaaggatttatgatttgccccttaacctgagggtcaaaagagtggctcaaacaattgcaaacaccataccccaatttatggagtggaataagaatgagcagaatcggttgggtcgctttgtaagagtgtga

SEQ ID NO: 60399 - DNA, 117 bp, Glycine max
  Peptide Sequence Number=SeqID_177177
gtggtgctcaactctaggtccattgtgccaaatgtcacccaacaggtccttgttattacttgttcaagtgcctttctaagtgcccttgtcaggaccgggtactacacatgcccctaa

SEQ ID NO: 60400 - DNA, 405 bp, Glycine max
  Peptide Sequence Number=SeqID_177178
atgacttctacagcttcacttgataattctctatctgacatgtaccgttctcctccaaggcccttgccttatgatgcagaccccaggtttttccgttcacagcgtgaaggactagtgtcaagacgtgagaagggttcaagtcatttgaatgaagagtcagaacctctaagaggtgatgtagatgctgactcagaatctttaaattctggtggcaaatggaatgataccagtgaagatggatcaaaggaataccgttccaagtcctctgtaagactctcatcagcaaaacttacaactggagctggggttgtctattcatcctcagaagaggaggatgtctgtccaacttgtcttgaagttagtaaagtagagaagattcctaacagaggatggctgttatactga

SEQ ID NO: 60401 - DNA, 198 bp, Glycine max
  Peptide Sequence Number=SeqID_177179
atgggaaggggtagggttcagctgaaacggatcgagaacaaaactagccagcaagtgacgttttccaagcgtagatcgggacttctcaagaaagccaacgaaatctctgtgctatgtgatgctcaagttgctttgattatgttctctaccaaaggaaaactttttgagtattcctctgaacgcagtgacatgtcttaa

SEQ ID NO: 60402 - DNA, 1407 bp, Glycine max
  Peptide Sequence Number=SeqID_177180
atggatattgatgcaatttttgggactattcggcccgtgagtgttccaaggaagagtgccatttatgtgtgggggtacaatcaatcagggcagacaggtagaaaggggaaagaggatcagttgaggattcccaaacagcttcctcctgagctgtttggatgtccggctggcaccaatgcatgttggttggatgttgcctgtggtcgcgagcacacggctgcgatagcctctgatggctcactcttcacttggggggctaatgactttggtcaattgggtgatggaactgaagagcgaaggaaacatccagaaaaagtaaagcaattagagtcagagtttgtaaaatctgtatcctgtggagcacattgctctgcttgcattgctgaacctcgtgaaaatgatggttccatctccacgagaaggctctgggtgtgggggcaaaatcagggatcgaatcttccaaggttgttctggggggccttcaaacctaatacaattattcgtgaagtgtcttgtggagctgtccatgtggttgctttgtctgatgaaggcctactacaagcttggggctacaatgaatgtggtcaacttggccgaggtgttacttgtgaaggactacagggggctcatattataagttcttatgctaaattccttgatgaagccccagaacttgtgaagattgccaaagtgtcatgcggggagtaccacacagcagccatttctgataagggcgaggtctacacatgggggctaggaaatatgggccagcttgggcattcttcactccagtatggggataaagagttactgccaaggcgggtggttacccttgatggtattttcataaaggatgtggcgtgtggtggtgtacacacatgtgctttaactcagggaggagcactttatacctggggtggtggtcagtctgggcagctagggcttggcccccaaactggattattctcttgtgttgctaatgactctcagacatttttccgaaacattccagttttagttgttcctaaaggtgtgcaacttgttgcatgtgggcattctcacactcttatctctatgagtgatggtcgaattcatggatggggttacaataattatggtcaggcagccaatgagaaatgtacatatgcttggtatccatcaccagttgactggaaactagctgctggtggtggccattcagctgtgttgactgacgcttgttcgttaaaggagttatgtgagtttgtacttgcagacagtatgactttatctaacgctgctaaggttgaggatattgcatatagaactggatcagatgctttggtgcgcctttgtggaagactcagagagtatatgcttgctggtggagctctagaacaaaaggaggagatgaacagtaaaatctga

SEQ ID NO: 60403 - DNA, 663 bp, Glycine max
  Peptide Sequence Number=SeqID_177181
atggaagacgtcctggaacgttacgagagatatacacatacagcacttactggagctaataacaatgaatcacagccatgtgtcgttgtcattatacacatgaatggaagtgaatatgaatatacttctttccatggaaattggtctttcgaatatatcaagctcaccgccaaagttgaagtcttggacaggaacgtaaggaatttcttgggaaatgatctggatcccttgagtttgaaagagcttcagagtttggagcagcagcttgacacagctctgaagcgcatccgaacaagaaagaatcaagttatgaatgaatccatctcagacctgcataaaagggcaaggacattacaagagcaaaacagcaagctagcaaagatgaaggagaaagcgaaaacagtgactgaaggtccacatactggcccagaaactctaggcccaaattcatcgacccttaacttaacttctccacagctaccaccaccaccacaaagactggttccttctctaactctctggcataatacctttgggcaaatattagtattgcaagtatgcattgagacattccaaggaagagcattggtggaagaaacgggaaaggctcaaacagtccctagtggcaattctctcatcccaccatggatgcttcatatctga

SEQ ID NO: 60404 - DNA, 145 bp, Glycine max
  Peptide Sequence Number=SeqID_177182
atgaagctcatgtcgtcttcaagacatatgatatgggagtccatggcatcaaagcgatcgtcgataaaagctcaaagatcccgtagctcaatgaggacgtcattcaataaggaggaagaggtatctcgttgcggtggtggagagg

SEQ ID NO: 60405 - DNA, 294 bp, Glycine max
  Peptide Sequence Number=SeqID_177183
atggagcacgttttatgtcaaagccaaaaccagttagagttagatgcttttggagcaaaaaaggaacaagggcctgaggaggtagaggctgacatccctggcaaacccgacccttacttcccaaaggatccggctcaaatatgttttaaatacagcaggatcatgagggggacttctgaaaagaaacttgtgagaattgatgttagtgctgatactggcattgttgatgttggcaaaaataatatagacaaggccatagctgcttccagggataaatgcaattttgaggtctaa

SEQ ID NO: 60406 - DNA, 807 bp, Glycine max
  Peptide Sequence Number=SeqID_177184
aagccacccgaggaagtggagggacttcagggtcatagtggtgcgaagcttgttaagggtgcgttccaagtagaagtctcacatcctgtcgttgtggaaagtgttcaattttcacgacggttcttgtaccgccttaatctgtttgttaagggtgcgctccaagtagaagtcccacatcggcttgtggaccctatgaacgaagaagaagacgatggggaaatccttaacattgtacttgtttgccaattcgttttcgacggtggcgttgaccttggcaagaatgatgtcatcgggcttgagcacgatggccgtagtggcatacttcgacgcgagggcctggcagtggccgcaccagggtgcgtagaacttgaccatgaaaaagcgattgttcttgatgacgatggtgaagttgcgctccttcaaaacaacgacatccttgttgtccacctcgggctccttgacacctcttctgacgagtggtcgaagccggtgaagtcgtcgcagtcgcactcgttgtcagcgtcctcctcgtcgaattggtggggatctagaaaatggtcgtgtggagaagtggtggcggcatcattggtgagggagaggaatgagaagagagtggcgagagagagagaaacaaatagcttggtcaaggagggggcgaggaaggcaaggaagcacgggagggaggagaaggcaaagatagtgagtgagcgggacgttttcagtgaaactatctttgaaatgttggcaataattacaagattacctccgttatccaaacgacaacaatttttcaacaatcatcattga

SEQ ID NO: 60407 - DNA, 336 bp, Glycine max
  Peptide Sequence Number=SeqID_177185
atggcagaatcctcaaagaagagaaagggatcctcctccaccaccaccgctgtaggccaatgtcgccacgacacatccggtgacccaccagcaccaaatcctccttctttttcatctcacaggtcattaactttgttttcttctaatgaccagcatcaaaggtactattcccaattctccaatcgtgtcattctcgatcctaagtatttagatgatggagtcattttctctgaggtgcatcaaatacctattgttgttgatcaatctctattttattctcttactaaactaagcagtcagggtgttccttttgagggcactctagttgatgattga

SEQ ID NO: 60408 - DNA, 198 bp, Glycine max
  Peptide Sequence Number=SeqID_177186
atggagacaaccacttggttgacggggttgctacccttgaagtccctgttcgtaaagatgccattttcaagactccctggactgtcctccatagggaaagtcgtcatcgatggtgttgattacacctctgatgtgtcgggcaggttcatgttttggtggaggttgtcgctcatgttgttgttgtcttggtctgcttag

SEQ ID NO: 60409 - DNA, 261 bp, Glycine max
  Peptide Sequence Number=SeqID_177187
atgggggtgtcaaagctgcctatggacttgggtggaaatccaccataccagaggttcgcctgtgttaggaaggtgtccagatgctcgtctggatcggttgtcccatcgtaccgctcaaggttaagtggcttccaccataagggtatgtctgcctccatgatgtggttgacaaaaggatattggcggacagtccgtgttgctggacggcaaggtgtgggaggatggctcgtcgcccttgggatgtatgacatgagtctctag

SEQ ID NO: 60410 - DNA, 804 bp, Glycine max
  Peptide Sequence Number=SeqID_177188
agactcgaggtttcacccgacattgtccacccttacgcaagtccactcctctgttttataggcgagagagtcgaaacccgaggctatgtggacttaatgaccaccttcggtcagggcaagctctctaggagcttcaccatcagatatctactggttgacgcgaccacatcatactttgccttaataggaagaaagacactcaaggaattgggagccatatcctccatgccccatttgacaacgaaattccctacactgacatgggagattgagcctgccatgcctcaccctatagtggctgaatgcacacaagtcatgacagtggatgaagggtctcatgttcgagccttaactgtctaccaagctagcttgggcggtgaatttgacatagatccgcgatatgacaccttcgacaaaggcctgaaacccattgaagagcttgtccagttgcaactcaggcccaaaccggggcaacgaatgcggctcaatagggacctctccaatcacgagcaccggcgccttgccgatgtgttgcacaaaaatgcagacctatttgcctggcaaccatttgacatgtcgggaatccacctcagcataatggcggatgtgctgagcttcctggacgcctactccggatacaagcaaattagaatgcatactctagacaaggacaaaatgacatttatcactgaagatgctaatttttgctacaaggtcatgctatgcgacctcaaaaatgcaggcacgacataccagcgactaatggaccgagtcttcaaacaacagatcgatcgaaacgttgag

SEQ ID NO: 60411 - DNA, 249 bp, Glycine max
  Peptide Sequence Number=SeqID_177189
atgtcagtgaaaaacctcgccgggagcctaggagtacatggcaagacaaactacacgctggaatacaagctagggtcacgctgttttgtgagactacttcaaccatgtgagattgacacaagcttaaaggagcattcaaaccgggtgtatttaccccaaggtctaaactctgaagagtcagttaggacctttccttcccaattcaggtccaacctagaaaacattttagcacgcagattgtatcaatga

SEQ ID NO: 60412 - DNA, 174 bp, Glycine max
  Peptide Sequence Number=SeqID_177190
atggataaatttgacatctttgtccctcatcctctcgtaattacatctttgcttccattggaatatgggtgcaagccattggttgtgaaaacaacgattggtacctcagagccctacattggggcaatgagaggcatcgtgcatgaacctcaagtgaacctaggggcagattag

SEQ ID NO: 60413 - DNA, 231 bp, Glycine max
  Peptide Sequence Number=SeqID_177191
atgggtaggggaagagtggagttgaagaggatagagaacaagataaacaggcaagttacgtttgcaaagaggagaaatgggcttctcaagaaagcctatgagctatctgttctctgtgatgctgaggttgccctcatcatcttctccaaccgtggcaagctttatgagttctgtagcagctctagatttatcagatctagtaatatggcacatgatctggtggatatctaa

SEQ ID NO: 60414 - DNA, 1086 bp, Glycine max
  Peptide Sequence Number=SeqID_177192
atggcttttttcctaatcaagaatttcataaagcttgaaaatcagatgcatcgtggtaaattttcccttacacccaagaatgaagtcaaggacttgacaggttcaagtttaaccagttacaaacatagcagtcttctggaccccatagatgtttcttcatcttcagatgatgaaaatgaccttcctaatgatgatgtgtctaatcaattagtcctttatgatcctgtggcgaatggaaacaatgcaattgaacttgcacctgatcctctccagtgtgaacatccattgcttccaagaagcaaaccttcacattcagttcctagagttttgccttcagttggtgctttcactgtccaatgtgcatcctgcttcaaatggaggttgattccaacaaaggaaaaatatgaagaaatacgtgagcatatccttgaacaaccttttgtttgtcaaaaagctcgtgagtggcgacctcatgtatcttgtgatgatccagaggatatttctcaggatggcagcagggtttgggctattgataagccaaacattgcacagcctccggctggatgggagcgactgctaaggatcagagctgaaggaagctccaaatttgcagatatgtatgcatccattattgatcctttatttttatctgttattggaatagaaacacccttatactatatagcaccatcaggcaagagattgcgttcaatggtagagatccagaagttcttgatggagcatcctgagtatacaagagatggggtaactctttcacagttctcatttcaaataccaaggccattacaagaaaactatgtgaggaagcgacctgctagacttacctcttcatatgaagtcagtgagcctgttgaacatgaacaagtgagtcctctagcatgggtagatccagaagggcatggtcgcagactggggcttcctgcccccccattcatggaatcccatgatattgaccctatcagtatcagccgtccttcaaagaggcaagcaactcataaagggcattttaggtgtaatgagcttgcggggaaaagcagtgtagagacggttcacttgtcctcatga

SEQ ID NO: 60415 - DNA, 825 bp, Glycine max
  Peptide Sequence Number=SeqID_177193
atgggttcgcttgctacacagaaagggtggaggaaaggcccttggactggtgaagaggacaagttgttaagtgaatatgttagcttgcatggggatggtaggtggagttcggtggcgaaatttacaggattaaataggagcggcaaaagttgcaggttaagatgggtaaattatttgagacccggcctcaagaaaggtcaattaacaccgctggaagaagaaatcattattgaactgcatgcaaccttgggtaacaagtggtctacaatagcaaagtacttgtcgggtagaactgataacgagattaagaattactggagaactcacttcgggaagagggagagatccaaacacaagaagaagctgcaaaggccaaaagtgaaaagggtgcttaaacaattgaaacacaagcaacaacaggaacaacaacctcaagagtatgatattaaaagcatcatgtctcatgaagagaccgtaaacgaaacaaaatcctttgagacacaaaattgtaagcaacaagaaatgggcttcatgtatccaacaacagagcaccaatataccgttcctaattccctgcatgagggattctcgtccacgtggcaagacagtactctagtggatgatgactcatggtttagtttatgggactttgatgaaccacaaggtttttctgattatgttgaccagtttagcaaatgtgccatgccaaatcaagctacctttcgagttggaggggattattccatgcaaaatgatgttaaaacttctcgttttgatgatgcatacgataacgacctcttctacggaaaagacatgtttggatga

SEQ ID NO: 60416 - DNA, 201 bp, Glycine max
  Peptide Sequence Number=SeqID_177194
atggagtcactagtgatagaaaaagaggagtttaagagtgaaaaggatgtttttgagagaggtgtttctaagtgggtatgtagaaatagaggtgacatgctaaataatataacaagattcttcaaagagattacaatgagtaattttgctagtaaatttggattgagcactattgagaaatttgaagtgataaatatttga

SEQ ID NO: 60417 - DNA, 519 bp, Glycine max
  Peptide Sequence Number=SeqID_177195
atggcacgttgcagtgaagttgttgcaaaatacgcacaagaaatgagaacactaggagtcaaaattttggagcttgatagtccattattgctagctcatcactacccgccttgcccagaaccaagtttaactttgggagctcctaagcaccgagatccagaccttgctaccgttcttcttcaagaaaaagatataaatgcacttcaagtcttcaaagatggggaatggattgttgttgaaccaattccttatgcttttgtggttaacattagccttatgttgcagatcattagcaatggaaggttcatcggtgctgaacaccgtgtcgtcacaaattcaggcattgcgaggaccactgttgcatattttatccgtccaacaaatgaacagattatagaacctgcaaagctttggttaagttctggtgctcgccccatctacagctccattacatttgaagagttcgtgagaaatttcatgagcaagggtcctgacattgaacaagaattgctcttataa

SEQ ID NO: 60418 - DNA, 129 bp, Glycine max
  Peptide Sequence Number=SeqID_177196
atggtggcgtggtgggaacaaaaggttaaagggaacaagggtgatgttgaaaaagccgaaatggtgatgactgatgaagtaaaaataggaggtgttgttaataacaaaaatagatggtgtaaaaagtag

SEQ ID NO: 60419 - DNA, 345 bp, Glycine max
  Peptide Sequence Number=SeqID_177197
atggttccagccccctcattcaagtatgttctcttcttttgttgtacttttgcctttaacttgttatccactcctgtccgtgccctcaacataggagctgaaaccactggagtcgctgtctctgtgggcaaagagtgcagtagacaatgtgagtcaagtttctgctcagatgactacctaagccaagagtgcagccaaacattcataaattgtatgaataactttaagaactcaaaggctcctacattcaaaggaaacacgtgcgatgtggatgatgttattgaagttatacatgttgtgatggaagctgctttactggctggaagagttctccacaagccatag

SEQ ID NO: 60420 - DNA, 249 bp, Glycine max
  Peptide Sequence Number=SeqID_177198
atggttgtgatacatgagaaaagactaaggaaatgcctcacaaaattgaaagggatagagaaggtggaagtggattgtaacagccagcaggttgtggtgacgagatacgcacacaagaacaaaatcctgaaagcaatgagaaaatctggtctcaaggctgatttcttgtatgctcaaaatgacttgcttaatgcttatgtcagtgctagttatgccaacctccgatttaacaacttcagcatcttctag

SEQ ID NO: 60421 - DNA, 1320 bp, Glycine max
  Peptide Sequence Number=SeqID_177199
atgggagaagaagaagaatcagctctcctcctctcccgcagcaagcgttcttcttccacattcacttattgcattctcctcttgatcgcttccatgttcctcctcgccgtctacttctcctcctcagcaaccgccaagctccaccaccccgtggtgatcctcatttcctccgacggcttccgtttcgggtaccagttcaaggcccccactccgaacatccgccgtctgatccaagacggcaccgaggccgagagcggcctcatccctgtcttccccaccctcaccttccccaaccactactccatcgtcaccggcctctaccctccccaccacggcatcgtcaacaacgtcttcttcgaccccctcaccggccaacaattcaccatgcaaagccacgagcccaagtggtggctcgcccaacccctctgggagaccgtcctcctcaacaacctctccgccgccacctacttctggcctggctccgaggttcacaaaggcccctggacttgccctacagccttttgtcaaccctacaacggatctgtcccctttcaggacagagtagacactgttctcaactatttcgatttaccctctcatcaaattccttcttttattactctctattttgaggaccctgaccatcagggtcaccgggttggtcctgatgattctgaaatcactcaatccgttgccagaattgatgccattatagggagcctcattcagggtttggaacaaagaggggtttttcaggatgttcatattatcatggttggtgaccatggcatggttggtacctgcgatacaaagcttgtctttttggatgatttggcgccttggatccagattccacgagattgggtccagtattttactccaatactctctattcgtcctcctccttctgttgatccggcacatgttgttgctaagatgaatgaagggttgaattcgggaaaagttgagaatggggccaaattgaaggtttatttgaaggaggatttgcctgagaggcttcattactcggacagtgatcggattccgcccataattggtttggcggatgagggttttaaggttgagcagaacagaactggtaagaaggaatgtggcggtgcacatggttatgacaacgcctttttctcaatgaggactatatttattggacatggtcctaggtttgcaagagggaagaagataccctcctttgagaatgttcagatttataatttggttacttccattcttgacatcaagggtgcgcctaataatggctctgactcgtttccggattctgttcttctgcctcctgcatga

SEQ ID NO: 60422 - DNA, 249 bp, Glycine max
  Peptide Sequence Number=SeqID_177200
atgtttcagttcaccaggttgtctcttgcctgcccgtggattcagcagcagttcgaaaggttgacctatatcgggaatccccggatctacgcttattttcaaactccccgaagcatttcgtcgcttactacgcccttcctcgtctctgggtgcctaggatccagctacaggagaaccgggaacggagagcttcccccgccccccttttttttccgcccgactcttgctcttaagaatactggtttttaa

SEQ ID NO: 60423 - DNA, 208 bp, Glycine max
  Peptide Sequence Number=SeqID_177201
atggacgttgataagatccttccatctagcagcaccttaggatggcatagccttaaagttaagggcgaggcacccagagacgaggaagggcgtagtaagcgacgaaatgcttcggggagtttgaaaataagcgtagatccggggattcccgatataggtcaacctttcgaactgctgctgaatccacgggcaggcaagagacaacctg

SEQ ID NO: 60424 - DNA, 402 bp, Glycine max
  Peptide Sequence Number=SeqID_177202
atggagggggaaagcgaattcaaaagccaggacatgatgagagtgttgcatctctcccagagtaaaaagacatgggaggacaacaggcagagctctgataccataaaacgaataaagacaagagagaagatattcaagacgctaagatcattagcaaatggaagactcattgctgctaaacacctggttatcacaaattcaagcaatacgagacacaatgttgtctatttcgttaacccaacaaaagaatcccttatagaacctgcaaagcctctgataagtttaacatctccagtgttcagatccatgacttttggggaggctaatgacctcatatgtattgataacgtgaaatcaactaagggattggattgtgtgaaatacaaattctccgatgcttaa

SEQ ID NO: 60425 - DNA, 370 bp, Glycine max
  Peptide Sequence Number=SeqID_177203
tgcagttcagtacgcaaaacagaggcgcaatcggcgacggtggcgtacagcagcagcggtggtgcagcgtgaacgtccggcggttgcaaacgggtcagaagcaatcctcaaagggacgacgacggcggcctgccgcaatgccttcgacggctccggtggggacctgcgatgttcgacgcggcctagagcggcgttcgacggggcctggtggtcctgcgactctgcgacggcggtgcgacctcactgggttttacacattcatgaacaaaatagtcatttacactgtgcccaatttgacaaagtggcaccaagaagtaacaaggcaagttttgcaattttgaacgtacaaccttctggtccttctggttaa

SEQ ID NO: 60426 - DNA, 324 bp, Glycine max
  Peptide Sequence Number=SeqID_177204
atgcatgaaattatgcagtcaggaactagattctcttgccgccagggaggaaaatttgggaaggtacccgaagtcattacaattaagatagaaaggttgcactggcgtagacatcgttatatccgtcgaatgtcacgaacattggttgttttggtgcagctccgccaaggtcgggtcgagaactcattccaaaaggcaattgtgactaattcttctggaaaagactttatgatacacttataccacaattacggaaaagctttttttgtaaataattattattcagaatggttcaacaaggattctgaaatagctactccgtga

SEQ ID NO: 60427 - DNA, 1176 bp, Glycine max
  Peptide Sequence Number=SeqID_177205
atggaaggcaagacaaggggttgttcttcaagtgaagatagtgatggtgagatctatttgcaaaatgcaagtgatgaagaggagcttggctcttcatctggttctatgcccaagttgcagttcaggaacgtgaaatccaaaggctgttggaatgaagaaatgggaatgggagaagtcattgagaagaatggcaaaatgtggataacaactggaattgttcgcagtggcaagatttattcttcaattgaagagactttgtatcttatggaactaggagccttagatatcgtagataatgatggtagaagcatatctttaacagaaatgtatgaaaaggttgctagcgggaagagtggatgttgttgggagctgtttgaggtttacaggcacctcaagtctcttggctacattattggccggcatggtgttgcttggagtttgaagagtattaaaagttcccataaagctgctgctgttgaagtcacagaagaaagcaaacaactagaagacactgattctaaatcagagctttccatcaataagttatgggtcttgctaaccagtgctcttaggacattggttaagaaactaaaaggagaaagtatttatgtagaaatcataggagagcgtaaaaaaagtcatgaacaatgcaattttgtgcattccaataaaaacatttctccttttagttttctagccaatgcggtacaggcactagttagcacatgccataagttatttggagagttgcaggaattcatggtggcagacatgctacttcattgtgtgacatgtgggaggcaatgtggctatgttatttctcaaagtagaatacttagaattgataaaggcattgtacctgtctgttctctgataggatttaaaggtgatagccatttgggacttggaggaatagttctaattcctgggggagcaagtgtgaatgagcaactagttgttttatatcatgtatctcctgttagggttcaaaatccaccatctagagcagagattgaagcccttgagaaacaatgtggtggcatccctttgaaaatctgcctggtcacagagggaaggcttgtaggatccaatgatgtgcaagaaagctgcagaagctgtggtaaagtgatcaagcaaatgggctcaacttctaaaattcgattcttgtcaaactga

SEQ ID NO: 60428 - DNA, 186 bp, Glycine max
  Peptide Sequence Number=SeqID_177206
atgcctgcggatgtaaagatacatgaaagccctaaggatccaaatggaagctgcaagatctatacaagtagtgcaagaaccaccaaagacgtggttgaatattggaaagacacattatcacacccatgtcaaccttctggagaattcaaggattattggcccgagaaacctgttggataccgttga

SEQ ID NO: 60429 - DNA, 906 bp, Glycine max
  Peptide Sequence Number=SeqID_177207
atgaccaattttgttggactaaggttgcacacgaggttgccattgccagtgttgggtgatgtttctgccactgccacttccactactctgtcaagagcagtattaaagaagtggaattggagagttaagggtcctcgtcgtatgctattgggccttggggtttccttcttgtctatggctggtagcaaatccttcattgccttggctaggataacggctggtccctctgtggatgagatactgaagaatgtcgaatggcccgaccagttcccctttaaggaggaggatttccagcgcttcgatgagacaccggattccttgttctatgaagctcctcgatttgtgacacacattgatgatcctgcaattgctgctctgactaagtattactccaaagttttcccacctagcaacactcctggagtaagcattttggatatgtgtagcagttgggtcagccattttccatcaggatacaagcaagaactagtggtgggattaggcatgaatgaagaagagctgaaggggaacccagttctcacagagtatgctgtgcaagacttaaatgtgaacacaaaactcccatttgcggataactcttttgacatcatcactaatgtggtgagtgttgattaccttacaaagcctcttgatgttttcaaggagatgtgcaggatacttaaaccaggtggactggccataatgagcttttcaaaccgatgcttctggacaaaagccatttctatatggacatcaactggggatgctgatcatgttatgattgttgggtcatatttccattatgctggaggatttgaacctcctcaggctgtggatatatctcctaatcctggacgctcagatcctatgtacattgtgtactctaggaagctctctactgcttga

SEQ ID NO: 60430 - DNA, 189 bp, Glycine max
  Peptide Sequence Number=SeqID_177208
atgaaggaaagaggatcaaacccaaccccttttgtaacggcggaagaggtcttctgtttgagcatttttgaaggcactgcatgcaatgagatagacccagatgattgtagcagagctggctctggtcattgctccacaagtagcaatctgggtctaccattggattcacaggatttatccacagtatag

SEQ ID NO: 60431 - DNA, 1044 bp, Glycine max
  Peptide Sequence Number=SeqID_177209
atgaagattttcgggccgctgtacgagcgggcgatgaagtgggcggcgcacgaacgcgcgccgacctacctgacggtgttgagcttcttcgaggcgatcatcttcccggtgatgccggaagtgatgctggcaccgatgtgcgtggcccagcccaagcgaggctggtggttcgccaccctcagcctggccggctcgatggtcggtgcattggtcggctacgcgctgggtcactacgcattcgaggcgatcaagccgctgttcgaagcgctgggcatgctgccggcgatcgagcagggcatcaccaccgtgcaggcgaagatggccgagtcgccgtgggcggtgttcaccttcctggtgctgggcggcttcatgcccatcccgatgaaggtcttcacgtgggcatcgggtatcgtcggcgtaccgatgccgcagtacctgttgagcatgctgatcggtcgtggcaagcgcgtgttcgtgctggccgcggtcatccgtatcggtggtgcgcgtgccgaagcggcattgcgtcgctggattgaaccgctgggctggatcgccaccgcgttggtggtcgaagttcgcatgagtcctgatcgtctgagcaagggagtgcgcatcggcgcgctggcgttgctggtttccaccctggccgcctgcggcaccgccaccgtggtccgtcccggtggtggcagtgccgccggtggcgtgaccacgccgaagacttcggtgcccaagcccgggcagaccgtggtggtgcgcaagggcgacaccatctatgcgctggcccgcatccatgacatcacgccggccgacctgattgcctggaatcgtctggacaacccttcgaccatctaccccggccaggtgatccgcctgtatccgcagggggccaccatcggccgtgcgccgaccacggtggtcaccccgccgcgttcggctggcagcagtggcggcagcaccgcgccggccccggcgccggtcgggccggtgaagagcaacatcgcctggcgctggccagccgatggcgcgatcgtcggccgctac

SEQ ID NO: 60432 - DNA, 267 bp, Glycine max
  Peptide Sequence Number=SeqID_177210
atggcccggcaatgccctggatcacacctactctgtagcgcccgagcccatgctcgggcggcgccgcgtcgcggcgcggcgcggaaagccgccgggcgtgacccggcgctacccgatcacactgtgatcagcgtgccggcagatactgctgcgggtcgaccggcttgccgttgtaacgaatctcgaagtggaccatgtcgcggatcgcaccggtacagcccatttcggcgatctgctcgccagccttcacgctctgtccttcattga

SEQ ID NO: 60433 - DNA, 558 bp, Glycine max
  Peptide Sequence Number=SeqID_177211
atgaaggcggcggcgaccttgcggcctttgccagccaggatgttgaaggtgcgtgcggcggccggattgttcatcacttccaggccgatgccgcgtgacaggcaggcggccatcaccaccgccggcgggaacacctggcggtcaccggtcggccagctgcagttcggtggcctgcttcaccggccagcgctcgaccagctggtccggggtcaggaagaagctgctgcccagcaccagctcgttgacccgggccgagcggccatcggcggcgcgcaggctgtaggccacggcgacgtggccgatgcgctgcaccagcgcgctttcggtggcttcgacgatctcgccgatcatcacgtcacgggcgtcgcggtcttcggcagcgaccttcaccttgaccagctcgtggcgctccagcacttcgttcagctcagcgatgaaggccggggtcacacccttgccgccggtctgcagcagggccttcaggtcgtgggcttggccgcgcaggaaacgggtctgggaagcggtcagggcgatggacatgcaggaaaacacggttga

SEQ ID NO: 60434 - DNA, 300 bp, Glycine max
  Peptide Sequence Number=SeqID_177212
atggggttctttctgattgagaaccatgaaattgacaaaaacctgatggaaaaggtgaaggagctaattaatattcactatgaggagaacctgaaggaaggtttctaccagtccgagatagcaaagaccttggagaaaaaacagaacacctctgatatagattgggaaagtgccttcttcatttggcaccgtcccacttccaacattaagaaaatcacaaacatctcacaggagctttggttagtcaactcaacctgggtgacttctaatgtagagaaatgctggcaatatattttctga

SEQ ID NO: 60435 - DNA, 372 bp, Glycine max
  Peptide Sequence Number=SeqID_177213
atggcggaagaaccgaaagttccaccaccttctgatcctccgttaccgtttgatcctagtcggatgattggtatcatcaagaggaaggccttgatcaaagacttagctgcggtataccatgctgaatgccttgcatactgtcaagagcttttggaacttcaaactaaatgggaagagtggttttactatgcgttatctcttctaaagtgtaccaacgcacttgagagaagccaaccatttattgacttaaaaactccagaggaatcaaaaaaggagacagcacgaccctccaaacgtattgttgaacatcagcccaagttcattaagggtgggtgcagattcagtgagaccttcatgctccgatttccttag

SEQ ID NO: 60436 - DNA, 657 bp, Glycine max
  Peptide Sequence Number=SeqID_177214
atgggcaacgagaggttggatacgaattacgtggttccccaatggatgccacaatttaagtgcagaagtgaagctcgaactctgattgttttggatgatgtgtggacactctccgtggtggatcagcttatgtgtagaataccaggttgcaagtttcttgtgaaatcaattcctttagctgctaatgagaatttggtcaagcaggctgtgactgaatgtggaaggcttcccttggctcttaaggataagaaaatccctctggatgttctcatcaatatgtgggtggaaatccatgatattcctgaaacaaaagcttatgccattgtgattgagctctccaaaaaaaaaaatctcctcaccttattgaaaaaggctcgagctacaggcacgtatagcagttgctttgagatcttagttactcaacatgatgaactgagagacctgacccttaatttgagaaaccatgagagcattgatgaacgccgactatttgttatgtcgaaaagagagaatggaatgcctaaagagtggttgatatacaggcacaagtcatttgaggctcagattgtttcaattcacacaggtgaaatgaaggaagtggattgttctaatttgaaatttccaaaggctgaagtgttgaccataactacaacttga

SEQ ID NO: 60437 - DNA, 282 bp, Glycine max
  Peptide Sequence Number=SeqID_177215
atggaagaagagagggggaggggtcactggatggagggaggtacaaatgaaaacttggttaacggggctcacaactttgttttggtacgtaccaaggtacgatattccctcgagggggtaacatgcaatcaggcatcattttccattgttgtttgtggcacaagcgcagccccactagttagttcctttgagcttcatcatcctcaatgtgaccaagcagacaccggatcacatgggttttggtactccttttctaacataaggttacctattgtggactga

SEQ ID NO: 60438 - DNA, 1282 bp, Glycine max
  Peptide Sequence Number=SeqID_177216
ccttcaaattcaaataacccttttatgattcccggtgttaggtactctaacggaaagatgaggaaaataattgcaactgctatcatggttcatgaatatccttttagtgttgttgaggattctatttggatgtgggcctttcaatatgcaaaccctagttttcataagaaatctagccatcaagtagttgaatatatggttattactggacatttcatcgacgcaggatggaatcttcaaaaaagagttttaagttttgtgaaagtgcctgctccaaggcatggtattgatgttgctgatgctatttttaagtgtttgaaaacttgggggattgaaaataaagttttttcaatatctgtggataatgcttcttgcaatgactcatgcataagatgtctcaaagagaatatatctctaagtagtaagttattccttggtggctctttgtttcatgttagatgttgtgctcacatattgaatttgttagtgcaagatgaccttagtacaattaaggatatcattttcaatattagtgaaagtgtcaaatatattaaccacaacgatgcaagactaaaggcattttgtgatgttgttgagcaaaaacgcttgaaagaaaggaaacttgtcattgattgtccaacaagatggaattcaacctttaatatgttgtcaactgctttgaaatttatgactgcatttgcttcttacaaagaaagaaagtctcactataattatgcaccttcacttgaggagtggaatcaagttgagaaagtttgtaagctgctggaagtttttaatcttgctactcatgtcatctcaggtagtgagtatctgactgcaaatttgtatttggcagaagtttggaaggttaaacaaatacttgataaggagattgaagatgaagatctcttcatgagggaaatgtgcaaatttcatatggtgagtatatgttttcccttgatatattctaaagaagttgctggtgagaatataaagaaggtgaaaagttcatttgaagaattgtatgatgagtatgtagttgtcactggttttgacgaaattatgagcatgctacatgaaaaggaagttatttctcctataaaatcagaattgcaagattatcttggtgaaggtatttatgttcctaaaactaattcctttagtgctttggactggtggaggaacaatagcataaaacataagatattgtctaagatggttgctgatacactagctattccaatttcaattgtgacatcggagttcatatttagtgctggag

SEQ ID NO: 60439 - DNA, 1395 bp, Glycine max
  Peptide Sequence Number=SeqID_177217
atggctttgttcatagtggttcttgttgttgttgccttggtgctctgtttttgcactgctctcttgaagtggaatgaagtgaggtataggaggaaaggtttgcctcaaggcacaatggggtggcctgtttttggggagacaactgaatttcttaagcaaggtccaaacttcatgaagaacaagagagcaaggtatggcagttttttcaaatcccacatcctggggtgtcctaccattgtatccatggatccagagcttaatagatacatactcatgaatgaagcaaaagggcttgttccagggtacccacaatccatgttagatattttaggcacacgcaatattgcagccgttcatggctccactcacaagtacatgagaggagcacttctttcaatcattagccccaccttgatcagagacctgcttttaccaaaaattgatgagttcatgagaacccacttgagtgattgggagaacaaagtcattaacatccaagagaaaactaaagagatggcatttctctcttccctgaagcagatttctggtatggaatccagctcaatttctcaacccttcatgaccgagttttttaaactagttttaggaactctatctttgcctattaaccttcctggcacaaattattgccgtggattgcaggcaagaaagagtattatcagcattcttagtcagctgctagaggaaaggaaattatctcaagaagcccacgtagacatgcttggttgcttgatgaatagagaggaaaatcgatacaaactaactgatgaggaaatcattgatctaattattacaattatgtattctggttatgaaactgtttcaactacatcaatgatggcactaaagtatctccatgaccatcccaaagttcttgaagaaataagaaaagagcattttgccatcagggaaaggaaaaagccagaggatccaattgatggtaatgatctcaaatcaatgaggtttactcgtgcggtgatttttgagacctcgagattagctacaacagttaatggggttctaagaaaaacaactcatgacatggaactaaacggctatttgattcctaaagggtggaggatatatgtatatacgagagagatcaattatgatccatttctgtatcatgatccactagcattcaacccatggagatggctgggtaacagtctagagtcacaaagccacttcttgatatttggaggagggaccagacaatgtcctgggaaggagttggggatagcagaaatttccactttcttacactactttgtaactagatacaggtgggaagaagtaggaggaggtaaactaatgaaattccctagagttgtggcaccaaatggactgcacataagggtctcgccttactaa

SEQ ID NO: 60440 - DNA, 2178 bp, Glycine max
  Peptide Sequence Number=SeqID_177218
atgatagtgcgtattgttgttattggaacaggtgtgaggtgtctcatctcagctggaattttgcttggtctgtctgtacgtctctgcttccactccctcacatcgcacacttttccgaatttcgattcaatggatccatcatcgtcaccactccgccaaaacgacgtcgcttccttcgaccgccaaacttcttctagaatatacttgcactcctcctcttccgacgacgacgtttcgccctcccactctatccaatccaccaaccgccgtctcgattacatgctccagttcctcgaccggaagctctcctccgaccacgcccaccgccgccactcatccggctcccgcgccgcgcaactgccggagttcgtcgcgaagggcggcggcgctggcatcttccgcctccctgctcgcggcgcggtgcacccggcgcggccgccgagccttgaactgcggccgcacccgctgcgagagactcagattggacgtttcctgaggaacattgtttccaccgagtcgcagctatgggcggcttcggagtgcggggtaagattctggaacttcaaggatctgtacgcgtcgtggtgcggcgtaggagaagaagaaggagtggttgcgaggaacggcgacgaggagagtgcgccgtttcgagagtcggtgtggacctcaccaacgttgtgtttggttgcggatgaggggaacaggttggtttggagtggacataaggatgggaagattaggtgctggaagatggatgatgatgacgatgataacaacaacaacaactgcgattggagcaatcggtttacggaaagcttgtcttggcatgctcaccgtggacctgttctttcccttaccttcacctcttacggggatctgtggtcgggttcagaaggaggaggtataaaaatatggcctttggaggctgttgaaaaatctattcatcttacaaaggaggaaaggcacagtgctgccatatttgtggagaggtcctatgttgacttgaggagccagctatctacaaatggcttcagtaacatgctaacttcagatgtaaagtacttagtatctgataattcgagagcaaagtgcttgttaaattgtagggatgctcgtacaagagagctactgaaagttttcaattcagatggacagattgagaatcggttggatgtgtcctcaattcaagacttttcagtggagcttatttcaagttcaaggaaagacaaaacacaaagttccattgggttctttcagcgttcacgtaatgccataatgggggcagcagatgctgttcgtcgagttgcagcaaagggaggctttggggatgataaccggagaactgaagcactagtggtaacaatagatggaatgatttggacagggtgtacaagtggcttactggtgcaatgggatggaaatggcaatcgcatacaagattttctctaccattcatcttccattcagtgtttttgtacttttggcatgcaaatttgggtaggctatgtgtctggcactgtccaggtattggacctcaagggtagtctgattgggggatgggtggctcatggcagtccaattgtaaaaatgacagttggcgctggttatgtatttgcattggctaaccatggtggcattcgtggatggaacatcacctccccaggacctcttgatagcatattgcgttcagaattgggtggcaaagaatttttatatactaaaatagaaaatataaaaatattgagtggtacctggaatgttggacaaggaaaagcatctctagattcccttacttcatggctaggttctgtggcctcagatgttagccttgttgttgttgggttgcaagaggttgaaatgggtgctggatttcttgcaatgtctgcagctaaagaaacggtaggattggagggaagttctgttgggcagtggtggctggatatgatagacaaaacattagatgaaggttcaacatttgaacgtattggatccaggcaacttgctggcttggtcattgctgtgtgggttaaaaccaacattagatttcatgttggggatgtcgaagtggcagcagttccatgtggctttggacgtgctattggcaataagtttctcatgatcacggatctcgtaattgtcagctttggtttcattgaacagtctaacaaggatatttaa

SEQ ID NO: 60441 - DNA, 537 bp, Glycine max
  Peptide Sequence Number=SeqID_177219
atggcttccttactacagaaagctttcggctctgaaatctcttcgtttatataccgcctttttatctatcaaaatcataacaaaggcattcctaggaacttcaagatgccaaagaagggtcgaccactttccttgcagaccgtagagctgaaagtaaggatgtgctgcactggctgcgagagagttgttaaaaacgccatttacaaactcaaaggcattgattcagtggaggtggacttagagatggaaagggtgagggtaggtgggtatgttgacaggaacaaggtgcttaaggctgtgaggagggccgggaagagggcagaattctggccttaccctaatcctccactttacttcacaagtgctgaccattacttcaaggacaccacccatgagttcaaagaaagctacaactactatagacatggctacaacctcccagagaggcacggcaccatgcatgtgtctcaccgtggagatgacaatgttagcaacatgttcaatgatgataatgtcaatgcctgccatatcatgtaa

SEQ ID NO: 60442 - DNA, 251 bp, Glycine max
  Peptide Sequence Number=SeqID_177220
atgtcaattgctatattgagagctttcatttcaaaacggaagcaagaacatgaagcaatgctgtacaagagaacaaaagcagcccaaaaagtatccgaaaatggcatttctgaacctgttatggaggatggagctcacgcatttctgccaaaagaatgtgatgaggtatctatggaagaaccgtgcagcacaacagaagaatgcgatgctgtgggagagtcaatcgacatttcatatggaaaagttcatag

SEQ ID NO: 60443 - DNA, 2049 bp, Glycine max
  Peptide Sequence Number=SeqID_177221
atctattctgctggaagagaccccattttctattctcaccatgccaacgtcgataggatgtggaacatatggaaaacaataccaactggaaaaagaagggatttcaaaaaccgtgattggttggaaaccacctttttcttctacgatgagaacaagaaccttgtgagtgtgaaagtgaaagattcccttgactcgaaaaagatggggtatgtttaccaagatgttgacattccatggctccagaaaaggactaaacccaaaagaactagaaaagctaagcaggtggcgttcacacaacagtttggcggcattggtgcagcaatcgctgctgagactgggccaagttccaagtttcctctcactttattggactcaaaggtaactctacttgttaaaaggccaaagcagttgaggagcaagaaggacaaggaggaagacgaagaagtgttggtgattgatgggatcgagtttgatggggatgatgatgtcaagtttgatgtgtatattactgatgaagatgtcgaggagattggaccagagaacacggagtttgctggaagctttgcgactctgggtcattcccattcaaacatgaacatggacaagaagatcaaaactagtttgacactgggaataacggatttgttagaggacttggatgccgaaaatgatgatagtattttggtgacattggtaccacgatctgagaatgtaaccatcacaattcagagcatcaagatagagtttgagaaggaggagaggcatgttctccttggcggaggcatttacgatgcttctactcttagcaacaccatcaacaaccctttagccatcgctgctccatttcaaccacccaaactagaaaattgtgttgaaacagatgatgtaccagggggattgagaaacaactcaattgttgcccaccataaccttcttccaagcctatcagctgctcaattcttcaacaaagactatctagagaagtatgagaaagcccttacgcgcatgaaagcccttccacctgatgatcctcgaagtttcatacaacaagcaaacatccattgtgcatactgtgatggtggctataaacaagttgagttccctaagcttgacttcaaagtccacaactcgtggctattcttccctttccacctttggtacctttatttctatgagaaaatcttggggaaattgatcgatgacccaacctttgctcttaggttttggaactggaacaaccctgatgtggcatgggataaaatccaccaaccccctactctcgtagacctaaactatagcaaaaacaatgacggcagtgcaaatgtagaaaacaacctctgtgtagtgtataagagtgttgtttcttgtgggaaaaccccatcagtcttcctcggaaaacctttccatcctggagaggagcctaataatagtgctggttctgtagagagtgttcctcacactcctgtgcacatttggactggcgatagaaatcaacctaacggtgaggacatgggaagattctattctgctggaagagaccccattttctattctcaccatgccaatgtggataggatgttgaacatttcgaaaacaatcaaaggtgggaaaagaagggatgtcactgaccctgattggttagaaaccgcgttttacttctacgatgagaacaagaaccttgtgcgtgtgacgataaaagatagcctcgacaccaaaaaactagggtacgtttaccaggatgttgacattccatggctcaacaaaaagccaaaacccaaaaaatctagaaaagctaagaaggccgctgaagctaggccaagcgtcaagtttcctctcactttgaattcaaagaggtcgaagccgcgctcctggaacgagaatgaagaagaagaaaaaggcgtagaagaggtgttagtgatagatgttgagtatgatagcactgatggtgtgaggtttgatgtgttcatcaacaaccaaggcgacaatgagattggaccccaagattcagagtttgcgggaagctttgtaactttgcctcactcgccgcat

SEQ ID NO: 60444 - DNA, 150 bp, Glycine max
  Peptide Sequence Number=SeqID_177222
atgtctgtttataaggtcttgagaatattctcaaggttggggaagctgagagagcttgggaacctggttggatggagcagggttgatgctagggtgactgtcatcgtcgagtctgggtggggtgggggagttgggggtttagttgggtga

SEQ ID NO: 60445 - DNA, 1599 bp, Glycine max
  Peptide Sequence Number=SeqID_177223
atggtaacttcacagtatggtgaggctaagccatcagagacaaatacaccttcaaacactgcctttgacgtgttatgttcactcatatatgtatctcccgcctattctatggtcagtggccgttgctttaagatatgggaagttcaaaaggaaatctcatgggctctttttctacattactacacatccaattccatagcattgaggcacaacaacattgagggaatgaggcttgtcatatcagctgtatgtgttattgtgctattttcttatgctgctgcgtatgatcctttggatccaaatggaaacataacgatcaaatgggatgttgtgtcatggacaccagatggctatgtagccgtggtaacaatgagcaatttccaaatgtttcggcacatcatgaatcctggatggaccttgggatggacatgggcaaagaaggaagttatatggtccatggtaggagctcaaaccactgaacaaggagactgttctaagttcaaaggcaatgtacctcactgctgcaagaaaactcccacagttgtagacttgctccctggtgtgccttacaaccagcaattctcaaactgttgcaagggtggagtggtggcagcatggggccaagacccttcatcagcagtttcatccttccaagtgagtattgggttagctggtacttcaaacaagacagttaaactccccaagaacttcactctcttgggtccaggaccaggctacacttgtggccctgccaaggttgttccttccaccgttttccttacacctgacaagcgccgcaagactcaagcactaatgacatggaatgttacttgcacatactcacaatttctggctagaaagaacccgggttgctgtgtatctttgtcatccttctacaatgagaccattaccccttgccccacttgtgcctgtggctgccagaacaagaggaactgtgtcaagagtaactctaaacgtatcaacatggtggggattcacactccaaagaaagacaatgaaccattgctacaatgcactcatcatatgtgcccaataagggtacactggcacgtgaagctcaactataaggactattggcgagtcaaggttgccgtgacaaatttcaactacaggatgaattactccctctggactcttgctgttcagcatccaaatcttaacaatgtcacccaagttttcagctttgattacaagcctttacttccctatgagtccataaatgacactggtatgttctatggcatgaaatactttaatgatctcttaatggaagctggaccaactgggaatgttcaatcagaaattcttcttcagaagaaccaggatacattcacattcaagcaggggtgggcatttcctcgcaaggtctactttaatggtgaggaatgcatgcttccaccacctgatagctacccaatcctccctaattctgcccctgtgaacctattaaacttcccagcattcgttttgacaatgcttgtcatgataactaatcttacggaattgcttgaaaaaaaccaagcccgactcatgaatgtgtgtgttgtgattcacaagtgcttatcagatgctgaatag

SEQ ID NO: 60446 - DNA, 1182 bp, Glycine max
  Peptide Sequence Number=SeqID_177224
atgggcttctttctgttaccaaaagcaactccttgcattttgttcttggctctgctgtcttgtacttgctttacttctacagatgcttatgatccactcgacccaaatgggaatatcacaatcaaatgggatattataagttggaccccagatggatatgtggctgttgttacgatgaacaacttccaacaatatcgtcatatcgcttcacctggctggtcaatgggatggacatgggcaaaaaaggaggtaatatggagcatgatgggagggcagaccactgaacaaggggattgttcaaaatttaagggaggcattccacattgctgtaagaaagatccgacggttgtagatttgctacctggaacaccttacaatcaacaaattgcaaattgctgcaaaggtggggtgctcagttcatgggtgcaggatccaaccaatgcagtttcctcatttcaagtcagtgttggtagagctggaaccacaaatagaactgtcaaagtcccaaaaaacttcaccttgaaagcaccaggaccaggttatacttgtgggccagctaagattgtggcacccactaaattcattacttcagacaaaaggagagtgacccaagcactgaatacaccacatttggcatcagttgttgctggctctgggaagaataacttttcacctttggttcaatgtactcatcatatgtgcccagtcagtatccactggcatgttaagcttaactacaaggagtactggcgtgtgaaggttactattactaattataattacaggatgaattattctgaatggaacatggttgttcaacatccaaactttgacaatctgactcaactgttcagtttcaactacaagtcattgactccttatggttcaataaatgatactgcaatgctgtggggagttaagttctataatgattttctaaaccaagctggccctaatggcaatgttcaatcagagctactcttccgaaaggataaagcaacttttacttttgataagggttgggcttttcctcgaaggatctacttcaacggtgacaactgtgtaatgccaccacctgatgcttatccgtggttaccgaatgctggtgctaggcaagaggtttccttgtttgctttagtgatagcatctttggtagccttggtattttatgcacccgcataa

SEQ ID NO: 60447 - DNA, 240 bp, Glycine max
  Peptide Sequence Number=SeqID_177225
atggcacgcaacgtgtttgcttcgtgcccctattataggaacctacatggaaggaaactaaaagggcttttagtgataattcccaaggtggtcatatctctcttgatggtctctttaggtatcatccccttcgaagaacatattgcggcagtaaggactactagcaccaatacgttatcaaagagaaaaaactctagactagggttcactgttatcaagcaagtcggagacctagcatga

SEQ ID NO: 60448 - DNA, 417 bp, Glycine max
  Peptide Sequence Number=SeqID_177226
atgtttatcattcacgtagtgcagtttcaccgaggaattgccgctcgtgcgtcttctcccctacgagaaacgaagggaaagaaacaatcagatagagaaactaaggaacaaagaacagagaacagagaaaacagagagagaaatctgggaaggaaagaggcgctcatcgatgtgaacggtgatgatgttggagaaacgcgcggcgaggagatggatgaagaggttaggggagcccgaggcgtcgatgcggatggtggcgcgtgtgaagcgctcgaggctggacttcgagtccaggcggctgaatggccctttttgggtctcataaactgccctcacgacatttcttgcagctggaagatagatagaaatgtacaagtgagaaaaggaagcataatcagcgattcaaggaaggtttaa

SEQ ID NO: 60449 - DNA, 243 bp, Glycine max
  Peptide Sequence Number=SeqID_177227
atgaactgtattctaattaataaatttgatgacaaagatttaagtgatgatggtgttgttagatctgatgacaatcacagtgaagacgacagtgatgttggttgcaagcatggagctgaagaggaacatgaaactaatataggtgatttgacagggagcacacaaaggttctgcattgcggcagtgaagaacatgcttttgatttctatactagatatgccagatgtcatgggtttgatgtga

SEQ ID NO: 60450 - DNA, 219 bp, Glycine max
  Peptide Sequence Number=SeqID_177228
atggatatagacaacattttcaatatattgaagcctttgatcaactttggtgtcatccatgcgaggtctagccaagaacgttgcatccaccatagtcaaggcaatgccatgccctttgccatggcacttggcaaaaactcagtcatgcgaggtgggccaaactcagccatggtattcaacacaaaaagatgcagaaagagacagaatcgcgaaaaataa

SEQ ID NO: 60451 - DNA, 1698 bp, Glycine max
  Peptide Sequence Number=SeqID_177229
atggcagttcttagttctggagaattccttggggcatttcttgttttcgttgtaatccactactggaggctcaacagacacaccccaattgctaagtggcccattcttggcatgttacctggtgtattcctcaacatgcccaccatctttgattatataacttctgttttgaaacgtgaaggaggcactttcatgtttgaaggaccatgcctatcaaacatgaacataatgtttaccagcgacccaatgaatgtgcaacacatcaccagcacaaaatttcaaaactatgggaaagggaatgattttagagagatttttgaaattctgggagatgggattttcaggtccgattcccagttatggaattataacagaactatacttcattcagtttttaggaaggcaagttttcagttgtttgttcaccaaacaatcatgaacaagattgagagttgtctacttccatttcttgatcgtggatggaaagaaggaatggaagtggacctgcaagatgtattccaaaggttaacctttgacaacatctgttccattgttttaggatttgatccgaattgcctttccatggaattcccagaagttgcatgtgagaaagccttcactgaagctgaggatgctctgctctaccgacatttcaggccaaaatgtttatggaagctgatgaaatggcttcatgttggaaaagagaagaagctggaagaaagccagaaaattgttgaccaaatgttgtatacagaaatcagatccaagtgcaaagtgcaaggcgaaagcaataacagtagcaccccggtagatgagtcacagtttagcttgctaaatgttctaataaatgaagtaggaaagggaaaagcagatgacaactttctgagagacacagcaataaatctccttgcagctgggagagacaccattagttcaggtctcagttggtttttctggctggtggcaacacacccatctgtagaatctaagattcttgaagagatccgaaaaaatttaccagcaagagaaggtaattggaagaatttaggcgtggaatcgattagcaggttaacttacctccatgcagcaataagtgaagcattaaggctttatcctccaataccaattgagcacaagtgtgccttaaaatctgatatgcttcctagtggtcattggataaattcaaataccatgatactatattctctatacaccatgggaagagcagaggaaatatggggcgaagattgcttgaagtttataccagagaggtggatttctaagcaaggagggattattcacataccctcttacaagttcattgcattcaacgcaggaccaagaagttgtttgggtaaggacataagctacactgagatgaagatggttgctgtttctatattatcgaattatcatgtccacttggtggaaggccaaataatatccccaagagtttccattgtccttcatatgaaacatggcttgaagatggttgctgtttctatattatcgaattatcatgtccacttggtggaaggccacacaatatcccccggagtttccattgtccttcatatgaaacatggcttgaaggttagagtaacaaaaagaagcttctgtggtcaagagatctatgttatagtaactgattgtgttcggcttctacatgtaacgtttattagaaatgttgaagtttag

SEQ ID NO: 60452 - DNA, 282 bp, Glycine max
  Peptide Sequence Number=SeqID_177230
atgggcacttgtagccgacaagggtatagtgtcgatgacactgtatgcgaaaagtatgacattagcaaggaaaagtggatccaattttgtcagagccgcaaagacccttcgtgggaggatgtgcaaaagaaggcacatgccattcagaaacaaaacgcttcccctcatgaagctgctaaattcggaagcactgacaccgtcattgatcctccatctccccatcagacgacacatgaagtggaagatgactcaccccaagaaaactggtcaaatgacgtatga

SEQ ID NO: 60453 - DNA, 1410 bp, Glycine max
  Peptide Sequence Number=SeqID_177231
atggctgacacagtgacagtgaaggtgatagaacagtgtgaagtgggtcctccaccaggtacggttccttcaacctccatccctctcactttctacgaccttccatggttatgttgccctccactcaaacgtattttcttcttcaacttcccttattcttctcaacacttcctccaaactctccttccatctctcaagcactctctctccctcactctccaacacttcttccctttctcttccaacctcgtcttccctccaaagccaaacccccctcacatcctccacacacaagcagattccatctccttcaccgtagcagagtcctcagcagatttcaccacccttgtctctgattccccgaaacatgtcacacttttgcacccttttgttcccgtgttgcctcctcctcgtaccttgcatgatggaacttttcttatccctctcatggccattcaggtcactgttatatcccattttggcttcaccatatgtatcactttcagacatgtggctgcggatgggagagcttttcatcacttcatgaaattctgggcctctgtttgtaagtccaaaggagacttaggtttggcttcccttgctctgcccttgcacaatagggacatcattcaagacccaaaaggccttaagctcgttttcttagaagaattgtggaatttgttaccggaaaatgtagagtccaagggtgaaatacgtgatgttcctagtgacatcgtgcgtcatacgtttgtcttgagccatgaccatgttgagaaactcaagaaatgggttactattaaatgcaaaagccatggtctagaaataccacacttaacaacatttgtggtaacatgttctttgatttgggtttgtaaggtgaaatctgaagaggctgaagttggtacaatacttcccaataatgatgagtcctacatcttggcctttatggcagattgtcgtaatcgtcccgaatgttcaattccattggaatattttggaaattgtttggtttgtggaaatgctgaagtcaagaggggcaagcttgttggagaaaatggtgttgtggaggcagcccttgctattggaagtgaagttagacatttgcaacgcgaaacttttgaaggggctcaaacattgatgtcaaattttactgaattcgccacggtggggaagcatatgacaatacttgcaggctcaccaaagcttgaagtgtatcaaactgactttgggtggggaaaacccaagaggagtgaagtagttcatgtagataattcaggaacaatctccctttctgactgtagagacaaagaaggtcgaattgaagttgggttagcactgcaaaagattcaaatgaatcaattcagtaccattttggaagagcacctcacagaaattggagttcttgactga

SEQ ID NO: 60454 - DNA, 861 bp, Glycine max
  Peptide Sequence Number=SeqID_177232
atggaaccctcgtgccccatttatgacgctccttgcgacagcgacatggtgcgtcacagaattattctaagttgtgaccaagttgaacagctaaagaaatgggttggtattaaatgtgaaagcattggtctcgaggcattacacttgtcaacctttgtggtgacatgttctttgatttgggtatgtaaggtaaaatcaaaagaccttgatagtactgatgtaactgatcccaaggatgatgactgttactgcttgaatttcctagctgattgtcgaaaccgttccgagctttcagttccatccacgtactttggaaattgcttaactatttgccacgtggaacttcagagggaaaagttggtgggagaaaaatggtattttggaggcagagtgctattggaggggaagttagaggtctggggtgatcctttgaaaggttttgaatggatagtttcgggtcatcgtaggagggagctggggagaaggtcgcaaaatgtgatgataattgcagggtcaccaaagctgaatgcgtatgagactgactttgggtggggaaggcccaacatgagtgaaatacttcatgctgatgatgcaggagctatgtggctttctgattctagggaacaagaacgtggtggcattgaagttgggctagcattaagtgcctttcaaatgaagaaattcaatgctatattggaagagcaacttatagatatggacgttgttgctcctcatgaactctcaatactaaatgacaggaacactagaggaagtctgccatattcatatccagccgagtgttttcatataatctgtcagcatagctgtactgctaaaagtttaacccttgagtcagagtga

SEQ ID NO: 60455 - DNA, 1005 bp, Glycine max
  Peptide Sequence Number=SeqID_177233
atggcccagtccttcggtcagaccgagatcaactgggacaagctagataaaactagattctatgtcgtaggagctggactctttacaggtgtttcggtggcactttatcccgtttctgttgtgaaaactaggctgcaggttgccacaaaggatgctgtagagagaaatgtgttttctgttgcaaaaggactacttaaaacagacggcatccctggtttgtatagagggtttggcacagttatcactggtgcaattcctgccagaatcatattcctctccactctagagaccacaaaggtgactgccttcagaatgcttgagccatttagactatctgaaacttctcaggctgccattgcaaatggagttgcaggcatgacatcatcgctttttgctcaatctgtgtttgtaccaattgatgtggtcagccaaaagttgatggtgcaaggatactcaggccattcccaatatagtgggggtctggatgttgttcgcaaggttttaaggactgacggcatccggggattgtatcgagggtttggtctgtctgttattacttatgcacctgccagtgcagtatggtgggcaagttatggttcaagccaacgcttcatttggagattcctggatcatggtgccaaatatgatgaagtcgcacctagtatgcagaaaattatgttagttcaggctactggagggattattgctggtgcaacttcatcctgcattacaaccccattggataccatcaagacacgattacaggtaatgggacatgaaaatagaagttctataaaacaagttgccaaagatttaatcaatgaagatggttggagaggcttttatagagggtttggtccaagattttttagcatgtcagcatggggcacttcaatgatattgacttatgagtatctgagtgagaactcttcctctctaattacattttctttatgtgtatgtgcacttgtttttatattccttatgatctacattttccagtag

SEQ ID NO: 60456 - DNA, 255 bp, Glycine max
  Peptide Sequence Number=SeqID_177234
atggagagcaagtacatgtcagagtcaaagaaaaatgctcttcaaaaaacatcgtttgccaatgatcaccttaattcccttgaagaactaattggaaggttaaggaggctgaacgagaatgtggggtttgcatacctcagtgaagtcaactggcggaaggtctccctagaaacacaagatgtttgcaatttatcgttcaaaatactaaatatcggttgtccttcgaactttcagttttgcaaattagtgccataa

SEQ ID NO: 60457 - DNA, 213 bp, Glycine max
  Peptide Sequence Number=SeqID_177235
atggagtggttttttcggatatcgcactcattcgtcacgtggaccgaggagactgctgcgtcgagacatccgcctccccctcatcatgaggagttcgtcgagccacccatccccaaggtttcagtcgcgaccgatctccgtacgcattcagtggttcagtgcgaaggatgtcaggggatggctcaggatttaggagcgattgctgaggattag

SEQ ID NO: 60458 - DNA, 222 bp, Glycine max
  Peptide Sequence Number=SeqID_177236
atgtggatgacagtcgggagtaattgcaacttacggatatttcgtacacccaactcaaaaagtataatcttggagtccatcaagaatagcaaagtgaggctttgggagcagctggaacaacaaagacacgggagccgctgttgcaacagtgtggagacttcagttgcatttgcatctctgcaagccggcatcactggatattacaatgcaacattcaagtaa

SEQ ID NO: 60459 - DNA, 141 bp, Glycine max
  Peptide Sequence Number=SeqID_177237
atggttggtggctgcgcgagattgttggagaggagagaagacccttcacaaatggagaatttttacattgaaatagtggctataaagatgacaggaaataatgatggttggaaaagtaaaggtcaagtatatggtagataa

SEQ ID NO: 60460 - DNA, 813 bp, Glycine max
  Peptide Sequence Number=SeqID_177238
atggttgatcaggttcagcaccctagaatcattgagaaggttgcaggccagcagcatctccgtactggccttcctttgtaccaccagtggcgctcgtttgctaattactcaaatggtgcattgcagtatccagtgatgccagcatgcagagctgcaacagcagcctcccatgtgtttgttgcagctccttctgagaaaggacacttccttattgactttctcatgggtggagtttcagctgctgtgtccaaaactgctgctgcccccattgaacgcgttaaactcttgatccagaaccaggatgagatgatcaaagctggtagactctctgaaccctacaagggtattggtgattgttttaagagaacaatgcaggaggaaggtgttgtttccctgtggagaggtaacactgcaaatgtcatccgttatttccctactcaggccctgaactttgcattcaaggactacttcaagaggcttttcaatttcaggaaggacagggatggttactggaaatggtttgctggtaacttgggctcaggaggtgctgctggtgcctcatcccttttgtttgtatactcccttgactatgcccgtactcgtttggccaatgatgctaaggctgcaaagaagggtggagaaaggcaattcaatggtcttgttgatgtctacaagaagacattggcatctgatggtgttgctggtctgtaccgtggcttcaacatttcctgtgttggaatcattgtgtaccgtggtctctactttggaatgtatgattccttgaagcctgttctcctaactggctctttgcag

SEQ ID NO: 60461 - DNA, 500 bp, Glycine max
  Peptide Sequence Number=SeqID_177239
agactaacattgtctcccgcaccttttgtcgtcctgacccacgaagtcaggtgatatgcgggattacctcatggttacctgcacctttcatcaaaccgggggcaaacgagcccgttgacgcgaagagactgacatcgtcttctacactctttgccatccagggacatcaagtcaggtggcaggcggagataccttatggtcatcggcgcctttcgtcaatcgaggggaacgacttcgacggtatcaggatgatgttggccgttcgggacgatcgagtgcgatggcgaagggaagtgtcgtggttgttctaccttgtcgttttcaagacgctgaagggtatgcaaatagcaatcaggcccacttgggccttccaggatgttccaacagaaggcagtgcctactggtggaagcaacccagctcgcctgggcggcaaccatctcctgatgagaatcctgaaattggccaaatacaggctaaaggcccaagtggagaaggataa

SEQ ID NO: 60462 - DNA, 501 bp, Glycine max
  Peptide Sequence Number=SeqID_177240
cgcggtcagggccagcagcgccaggcagatggtgcccagggcccagaacgattccagcagcaccagccagcggccgcggcgctcgctgggcaggaactcggccatcatggtgtagtccaccggcagcgtgccgccgacaccgatgccggtgacaaagcgcagcaacagcagccaggtgaagtccggcgcgaaggccgaggccacgccggcgcaggcgtcgatgaccacggccatcatcagcaccgggcggcggccgatgcggtcggccagtcggccgaaggcgaaggcgccgatcagcatgccgacgaagaacgcggtgccggtctgcagggcttcgggcaccgggatgccgaaggtgcgggcgatggacggcgcgctgaagccgatcgacagcacctgcatggcgtcggccatccagaccaggccgaagatcatgaacagccggtactggaacttgccgacgccggcggtcttgatgccttgttccaccgtgatgaatga

SEQ ID NO: 60463 - DNA, 220 bp, Glycine max
  Peptide Sequence Number=SeqID_177241
atgtcagatatggaattatacatagaaaaggatgtggctggtggttctatgtttcattctgcaaattctcttacatcatgtggaaataaattatctaataatgaggcgcaaccgccaagaaatgtgagcaatttacatggtgatgaagatgatgatgatgattatcttgtgtctaactcatacattgaagagtctttagacgaagatgatagtgttgacg

SEQ ID NO: 60464 - DNA, 177 bp, Glycine max
  Peptide Sequence Number=SeqID_177242
atgggggaggagcttgccacccagctcgcccaggcgagctcggttgctacctccaaaagcaaccgccttctggaggaacatcctggaatgcccaagtgggcctggtgcaaaatgaccataatttgtgtctgcgtgtctttggacgtgaacgagcctgggcggcaaggtgcagaatga

SEQ ID NO: 60465 - DNA, 135 bp, Glycine max
  Peptide Sequence Number=SeqID_177243
atggagagtaaggaaccgatggttcaattccatctgtgggaaggtgagattgagttgaggaaatggatgatggacaaagaaacattgggctatagtgggtggagagggctccataatgtagctagggtaccctag

SEQ ID NO: 60466 - DNA, 240 bp, Glycine max
  Peptide Sequence Number=SeqID_177244
atgtcttttgtcatgccatcaaagtatggtgctaacttgccactgcctaaagattcctctgtgaggattaaaaaggtgcccagaaaaatagttgctatagtttccttttcaggtttaaagaggagtttaggacagataatggcttatgttggcatagatctaagctcgcctactcttgcatcagccacgcttaatctcattccagctttcacttttatacttgctctcatatttaggtaa

SEQ ID NO: 60467 - DNA, 198 bp, Glycine max
  Peptide Sequence Number=SeqID_177245
atgggcatcctctttagccaaacctgtggctgcacacctcaggaggctcaccacaatatcaacgaccaaagatcacaattctttaccctctccactgcccttgggacggaggtagtcagagaccagggcgtggatgccgggggaatcagaagactgaagcttggagatgagggaggattccgagggactcgtggttga

SEQ ID NO: 60468 - DNA, 240 bp, Glycine max
  Peptide Sequence Number=SeqID_177246
atggagaacaaagagagcaagaaagcatggatggagaagaagacagagagaaggagaagacaacacgaaggagacgaaacatacctaggtatcatggcgaaggagaagaagcagagacttgtgacgatgctcgagtgcaacgaagacgatgctcgagtgcgacgaacacgatgctcagatgcagacagggacggtttcgctagacggagattagaagaagaagagagcgcgaaagcttag

SEQ ID NO: 60469 - DNA, 270 bp, Glycine max
  Peptide Sequence Number=SeqID_177247
ggtggcgacccgcaggccccagacacaccgccgccacctcctcaggctgacccagctgggcggccaaccacagggcgcacgtgcagacccatgactgcctctaccagctcagcctcagcctgcagagccagggtcgcatggcccggagattggcctgaggcccaggcaggggaggcacccgcagaggcacccagcgaggcagatcaggcccgcatggacgaggagatgaccgatttgcttgatttcttgggagggagcggagccacatga

SEQ ID NO: 60470 - DNA, 1269 bp, Glycine max
  Peptide Sequence Number=SeqID_177248
atggcgcaggatatcagtcagctgatcgacgcgctcggcctgcagcgcgtggcgtttgtcggccacgatcgcggcgggcgcgtcgggcaccggctggcgctcgatcatccggagaaagtcagctgctgcgtgtttgtcgatatcgcacccactgccaccatgtacgcgctgaccgatcaggcgttcgccacgcgctatttctggtggttcttcctgattcagccgcacccgctgccggagaccatgattggtcacgatccggcgttctttttgcgtaaacacattgatggccaactgaaaacgccgggcgcgaccgaagcggcggtgtttgaagattatctgcgctgctatcgggatccggcgatgatccacgcagtatgtgaagattatcgcgccgccgccagcatcgatttgcaacacgatgccgctgacagcgaccggcgcattgcctgtccgctgttactgctgtggggcgaaaagggcacggtcggtcagctgtatgatgtggtgcacacctggcaggacaaggcgctgcaggtgcagggcgaggcgttaccgtgcggccattcaccgcaggaagaggtgccagagcggtttctgtactcgcttcagcgcttcctgggatctggttggccatcgattgaagacctgtacgtgtttatcagcgtggcgcggcatgacggtttcggccgcgcggcgattgagctgggtcagtcaccgtcttacatcagtaaacgcatcgccattctggaaaaacaactggagacgcggctgtttttccgcactaaccgcgtgatgcgcctgacgccggaaggtgaaaaagcgctggagggcgcgctgcaggactatttatcggatgcggtttcggcatttattcaccagcatccgtcgctgaatattaaactgatgctaagcgatcgggcattcgacctgctacagagcggcacggatgtggaaatctgcgttggcgacgatctcaatccttcctatattgcccgccggctgattgctaaccggcgcattttatgtgccgcgccggcgtatttatcccgcgccggtatgccagcctcgctggatgcgttaattcatcacagctgtctgatcattaatgaacgcgatatttcatttggtaactgggcattgaccaatggcgagcagcaggggcatggtattgcgctgcgttcagcgtgggatgtggcgccgtatctggcgacgggcgagctggtggcggtattaccgcagtggtatcaggaagccaatatctgggcg

SEQ ID NO: 60471 - DNA, 612 bp, Glycine max
  Peptide Sequence Number=SeqID_177249
atgcagaatctcggccatcgacggcacttcacgccagccgtaagcggcagtgacctgccagaacgacggcgacaattgcgtaatgctgatgcgctgctggttatagacgcgcggcgtgtcggtggtgcggatatgcaacagcaccacgcggcggtgcagcacgcggttatgcttgaggttgtgcaacagcgcctggggaatttcaaactccttgcgcgcgaggaagatggcggtgccctcgacgcggttcggcggattgctctccagcgatttcaccagcgccagcggttacgctcgctgctccagatcagcatcaatcccatcatggtcagcgccagcagcaccggtacccagccgccggacagcagtttcatcaggttggcgatgaacagcggcacgtcgaccaccagcatacacagcaggaacaacagcgccagcggcagcggccagcgccagttacgcagcgccaccacgcccgccagacaggcagtgatcaccatggtgccggtcaccacgatgccgtacgccgaggacaacgccgatgactggcggaaagccagcacaatcagcatcacggcggtgaacagcagccagttcaccaccggaatgtaa

SEQ ID NO: 60472 - DNA, 354 bp, Glycine max
  Peptide Sequence Number=SeqID_177250
atggcgtctgttaactcttccattgacgtggcccagcttacggaggtcacacccgctggatggattgaagataattcgcggtgcgttaaatcggcgcgaattaaaaccggtttaacattttgcggcgtaaaaatggaaatcacatcgttaatcaacgctttcatgctaaatccggccatccgtggcctgcggcttaaaactcgcgctggccgcccagttcgatcacccggttgggcggaatatgaaattgctcatgggcgcgcagcgcgttgcgctggcagaagtgaaaaatcccgccgcgcacccgcgccagaccgcggcgttttttcatcaccagcgtatcgtgcgcggtaa

SEQ ID NO: 60473 - DNA, 705 bp, Glycine max
  Peptide Sequence Number=SeqID_177251
atgatcaccatttgtaccgcctgcggcacgtcgtatcagcagcagcaacctgcccttacgcagtgtcgcatttgtcaggatgaacgccagtttgtgccgcccggcgggcagcagtggatcgatcagtctgcgctgcgcgcctcgcatcaaaaccagtggcaacagctggcgcccgggctgctcagcctgcaaaccgtaccagattttgccattaaccagcgcgcctttgtgctgcaaacgccgcacggcaatatcctgtgggattgcatcgcgcatctggatgacgccaccgtcacgctgctgcgtgcgctcggcggcctgcacgccatcgccatctcccatccccactattacagcaccatgcaggactgggccgacgccttcgacgcgccggtgtacctgcacgccagcgacagcgagtggatcatgcgcgcatcgccccgtctgcagccctggcacggcgacagctgtgatctgctgccgggcgtgcggctgttacgtctgggtggccactttgccggcggcacagtgctgcactgggcgcacgacggcggcgtgctgctgagcggcgatattttgcagctatcccaatatgttaccgctggccggcgccacggtggcggccatgctgcaacggttgcagggcgtgaagtttacgcgcctgtacggcgcgtttgccggccgcgaaattctcgcgcgtgctga

SEQ ID NO: 60474 - DNA, 2439 bp, Glycine max
  Peptide Sequence Number=SeqID_177252
atgggagatggcgatggcgtgcaggccgccgagcgcacgcagcagcgtgacggtggcgtcatccagatgcgcgatgcaatcccacaggatattgccgtgcggcgtttgcagcacaaaggcgcgctggttaatggcaaaatctggtacggtttgcaggctgagcagcccgggcgccagctgttgccactggttttgatgcgaggcgcgcagcgcagactgatcgatccactgctgcccgccgggcggcacaaactggcgttcatcctgacaaatgcgacactgcgtaagggcaggttgctgctgctgatacgacgtgccgcaggcggtacaaatggtgatcatggcttctcctcacagtccggtgaggatcagtttaggcaaggtacgaggttagcgcgcggcgtcctgctgtggctgcagctgataaatccacgccgtccgctgctgaccgtcggtcgtggtgacctgaaccggcacccggtcgtagccatcttcaaactcatccagcatcggccagtgcagcgccagccggtccgagataaacagataacccggcacgcgcgcgccgtgctcatcaagtacgatgccgggaaaatcggcggccgcgccccagccgttggcatagtaagtgccggcgaccgtccctgccagccactcaccgccgatgttttccaggatatgcgcattgcactggcccggctgcagcgtgccggaaaggccacaccggcagcgaaattctgcgttaccggttgtgcgatggctcgtaatatgtttaccgctgctgacagccagctttctctttttcgaggtatccgcgctatgttgaagggttccagcctctgccggggggcaatcagggagtacccgcactccgctcagtttgatggcaaaaagtttcgcaatgtccagccgcgtcagtcgctgagctttggcgactaccgcaaaatgctgtgggatttcctgttcaataaacccaaagatacccagccgccggccgcgctgccggtgcagcccatcacggccgccgcgctggcacaggccgcgcccaacagcgtctttcgcctcggccactcttcgctgttgctgaagctcaatggccagttctggctgaccgatccggtgttcgccgagcgcgcgtcgccctttaagcgactgggaccaaagcgctttcagccagcgccaattgccgtggccgatctgccgccgatcgaaggcattattttgtcgcacgaccattacgatcatctcgattaccacaccatcatgcagctgaaagatcgggtgaagcactttctcacgccgctcggcgtcggcgatttgctgattaagtggggcgttgcgccagagaaagtcatccagctcgactggtggcagtcgcgggatatcggcggcatccactttgtcgcgacgccgtcgcagcacttttccggccgtggcctgttcgacagcaacaagcggttgtggtgttcgtggacgctgatttctgaccagttccgcctgttttttggcggtgactccggttacttcgacggtttcaaagcgattggccggaaatacggcccgtttgatgcggcgtttctggaaaatggcgcttacgatgcgcgctgggccgacattcatatgctgccgcaggacacgttgcgcgcgtttcaggacctcaacgcgcgctggctgtttccgattcacaacgcggcgtttgatttagcttttcaccgctgggacgatccgtttacccaaatcgtccagctggcggcagagcatcaggttgcactcccaccgcggcctggtggtaaagcacgcaacccgatggccatttggctatcgggtcgcgctggtcaggccgtgagttcgtcgtacaggctgcgcagccggcgcctgcacgctgtcgccgctttcggcggccagatcctgatagctgaagccgagcagctcggtcttttcaaatacctcgcgctgcgcagcaggcagttccgcgagcgcatcgtccagctcttcccacagcagcgttttcagatactcatcctccggcgtctgcgccacgccaaacagcgtttcggcaatttcatcttcgggaaaatcctcgtctccggcggcgttgaacagcgagagttcgcgtttttttcgcgatcgatcggtgatctcgttgcgcgcggcgcgaaacagccaggcgctgacgttctccaccggctgttccacctgcagcagtttccagctgatctcctgcaggatatcttcggcctcatcgtgccgctcgctgcggccgcgaataaaggcgctgagtttcgtgcggcaggcggcgagggccgccagcagccgcgaatcctgcggcatgctgtttactctgcatccggggatttggcgggcgcatcgtccgcgggcgggcgcggatcgtcacgctggctgcggcgatcgtgccagtcacagcgtccgccatggtga

SEQ ID NO: 60475 - DNA, 531 bp, Glycine max
  Peptide Sequence Number=SeqID_177253
atggctaactttgttattgtggatgatcatcctattgtgcgcgtggcgataaggctggtgctggaaaacgctggccatcgtgtttcagcagaggctggtgacggcgacaatatatttagcctggtcaaagagaaaggtgccgatgcggcaattattgatattgatctgcccggcattggcggtattgaagcggttaagaaccttcgcaccgccggatcattgatcccggtgatcgtgatgagcggaaaaaacgcggaattttacgcctacgagagtaaaaaagccggtgccaatggctttatcagtaaaaaaaacaacctcaatgatctgacccatgccgtcgacgcggtgctgtccggctatggttttttcccgctgcgcctgagtcaccaggcggagggcgatcaactggtgcaggacagcgacaaattgctgctgctgtcgcatcgcgaatatgaagtgctgcgctatctcggtgaaggcaccgagattgtcaaaattgccaaccgcatgaagcttagcaataaaacg

SEQ ID NO: 60476 - DNA, 147 bp, Glycine max
  Peptide Sequence Number=SeqID_177254
atgtatgaagcaaaatctggtatgcagttctgcatgtatacaggaagaaacaaaaatagctctcatgatagtgtccatgcaagtgtcaatccagcttcatccaatactgaagatcattataaccaaccaaaagacaccaccgcatag

SEQ ID NO: 60477 - DNA, 621 bp, Glycine max
  Peptide Sequence Number=SeqID_177255
atggatgccttcacggaaactattgatccgcataccaactattttaacccggtaaatgcagagaagttcaatgaggatatggcacgctctttctttggtattggtgctactttaaggatggaaaatgatatccttaaaattgaatcaattgttgcaggcggaccggctttcaaaagtaaattggtgagcgcgggcgaccgaataattggtattgcacaggggtcaggtgattttgaggatattacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 60478 - DNA, 132 bp, Glycine max
  Peptide Sequence Number=SeqID_177256
atggctatcaaactacccagacagattttggtacctaagtctcaaaccggatacatgcagacaccattattttatagacgggaatatagaagtgcaagggttgcttcggatggttttgacttgtctagttag

SEQ ID NO: 60479 - DNA, 165 bp, Glycine max
  Peptide Sequence Number=SeqID_177257
atgcatatgacacagatgcaatttacgaatacgggagcccgagaaactgtctccttcttagatacaacgtctaggggtagcaaagtgccccaacaggggatcaagacagaacccatgtgcgatgcatatgcgaaaggcgcaacaagggaatgtaccatagtatga

SEQ ID NO: 60480 - DNA, 544 bp, Glycine max
  Peptide Sequence Number=SeqID_177258
attgaagcttgtgaccagagagttgacatgttgaaaaatacgaaccaagacgaagtcaacaacatcatcttcatgcaatatatgcatggttcacgccaactaaatttcatgctaaacatttctcaaagccaaatcatccctactcctgcagagccactagtacttaatgataataatgggagggtattgaattttgcaaattcaacaaatcaggttggtggagcttctagtcatggaattaatatgttgagaaacattcaacaagatgatgctaattgctctagttatatgccaagcatggctcaaagcaaacttaattgcttgcagaacaactctcagagccaactgatcacacttcaaactttgaggtcactcaaagcaaaaaataagatggtagattttactaatcaagttgttgttcctcaagattcaattaatcaacttggtgagtctttggattggactaatcatcatggtgaatttgagtgggccaatggactcattggggttgaggattggtctaatccactaagagtgttgttag

SEQ ID NO: 60481 - DNA, 315 bp, Glycine max
  Peptide Sequence Number=SeqID_177259
atgcgtctaccggggaaggagagtctgctgatgaaatctcccataaccataaatgagattttggatgttagcatttcgtttctaaatgaccatttagaggaaacactgggttcgacaaaaatagaagaaatccactcaaagtgtatcaatctcgcacagtgcggggcgaaaaaaaagtcgctagcgcacgggattttggttgatattgtccggtccaaagacctctctgcacatttcttctgttttccttcaatccctgatcaggagctttctttccttcttcttcttccttttttactttctcccattctttga

SEQ ID NO: 60482 - DNA, 297 bp, Glycine max
  Peptide Sequence Number=SeqID_177260
atggccacaatgatggaggccatgatgagcataaaggagataatggaggtcaatgcggcttaccgaacccgtgctagagctagagtaatgggtgaagtagaggaggtgcaagagcagataaaggccgacatggaagagaaaatggccacaatggtggaggccatgatgagcatgaagaagataatggaagccaatactgttgcagttgccgctaccagcgctgttgctaaggtgaacccgatgccctcatctgatctcaaccaaatgaatcatctaacctcggatatggtgggctaa

SEQ ID NO: 60483 - DNA, 288 bp, Glycine max
  Peptide Sequence Number=SeqID_177261
atgtcacgaaaccttatggattacgcaatcatcccttctttggcttccggaatgttacgaaacttcacggattgcacattaacacttcctttcaactcccgacatgtcgcggaacttcacggattgcctaacaattggcctattctgattaagtgcaccacaaaaacacttttggagaagattctagctccaaagtacaatccaactccaactgcaaaagacagtccaactcctaaaacaaaactcatatggagagttcgtgttgccgcaacaagcactttttcatag

SEQ ID NO: 60484 - DNA, 189 bp, Glycine max
  Peptide Sequence Number=SeqID_177262
atgacgggagatgcatcaaagtttattcatatttatcccaaaaatagtaaacatgtgacctatggagacaacaacaaagaaagcactaaccgaatgaataacaaagaacagatgaagaacgagcaaagaacggcgaagaacgttcacggaattgatcacggaagcattacggaagcgcctcagccttga

SEQ ID NO: 60485 - DNA, 207 bp, Glycine max
  Peptide Sequence Number=SeqID_177263
atgggtttccggggccttcgggacacccctgttttgggtggaaaaaattgtttccgtgaagaaaatccaagccgaggtgcttccgtaacgcttccgagatgtttccgtgagcgaatccgtgaaggttttccatcgttcttcaccgttcttcattcttcaatggttttcttttcgtccgtctttaacgcacttttaccgtttatttaa

SEQ ID NO: 60486 - DNA, 300 bp, Glycine max
  Peptide Sequence Number=SeqID_177264
atgtcacatcctatcagagcgtggtttcccgtgtcctctagcatgaggttcttcatagtcatccacctattcatctgctcccccgaacacaaagttcaagatcatcacaggatccaaacacaaacagcaaaccgggagtcactctcactaagtaagatcatagggagaccagtcagggtcacgatgttttacgagaatgctccaaccatatgggatcaacataggcttaaaggagcactcaaacccggtgacccccaaggcctacactccgaagagtccttcagggcctcttcctcctga

SEQ ID NO: 60487 - DNA, 414 bp, Glycine max
  Peptide Sequence Number=SeqID_177265
atgattcttgatgaccatgaaggagaagagcattgttttggcaaaggaacaaatgcgaggagtgtttcttttttgcctagaagccaagagaagataagagatttggctaaagttgtgataaaacaagacatgaagggaggagagcataaatatgggtttaacaacaataaacgtgagaagccagagaaggtaagggtggtggatgatgaaactggcgacaaacatgagctatatgaagtcctaaggatgccatctagaacaaaaaaccgatgcctcgcattttttactgagggtaggaggggtattataaacatcgttttctacatctaccagacaccaaatccaatgcatgttaaatacactcaatactttgactatcccagcccattagaatatagattaaaggaaaattga

SEQ ID NO: 60488 - DNA, 1251 bp, Glycine max
  Peptide Sequence Number=SeqID_177266
atgtgctggccaggaacattctcccatgaaagaaatgtcaagctgtatatcactgagtttgatgatttcagaagagaattgattagaagaaactggcataaacaactgactaacttgactgagggaagcattgatgtggcaattgtgaaggaattctatgcaaatctatatgtccctgaggacaagtctgccaagcaagttagggttcgagggcacctgataaaatttgatgttgattccctcaacacctttttggagactccagtggttgtggagcaaggggagagcttacctttttactcctgctttgctagactgaggcctgatcctcaggagcttgcagctcggttgtctatccctaggaggggatttgttcttaatgtcgagggtctaccatggaagttgttgaggaaagatcttaccactctggcccaaacctggagtgttctatcttattctaacttggccccaacatcctatacttctgatcttaatctggataggaccaagttagtctacgggattgtaatgaagatgaacatgaacttaggatcacttatttctagtcagatttcactcattgctcagtctaattcctcgcagcttggattttcaaccctaattactaccttgtttaaggccggaggagtcacctcagattctcttaccttcgagtcactcaactcagccactaatttggcctatattaagaaaaattgctggaacctggatgaaccttcggtcacttttccagggacccaaaaatccagggctagaagatctgaggccccatctacattagctgcccctgctccccctacattagctccatctacttctgctgttccttcaccatcagcagctccagttcttccaggtccctccactcagagctcagagccattcatgtctatgctacagagcctgcatcagggccagctcctgatcatgcagagtttgcaggatatggagcctcagccagaccaggaggatgatattctagaggcctcagagccaactccacttgagcctttcatttttgagactgatccagtagcagctaccccacaagtgacaccagagccttccactatagtattggacatgtcttcttctcagcctgagtcatctgcaccagtaccagacttgcctctttctcaagattcaccatcaggcactactgcactggacctgaatgagcatgccatggactctgcacaggatcatgatttttatttccatgctttttaa

SEQ ID NO: 60489 - DNA, 222 bp, Glycine max
  Peptide Sequence Number=SeqID_177267
atgaccggccctctcgatgagccgatctcttgctttctcataaaggtggacccttgggtactagtacctatcacctttagaggactatatgtcctcgccatcagaggactcacatcctcgcctgcagagggctgcacgccctcgcctttagagggctacacatcctcgcctttagagggctacgcgtcctcgttttcagtgtgctccatatccacaccttaa

SEQ ID NO: 60490 - DNA, 405 bp, Glycine max
  Peptide Sequence Number=SeqID_177268
atgatggtcagatggagaacagacagcttcaaggtagatggagaacaaagagagcaagaaagcttagatggagaagaagacagagagaaggagaagacaacgcgaaggagacgaaacatacctaggtattgtggcgaaggagaagaagcagagacttgtgacgatgctcgagtgcgacgaagacgatgctcgagcttagacaaaacgatggtcagatggagaacagacagcttcaaggtacatggagaacaaagagagcaagaaagcttagatggagaagaagacatcgagaaggagaagacaacgcaaggagacgaaacatacctaggtatggtggcgaaggagaagaagcagagacttgtgacgatgctcgagtgcgacaaacacgatgcccgatgcagatag

SEQ ID NO: 60491 - DNA, 423 bp, Glycine max
  Peptide Sequence Number=SeqID_177269
gatttagaagcagcaacaattctagaggaagaacctcaatcttctaaggcatcttctagttttcctattgcaggacattttcatttagatcctatcaaagaccacatcatggctaaagatccaagaagagtcaccctggaagattattcaagcaatagtcttaagacatgggatgaggttgtggagaaatttctcaagaaatattttcctgagtctaagattgtagaaggcaaagccgccatctcttcttttcaccaatttcctgatgaatctttgagtgaggccttggaaagattctgtggtgggaaaatcaaattgaagacccctgaagaagccatggacctcattgaaaatatggctgcaagatgtaccatctgtgggggagctcaagaatctggatgttgtatacctattgaagaataa

SEQ ID NO: 60492 - DNA, 620 bp, Glycine max
  Peptide Sequence Number=SeqID_177270
atggagttcttctcaaatgagaattttgaatgcttccaagcatttgaaaactccaatcttattccattcatgtctctgaaattacttgtctattctgaattagtcaaagccttctattctaatttagaaattcatgaaggtgctctaatgtctgaagtctatgggattaagatggtcattgaccaatccctattttttgatttaacaaaattgcctagtgaaggtgtgccttttgagggtgcactgattgatgaatggaaatttgatttctctgtgcatgatgcccgccggttggtttgcaccaaccaagcggatatgaccggaagacttcttgccggttcattggcttttgagagccgcatcctccattaccttattgttcgcatcttactccctagatcttcaaaccttgctcaggtttatgaacaagatctcattgtcatgtgggcctttcataaaggtttacaaactgattgggcacaccttgtcagatatcgcatgcataaggcattgcgattgaatgccccattcccttatcctcatcttgttacccttttccttcaacacttcaacatccctcttgattctgaaccttatgttccaatcaagagatcattcct

SEQ ID NO: 60493 - DNA, 501 bp, Glycine max
  Peptide Sequence Number=SeqID_177271
atggcagcgaaaacttcctctgaaactgaaaaagagtgttcctcctcacagtcactgaaaatttcaaaggatttaaactttcgacgtgtttctgagaccttagatctgttcagagcgatggggaccaatattatcgcaccggaaaatagcaacacgcatggcttcttcgacggcttccttcggagtttcataaagctcgatcacatccaacgcggtcgtatcgcctgcacccttctcgtcaaaggccccatctgtaatggttttggaacacttcatggaggggctattgggtccttttttgtgattttgtctactgcttgtgctagaaccgtaactgctgagaacaaggaactttttctcggggaaattagcatgtcttacctctctggaactctaatagatattatcaataggggtggaaatgagctgagtagtttgtcgaggaccttcggctcggcctatgtaagtctcaagctcaagctttctaaaaagtctttataa

SEQ ID NO: 60494 - DNA, 270 bp, Glycine max
  Peptide Sequence Number=SeqID_177272
atggcgggatgggaggggataggagagagagaggtgtcccgcccttggagatggcgggataggagagagggggtggcggtaccgccactggcggttgcgggacagggggagagaggatcccacctttcgagctggcgggataggctagctttgtttctgaaaaaaagcctgcaccttgttcacgtgaatgaaggctttcatggcagcatgcgtatacacaaacacactagggaggagaatagggcactgtattggatagagaaatcataa

SEQ ID NO: 60495 - DNA, 639 bp, Glycine max
  Peptide Sequence Number=SeqID_177273
atgacggcatgccaagattggccagagccagtgattcgagtccaagccttggctgcaagtggcttagccacaatccccgaacgtttcataaagcctaagtcccaaagacccactaatagtaacaattatgctccaaagaccaatttctctcaaattggtcatcataagaacaataccaccaacagcaacatcccagtgattgacatgaagcacatctacagtggtgacgagggaaagagggctgagacgctccggctcgtgtcggaggcgtgccaagaatggggttttttccaggtggtgaaccatggagtgagccatgagttgatgaagggggcaagggaggtgtggagggagttctttcaccagccacttgatgtgaaagaggtgtatgctaatacacccctcacttatgaagggtatggaagcaggttgggagtgaaaaaaggggccattttggattggagtgattacttctttctccattacatgccttgttccctaagggaccaagccaagtggcctgccctcccaacatccttaagagagtgcgagaaacatgcgactaatcagattcaaccacttcttattcaagaaaagaaaaatcagtttcatatggttgaagaatcagctcttttttaa

SEQ ID NO: 60496 - DNA, 318 bp, Glycine max
  Peptide Sequence Number=SeqID_177274
atgcaatacaaattaacacgaagggatcacaactcaactccaagcaaggaaagacaccagagacagaaacaaagaaggatgagtaaggtgaagattttggttgtgggaggcacaggttacttgggtcagcatctgctacaagcctatgttcatgccaatgccaataatggaactccttttgctttcgatctcgctttcacccatcactcctctcctcctccccaacctctgttggatgccattcctttctctcttccttttcaagtggatttgaaaactggctttggatttgaagccatttccaacacttttggtcag

SEQ ID NO: 60497 - DNA, 783 bp, Glycine max
  Peptide Sequence Number=SeqID_177275
atgtcttacaagattttgagccttttatccattaaatgtatcttaaagcctgatgtggttgtcaattgtgctgccatctcagttcctcgtgcttgtgaaattgatcctgctactgcacatgctattaatgtgccatcgtctctagtaaaatggttgcaaagctttgaaaagagaagtactcttctcattcatctctccacagatcaagtttatgaaggggagaagtccttttacaaggaagaagacattgctgttccagtaaatgtttatggaaaaactaaagtggcagcagagcagttcatttcagaaaattatccgaactttgcaattttgagaagcagtatcatctatgggccacaaacagtctcaccagttccaaaatctcttcctattcagtggattgatggtgcccttgctaaaggagaaaaagtggagttctttcatgatgagtttcgttgtccaatttatgtcaaggatcttgtaactatcatactaactttaactagccaatggatatcggagggcaagcaaatgcaattgttacttaatgttggtggagctgatagggtgtcacgtttacaaatggctgaggctgttgcagaatttagaggatatgatgcctcattaatcaaatcagtgtctgcctcatcggttgatcgaggggtgaagtccccagctgatatatctatggatatcactagattggttcaaaccctaagaattcatcctgtttcatttaaagatggagtgagattgacactcacaaccgaggctaggcaatga

SEQ ID NO: 60498 - DNA, 237 bp, Glycine max
  Peptide Sequence Number=SeqID_177276
atgttccttgtaagttgtaacctcagaaaaagactaggttctgagaacagtgtcaccaacctgtttggaaaacgctggcaaaaatcagtcatgcacaggaaaagaaaaatgaaagagacactacaatacaacttgcacaatgcagcatgggcactaggagtggggcccaagtcattggccagaagcagatgggttcagagaaacaatgggctctgtgcttggatgcctaaccagtga

SEQ ID NO: 60499 - DNA, 1254 bp, Glycine max
  Peptide Sequence Number=SeqID_177277
atgggggaagagaatgaaggaataaaaacatttagggatttgggcttttccgagtcattggtggaagcttgcgaaaaattgggttggaaaagaaaagatgtgacaggacttgcccaaactggttatggtaagactggagcttttgctcttcccatattgcatgccctcttagaagcaccacgcccaaaacatttctttgattgtgtgttgtctcccacaagagaacttgccattcaaattgcggagcagtttgaagctctaggctctgaattgcttgttggaggaattgacatggtacaacaatccatcaagatagcaaagcaacctcatattattgttgggactcccagacgagttttagatcacctaaaacacaccaaaggattttctcttggtagattaaaatacttggtcttagatgaggcagataggttgttgaatgaggacttcgaggaatcacttaatgagattttacaaatgattcctcgtgagcgaaagacatttctgttttctgctacaatgactaagaaggtccagaagctgcaaagggtttgtttaaggaatcctgtgaagattgaagcatcatctaagtattccactgttgacacattgaagcagcaatatctctttttgcctgccaaacacaaggattgctactttgtttacattctcactgaaatgtctggaagtacatcaatggtgttcacttgcacttgtgatgcaactcggcttctagctttgatccttaggaatcttggtctgaaggccatcccaattaatggtcatatgagccagtcaaagagacttggagcctcgaataagttcaaatctggggaatgcaatattctcctttgtaccgatgtagctagtagaggactggatattccaactgtagatatggtgattaactatgacattcccacaaactccaaagattatatacatcgtgtgggaaggactgctcgtgcagggcgctttggggttgccatttcccttgtaaatcagtatgagctggggtggtacattcaaatagagaagcttataggcaacaagctaccagagtatcctgcacaagaagaggaagttctacttttggaagagcgtgttagtgaggccaaaagattagctgtcatgaaaatgaaggagactggagggaagaagaaacgaaggggcgaagaagattacgatggggaggatatagacaagtacttgggtctcaaggaaggaaaatcatccaaaaagtttagaagatga

SEQ ID NO: 60500 - DNA, 2469 bp, Glycine max
  Peptide Sequence Number=SeqID_177278
atggaagcagcagcagcaacagcaaactcttctcagagaaagccgaagagaaaacgagcttcagcaaaaagcgatcccgaacttgaccgtctcgactcgcttccgtggaactccgctcttcctcaaaacgacgacgacgacgctttctccttgttcattggctccaacgaactcgaaggaggttttctttcgctcgaggagattgatgaggctgagtatggtttgagtattcccgaacctgaagttgacaagaggaagacgaagaagaagaagtctgaacagaacgaaaatgtgaagaagcagcagcaggatggagttgacagtgcttgtagcgacgacacggtggtcgaagcagagttggatgagagtctgaagtctaaagagaagaagaaaaagaagaagaagacaaagaacaagaagaaggatgccagagaagatcagacagttgagccgtcagatgctggtttagatactaatgtgaaggatgatattggggaggaggacgttgatgaaactgaattttatgcatggaatgaattgaggcttcatcctctcctcttgaaagctatatgcaagcttggcttcaaggagccaacaccaattcagaaggcttgtattccagctgctgctcatcaagggaaggtttgtttgaagctcttcttcaaggcactgtgtggggacgttgttggggctgctgagacaggatccggtaaaacacttgcatttggtttgcccattttgcaacgtcttttggaggagagagagaaggccggaaacatggttggagaaaggggtgaagaacctgaaaagtatgcttctactggtcttctgagggctcttattattgctccgactagagaacttgcacttcaggtcactgatcatctgaaagcagtagccaaacatattaatgttagggtgactcctatagttgggggaattttagcagaaaagcaggagagacttttaaaagcaaaacctgagattgttgttgggactccaggaaggttatgggaacttatgtcagctggagaaaaacatctagttgagttacattcattgtctttcttcgtgctggatgaggctgatcgtatggtacaaaatggtcattttaaggagttgcagtcaataattgatatgcttcccatgtccaacaattctgctgaagataattctcaacatgtacaaagttgtgttacagtttctagttaccaaagaaagaaaaggcaaactcttgttttttcagcaactgttgcactatcttctgattttcgcaagaagctaaaacgaggctcaattaaacaaaagcaatcattgacagatggattgaattctatcgaaactctttctgagcgtgcaggaatgagatctaatgcagcaattattgatcttactaatccgtctatattagcaactaagcttgaggagtcatttattgaatgcagagaagaagataaagatgcctatttgtactatattttgactgtccatggacaaggacgcacaatagttttctgtacttcaattgcagctttacgccatatttcttccatactgcgcattcttggcatcaatgtttggactcttcatgcccaaatgcagcagcgtgctcgtttgaaggccatggatcgctttcgtgaaaatgaaaatggcatacttgttgctacagatgttgctgcaaggggtcttgatattcctggtgttagaactgttgtccactatcagcttccacattcagcagaggtttatgttcatagaagtggaagaacagccagagcttctgctgaaggttgtagtattgctttaatatcatcaagagatacatcaaagtttgcttcattgtgcaagtcattttccaaggataactttcagcggtttcctttagagaactcttacatgccagaggtcctaaaacgattatctcttgcacgtcaaatagacaagataacaaggaaggattcccaggaaaaggctgagaaaaactggtttgataggaattctagctcagtagaattagttacagaaagttatgacagcgaagaggaacaagtgaacaaacataagcaaatgaaggccagctctagacaattgaagaaattgcaggaggatctcaaaatactgatttcacgtccattacaatcaaaaacattttcacatcgatatttagcaggggctggtgtcacacccctcatgcaggagcaattgcaacaattagcaaggcaaaaactaagtgatcaccagggttcaggactaggcaaaaaggggaagttggtagtgattggtcaagattgtgtggatgcacttcaggcacttcgaagtgctggtgaagaggtgcgaatggatgccaaggatttggctggaaaacagagaaatatgcagaatttaaaaagaaagcgtaaagaggagaaaaagcgtttgcgtgatcagcgtagaaagcagaagaaaaagctaaaatacggggatgaatag

SEQ ID NO: 60501 - DNA, 360 bp, Glycine max
  Peptide Sequence Number=SeqID_177279
atgtacataggcatcgcgattcagcaagggacaccaacgacatttgggacaaaggacttggcaccaaggcactatatcaaacaagaggggtgggatatgcaatggttgcggttgccattgacaatgctggaagcaagcattagaaatggagatattcaggggtttcaactattcaggaatgtcgcagatcagctatcatcaaataataggaagaaatgccatttaaatctgcatcaagaattgttcgaggagggaatcaagaaagagaaaaagaagaacctgccacatgcccaggaacaatcaagggatattggaggttgggaacattcactgagcctttacaaccccgtcagcacttga

SEQ ID NO: 60502 - DNA, 375 bp, Glycine max
  Peptide Sequence Number=SeqID_177280
atgggagaagctacagaaaggtatgcagttgtgacaggtgcaaacaaaggaattggattagagatagttagacaattagcttcagctggaatcaaggtggttctcacagcaagaaatgaagaaaggggtctcaaagcactggaaacagtcaaggactcaggtctatctcaccttgtactgtttcatcaagtggatgtggctgatgcaacaagtgtagcttctctggcagattttatcaaatctaaatttgggaaacttgatattctgaaggcactccttaacatgatgaactacagaaatgagaaacacatgctctatttgtatgattcttgttggaaagtcaccttaattgcggtcacccctagcccaccttag

SEQ ID NO: 60503 - DNA, 591 bp, Glycine max
  Peptide Sequence Number=SeqID_177281
atggagaggcatgctccagagattgaagacttagtggctgccagaggattaagtcctttgattacatgttcgttggacactggtgatcggagacttatatcggcatttgtggagaggtggcataagaaaactagtaatttccatcttcctcgacaatgtggcatcgttgctacatctgccgattacatgggtcttccacaacttcgaggctcttcatgtggacgaagtcatcttgctagtggaagttacgcatggggaggtgctacactggtccatatgtatgacaatttgaatgatgcatcaaagggcactgttaagcaacttgtagaatatatcacacttttacagtgttggatttacgaacactttccttctgttgcttcttctattgttgtccaagattatcatgaaagaaaatcacgtgtctgtcgttggaagtctgggaaggcattaccagtgtcaacgtatcgcaagcgtttgaatagattgacgtgcgatgctgtgtgttggatttcctatggtgaccatcgtgcattcaaagagtttgaacttatctctttatttgtcggacatattagatggagcccataa

SEQ ID NO: 60504 - DNA, 798 bp, Glycine max
  Peptide Sequence Number=SeqID_177282
gctaaaccagaatatgatgggacaaagggagtaactcatacatatgagttagccgaagaatgcttgcaaataaattactatggcgctaaaaaaactacagaatcccttatgcccctcctccaattatctgattcgccaagaattgtgaatgtctcatcctctctgggacagttagagagtttgccaaaaggatcatgggccagaggagtcttcaatgatgttgataaccttactgcagagatagtggatgaaatattgaacaagtttctcagagatttcaaagaaggttcattggaaagtaaaggctggcctaagtatctgagtgcctatattgtctctaaagctgctatgaatgcctatactagaatccttgcaaagaaatacccttcattctgcatcaatagtgtttgccctggctacgtcaagacagatataactgccaacaccggcatcttaacagttgaagaaggtgctgctagtcctgtgaggttgcttcacagcacagctaaccaggttgctctcatgtcaccagcggaggtcgagttgccaggctcccaaatcaatcactcgctgccacagaagggcatgtcgtccaagtccaataggtgcaagcgatggagccaagaacacaggttgtttctgcttgggcttgagaaacatggaagcggagattggaaaaacatttcaagaatcattgaaacaagaaccccacttcaagttgctagtcatgcccaaaagtatttccttcgtcaggcattgggcgataaagccaaaagaagaagcattaatgacatatga

SEQ ID NO: 60505 - DNA, 1113 bp, Glycine max
  Peptide Sequence Number=SeqID_177283
atgcaaccaacagcagcattgaccatggcggaggaccttactcagatcgctcacttgctcgaccaaacactcagccccgacgccatcgccgtcccagccgccaccgatgcgctcgatcgcctctcccttactccgcacttccctttctatctcctctccatttccaccggagcaggaaatcaaggtcagaaaatcgctgctgctacctacctcaagaacctcattcgccgcaccgtcgatagcaccggcgtcaagccttccaacgtgagcaaggagttcaaagaccagctgatgcaggcgttgcttcaagtcgagttgtccgttcttaaaattttagtcgaagtgtttcgcaccattgctgttgctgattttgttaagcagaatttgtggccggagcttgtgcctaatttgcagtctgctattcagaatagccatcttatcagcggttcaaacaccaaatggaatactgtaaatgcacttcttgttctccatgctcttctcagacctttccagtattttttgaatcctaaagttgctaaggaaccggtaccgccacaattggagcttatatccaaagaaattcttgtgcctttgcttgctgttttccatcaatttgttgaaaaggctttagcaacccatggcatagcagaaaaaaaaactgagaaagtcctccttactatatgcaaatgcctacattttgcagtaaagtcctacatgccatcaactttagctcctctactgctttcattctgtcgggacctaatgagcattttgggttctctaagctttgattgtgtggtcaatcaagaagatgaatatttgacaagattgaagactggaaaaagaagtctgcttattttctctgcccttgtaacccggcacaggaaacattctgataagtggatgccagaaattataaattgtgttttaaacatagtcaaatttaccaaaaataccagtaaacttcctttcctttcagagaggcttttgtccctaggttttgatgtaatttcaaatatactggagactgggccgggatggcgattagtttctccacattttacaactctattggaatctgcaatctttccagcattagtcatgaatgacaag

SEQ ID NO: 60506 - DNA, 882 bp, Glycine max
  Peptide Sequence Number=SeqID_177284
atgcaaatgcagcttttatcatcaccattcaccatcttcaaactcctcatacttacattattattacaagtcattcccactctgacactctccccttgcaaaaccacatgtggcagcattcccataaactacccctttggcctagaagatggatgtggtgcaccccagttcagacacatgctgaactgcagcaccgacttgttctttcaaaccccttcaggttcttacaaggttcaatccatagactacgacaaaaaaaccatggtaatctatgacccctccatgtccacttgctccattctccaacctcaccacgacttccaaatgaccgatgttcaatccgcaataatccccccatcacaggacacagttttcgtgcttctaaactgctccatagactctcccgttctcaaccactacaagtacctctgtttcaacttcgccggtcacacgtgcgacgagctttacggttcgtgcaacgccttcagggtctttcatttgctgacaaatagttctccaccgtgttgtttcacaagttatagcaccgtgaagttcatgagcatgaacatattggactgcacgcactatacgagtatgtttaacacggataatttgaagggtgttggccctttggactgggtttatgggatcaagctttctttcagtgtgcctgatactggatgtgaaagttgcagaaaatctggtgggacctgtgggtttgatactgatacagaaggtttgctatgtctttgctcaagtttcgctaattcaacaagggaatgtgctgctggaagcataatatcaaaaggacagaacaatgctccttggacacactacctactggttttgctttttgtagcttattttttctcactaggttaa

SEQ ID NO: 60507 - DNA, 825 bp, Glycine max
  Peptide Sequence Number=SeqID_177285
atgggagaaactacagaaaggtatgcagttgtgacaggtgcaaataaaggaattggattagagatagttagacaattagcttcagctggaatcaaggtggtgctcactgcaagaaatgaagagaggggtatccaagcactgcaaacactcaaggactcaggtctatctcaccttgtactgtttcatcaagttgatgtggctgatgcaacaagtgtagcttctctggcagattttatcaaatctaaatttggaaaacttgatattctggcagcaccagaagaagatgtgacaaaggcaatcactcaatcatatgagttggctgaagaatgcttgcaaataaattactatggtgctaaaacaactgtagaatcccttctgcccctcctccagttatctgattcaccgagaattgtgaatgtatcatcaactatggggcagttagagagtttgccaaaaggatcatgggctagagaagtcttcagtgatgccaatatcatcactgaagagaaagtggatgaaatattgaagaagtttttgagagatttccaagaaggctcattagaaagtaatgggtggccaagacatctgggtgcttatattgtctctaaagctgctatgaatgcgtatactagaatccttgctaagaaatacccttcattctgcatcaatagtgtttgccctggttatgtcaagacagatataactgccaacactggcctcttaacagttgaagaaggtgcagctagtcctgtgaggctagcattgcttcccaatggtagtccatctggccttttctattaccggagcgatgtggcttccttttga

SEQ ID NO: 60508 - DNA, 753 bp, Glycine max
  Peptide Sequence Number=SeqID_177286
atgtcaggagtgaacaacaggagtgagctttctccattggatcaaggaaacaagactctcactcggcgtgggagatggagtcaagaagaacacatgttgtttctcttgggacttgagatatattcaaggggagattggataaacattgcaacaaacgttgttaagacaagaagtccaactcaagtggctagtcatgcccaaaagtatttttatcgtcaggcctccaacaatacaggcaaaagaagaagcattcatgacattaccatacaacaccccatccctctcctgaatttccctgcttctccaaacaccaatcttgcaatgcatcactcattccctcaccacatcaatcaacagaatcagggtttttcttcaaatcttccaatgcatcatctctcagtcccttaccacttcaatcaccagactcaggttttttgttcaaatcttgcaatgcagcagtttcatggaattcctcattcagtccctcagcacatcaatcagcagaatcaggttggttcttcaaatcttgcaatgcaagagttacttggaaggcatctctatgtccctgaccacatcaatcaccagaatcaggctgtttctcccaatcttgcaatgcaacagttacatggagttcagcattcagtccctggccacatcaatcagcagaatcaggtttcttctccaaatcttgcaatgcaacagttacatggagttcagcattcagtccctgaccacatcaatcagaagaatcag

SEQ ID NO: 60509 - DNA, 465 bp, Glycine max
  Peptide Sequence Number=SeqID_177287
atgcaacagttacatggagttcagcattcagtccctggccacatcaatcagcagaatcaggtttcttctccaaatcttgcaatgcaacagttacatggagttcagcattcagtccctgaccacaccaatcagaagaatcaggtttcttctccaaatcttgcaatgcaacagttacatggagttcagcattcagtccctggccacatcaatcagcagaatcaggttgcttctccaaatcttgcaatgcaacagttacatggagttcagcattcagtccctggccacatcaatcagcagaatcaggtttattctccaaatcttgcaatgcaacagttacatggagttcagcattcagtccctgatcacatcaatcagcagaatcaggtttcttctccaaatcttgcaatgcaacaattacatggaattcatcattcagtccctgaccacaccaaccagcaacattag

SEQ ID NO: 60510 - DNA, 360 bp, Glycine max
  Peptide Sequence Number=SeqID_177288
ctgcatgcgctggcccagcgctacggcagccggctgccggcagggcaacggctcaccgcacgagagctcaccgccgctgaccgctgcggaagattacaccctgacgctgcccggcacgccgcagctgagactggtgtttgccctgccgcgctcccattcgcgcggctggctgcggcggctggagcgcctgctgctggacgaagcccccggcgggctgctggcccggctgcgcgctcaggcgtggtgcgatgcggcgctgcaggtgctgacaccggcccagcttgcgcattacgagcggctggcaaatcgcgatttccaccgtttggcgccgctcgaccagctgcgtcccagagcgtttag

SEQ ID NO: 60511 - DNA, 444 bp, Glycine max
  Peptide Sequence Number=SeqID_177289
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaaca

SEQ ID NO: 60512 - DNA, 300 bp, Glycine max
  Peptide Sequence Number=SeqID_177290
atgtcaccacacgttatgcatgatggtggaagcagtcaatactgtatcatcatcgtgattttgcaaagaatattagtcggtgaaagagaattctatgcaatgatgctggtgtttccacctgaattttctcctttgaaaactattttatttggaaatccttcccaagacaccgttgaaccactaatggaggctttggaggaagattataaagatggaaatgagataaatgaatcaaggcagtttattggaggagtattggatcttgaaaagagaatcaatagactagatacattgacttag

SEQ ID NO: 60513 - DNA, 261 bp, Glycine max
  Peptide Sequence Number=SeqID_177291
cgatacatgaagatcttaaaagggtataccatgaatctacaccgtccaaaagcatttattgtggaaaggtacattccaaaagaagccattgaattttgttcagagtacattgaaaaggaaaaacctgttgggcttcccgagtctcatcatgatgaaagagtgggaggtaagggttcaagaggattgtatgttatcactccaagtgtagaagatttgcaacaggctcgtttgaatatattgaataatagtaatgaagtttag

SEQ ID NO: 60514 - DNA, 273 bp, Glycine max
  Peptide Sequence Number=SeqID_177292
gagagagacgagggtgtgccgccactggcttctgcgggacacgttcaggctagtcccgccattggagctggcgggataggctctgcacctagggttcacgctttaacgtttgcacctcctgcacctagggttcacgctttaacgtctacacgttccaggcttaaaggcttgcagtgtttagttttcagttctgaaaagcctatgcttgttgttgttgctgttgtgctttcatccttcaagtgcccttacccttatcttggacataaattcctg

SEQ ID NO: 60515 - DNA, 408 bp, Glycine max
  Peptide Sequence Number=SeqID_177293
atgaccattggaatttctcgagagcatccctacttaaatttcgagcgtctcgatatattatgtacccgaatcggacatccgtgtgaaaggccaacttacaacaacaagccccaagagactcagcataaggatgcacatgccaaagttgagtatgtgaaaagattgtatgaccaggtgaaggtgcaaattgcaaagaagaatgaaagctatgtcaagcaagcccacaagaaaaggaaggaattggtacttaaaaccggtgatgatcctggacatttgagggcaaatgttttccaagaaggagggaatgatgagaatcatgaaactggacaaatacaggctaaaggcccaagtggagaaggacgaaggcccaagtggagaaggacaaagcccccgagtggagaaggatga

SEQ ID NO: 60516 - DNA, 741 bp, Glycine max
  Peptide Sequence Number=SeqID_177294
atggaaaaaatagcggaaaaccgaacaattatacaatatttgccttatgtaacacgttgggactatttagctactatgttcacagaagcaataactgtaaatggaccagaacagttgggaaatattcaaattattggtgcacaaacccccttcttctatattttcagagaaagagaattaatatatgatctatttgaagctgcgacgggtatgagaatgatgcataatttttttcgtatcgggggggtagcgactgatctaccttatggttgggtagataaatgttatgatttctgcgattattttttaacaagaattgttgaatatcaaaaacttattacgcgaaatccgatttttttagaacgggttgagggggtaggtgtagttgatataaaggaagtaataaattggggtttatcaggacccatgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaagaattcccggcggaccatatgaaatttagaattcgctgctttgatagagaaaaagagccagaatggaatgagttgagtatcgatttattagtaaaaaaccgtctccgacttttgaattgccaaaacaagaactttatgtaa

SEQ ID NO: 60517 - DNA, 387 bp, Glycine max
  Peptide Sequence Number=SeqID_177295
atggcacatcaccttctcagcttgacttcattactattgcatgacaaagctccttggtaccttgttctgtttgtctcttcccctttagcccttctcatttcttgcttcgatgctttagttattgacatattgacatcccttagtctattgcattctttccttaccctgataactactcccttcaactcttctttcgtccccatggatttctataattctgctttcaattctctaacctcctctgtctcaataggtgaaggggatgatgcaatcctccctaggaagggaccagtcactagagccatgagcaaaaggctccaagaggattgggctagagctgctgaagaaggccctagggttctcatgaacctcagggtagatttatga

SEQ ID NO: 60518 - DNA, 377 bp, Glycine max
  Peptide Sequence Number=SeqID_177296
atgagggccattaaggggatcggtgattatctatttgccgacatggcgaagctatgcttagtgcccaatgttgtcatccctcccaaattcaaggtgccggacttcgacaagtacaaggggaccacctggcccaagaactacttaaagatgtattatcgaatgatgggggcatactcaagagatgagaagctcttgatgcactttttacaagagatattggtcggggtggcaatcacttggcagtatcaatacaacactgacatggctcccaatagaacccaattgcaaaacatgtgtaagaaagagcatgaatctttcaaggagtatgcccagaggtggagggatttggcagcccaagtatcaacccccatgatgga

SEQ ID NO: 60519 - DNA, 153 bp, Glycine max
  Peptide Sequence Number=SeqID_177297
atgagagagaacgagacttacctcgacgcgatggatctctattgtggaaatgcaaatggcgtggcagcatcgatcactggtggcactaatggcggcaacggtgaacgagttgggttggtacccaaagcaaaaccccatatcttatggctataa

SEQ ID NO: 60520 - DNA, 682 bp, Glycine max
  Peptide Sequence Number=SeqID_177298
atgcagacaattaaggaattcagctaccacaccggctggcgctcccgctcacgccgccctggtcgccacaagagcaaccagcgtggcatggggatggagtttagagggcataccacgctgctgtcctatccggatccacgccggattgatatccgccagacgatacgtgatccgatggagcaggtatatgtgcgtattttcaaccagaaaagcgccacgcctgtgtttgtcatgtgcgacatgtctggctccatgcagtacggtacaccacacaccaagctggtcacggccgccgaaatcacgcgctcggtggcgcagtcagcctgccgcaatacagatccggtcggttttatcggctttgatgatgcactgcatgacgagtggttatgcacactgtcttcccgcccgcacagcatgtttgacctggctgaccggcttgaagaccacttacctaatgaagtcggtgctggcgccttacttgaaagtgcaaccttgctgccacgtgaacgctccctgattttcatggtgtctgacttccatatgccactcgagcagctggaagccgctttgctactcatgctacgccatcatattgtgccagtggtgttatggaacagcactgaatacaagcagttaccagagtttggcatcacgagcatcaatgacccggaaaccggcgaac

SEQ ID NO: 60521 - DNA, 279 bp, Glycine max
  Peptide Sequence Number=SeqID_177299
acgagaaggaggataaatgaggtgcttcttgccgctgtgctggtcgtcttcttgctcgaacacgatgctccgaagccgcctggcgcgacgttccttggtggagatgttcttgtcggaggcggcgcgggggatggcaaggatcatctcatcgtggttgggatcagggcgggggaagtcatccaggtaggtgaagggctccggccccggaggatgacgacggcggagtgggtaagtggctgcggaacctcacttgctcgctcactcacttcactagcgtaa

SEQ ID NO: 60522 - DNA, 627 bp, Glycine max
  Peptide Sequence Number=SeqID_177300
atgacatctgagtcggcacaggaaattgcagataaaatagactccttagaagagcaggtaacgcaaggttcgtttgtaccccatggtcggcaagacatactgaacactgccattgggcgacctgaccatgggggtcgcattcgggcagcaggctcaggtgtgactattactcagtactacggaagggcatcaaggacatgcagcagctcgtccacatccatcagccaacaacaactagatgaagttgttgcaaggcttagggaagacatgactggtcagattagggaagaattgaggactcagctagaagaggaaaataaaatgagcttggaaataatgaccaatgcattgaaagaggctattaaaaaagagttgtcaaataaaggatccccagagtcgctccaaattcagttggacatacaacaattaggtgcgcgtgtcagcactaagggaagtaatgttgttatcaatgtccagccttcacaagaacatcatgctgatgccataccattgatgggactgtatgtgcagcgtaaggatggtacactaaggttggtggccatggggaaaataatggagggggattcaatcatacacacagtggcatatgcagatgatgttgtcagg

SEQ ID NO: 60523 - DNA, 857 bp, Glycine max
  Peptide Sequence Number=SeqID_177301
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccagagcccacgctcctaacttttcactatgctgcctctggctccttacgaaacacgatcatgtgtgaggagcccaacatggcacttagcacacagctaggccacaacacccggcaggtggtactggtgttactcaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 60524 - DNA, 243 bp, Glycine max
  Peptide Sequence Number=SeqID_177302
atgtgtaggggaaaggacaatgccaagtgtagcgaaggagtacccaaaattggtaaacatcaatactcaaggcagtatgcatttgactttgtactttgtcaaaacaggtcacgaaggaaacgctattggaggcatcccacatttagttcttccaaaataattattcccacatggcagcattggattacttcggagttagacagagatatttttcttcccacatacgatggaaaaatggcctaa

SEQ ID NO: 60525 - DNA, 613 bp, Glycine max
  Peptide Sequence Number=SeqID_177303
atgtcttgcctagtgatcataactctgaccttcctctgccgaagtgtcagctggtgtatgccacctaccaggcacactctagacccggatatgtctaacagggccctgggatttccggcattgatcacgggcctctgtcagtccttcggggttcccgtcacacctagtaaggtgatccaaccgccgatcacccgggccttcattgagaagtattgcatgcctaggcaggcgcagggtgatgcaccacaggccgcagacgcaccgccaccacctcatcaagctgatcctgctgggtcattaggcatggagcggtatctacagcacttggttcgccagcaggcggccaaccaccgggggcaggtgcagatacatgagtgtctctaccagctcagcctcagcagcaggcccagggcttcgttccctttgtgtgtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaag

SEQ ID NO: 60526 - DNA, 696 bp, Glycine max
  Peptide Sequence Number=SeqID_177304
atggttgccctgatcggtcctaacggtgccggaggtgatgcagttaaccggcagcgcgccgctggcgcagcgcgactatcgctcgctgtcgggcggggagcagcagcgcgtgcagctggcccggcagtccactctgcgcctgttgcaccggctgacgcgcaatggccgcttcagcgtctgcgcggtgctgcacgatttaaatctggcctcactgtggtcggatcgggtgttgttgttacaccacggccagctggtggcgcagggcgcgccgcacgcggtgatgaccgaaccgatcctgacgcgctggtatcaggccgacctgcaggtggttacgccgccagcgcaggatcggccgcagatacagctgcggccataacggcaccctgcaccgggtcagggcgcctggcggcaatcgacaatcagccgaccacgcacctggcccgccagcagctgttctgcgcctgcgcgcgcctcgctcagtggaatcactttggtcatttgctccagcagcgcgccgtcaaccagttccgccagacgctgccacgcctgctgacgcagtggtttggcgcacatcacgctgtccacgccggccagcgtaacgccgcgcagaataaacggcgcaacgctggtgggcagatcgaggccctgcgccatgccgcaggcggcgaccacgccgtcgcgctggatcccggctaa

SEQ ID NO: 60527 - DNA, 264 bp, Glycine max
  Peptide Sequence Number=SeqID_177305
atgcggcgcggcggttggcgtgctgtcgtggctgagcaacgaccagcagctgcgtcagctgtcgctgtggggcatgggcagcctgacgggtgcccagtggccgagcctgctggtgtgtgcgctgctgattgttccggcgctgctgctgcgccagctgttggtgctgagtgcgctgctggtgggcacggcggtggcggtcagcggcattatcggttttgtcgggctggtggtgccgcacgtgatgcgtttttgtctcggcagtga

SEQ ID NO: 60528 - DNA, 225 bp, Glycine max
  Peptide Sequence Number=SeqID_177306
atggctactaacagtgaaccaccacgaaactcacaaattggcttcgaggatgtaaccctaaacttgatgtcttccttgtcacatgtgttaatgctaagtttagaagacaacaaagaaggttcatcaacaagtatagcagtaatatcaatctcttttgcaactagcattgctcaaatcgaactaaaatggcccgaggtaccaacacaaaccacaaaggatggttga

SEQ ID NO: 60529 - DNA, 180 bp, Glycine max
  Peptide Sequence Number=SeqID_177307
atggtgcatgatgatgatcattggattcatggaaattatttagggcaacactttccaccaacagctcttccatggttgttccaacaattgaatagtaacaataatgatggccaagctgcaccctggaatcaatctcttctaatgccttgtgtgcaagtgatactttgtgataacatataa

SEQ ID NO: 60530 - DNA, 213 bp, Glycine max
  Peptide Sequence Number=SeqID_177308
atgtgggttaggctaattaaggaagagaaatccataactgggagagaaacgcgaggaactggaaccagagaaacagcacgcaaaccgaggcaggattttagcgtttcaaaggtcaggtttttctcactttttgtggctgagtatgggtcacaatcaaaagagaaagtgggccctttttgctccactcaaatggagacatgtggcatagcttaa

SEQ ID NO: 60531 - DNA, 156 bp, Glycine max
  Peptide Sequence Number=SeqID_177309
atgtttgtattgaacaatgctttgaaaggacttgacgatacttcacaaagtaagtccaaggctgctactaggtggattgttgttaaagcatgtaatcgattacatgaggactgtaatcgattaccagccgctcaaaatatttacaatagtcattag

SEQ ID NO: 60532 - DNA, 274 bp, Glycine max
  Peptide Sequence Number=SeqID_177310
atggccgtggccgcggctgctgcggcggcataccgcggccgcgcgcggggaatgcggaggaaaggtaaagttacagctccgctaagaagaggaggctactgggtgctgctggccgcccaaaggtggtggtggccgccccgcgcctcgccgcccgtgcggtcagcagtgcagcacggcgcagccgtcaagcggtcagccgcaacgcatccacagcagcagcagcagcagcagcagcagcagcagcagcagcagcagcagcagcagcagcagcagc

SEQ ID NO: 60533 - DNA, 240 bp, Glycine max
  Peptide Sequence Number=SeqID_177311
atgcatcatagccatgctagtgctagcttttccatcaagtggagacctaaacgcccgcataccggctgtcaacaggtgcctagttggtgggggggcgggggggctggtgtagctactgcgtccggacggactgctattgctgcgctgcgccggctgcgatatatcgtctcgctggctcaacgtcgtcctgctattgcagcgcgcagcttgcgacggtcgcgggatgtgatcaccatttga

SEQ ID NO: 60534 - DNA, 616 bp, Glycine max
  Peptide Sequence Number=SeqID_177312
agggctgcatgccctcaccttgagaggactacacgtcctcgccaacgtagggctacacgccctcacctttagaggactacacgtcctcgccaacagagggctgcacgccctcacctctagaggactacatgtcctcgccttgagaggactacacgccctcaccttgaggactacacgtcctcaccatcagagggttgcacgccctcacctccagaggactacatgtcctcgccttgagagggctacacgtcctcaccttggaggactacacgtcctcgcctttagaggactacacatcctcgccatcagagggctgcacgccctcaccttcagaggaccacatgtcctcgccttgagagggctacacgccctcaccttgggactacacgtcctcaccatcagagggctgcacgcccttacctccggaggactacatgtcctcgccttgagagggctacacgccctcaccttgggtactagttaccctcaccgtcagagggctacacgccctcaccttgaaaggactacacgtccttgccagcagagggctgtactccctcacctccagaggactacacctccgcgccttgagagggctgcacgccctcacctttag

SEQ ID NO: 60535 - DNA, 651 bp, Glycine max
  Peptide Sequence Number=SeqID_177313
gcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacgagaccaagtttggtcattctgcacccaagatacgcggagataccttacggttatctgcacccctttgctaggcagacacagttgtgtccgatggcaagcagagaccaagtttggtcattctgcacccaagatacgcggagataccttacgagaccaagtttggtcattctgcacccaagatacgcggagataccttacggttatctgcacccctttgctaggcagacacagttgtgtccgatggcaagcagagaccaagtttggtcattctgcacccaagatacgcggagataccttacgagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcaccccttgctag

SEQ ID NO: 60536 - DNA, 674 bp, Glycine max
  Peptide Sequence Number=SeqID_177314
gtaccgcccagcagtatggcctggagccgaagctgctcaatgcggttgaagcggtcaacgatgcacagaagggccacctgttcgccctcatccagcgccattacgacaagggcgaggacgaaggcgtgcgcggcaagacgttcgccgtatggggcctggccttcaagccgaacaccgacgacatgcgtgaggcctccagccgtcgcctgctggcccagctctgggaaggcggtgccacggtgcgtgcctacgacccggaagcgatgcatgaatcgcagcgcatcttcggtgagcgcgacgacctcacgttctgcagcacggcaggcgaagcactgcagggcgccgatgcactggtggtggtcaccgagtggaagcagttccgcagccccgacttccagaagctgcgcgagcagttgaaggacgcagtggtgttcgacggccgcaacctgtatgagccgggcgaagcgctggaagcgcgcctggtcgagctggaaatgcgcgtgtccttccaggaacaggcgctggccgaactgagcgatgcgctggctgatgcccgcatgcagggcatgcgcaacgccgatgtgctgcgcgtgctgctggaagacctgggcaaggtccgcaacgcactgaattcttctgatccggcgagcgaaccgccgccgccgcactactga

SEQ ID NO: 60537 - DNA, 216 bp, Glycine max
  Peptide Sequence Number=SeqID_177315
atgaagatgctatcccagcttatggctgaggtaaccatcacgaagctgaatgaggagaggcacaggaacactcaagaaaaagatttgcttaagaaagagttggaggtgttgaagaggcaaatcaatacgaaaggaagtcaggctggttttccatttctgtttgtttgcatggttgctcttatcagcgtggcagttggatattatattcacccataa

SEQ ID NO: 60538 - DNA, 315 bp, Glycine max
  Peptide Sequence Number=SeqID_177316
atgtcgatctccccctgtggaaggatcgtgctcacaagacacctagtggacccggagaagttcaatagggtcctggggtttccagctctgattacgagcctctggatcgcgcccacaagacacccagtgggcccggagaagtccagcagggccttggggtttctagctctgattacgggcctttgtcagttctacgaagcgcccgtcgcccccaacaaggccattaggccccccattaaccgagctttcatcaagaagtactgcgcccctaggcaggcgcaggacgagacaccacagcagcctggggatggctaa

SEQ ID NO: 60539 - DNA, 505 bp, Glycine max
  Peptide Sequence Number=SeqID_177317
atgctggtttatgacggcctgacttcccgttggggcatgggttttgcgtcgctgctgattaacttctccaatatcgtcttcatcgtcattctggcgcaactggtgctgtgggataagcggcgtgccgattcgatgccggggccaattaacgctctgaatcttttttgttattgcctgctggcggcgttggtgtgcgcggcggttggcgcgttgggctcggttgatgttgaacgggcgacttttattccgcaactggcggactggtttagcgagcagttctcgaccgcggtcctcatcctgccgtttattctgaccctgacgctgccatcggtgctgggccgctttcgctttagccaactactgccggtgatagcgctggtgctatcgatggcgctcggcgtggcggtaggcggcgccggaagcctgactttcccgctgccggcgctgatctggtgcgcgattcgctatccattgccgctgacctgcctgctaacgtttattaccg

SEQ ID NO: 60540 - DNA, 360 bp, Glycine max
  Peptide Sequence Number=SeqID_177318
atggaaaatctgttcgcccggcttgggcgttcaacgttccgctctcgtttccacctcggggtgaaagagcggcagtattgttatgataaagggccagagattatcgacagccacgcggcggattttatcgccaaacggctggccccggcgcagattgctaatgacggcaagcagacgccgatgcgcgggcacccggtatttatcgcccagcacgctacggcgacctgctgccgcggatgtctggaaaagtggcatgcgatcccgcgcgggcgtgaactgagcggcgaggagcagcgttacgtggtacaggtgattcaccactggctggtgatggaaatgaacgcgattaccaaccgttaa

SEQ ID NO: 60541 - DNA, 117 bp, Glycine max
  Peptide Sequence Number=SeqID_177319
atgtctctactgcattttctggaaaacgtgatgaactcgctaatcgagcatgcagcgctaaacgagatcatcagtactcattcctttaaggagcttagcgcatacccttgtggctga

SEQ ID NO: 60542 - DNA, 771 bp, Glycine max
  Peptide Sequence Number=SeqID_177320
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggagctgaagttttctccgtcaaatacttcgacaccacggccttcctcgcgcagtcgccgcaattctacaagcaaatggctattgccggcggcatggagaaggtatttgagatcggcccggtcttccgtgctgaaccctccttcacatcgcggcacgaaaccgagttcacctccatcgacatggagatcagctggattaaagaccaccatgaactgatggactttgaacaacgctggcttgcccattccatcagggtggtcgcggagattcatggccctgagatcgaggctcatttcggcgtgaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 60543 - DNA, 261 bp, Glycine max
  Peptide Sequence Number=SeqID_177321
atggctattacttttgctttaacaaagcttatactcctttatagacagctatcctgcattatatatatgctgatatcactatcctggattatagacatctatgctgcacttgaagtagctagatttggttgcactttgagtgaggttgacatattggatgatgggtactgctggcgtaagtatggccaaaaggttgtgagaggcaatcctaacccaagggatactgagatgggcatatgggtgaaggctgatgatatatag

SEQ ID NO: 60544 - DNA, 168 bp, Glycine max
  Peptide Sequence Number=SeqID_177322
atggaggttgcaggatcaaagaaaggaatttttgtgtcacaatcaaagtatattctagatcttttgaaagacactaggatgatgggttgtaggacagctaaaactcctatagatcctaacaaaaaacttggaacatcaactcaaactacaaagatggaagcaaattga

SEQ ID NO: 60545 - DNA, 303 bp, Glycine max
  Peptide Sequence Number=SeqID_177323
atggaagttggaagttggaagttggaagttggaagttggaatgaaaattattggaagttgaaagttgaaaatggaggttggaagttggaagttgggaggggaaaagaatcaaacaaagttgcttcaaaagataagcatggcttcaagattaatacaagattgcttcaacaaaaaaagccttgcttcaagattaactcaagatcaagccttgccttaaaacaaagtgttttcaagacatgcaaggctctggtaatcgattaccagcagtgtaatcgattaccagaagacagggttgagaaatag

SEQ ID NO: 60546 - DNA, 219 bp, Glycine max
  Peptide Sequence Number=SeqID_177324
atgctaggttacagtgtctacaaagttggcttagctggcaaggagcccgctaagcctaagcgaacagggccgctcagctcagcagatgccgcaaggaatttcgcttggcgcaggagatcctggcttagcgggcggccaatcaataaaaaacttttactaagttacccgggcttagcaaatcagcctcgcttagccacaggtactgtaccaggtggatga

SEQ ID NO: 60547 - DNA, 1602 bp, Glycine max
  Peptide Sequence Number=SeqID_177325
atgaggttgtctccccgcataggacctaacatgagtgttaggtcatccttgtctaccccagccattgctggctatgagtgggtgaagctagcgaaccccgaggactcttgtaagctggccgttcagacttgcaggagtgatgacctcccgttcttgaggatagtgtctggtcctctgcctttctttaccttgtatagatgtttgtttgaggtcctgggtgtcattctacccttgatcgcttttaagtgtgctttgctggagcacttgaatgtggccccttccaagcttcacccgaatagttgggcgatggtgcgagcttttgaaattttgtgtccttttttcaatgtccggcctagtgtgtcggtcatcttattcttctttcaaataaaattgttaggcaagattggatgggtctccttgaacaatgtgtccaagaagctgttcgagtttgaatcaaacgtatttcaccatatcaaggaccatttgtttaaggtcctggctactaatgtcgtggctgatggaatgccactgatgtttaatagggacggagagcctcgcttcccattctactggcagtcttatcccactaggttcaagtcgtatgatgaggatttgttgacccttgtggagagagtcaacaaagcgattttggagcagctaccggcctcgttggatgtgtgggtcatccaatctcttccttcggtgattgatcctctcgctaccttggatggtattacgaatgacttctcttggaggcgactcgtgatgcaggtcgaacctgtagttgggaccatgccactgtctgttgctactccatccattggagaagggggccaaactgctggtgaggttggtcctgttgttgttgttgctgaggtcgcccccagtgctctttcctctgcgttggtaaagaggaagatggatgatgttgttcagccgttgggccgcaagaagtcgaaggaccctatgagcctccgctccctgaggcaggctgccatcgaggctcctattgctgccattgttgttgcgaatcctgctccttcacctcctcctatggcttttgttcaagaggctaagtctgttatggtgttgtcgtccactattgcggcccctttattaagtgccggtgaggcgaccactggtgctctcccaatgctgcctccttcttcatcgactctagtggccctccctgatgttgttttggcgagtatggcatcgccttcttcatccccgcatctccctcgatcatttgaatttggcaattatgaaggagaatggactgcgacaccaataggcggtgcaaaagtttatatccttggaggcggaggtcgccaagtggagggctactgctcggactttgtggctgagaagatggacctggatggcaaagtgaagagcatggtggcagagaaggacgagcttaccaagagaattactaacttagaggcccaaattagggagtcagagtccaaattgaaggagtccgagttgcgggctgtcaaggaaagggaggccagcaaggagctcgaggaagagctgattttgtacaagaaaaagatcatggagcaatatgagaaaggctttctaaaggtcattaggtag

SEQ ID NO: 60548 - DNA, 231 bp, Glycine max
  Peptide Sequence Number=SeqID_177326
atgaagagtcacacggaaaccaggacacatatagcgtacaccaccatacctaatcacagcattcagtcaatgacgcaaggcatgactcagatcctccacgccggcgagcacctccatcgcatgataggcagcgagtcagcgactgctcccctgattgacaggtgcagtcctacatgtccccctacacccgcactcgatcgatgctccacgagctcagacggtgtttcttga

SEQ ID NO: 60549 - DNA, 222 bp, Glycine max
  Peptide Sequence Number=SeqID_177327
atggcgacgccatcgccggttccatcaccatcctctctgacgccaaactccgttcaaatccaaacaaaggtcgttgccggtgagctcgttcccggagagggcgaggtacgggaggttctaccaggtgccatactcgggagggatctgaccagagaagaagttgctgccgaggtgaaggtggcggatgaggggcatggcagcgacggagagaggaatttctaa

SEQ ID NO: 60550 - DNA, 249 bp, Glycine max
  Peptide Sequence Number=SeqID_177328
atggtaactgagttaatcaatgtgaaccctatcatatatgaaaagaaagagcgtcgagctccatctactccccatgatgagtatgatgtcgaaccaatcgaccaacaagagggttacatttactccaacagtggaacattgcagtatggcaacagttataggtctatgcttacgtgtcaagctcatgagaagcttgccttcatgatacaaggtggatatcagagtggcacctggatctcatgcaactga

SEQ ID NO: 60551 - DNA, 168 bp, Glycine max
  Peptide Sequence Number=SeqID_177329
atggttcaagctggaaaacacaggattgcgtacttattggcttgtggcaaaacaaaaggaaataagtacctgtctccaaagaggaagcaatctagactcatcacccaggtcattcaatcgttgtgcactgcagaacataatataatagagtttcacaatttattttga

SEQ ID NO: 60552 - DNA, 417 bp, Glycine max
  Peptide Sequence Number=SeqID_177330
caatctggaaagagtggcattgattctgtggctacctctcagaaactaaagggagaccttagggccattttcaatgttctttcaaaggacatgcaacaactcatgctttcaaaccctgaaagggcgtcccttctgcaaccaagtccagagtcaccaaaacttccagggcgtccgctcatacaagttgcggttgggtcttctacatcaccccggggtatttcgacatccggtgacttctctcctctgatgagagacagaaaaattgagttggtcgtggaagccgtaacgaccaattgtttcgaagttgttggaagcggtgatttagagcttgtagggaaggttgtcctccgacatgatgagaagttttctgttgaagaacacgaggccagtgttggcggcgccaatgctgttgcgatg

SEQ ID NO: 60553 - DNA, 1896 bp, Glycine max
  Peptide Sequence Number=SeqID_177331
atgagtaggtttccttcgttttcagtgagaacagaagtgagtccgagtgttgattcagaatcattgcaacgatgggttgttgccttttgtgctataaggtttgatcttgaacagggccagcttgtagaagagtgttatccacaggggtgtttttcccatgatgaggagcttgaaattgcttatagttcctttcctgattccgtttcacagcaccaaaaccaaaaccgatccagcattcacgattgtatcttcttttaccgaattcacaggcaccttaagaagtccctagatgaaaagggtgtcgctgatagtagcaatgcttctaaattcttgtatggttatgtgtttaataggcagagacacgatgagcggttaaagcgtggtggggagcagaagtccgtggtcattttgtcttatagtccttattcaagtgtgtttagacctttgttgcaaattgtaggtcctttgttttttgacattggtaagaaagcattggagcatattgctgcttatgtttcaaaatggcctgctccccttcctggtaaggtgatggatcttcctattggaaatgcaacccttaaagtgaacttgccacctgctcacggtttgcctgtagaaggtgaattgtcttttgaagagggtgcttcttctgtggcaccttttgttcctaatagtcagccagtcccacaaggtctttttcatgattcagatatttttggatcgttccgagggattctattgcagctttggctgttgtgggagttgttgctcattggtgaaccgatgctcatcattgcccccacacctccccaatgttgtgaggctgtagctagtcttgtgagtttggttgctccattactttgcagtgttgatttccgtccctattttaccattcatgacccagtgtttgcacgtttaaactcaatccaagaaggccaagctttccccccgatgattttaggggtgacaaacgtgttcttcctcaaagcactgcgtaacatcccacacattgtctcagttggaagtcctcctcttaattcgaacaggcttgcccttacaactaggtcttctactggcagaggttctggcagaccagaaggtcttgggtttcaacaactttccctaaagaagttctctccttctagtttattgagtgcggttaggctgcggagagatggccctctatgtctcatgacagaacataaggaagccatttggagtatatattctgcgacaactaagccagatacttctatcttaaataggcttatagatgctggggtgtcaccaagagttgaagagtcaatgtcagttgtgaataatgagatattacggagacacttcttggagctcacaacaaactttttggctccttttagcccatactttaggacttcaacaccattagaaggatcttctccttatgtagatcctccttctctacctccattcaatgccgatgaatttcttgcaagtttatcagcaagaggtccagggaagtttatattaaagcgaatgaaatctaactggcttgacttatacaggcgattcctgaatggacccaactttctgccatggtttcagagaaggcgtgctgttgcggaacaagaacaagatagattatggagacaagcaagaatgaaaaccgacatacaacaacttatttctagactatctgaattggaaattgtggactccttcaatgtcatagagagacttctcctcagagaaatacagggccctgcatgggcccgtgtgcggcggtgttttgagttggctgtgcacgtggatggtgtgacagtctttgacgatgacaatgggtactgttcacccgtgaaaaaagcacaaagatccaaatgggatgccttgagccggagggagagaagatcaatgtga

SEQ ID NO: 60554 - DNA, 276 bp, Glycine max
  Peptide Sequence Number=SeqID_177332
atgcaatcacaaggacttgtacaggctcctgagtctaaggttggtctttttgctgcccgtgtcaacacaaagggaagctgtgtcaatccctcgaggccggacccagacaagggtgaattagacaaatatgggttgtatgttgatgacaatcctccccacctggttacccttggacgagtttatgaggggccgacaactatccacaatgttcctttgggcaatgatcaagtgaaggataaacaacgagctgagggatctatgaatacctatagatag

SEQ ID NO: 60555 - DNA, 306 bp, Glycine max
  Peptide Sequence Number=SeqID_177333
atgaaattttttaagagggaagggttaaggaagaggatcaaagtattaaccgcttccgagtttctgagaatcgtgtctcccctgtcgatgaaaagaggagaaagaagaacgacgttgtgtaaaggagagaggaatcatcacgttgttgttttattctcgcgcaacagagtaggcagcataggaagtggatcggaaacacgactttcttcgaggggaatagattcacgattgcttccagaagcttccgttgtttggatctgggattggaatcgttgggatcacgtagatcgccctcaatgtaggtga

SEQ ID NO: 60556 - DNA, 243 bp, Glycine max
  Peptide Sequence Number=SeqID_177334
atgccgtgttttgtgatatttggctcagtcatagtacttgcatacattggtgtgtttggagctgggctattagctggctttcttttccaattttttgttcaagacacgtcatttccaacattgaagcaatccaaccccgcaagggcattggatagaagactccatgaagattgggccagagatgcaagagaaggccctagggttctcatgagccttagggtagatttccggcctatgggctaa

SEQ ID NO: 60557 - DNA, 657 bp, Glycine max
  Peptide Sequence Number=SeqID_177335
atgtcggatgatgttctttatgaagtttctgaagaactgattgttgttgggctttggctcaaattggagaaactcttcatgacaaaatcaatcagctacaagaaaggtatgccactgaaggaacatcttgatgagctaaactctattccgatggagctatgtgacattgatgttaagatggaagatgaagatttggcattgattttgaaacaacattggatgaagtttccaaatgttgtgcacacaacaaaggccatgttggactatgtgcatttcaactgttgggggccttcgagagttccatcattgggaggggcaagaggaggttacctagtcgggagcttcatgtggatcgacacacattatgaacaaaaaggaaaagaatggacaaacacatgtggtgaaggcatgctaaagttaaagagacggttatgttgggaattgggggatggtccgaaaggttcaaaggaacctaggggaatgttgagttttgataacccaactagggctccattggagcttgtaggcctaggatcttcttcatcaatggattcctttgcttcttataagatgaatggcatcggaatggagaaggaagagagggaggagacgccacttcaaggagaagatgagtctagaagaagctcaccaccatag

SEQ ID NO: 60558 - DNA, 1023 bp, Glycine max
  Peptide Sequence Number=SeqID_177336
atgagtgaaatagaggaagtgcaagagcagatgaaggccgacatggaggccatgaaagagcaaatggccacaatgatggaggccatgatgagtatgaagaagataatggaggtcaatgcggctgcagttgccgctactagcgccattgctgaggttgacccgattcctccatctggcctcaaccaaataaatcatccaccctcagataggagccaacaacctcaatctaatcatgcacatgtctctcaacccatgggggagatgcatgaaataccctaccataatctagccgacttcgagcctcgcctcagatatgccactgaggggcaagcagttgatgtggggagagtccctcctgctatggcaaaaaagggaaaattagatcatatagaggagaggctcaaggtcattgaaggaggcggagatcatgcttttgctgacatggcagagttgtacctagtgcctaacatcgtcatccctttgaagttcaaggtaccaaatttcgataagtacaaggggactaattgccctaagaatcacttgaaaatgtactgtcggaagatgggggcgtacgcaaaagatgaaaaactactaatgcatttcttccaggaaagtcttactggggcagccgacctagtggttgccttcgttagacggtatcagtacaattctgatatggctccggataggatgcagctacaaaacatgggtgaaaaggggcatgaatctttcaaagaatacgtccaaaggtggagggatctggcagctcaagtggcacccccaatgatggaaaaggagatgataacaatgatagtagacacgttaccggtgttctactatgagaaaatggtgggttacagaccttcaagctttgcggatttagttttcaccggcgaaaggattgaagtgggtctggaaaaaggaaaatttgattatcctgctttgatgcatgaaaagcttggggcaaatagagaggatgagaaggaggaaggaacccatgctatgactaccattcctacatga

SEQ ID NO: 60559 - DNA, 1497 bp, Glycine max
  Peptide Sequence Number=SeqID_177337
atggaaaccacaccaccacaacccaccatacaagaacccaaagatcatacacacacagtgaaatctacttcctcacaacccagacgctcaacacgaatgaagcacgcaccaacatacttacaagattatcaccgtgatctctcttcacacaatgccagtgcttcaacgattattcgctaccctctgagcttggtcctttcatactcacgtttgtcacccacacacaagcacttcattatgtcaatctcatccacagtagaaccttcctcctatgccgaagcttctcagcatgactgctggattaaagcgatgaaagctgaactacaagctctacaatcaagcgacacctggagacttactcctcttcctcctcataagaccgccattgggtgtagatggatatacaagatcaaacatagagcagatggttccatagaaaggtacaaggcacgtctcgtagcaaagggctacacgcaaatggaggggctcgactatcttgacaccttctctccagtggcaaagctaaccacagttcgtctcttccttgctcttgttgcccttaatcagtggcatctaagacaactggatgttaataacgcctttctccgtggcgagttagatgaagaagtttatatgcaggtcccgcctggattatcggttccgaactcgcaactggtatgtcgtttgcagcgttcactatacggactcaaacaagcgagtcgtcaatggttcacgaagctatcgggcctcctaacatctcacgacgatatcattttaactgggaatagcagctccgaaatacaggatgtaaccatgcttcttgatcagacatttaagatcaaagatcttgggaatttgaaatacttccttggcctggaaatcgcacgttcttctgcaggaattcatttgctcatcggccgacttatatacctcaccaacactcgtcctgatatcgcgtacgccgtgcaacaacttagtcaatatatgtctagccccacaaatgctcatcttcaagctgcttatcgggtacttcgatacctcaaaggaacaccaggctccggtctcttcctctccgccaccggcactcctcagctccgagctttcagtgactcggactgggcaggctgtcaagattccaggaaatccaccaccgatttcgtggtctacttcggttcttctctcatctcatggcaatctaaaaagcagtccacagtttcacgcaactcttcggaggctgaatatcgagccctagcttcaaccacctcaatccagattgccactaatcccgtcttccatgaacgcacaaagcacatcgagatcgactgtcatatagttcgtcaaaaggtcaccatgggtctccttaaactgcttccagtctcgtcttccttacaacttgcggatatcttcacgaaagctttacctcctactgcttttcagaatctttgtaacaagctgggaatgatgaatatccattcccagcttgaggggggattttaa

SEQ ID NO: 60560 - DNA, 213 bp, Glycine max
  Peptide Sequence Number=SeqID_177338
atgaaatcttttccaatctgttacagcagttgttactttgttaacaacataactccaccggagaatctagctaacgacctttacccaccaaccatattcttttctatccagcctgaacccgagactatgattttgcaaactgcaactttgcctcccattccaacaagtacaccacagctaccagagtttaaggaatttcagctggaaacttag

SEQ ID NO: 60561 - DNA, 690 bp, Glycine max
  Peptide Sequence Number=SeqID_177339
atggtgaagagaataaattggatgacttgtagtctgctgaaaagtgtgagaaggagactaggaaggacattgagagaagtcgtgaagaatgatttggtctcaaataacttgatgattttattaccttttgtttttgtcaatacgcgcatgagtttattaattctaagggcttccaatgtcattggacttatttcaacagacagccttgccttgcccggcatgtgggcccaaaatactttaaatacgttgtatcgtagagcatggactgctactgaacataataattgtatttactgtcctgagcatggactgctactgaacaagaagcaatactctaatcccaagtacaggaaccagggaactagtgctctcactgcagagaatcatggcatgcaccttcatggttttagcttctttgtggtgggtgtggggacaggaaatttcaacaatgtgacagacccaaaatcctacaatttgattgatccaccagaagttaataccattggtcttcctaaggatggatggcttgccatgagatttgtagcaaacaatccaggggtatggttcatgcattgtcatcttgagaggcacgctagctggggtatgcatactgtgctcattgtgagagatggaggtaccatgcaaaccagtatggttccacctcctaaatacatgccccctagttcttaa

SEQ ID NO: 60562 - DNA, 1254 bp, Glycine max
  Peptide Sequence Number=SeqID_177340
atgaatgaagcaacattcaataataccgagagctatttgtatcttcatccaagtgaaaacccagccactactcttgtctcaccagtgctggattcaactaactatcattcatggactcgttccatgattactgcactaagcgccaaaaacaaaatagaatttgtagatggaagcacgccggaacctctgaaaacagacaggatgtacggagcttggtgccggtgcaacaatatggtggtatcctggatagtccactccattgccgcctccataaggcaaagtgtgctctggatggacaaagctgaagacatttggagagacctgaagtcaagatactcgcaaggagatcttctaagaatctctgatctccagcaagaagcatcgacattgaggcaaggagctctctcggtgacggaatatttcactcggctgcgcgtgatttgggatgaaattgaaaacttcagacccgacccagtctgtacctgcaacatcaggtgttcttgctcagccttcgccattattgcacaaagaaagcttgaagatcgagccatgcaattcttgcgtggcttgaatgaacagtatgccaacattcggtcttatgtgttgctcatggatcccataccagctatatcaaaaattttctcttatgtagcgcaacaagaacgacaactgctaggtaattcttctcctaacctcaactttgaacctaaagatatttccgttaatgctgcaaaaactatctgcgatcactgtggacgaaccggtcacaccgaaaacgtttgttacaagaagcatggcatgcctcttaatcacgaagcaagaaacaggagcactagcggaagaaagacatgcactcactgtggtaagataggtcacaccgtcgatgtgtgctaccggaagcatggatacccgccgggatataaaccctataatggaagaagaaccacagtaaataacgtgatgacggtggataataaacccctggatgatcaaactcagcatcatgagtcccagatctccggccatcggccggaaacgcggcatcggagcaaaccaaacaagttgcctcaatctcatcctgcaccattgataaaccttccaacccaggatacgaacaatcgtatgaagattggtatagttgaagagagacatggcctctatcacctcataccagaccaaacagacaaagccatttgctcgaccattattcaccctaaatgcaatattatcccaatagatctttggcatttttga

SEQ ID NO: 60563 - DNA, 756 bp, Glycine max
  Peptide Sequence Number=SeqID_177341
atggagagagaaggaaacgattgtgttgtgggcgacacgtctctcacagcttcaccttttgatggtgaagcttccattttgagttccacccttttgttggatcacgttggggaggtcaccctcacctttcactcagataggctgtcttggaaattggttgaaccattggataataattctctcaataaccctgtgtatcgaattcaccgtactatgtgccaggatgtttcaacttgtttaggcattaaatatttttctaaggttgctactgggatcaaactttctgacatatatgcttttgagttaaatgatcatggttcaattcacatatcaagtctccctcctgctactgaatgtctacttttaggtcaagacataaagatgtacagctttactgtgcatggttttataaggaacaagaatcaaccttctcaatgcatcctggttgaatatacttttggtcataaaaatttgccaacatgtcagatgtgggtaaatcaacttaatgcttccttgaaacatgaagttggaagaccaaagaatcttttggtttttgttcatccaaggagcgggaaaggtaatgggtgtagaacctgggaagctgtggctcctatattctctcgtgctaaagtagaaacaaaggtgattgtgacagagagagcaggagaggcatttgatgtgatgtcttctttgacaaatgtggagcttaactcatatgatggtgttgttgctgttaactggactggaaatagctag

SEQ ID NO: 60564 - DNA, 474 bp, Glycine max
  Peptide Sequence Number=SeqID_177342
ggtggtgatggatttttcaatgaaatccttaatgggtttctttctcccaggtttaaagctccctacccaccaactccatcagattttgttcatttggttaaagataatgatgattccttggttcttgatgaagatgaaatagttgatgagacttcaagtcgaaatgaagaccagtttcctctgatttcaagtccaaaacaatctgggtctagaatctcaaattcaaattctgaagataaggctgctgaatttcctcttcctaatgaatggtttagatttgggattattcctgcaggttcaactgatgcaattgtaatctgtacaactggaactcgagaccctattacttctgcattgcatattgtccttggtaaaagggtgcaccttgacatagctcaagttgtacggtggaaaagaactcctaaatctgaggttgagcctcatgtgcgctatgcagcttccttttcagggtaa

SEQ ID NO: 60565 - DNA, 526 bp, Glycine max
  Peptide Sequence Number=SeqID_177343
gtcatatgaggcagaaataacatacctagatgttgaatcagatgaaaccaatttgacttccagaagggatcatgagggtaatctgttacaggcaataaggtctccacaaaaatcagaaagatgtatctgccgaattaattgcaaggtttgtaatgaaaagccaaatcatgcatccgttggagtttgcagcctcacacctcatctgaattcagaagaaacaagatgggcaagatccaaaggacgctttcttagtgtaggagctgctgtaatctcttgcagaaatgaaaaagcaccggatggattggtggctgatgcacacctgcatctgactcaacttacaagaagagggggaagtcccttgaattttaagtttgtggaacatcataagacccctgcgtttacttttacttcttcgggcaatgaaagtgtatggaatgtggatggagagatttttcaggcacaccaactctcagctcaagtgtttagaggccttgtatgcatgtttgcatctggtcctgaagtttaa

SEQ ID NO: 60566 - DNA, 1389 bp, Glycine max
  Peptide Sequence Number=SeqID_177344
atgtgtgagcaaagaaaggtgcatgtggatgttatagtgattgaatcagatgatgtggcaactgcaatagcagatgaagttgctaagggtgcaataaccaaacttgttgttggagcttcatctcgtggcttatttaaaagtaaacagaagggtatgtctacaagaatatcagtatccactccaagattttgtacaatttatgctatttctaagggaaaattgtccattcggccatcagacatgcctattgatggaaatattatagatgacgctagtgaaagtgaaaccagtttgtccaccagcagctcatctaactacacttccacctctcagacagaatctgcctcagtttcatcatatgctgctttacagtcctcttccctaacaacacaacgatttcaagctctttcaagtataaatagtgcccttcttagcacaaatccaagttttgctgacactaaccattctagaggccaatctctagatcttgggagagaaaatactgcttcaagttctgctagaaactcagacattgatcatgccttaagtcgagtctctagttgcaaaagcttcatttcagatactgaatcttggatgtatgatcaaaattcttgcaaggatgtgcaactagcaactacacttccatcacctaataggcaggcaaaatataaccttgagctggaaaagttgagaattgaactaagacatgcccaaggactgcatgcagtagctcaaactgagaaaattgaagcatccagaaagctaaatgacctaagcaagagacgatcagaagaaaccatgagaatgaaagagatcatttctaaggaggagaaggcaaaagaattagcaaaactagaaagagagaaatatcaagatgcatcacgagaagctgaatatttgaaagaatgtgctgaaagagaagcggcagaaaagaaagaaatggagttgagagccattcgtgctgcaaaagagaaagaaaagctggaggatgctctcagtggttccacgccccagtaccggaagtttacatgggatgaaataatcttagctacttcatctttctctgaagatctgaaaattggaatgggagcgtacggagtagtatacaagtgcaatttgtatcacacaactgttgctgtgaaagttctcactctcaacactaacgtaaacagcaaaagaaagcaattccagcaggagtgttcatggataattagtgtccaggaagttgaatcactcataacaatgagtataacactagaattgaaccagacaacaggactaatttacatcttttcttttatcccagttagagattttgagcagaattcgtcatccaaacttgcttcttcttcttggtgcatgtccggatcatggatgccttgtgtatga

SEQ ID NO: 60567 - DNA, 264 bp, Glycine max
  Peptide Sequence Number=SeqID_177345
atgtcggttgtacaaaaaccgatatctaaccccaacgtcgtttcaacactcctcgcaaacccttccctcagtgtggtttgtgaagccggtgccccagggtttggtggaagcccaggaaatgcggctatagttgatgaggagcaggttgttggagttagtgtaggcggtggggtggacttgaatgagttcaatggaggaaacgagaagagaatcagtggcgaagtcgtagaagcagtgattgagggaggaggaagaggaggatga

SEQ ID NO: 60568 - DNA, 213 bp, Glycine max
  Peptide Sequence Number=SeqID_177346
atggataagattctggaggccgatgcaaataatatgtctcagcattcctcgtcttcagttgttgctctagcaatcaagggtaacaagaaaagcaaatatgtggtacaatgggcacttaataagtttgttcctgagggaatgattatcttcaagctgattcatgtccatggtggaggtggttatgaattagcagaagattattcattaggataa

SEQ ID NO: 60569 - DNA, 267 bp, Glycine max
  Peptide Sequence Number=SeqID_177347
atgggctcagaaatctaccttgagggtcatgagaaccctagcgccttcttcagcagctctagcctaatcctcttggagcctcttgctcatggctctaatgaagaaaaggtttatcagaaggatacatctagcgaggaggacccgtccatgtatgaggaggattcatttatgaaggaggactcatctatggatgaggaggacccaatgatggcactagagaaaatggaggaggactcttcgcaggatttttcaaagggggattgctag

SEQ ID NO: 60570 - DNA, 498 bp, Glycine max
  Peptide Sequence Number=SeqID_177348
atggaggaatccttagagactaaggctttggatattctacattggtggagattaaagtttggacaatttttggtccttgcaaatattgcgagagatgttttggctatacctgtcaccattgtgacttctaactcaacatttagcactggtggaagagtgcttgatccatactgcaactccctaacaccaaaaatagtggaaactcttatttgcactcaagattggttaaaagaggcaccattactaatgcttacaaataaggaatttgagaaatttaaggaagaatcaaagaatgagttcaagattgaatcaagaacacttcaaggttcaaaaggaaatttgatttcaagaatcaagaatcaagattcaagattcaagttccaagattcaagttccaagaatcaagatcaagattcaagactaaagattcaagaatcaagagaagactcaatcaagataagcattaaaaagttttttcaaaaactgagtagcacatga

SEQ ID NO: 60571 - DNA, 168 bp, Glycine max
  Peptide Sequence Number=SeqID_177349
atgggagccctaattgggcaattagaaaaagaaaaggttatacacattttccattctaggtgtggtccaagaggtgtggtccaaggagatggcataaaaattgtgagatgtagacatgctcatgggagaagcttggagcatggagttgtttgtgtggaagaagattag

SEQ ID NO: 60572 - DNA, 894 bp, Glycine max
  Peptide Sequence Number=SeqID_177350
atggcgagtccgatgacatgcgggggtggcacgcgggggtaccttatggttatccgcaccttttgtcaaccagaggcaagcgagcccgttgacacgcaaagactaacatcgtcatctgcaccttttgtcaaccagaggcaagcaagcccgttgacacgcaaagacttacgtcatcttctgcaccttgtgtcatctagagacggcaagtccgatgacatgcaggggtaccttatggttatctgcacatttttgttaatcctgacccgtgaagtgaggtggcaagcggagatacccaagtggttatccgcaagcgagcacgttgacacgcaaagactaacatcgtcatttgcaccttttgtcaaccagaggcaagggtatcttatggttatccgcacatttctgctaatcctgaccagtgaagtcaggtggcaggcggagatacccgagtggttatccgtacaaagacaacttctattaatcctgacccgtgaagtcaagtggcatgcgcggggttaccttatggttatctgcacatttttgttaatcctgacccgtgaagtgaggtggcaagcagagatacccaagtggttatccgtacaaagacaacttccgttaatcctgacccgtgaagcaagcgagcccgttgacacgcaaagactaacatcgtcatttgcaccttttgtcaaccagaggcaagggtaccttatggttatccgcacatttctactaatcctgacccgtgaagtcaggtggcaggcggagagacccgagtggttatccgtacaaagacaacttctattaatcctgacccgtgaagtcaagtggcatgcgggggcaggcaagcccattgacacgcagagactaacgtcatcttctgcaccttttgtcatctag

SEQ ID NO: 60573 - DNA, 582 bp, Glycine max
  Peptide Sequence Number=SeqID_177351
atggccaagttcgaccctgagatagtcatagagttctatgccaacgcctggcccacggaggaggaagttcgggacatgcgctcgtgggaggccatcgcccagctgttatgcataccggggcaggactttgcccggaccgctacagggaggcgggttcggatcatgcgcaccagcatgactactctaactcagatatggatgatgttgttactcagcaacgtcctgcctagcgaccataactataacctccctctgcctaagtgccagcgccctttggacccggagaagtccaatagggccctggggtttccagccttgatcacaggcctctgccagttctacagagtatttgtcgccccatgcaagccagcaggggcaaagctccactctttatgtatgccctacccagagcagttcagggctgaggtcgcgtggcctggagactggcccactgaggacggagccggattagtgggatcccacggtgatgcggaggaagcccatatggacgaggatatgaccgacctgctcgattgcctgggagggagcagagccacacgatcgaggtcaccggacttgtga

SEQ ID NO: 60574 - DNA, 234 bp, Glycine max
  Peptide Sequence Number=SeqID_177352
atgtcttcatttacatttcaaagtgtcacaacctaccttttggcgggagggcgacatgagggctcatcgatgcgtcttccaagggaggaaggcgcgcggagttgccaccaacgtttattcgaggaaaacatcagaaaaaccagaaaagtgtggtctatgaacattaatcgtgaaaggtgtttcccttgctcctacgtattcctcaattgcgatgaggaaatcagacctatgtag

SEQ ID NO: 60575 - DNA, 732 bp, Glycine max
  Peptide Sequence Number=SeqID_177353
atggactggataggtcatggaggcagtgatggattgcatggttatgttccatctcttgatcatgtggttgcagatacgggggctttcctggaaaagattagatcagagaatcctgggataccatgctttctctttggtcactccactgggggagctgtggtcttgaaagcggcttcccatcctcatattgaagtaatggtggaaggaattatattaacctcaccagctttacgtgtgaagccagctcatcctattgttggttccctagctatgctcggtacacttggacttcttaagcttgcagtaaaaacatgctgtaaagctgtggctccaattttttctctggtagctccaagattccaattcaaaggagcaaacaaaaggggcattccagtttcgagggatccagcagctttgttggcaaagtactctgatcctttggtctacacaggacctataagggtccgaactggccatgaaatattgcggatatcctcgtacttgatgcgaaacttcaactctgtgactgtgccattctttgtcctccatggaactgctgataaggtgactgatccactggcctcacaagatctatatgataaggcagcttcaaagttcaaagacataaagctttacgatggcttcttgcacgaccttctgtttgagcctgagcgtgaagagatagctcaggacattatcaactggatggagaaaagattatttactatttga

SEQ ID NO: 60576 - DNA, 543 bp, Glycine max
  Peptide Sequence Number=SeqID_177354
atggaagaggaatctaagtcaaagtgggaaggtaaagccatggttgaggtagtaggcacaggcgcagaagtagcatgggctgtgttagaggatttctgcaacatacacaagtggatctccttagacacatgctaccaagtagatgggattctagggcaacctggcctaatccgttactgtgcttccaccgttgaagaaggtgttggtgctgagaagacaacaacaatcaagtgggccaaagagaagatactcgcgattgatcctgtccaacgttgtttgacctatgaagttgttgaaaacaacatgggatttaagtcctatgtggccactctcaaagtgctgccaattgaaggagatgggtgcaagatagagtgggggtttgtcagtgatccagttgaagggtggagttgtcaaggtttgaagtcatatgttgagtctactctccagtccatggccaagaagattgagtttgctctgatccgtttgcatcagagttttaaaactctcgacttggtaattgatctggcaagtgtatcgggttaa

SEQ ID NO: 60577 - DNA, 243 bp, Glycine max
  Peptide Sequence Number=SeqID_177355
atgggatcaagtcaagcacctttgcttaaaaagaggttctatcaagtcaagatcaagagcctaggagtcaccagtctgaaagaattaggacaattgatgggtcaagtccagcggcaacccttccgcaaagcctatggtaagatttgggacctagctatggaagaggtctccacggaggccgttgcctccctcacccagtattatgaccagcccttgaggtgcctcacctatggggacttctag

SEQ ID NO: 60578 - DNA, 156 bp, Glycine max
  Peptide Sequence Number=SeqID_177356
atgaaaccgagagcagacatgcacttccctctgccacagcatgtggcagacataacgtgcatggacccgaaccggccaccgctcgtggcggaaaaggtcttcaaaacggtgcgtttcataggcttcttcatacaaaacggcgtttcgaagagcaag

SEQ ID NO: 60579 - DNA, 168 bp, Glycine max
  Peptide Sequence Number=SeqID_177357
atgggtgcagcccttctggtattgaggaatcactcaaaattagtgagaaaaattgctttcgtgaagaaaatccaagatgaggcacttccgagacgtttccctaagcgattctgtggaaattcttcatcgttcttcgtccgttcttcatcgttcttcggtcttcaaccg

SEQ ID NO: 60580 - DNA, 1188 bp, Glycine max
  Peptide Sequence Number=SeqID_177358
atgaggggtagtataagggacgtgatgagtgatgtgatgaggggtagtataagggacgggcgtggagggagaaagaaagaaaatacgtttccctctcacaatggcaatgacccaatttcctgttatgacccagcattttactactacaatagcaggcccttttctcccattgactctgaaagcaacccaacatcaaaacaagacaacaacaacaactgtgacctcgttccttctcctactcctttgtcctttttccactttccttcttctccctttgaagacactcaaaatcaaattttgctcgaacaacaccacgattttctccttcagtttcaccatcaatctctccccaaagaccccgtgcctcaaccggcagttatcaccaccatggatccttttgttaaaaagagtgaccagatccaaagaaaaagacctggcaagagagacaggcacagcaagatcaacaccgcaagagggttgagggatcggagaatgagactttcccttgaagttgcaaagaggtttttcggccttcaagatatgctgaactttgacaaagcaagcaagaccgtggagtggttattgaaccaagcaaaagtagaaatcaaccgtttagtgaaagagaagaagaagaatgatcatcatcatcaaagttgtagcagtgctagttcggaatgtgaagaaggtgtgtctagtcttgatgaggttgtagtaagtcgagatcaagaacaacaacaacaacaacaacaagagaaggtggaaaaagttgtaaagagaagggtcaaaaactctagaaagatcagtgcatttgaccctcttgcaaaagagtgtagggaaagggcaagggaaagagcaagagagaggacaagagaaaagatgagaagccgtggagttctagctgaagaatcaaagcaatgtggagaggaaacaaatcaggatctgatccaattgggttcttcgaacccctttgaaaccggagatcaagaatctggtgccaagacaagtcacagtgttgatgtgcatccttcttccttggacgtgattgctactgaggctaaagaacaaagctaccgtgcagtaaaggagcataatgatgatgatgatgattctttggttgttttgagcaaatggagcccctccttgattttcaataactctggattctctcaagatgtaagtttctattag

SEQ ID NO: 60581 - DNA, 721 bp, Glycine max
  Peptide Sequence Number=SeqID_177359
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcataacttctctattgaaccaattgtaaaagattatctggttttaaaaaatgcactcgttgcagataatgacaaagcagctgctattgcaggaaaacaactttttgctactttaaacaaggtggatatgaaaaccatacccgccaacaagcataaggagtttatggatatttttgaaaatgctaaggaaaatgcagaacacattggcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 60582 - DNA, 471 bp, Glycine max
  Peptide Sequence Number=SeqID_177360
atgggaatttccttagttttcatgctcgtctatgtttggagccgcgagtttccaaatgcacgaatcaacatttatggtgttgtatcattgaagggtttttaccttccatgggctttgctagctctggatttaatatttggagatcctataaagccagacattgtagtgcttcaccctctcgcaggaggaaagttcagattcaagactcctctgtgggtgtatcttttttttaccagtcacaaaatagtggcatattggggagagggtactcaaataaatgcccctgtgcaatctaatccatcagctggaattgtattcaaaggaagaagccaccgtcttggtgggactcagacaacaacaagaagaactgcagagcaaactgaagggaatgattctgcttcctgccctcaaccgcagaatcagggtgatggaattgctttccgtggaaaaagttatcgtttggatggatga

SEQ ID NO: 60583 - DNA, 321 bp, Glycine max
  Peptide Sequence Number=SeqID_177361
atgtctacaccagcagaatactaccggtctctaccacctgtgagcaaggcctatggagtggcctgtttaatgactactgctgcattttatctgcaattctatgatgcatggaacatagcacttgattatggctcagtgtttaaacgccttcaagtttggaggcttatcacaaatttcttctttcttggcccgttttcatttccatttgcaatccgtctgataataatagcaaaatatggtgtttcattggaaagagggccctttgacaatagaactgcggattatgtttggatgttcatttttggtgcactctcacttctg

SEQ ID NO: 60584 - DNA, 466 bp, Glycine max
  Peptide Sequence Number=SeqID_177362
cgatccagcagttgttacagatcgcggcggccgcgaagtcggcgctgcgcctcggcctcgacgtcggcggcggcaccggctcctttgccgcctcgatgaggctccgcaacgtgaccgtggtgaccacgaccatgaacgtggcggtgccgaacagcgaggccgtcgcactgcgggggctagtgccgctgcacgtgcccctgcagcagcggctgccgctgttcgacggcgtcgtggatctggtgcggtgcgggcgcgccgtgaaccggtggattcctttgacggtgatggagtttctgctgctggatgtggacagggtgctgaggggcggagggtgtatgcgccgttgattgggaaattagggtacaagaaggtgaagtgggcgacggggaataagaccgatgccagtggcgtcaagaatggagaagtttacttgactgcgttgctgcagaagcctgtgtccagatga

SEQ ID NO: 60585 - DNA, 389 bp, Glycine max
  Peptide Sequence Number=SeqID_177363
atggaatattctcagttcaagtggttggtggacatcttcaaagctaagattgtggagatctcgcaacattcagtgacaattgagggagatgtttatcctatagagccaccagatggttttacagtcaatcacgtacttgatgctcactggggtgtcctcaatgaacaagatgtaaatgtagagggtacatctacttatgttattgtaactgagaacaagagagggtacgtctcttgtggatcagttcaagtggagggtacatccacttggttgttcaaagagaacaagggagggtgcatcccttctagatccttgcttgtaaaggtttttacaaggttgaaagaaatctcaagaaccggtagttgtttggggactggatgtaggcacag

SEQ ID NO: 60586 - DNA, 156 bp, Glycine max
  Peptide Sequence Number=SeqID_177364
atgagttgtacaagttcgctaagtgcactgcttcatctctctaagtgcaccgctttagttcatccactaagcgagaaaggcgcgctaagccaaaaatcactaacgtgcgatctgcagagactagagcttgaagcaggatccggtttaagagcttga

SEQ ID NO: 60587 - DNA, 288 bp, Glycine max
  Peptide Sequence Number=SeqID_177365
atggggaggttcttgccgccgagaggcttcttgaggaagatttctgagcgcaccccaattactaagttcaccccctcttttcatactttacagaaaaacgaggacattgtcgcctttgaagcatgcaatgacttaagacattgtcgtcttcgaaatgtagacaaggacattgtcgcctttgaaggcatgcaattactgaagatattatcgtcttcgaaatgtagacgaggacattgtcgcctttcaaggtatgcaatgactgaagacattgtagtcttcgaaatgtaa

SEQ ID NO: 60588 - DNA, 516 bp, Glycine max
  Peptide Sequence Number=SeqID_177366
atgaatgaatatcccaaaaatagcaatgtaatcgttagagaccaaattaaacttgactaccttgaacgtaactcttatgtcaccacaaccattgggtgtataagttttgagattgttaaagaagcaaagcttcatgatgaatcaagattgattcaaagatgttttgatgataacaaagatgatgacaaaggtgatgacaaaaatctcaaaggtcaatcaaagaatgagttcaagatgttcaagatagaatcaagaacactacaagattcaagaggaaagttgaagaacacttcaagattcaagaggaaagttgatttcaagaatcaagaatcaagattcaaggatcaagctttcaagaatcaagatcaagattcaagactcatgattcaagaatcaagagaaggcttaatcaagataagtatgaaaatgttttttcaaaaactgagtagcacaaggatttttctcaaaacatgtttaccaaagagtttttactctctgctaatcgattaccagtag

SEQ ID NO: 60589 - DNA, 348 bp, Glycine max
  Peptide Sequence Number=SeqID_177367
atgcactggatgtccacgataatcttaggatctttcaggaataattgggagacgtattttaacgaagttagaccattggaagcagagagattcaaggcactttgcatacagtgggcacagtattatctaaaagtaaaactcaacaacttatacctacgattatttggtgtagtaagtgagctctcttctcagttctcacacttatcacaaagagtgagaagttctgttgcaatcctccctaggaagggaccagtcactagagccatgagtaagaggctccaagaggattgggctagagctgctgaagaaggccctagggttctcatgaacctcagggtagatttctga

SEQ ID NO: 60590 - DNA, 780 bp, Glycine max
  Peptide Sequence Number=SeqID_177368
atgaagaagaagctggaggaagttgcacagtcaggaagcgttgatcgcgccatcgaccctccatcaccggtcaggcgccatgtgaagtggaagatggcccgcacgaagaaaacaagggagatgacaactgaggctgcaaaggaaatcgctgcgaagatcgattcctttgaggagcaggatgttctcaccgctgctattggacgtccagagcaccctggacgtccagagcaccctggacgtgtgcgtgctgctggagccgtagctgacccagcaaatcagggactagctagaggagtccatcacagaaaaagtgacgcaacatctcatggcatccttcagctagatgcagtcccaaatacaatctcagggacttgcactgcctctcgagcctctggaaacgatcctgagacgggtgactcagataggtgcggcttgtacatcgaagcagatcctgcccgcctggttgccctggggagagtttatgagggatccactgttgttcataacactcatttgttgcctaaccaagtaaaggtgggtgtggaggaggttacagatgcagatgctccagttcctgtacccactgatgaggtttccttagtggggcagacacttcacaccttccatgcttggccgacacatctggtagctgtgtctccggcaaaaccacctccaaagccaaatccggaggtcgatgatccactttatctgatgacattgaccatcccaaagcttttcttgaggccttatcaggttacatgggatgccatcgtgttcggg

SEQ ID NO: 60591 - DNA, 372 bp, Glycine max
  Peptide Sequence Number=SeqID_177369
atggggccagttccaatctttagcgttggagtttcaaaaaattatgcaaataatcaaggcctatgtggaggaaaaacattggcgccttgccaaaccaagtcttccaagagtaacttggctgttattgctggagctgctgctggcggggtgactcttgtggcattaggattgtgtattggattgttcttctttgtgcgacatgtttctttcaagaagaaggaagaggaccctgaaggaaacaaatgggcaagaagtctaaaaggaactaaacaaattaaggcaagctatattggtgcattgcacagaacatatatgattacacaactattcatttttcttgtagatccatttgtgtcttgtagcaatagataa

SEQ ID NO: 60592 - DNA, 447 bp, Glycine max
  Peptide Sequence Number=SeqID_177370
atgaatgaattaatcagcattggcagcctcggtaaaaagtttgatacagtccaagaagtttatgtacgaaattgcagcttcataagaactacaaatggagcaagaatcaagacatttccaaatggaatgggttatgcgaaacaaattacttttgaggatatcaccttagaacaaactcgcaacccaataattatagatcaagaatatcgtgatttaacgaatcaagcagttgaagtcagtgatgtgacatacagaggaattcatggaacatctctagatggaagagctattaccttagattgcggcgagtctggttgttatggaattgtattggatcaaatcaacattgtctcttgtttaacaggaaagtctgcttcgtgtttttgcaataatgctcatggaacagctacagctacaaatccaaattgtacttgcttattaccatga

SEQ ID NO: 60593 - DNA, 450 bp, Glycine max
  Peptide Sequence Number=SeqID_177371
atgtgcctccggcttcattggctgtcgaggctcctactgctgccactattgctgcaactcttgctactcctgctccttcacctcctccagtggcttttactaagtgtcgatgtggtgaccactggtgctcccgcagtgccgcctccttcttcgtcgactcaagtggctctccctgctgttggtttggcagtcggctgggtgaagaatgctattgactctgccaaggctgagaagattggcctgggtggaaaagtggagagcatggcagaagagaaggacgagcctcccaagagaattattgacttagaggctcgacttagggagtcagagtccatattggaggagtccgagctgcgggctaccaaggaaagggaggccaacacggagctcgaggaagaactgcttttgtataagaaggaggtcatggagcaacatgagaaaggattttag

SEQ ID NO: 60594 - DNA, 1488 bp, Glycine max
  Peptide Sequence Number=SeqID_177372
atgttgatggagaatctcttgcgatccaaggagttctggcaggttgttgtaggtggtgtggcaacaccaagtgatgacgtagctcttacagagacacaacaaaaagagtatgaagtaatgaaattgaaagacttaaaagccaaaaattatttgtttcaagccattgatcgttctatccttgaaaccattctttgcaaagatacttccaaggacatttgggattcaatgaagaaaaaatatcaaggctcctcacgagtgaaacaaccatgggtattgctaacaacatgcgatttcatgtgcatgaacaaaagatcaacaatggaggagcatgcattgaaggcttctaccaatattcattccaacaactctagaggaaggggtagaggtagaggtagaggaagagggcgtggagatcgaggaaatagagatttcaacaataatacaaaagacaataatgatcaatctcaaggcaatggtagaggaagagatcatgataaatcaaaggagaaagaagtggaaaccttattgatggatgttgaagatgcaaaagatagtgaggcagaaatctggcatgtagacactgattgtagtaatcacatgagtggaaaaacaatttctaatgtgctctatgtccctgacttgaaaagcaacttgttaagtgctggtcaattgcaagaaaaaggttatgaaatttttattagcaaaggaaaatatgaagctctctcttcatttaaaagcttcaaagctcgagttgaaatagaatctgaaaagactattaagtctcttcgaacaaaccgtggtggagagtattgctcagatgaattttctactttttgtgtaaatcatggaatctggaaggagttgacaacaacatatacaccacaacaaaatggtgtctcagagaggaaaaatagaaccattctcaacatggtacggtgcctcttgactaagagtggcatttcaaaagaattttggcctaaagctgataattggagcgtgcacattctaaatagaagtcctacatttgctttgaaaaatatgacaccagaggaggcatggagcgaaagaaaaccaacagtggaccactttaggatatttggatgcattgcttatgcccatattccagataagaaaagatcaaagcttgatgataaagataatgaagatgaagagttgcagacaagggagctagaagaacaacaaattccaacaatcacaattgaagatgaaagacctcaacgagcaagaagaaggcctgcatggatgtttgattatggggtaacagaaattgaaaatccgattactcattttgctttgtttttagattgtgaccctacaacctttgaaagtgttgtcaaagaagaaaaatggaggaaaatgatggatgatgaaattgatttcattgaaagaaatgatacttgggagttgtgtgatcttccaaatggacataataccataggagtgaaatgggttttcaaaacaaactga

SEQ ID NO: 60595 - DNA, 544 bp, Glycine max
  Peptide Sequence Number=SeqID_177373
atgtcgtcattgttgttggcgagaccggctgagtctggtgacgtggagagagtcgccaatgcttctggtgatataggttgcaggagtggttctcgtcactggaaatggcgagactgcactaaccaactggtgtgggcacggcggtgtgtgcgatggcagtcactgctcaatggcggtgccacaatgtgtgatgggggtttgggaaacttgcccgagagcagcgagacagtgatggagctcgtgccacggcagcgtgacggtggtggacctcatgtgcggcagcgtgacggtgctggagctcatgcgcggcggccaaagggtgacgagtttgtcaagcccccaagtgtggacgagtattgtcttgtgtcaggtgtggcaactttgacgagtgtgggagttgcaggctgcctttgtcaagttgtccgtgatgaacgtgtcttcgacgtgtcaagtaaggtcactgttcattgtcttcttgcttccttgcttgctcttgcgctttctggctttcagtttccctttcttcttcctccaacttccaaag

SEQ ID NO: 60596 - DNA, 162 bp, Glycine max
  Peptide Sequence Number=SeqID_177374
atggccaaatttggaacgtcttcatcagtaggcatgttggctacagtcggggatggggatggtgtggatgtaggtggagatggtgtaggtgcaacatcagaagacctgactagtatagacacagtagacgaggatggggtagatgatggtagactatcttaa

SEQ ID NO: 60597 - DNA, 342 bp, Glycine max
  Peptide Sequence Number=SeqID_177375
atgggagctggaaatccagctatgcaaaaccatcttcaccaagatcctaaaaacaagccaagaggaagtaatccagacacctcactcagatggctatccaatccaagcaacaacacaacatataaactccatagcaccataatccttcgaagaacacaccctgaaaaaacattgaaaagaaaaccaaaagagcagaaaacacagttcaacacctcacacaaaccaagtcaaccatgcaaaagaaaccccatgaagctttcaggaaactctgctctgcccaagaaaaatacacaaccactaagtaaacagcagaaaatgaaaagcagcaaaaattgtatttag

SEQ ID NO: 60598 - DNA, 1263 bp, Glycine max
  Peptide Sequence Number=SeqID_177376
ggtgctggagaaaacccgggcggcggaggacgtagagtgggaactggaggagatcgaagagaccatcgaagagcatcgccagcaaggcaaaggtcgctgcgtgacctgcgcacgccatggttgcgcaaagtgtttttactgggaattggcattgccgccatccagcagctgaccggtgtgaataccatcatgtactacgcgccaaccatgcttactgccaccggcctgagcaacgatgcggcgttgttcgccaccatcgccaacggcgtgatctcggtaatcatgacgctggtggggatcgtgataatcggtaaggttggtcgtcgtccgctggtgctgatagggcagatgggctgtaccgcctgcctgttctttatcgctacggtgtgcctgctaatgccagagtatcacgccggtgggcgcgctgtcaccggtcacctggttgctgctgtcggaaatcttcccggcgcgcatgcgcggcatttgcatgggcggtgccgttttcgccttgtggattgccaacttcgccatttccatggccttcccgctgttgctggccgcctttggcctggctggcgctttcctgactttcgctgtgatcgggatcggcggcgccctgtttgtactgcgcgctatcccggaaaccaaagggcgcagcctggaacaggaaagatcatgacctacaaaataagcagtgaccgattctgtgttaaccgtaaaattgcccctcatctcagcatggcggaattcttcgcgctggtggaacagctgggattaaataaagttgaaatacgcaacgatatgaaaagcggcagcgtgaccgacggcgcaggcggtgaggaagtgcgtcgcctggcagcgcagcatcagcttgagatcgaaaccatcaacgcggtgtatcccttcaaccagttagatgatgcggtgctggaaaaaacgcgcgcgctgttagccgatgcgcgcgccaccggggcgaaagcgctggtgctctgtccgctcaatgatgggacgccggtgagtaatgagcaaaccgtacaggcgctgcaaaccctggcgccgctgtttgccgaatatggtgttgccgggctggttgaaccgctcggttttccgcagagttcactgcgctcggccgcgctggcgcagcagctcatcgctcaggccggtgtgccgtttaacatcgtgctggataccttccatcatcacctgtacgaaggcgctgaacaggatttcgccggtggtgtagacgtgaatcacatcggcctg

SEQ ID NO: 60599 - DNA, 357 bp, Glycine max
  Peptide Sequence Number=SeqID_177377
atgatcctaactcactcaccaagtaatttagatctgatcaaggaagtcacagtgtgtgatgtaagctccattggagcttgtaggcctaggatcttcttcatcaatggattcctttgcttcttggaagataaatggcagcggaatggagaagggagagagaggagacgccacttcaaggagaagatgagtctagaagaagctcaccaccataggaggccatggataagagtttggaggaagaaggagatgaatgaagggagagggagagaagagcacgaaattttatgctctaaaagggctctgaaatctgaagttaatattcaaatgatcaaagttgaaaaaaatgcacatgcatga

SEQ ID NO: 60600 - DNA, 312 bp, Glycine max
  Peptide Sequence Number=SeqID_177378
atgggcccgaaatctaccctaaggctcatgagaaccctagggtcttctcttgcatctttggcccaatcttcttggagtcttctatccaatgcccttggggggattagactaagcaagtacataattttccatcacacatctacaattgatccgggcaaagatgagcaacacaacgaggagttgaacagtgcttttcattggataatgattctgatcgacccaaccagtcagaactttttatgccgatggcgagaggcaaagcggtcaaaggagaaaagaccattatccactgtaattgagaataataggtga

SEQ ID NO: 60601 - DNA, 165 bp, Glycine max
  Peptide Sequence Number=SeqID_177379
atgactacaggttatccaccccaacagaagacaagtcaaggaaatgagaaaaagaaagaagatgagaatattactcatggcaatccacctcaagaggagagaagtctaagaattgagatagaggaagcactcaagaatattacagaaggtgatccacctaaatag

SEQ ID NO: 60602 - DNA, 432 bp, Glycine max
  Peptide Sequence Number=SeqID_177380
atgaccggaagaaaatgggaacaaccgccaacggaagaagtgaacggtggaagaacaccggaacaggagcaaccaccaatggaggatcggaagaggaacaagcaacaaccgtcaaacaccagaagaggaagacgaacacgcgctaatagggtgaatggcattttggacttttcgccatgggtgttgggtgcacaaagtaacacccctgatatttctggaccgtatccgcccgtgaagggtcttgatataggtgttcctgatagtggcggaaaatgtttgaaggcttgcaaacttgcagataaattaccacctcttgatcttggggcgttggtttctgtggtgcttagttgtttagattgtgtggagtgtggggagttcctggttgggttacgatgctggactagtgttgtttcttggcttgggagatggtag

SEQ ID NO: 60603 - DNA, 1172 bp, Glycine max
  Peptide Sequence Number=SeqID_177381
atgatgcaccctaacggcgaaggcctactgcatcagcacatagacagcgacaacaacaagttgttatcgaggaccctcttacggctgaggaggaattggtcaacgactagccagaaacacctgttgaagaaggaacgtcctgagttaaagctatctttccatagaaggaagatggctaagttcgggaggcctgccccagagattgaaggccttgtggtggccaatggactgagtcccttgatcgtgactatcaccttgggtgacattgtgtcgttgttacatttgcatgttgtaggggcgttccacaacttcaagcaacttcatgtcgatgacactatcaagatggtggagttactcgagataaagattgaggcatgtgattggattgtagcagcacgagcgtatttgttgcatctccctggatgcacactctttgctaacaaaagtgccacacacgtgcacgtggtattcttggatgcattgcgtgacctgacgcagagtgtgggttacacttggggcgctgctacacttgtgcacatgtatgataatttaaatgacgtatccaagagcacgacgaggcaacttacaggatatatcactctgttacagcatttttcatccatttcttgcgctgtttttgccgaggattatgatgagaggagactgagttcatgtcgttggacctttggcaaggcactgcccactattctgccacaccctgttgtgtcttcgctgtctgttgtagaaattgatgatagatggatgcagtttggtgactacattgcactagtagggaaattatgtgtagtgtctggccacttttcgccagattacctagattggttatacatgatctcgcacccattcatgagtccggcacagtcagggaatcctcctagagtaccgccagttcagcaagatgaagaatttgttgaaccagatatgtatcagcaactgatggcggcagcggtacctaatgaggcagacattgatcaacatcatcttcggcatgtagtggatgactttgcagcaattgctgataagttggacaagctactgaaccgtaggattttgattgaaagaacagaagcctatactgttgttgaagaatgtgtaggcatcgcaagacactacattggccagccaactgtagcccacagatcgaggcgaag

SEQ ID NO: 60604 - DNA, 195 bp, Glycine max
  Peptide Sequence Number=SeqID_177382
atggcttcagtcaagatagcttttgcagtggtccttcttgtcttaatatcttccaatgggcatggtttcaagagcgacactgttgagcctccttgtgaaggaaatcacgaatgcaacatttattttcccaattgtgaaggagaagcaatttgtgataatggtatttgcgagtgcccccatagcaaagagagctaa

SEQ ID NO: 60605 - DNA, 390 bp, Glycine max
  Peptide Sequence Number=SeqID_177383
atggggtcctattgtggtctttgttcgaccagagagggtggtacgacaattcaggtatcagcagactacatggattggtttttccagatatctcatccattcgtcacaccaacccaggcaggtgatcagcccagacatccacctgccccacatgatgaggaatacgtcgagccacatatcccagaggttccagtggcatctaatctccctagagattcagtgatgcttgtaaaggttgtgaagcaatcgcagaaaggttggagcgtgtgctcaaccttaggatggtcactaaaggcacagagttacacgagatcatgcaagattgcctcaggatcgctaggggtgacgcctcagatggaagtcttagggtgcgatgtagatgtcgcatag

SEQ ID NO: 60606 - DNA, 177 bp, Glycine max
  Peptide Sequence Number=SeqID_177384
atgtcttttccggtttttctgacgttttcctcaagtaaacgttggtggcgactccgcgcgtattcctttcttggaagacgcacccgcgagtcacgcgttgccctcccgccgaagggttttactttcatcatccagaaacactcaagtccggcgacgcaaaagattcttctctgctag

SEQ ID NO: 60607 - DNA, 678 bp, Glycine max
  Peptide Sequence Number=SeqID_177385
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttacccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 60608 - DNA, 438 bp, Glycine max
  Peptide Sequence Number=SeqID_177386
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagggggcgccagagagggtgagagccccgtcgtgcccggaccctgtcgcaccacgaggcgctgtcggcgagtcgggttgtttgggaatgcagccccaatcgggcggtaaattccgtccaaggggaagcggatgggggccggcgatgtgtcccggtcggatgtggaacggtgagagccggtccgccgatcgactcgggacattgaccgacgcggattgcgatggtggcccaagcccgggctgttga

SEQ ID NO: 60609 - DNA, 306 bp, Glycine max
  Peptide Sequence Number=SeqID_177387
atgggttctccacctgcctccactcctcctcctcctcctcctcctcctcctcctcctacttcggacgcatcggcttcaacgtctgccgtgaagcggacacgcaaagcctcacgcctacgatcattgtccactagaccacctggtgttgagagacctgtggtgcatgttgatcctgctacagggaaggccgacgatccccacaagaagaaattaagaacatatttggggattgtggcacgtgataaggtggacatcacctacgagaactggaaggaggtccctactgctcaaaaggacctgatttag

SEQ ID NO: 60610 - DNA, 205 bp, Glycine max
  Peptide Sequence Number=SeqID_177388
agacattttgctcattgggaaacaatttttgggggccttaaatttttgccggggttacccggatttggtaaaatccgccggccacacaaaaaggaaaaccggctctctggagattgttaacttggaaaattccaccaaatttgttaaaccgatacaaattgtggcccgggccctcgccgattttccattcccagctaaaggatga

SEQ ID NO: 60611 - DNA, 368 bp, Glycine max
  Peptide Sequence Number=SeqID_177389
cctggccagggactcagcctcctcctcacagggacgacgcaaatcccgctgctcaggtaccacatcagccatcgaatgagtcatcagagtcttccactcctaagcccttgatcaggaaaaggagggtagttgtaactcaggaagccgtagccactcctgaaaagtctcctgaggccactccagagcctccgacaccaatggcagataccacttctccacagcaggcagcaaacccttccacacctgaggttcaaaccaccccagtcctgtctttgaacacctctcctgtagctactcctgtactgcatttgattgacgacgaggaggttcaaacacaggatactcaggaccaatcacaagatttttaa

SEQ ID NO: 60612 - DNA, 315 bp, Glycine max
  Peptide Sequence Number=SeqID_177390
atgggcccaaaatctaccctaaggcccatgagaaaccctagggccttctcctgcatctctggcccaatcttcttggagtcttctatccagtgcccttgggggggttttacatgcccaccagctctgtctggttcatcattgaaccacgccatactgggaaagaggtatgctctggtatggcactgtatagctgaggatgacttaaacaatttaattggtactaccaatatcaacaagatgcatctacctttcggtagcccatcaattaagaacttcatagttaagtgttcttggcttggagtagttataggatag

SEQ ID NO: 60613 - DNA, 342 bp, Glycine max
  Peptide Sequence Number=SeqID_177391
atgaagttctacaacattccgatagtcgaaaggaagcattgttgcgcaatccataaagttccgcagggttctggaagtcaaaaaggacattgttgcgtaatccgtaaaggggaaaagggcagagcaaaaatgttcagcccttctggtatttgggattctctcaaaattagtgaggaaaattgttttcatggaaaaaatccaagccgaggcgcttccgtaacgcttccgagacgtttccgtgagcaatttcgagaagattcttcacccctttttgtcgttcttcggtcttcaatcggtaagttctcaaaatcgaatctttcaattcattctatgcacccttag

SEQ ID NO: 60614 - DNA, 344 bp, Glycine max
  Peptide Sequence Number=SeqID_177392
atggaaccatttaatcaatccattgaaatcccaaggctcatgcacggtgcccctcattgccctagtgtagggcttttaggtatcaaccttgtcttttgtcatgaccttgtagcagggaacctattggtcagcccgcatcaattagaccttgcaccttacgctttgaggtcatacagtgctcaatggaatgcctcggggcttcttcatgacaagcacacgttgcgttctagtcgtatcctcggagaaatggaggttgaggaaccttggttggggctttttcactgcaaaattccttccttcgttggtgttttggttcgtgctaaaggtggtgttcgtgattggaa

SEQ ID NO: 60615 - DNA, 694 bp, Glycine max
  Peptide Sequence Number=SeqID_177393
agaactacacgtcctcaccttcagagggttgaaagccgtcgccttcagaggactgcacgccctcgccatcaaagggctacacgccctcgccttcagaggactccatgtcctcgccatcagagggttacacgtcctcatcttcagaggactacacgtcctcacctttagaggactacacgtcctcgcctttagagggttgcacgccctcgcctttagaggactacatgtcctcgccatcagagggctgcatgccctcaccttcagaggactacacatcctcacctttgaaggactacacgtcctcgccttcagaggattacacgtcctcgccttcagagggctacatgccctcaccttcagaggactacacatcctctccttcagagggctgcacaccctcgccttcaaagggttgcacgtcctcaccttcagagggctgcacgccctcgccttcagagggttgcacgccctcgccttcatagggcgacacgttctcgactttagagggctacatgccctcacctttagagggctatgtgtcctcactttcatagtttccctttatcaattccttggccaccctactgatctcggaggagggtccactgtgcaagcacaaccagagagggaggctatcgtgcaactactatgcatactggggcaagatttcgtccttaccgtcgtagggagatga

SEQ ID NO: 60616 - DNA, 261 bp, Glycine max
  Peptide Sequence Number=SeqID_177394
atggcatcttcctcgttgcaagctaagcatgtttcagaacatatttggaatggggaagaagacagaaaattactaatcatacaagttgtccacatgtatcaaggtttccgtgtggacgggtcaccattaattggtccaacaaatcttgattgggttgatttatgtgaaaaattgttaggagtcagaccacaagaaggtgaacttcaaggtagtgtggttaaattaagttggttggctcaccattttttcacaattaaataa

SEQ ID NO: 60617 - DNA, 327 bp, Glycine max
  Peptide Sequence Number=SeqID_177395
atgcccttggggggtaggattgcatcaagctccttgagcatctgcaggtcttgcctcctccttaaaaataggcttgtctccaggccatgcaacagtggctctaaactgctcgggagtaggccaagagtaagggctaggttcctggagatgctggtgcagtgtgtaatgccaaatggcgcatgtatgtgtgcatctggagctccatcctctactagtgggctgagatggactccaaggatggtggctgatgtagagatggtggtggtgcatctgctgctagctgatgttgctgatcttgctttggctgctgtagcttccttggcatga

SEQ ID NO: 60618 - DNA, 186 bp, Glycine max
  Peptide Sequence Number=SeqID_177396
atgacaggacactttaaacttcaaccaaatttggttaggcttggcacctccttctactggtcaagcattgacgatagggtttcagcggcagtcgtagcttcagtagggcaatttgcggtagtcggtgctcaggcagaaggagaaataagaaacaatagggttttagcccgtggggggatgaagtaa

SEQ ID NO: 60619 - DNA, 240 bp, Glycine max
  Peptide Sequence Number=SeqID_177397
atgggaaggcttagagagattttccttcagccacctcaaagagccatattccaaacaaacacacaagctccctcaccagttgaaatttccaaatcaacagcttccagcaagcttaagaaagtagtccatgaccctccaccaaagaggtatgctaggagggtgagcttatattatagaaacaatgctgcaaagccttggaaagagaaggagaaagaaaaggatgaagatggcaagacttga

SEQ ID NO: 60620 - DNA, 1272 bp, Glycine max
  Peptide Sequence Number=SeqID_177398
atggtagagaagcctacaaaagttgtgattgaagctcctattgatgagccaagtgattcttctgctgtagtaattgatgacagtgaccaaggaggagattatgaattgatacatgattcaacaataggggaggaaggtgagctagtacaattagctctattttctgaatctgaattagtgagcttggaggaagcaatgaatgacacaaagtggattgatgctatgaaagaagagctgaaagctattgaaaagaataatacatggcaacttgtgcctctgcctgctaagaaaaaacctattgcagtaaagtgggtttataaggtaaaaaagaatccaaaaggagagatttccaagtataaggtcaggctagtggcaaagggattcttgcaaaaggctagcactaattttaatgaggtgtttgcacctgttgcaagaatggagacaatgagaattattactgctatagcaagtcaaaaagggtggtatatgcaccatatggatgtgaaatcagccttcttgaatggtcttctagaggaggtttatgtgagtcaaccacctgggtttgaaataaaaggaagtgaagagaaggtgtacaaattgaacaaggctttgtatgacttaaagcaggcgcctagagcctggaacaggcgcattgatggctttctaatgaagcttggattcctcaaatgcacaactgagccatggtatgacttgcttgtgacaggaaataatgagactgagattgctaactttaaaggagagatgatgagagagttcgaaatcactgatttggaccttatttcttattttcttggaattgaattcaagagaactgatgagggattgattatgcatcaagggaggtatgcaagagatgtgaagaagttcaaaatggttgactgcaattttgtagacacacccactaccactggtgtgaacttggtgaaagatcctaatgaaaaagaagtagatgtaacattgtatagacaaatggtgggctcactgagatatatggagaatcctaaactttctcacttttgtgctgccaagagaataatgaggtatgtgaaaggtactctcgattatggtattctgggatatagtgattctgattggtgtggagataagagtgataggaagagcacaacaggttatgtgttcttctatggtgatgcttcaatcttgtggagctcaaagaaggaacaagtggtagctctctcctcatgtgaggcagaatacattgccgctgcaatggcagcgtgtcaagcttag

SEQ ID NO: 60621 - DNA, 1863 bp, Glycine max
  Peptide Sequence Number=SeqID_177399
atgacgattaacacggtgttatcagcaatggcatacaattatcctgcgaataaattgagtgtgtatctctctgacgatggaggctcagagctaacattctatgctctcttaaaggcctccattttctccaaacattggttacctttctgtagaagattcaatgttgaacctatgtcaccagaggctttcttcgctgcccctaattctagcaataatagcactgagtatggccaagcatggttatctatcaagaaattatacgaagacatgaaaaatgagattgaatcagctgtagcaaggggcagggttccagataatgtgaggaatcagcacaaaggattctcagaatggaatccaaaaacaacgaagcaggatcaccaacctatcgtgaagataataattgacggaagagacacaaatgctgtagatgaagacagatttcaactgccaagagtcgtatacatggcacgcgaaaaaagacccaactaccctcaccacttcaaagctggagctgttaatgcactgataagagtgtcatccgagataagcaacgcccctttcattctcaacttggattgtgatatgtaccccaatactgcaaatacaattcaagaaatactatgcttcttcttggatgaaacaaaaggccacgatatagcttatgtgcaatttccacagagctataataacatcaccaagaatgaccattatgcaaattcttatcttgtgagcagtaagtttgagctagctggaatatgtggatatggagcagccttgttttgtggaactgggtgtttacatcgaagagaaagtctttcgggagcttacttgaaagattacaaagcaaaatgggacagcaagccaaaaagaaacgataatagaacaattgatgaattgaatgaagcatccaaggttcttgccacttgcacctatgaggagagcactcaatgggggaaggagaagggattagtatatggtattcccgtggaagacattgctactggccttgtaatctcatgcaggggttggaaatcgatttattacaaccctgaaaggaaggctttcatgggcatagctccaacaaccttggatgtagcatgtcttcaacatatgaggtggtcagaaggcatgttccaagttttcttctccaggtattgccctttcatttatgggcatgggaagatacactttggtgtacaaatgggatattgcacttacctcttatgggctcccatgtctctgcctactctctgttatgtcattgtttctcctatttgcctacttcatggcattccgctgttcccacagctttcaagcatatgggtccttccatttgcgtatgcatttcttgctacatatggctttagcttgtgtgagtatttgatttgtgggtccacagcaaagggttggtggaacttgcaaagaattaaattcatccataggaccacctcgtatctctttggtttcattgacaccatgaaaaagcaattaggactatcacaaacaaattttgtcatcaccaataaagtggttactgaggatgtccaaaagaggtatgagcaagagatcattgaatttggaggctcttcgatcatgttaaccatgttagcaacagtggcattgctaaaccttgttggtcttgttgggggaatcaagaggattatgatggatttaaatttggaattcagctctagccaattgatgatgcagattacactgagttcattggtggttatgatcagtttaccagtgtatgaggcacttttcattcgtagtgataaaggttgcataccatcttcagttatgctcaagtccattgtcttggcctcattagcatgttgcctggcacctttcatttgctaa

SEQ ID NO: 60622 - DNA, 357 bp, Glycine max
  Peptide Sequence Number=SeqID_177400
atgaaagcaaacaaaacaagaaatgaattgaaagtctcgaattcgaacacttaccggttgacgaccgaagaacggacgaagaacggtgaaaaacggcgaaaaatattcacggatttgctcatggaaacgtcttggaagagttacggaagcacctcaacttggattttcttcacagaaacacgagaaatggggaggtgtttgccgcccagaggcttcttgaggaagatttctgagcgcaccccaattactaaattcacccctttttcgtactttacggaaaagttatggaagccttacggaagcgttttgaacttgattttcctcttttatctcttccctttcaccaatattaagtga

SEQ ID NO: 60623 - DNA, 414 bp, Glycine max
  Peptide Sequence Number=SeqID_177401
atgtgccacccaactgcatatgtttgtgtttactataacggtcaaatctgcaacactaatgagagcaccgccttcattcgtaacaatacaaaaactttcatggtcaacaagaacaatccgatactattatttgtggagttatttgccataatttgcaacaacaatgacccactaaacaaccaacgtgatggctcaacctccaatcttgaggacctatcacatgaatatgagagtttttgggtcaaaaaccatggtagttgtcgcaacctacccttcggcgggagggcgacgcggggctcacgagtgcgtctttcaaggaaggaaggtacgtggagtcgccaccaacgtttattcgaggaaaatgtcagaaaaaccggaacatgtggtctacgaaccttaatcgtgaaaggttag

SEQ ID NO: 60624 - DNA, 156 bp, Glycine max
  Peptide Sequence Number=SeqID_177402
atgcagtttcctatgggtgagagcaaggaagtcttattttgggaggaccattggataggggaggagactttaggaaggaaatatagaaggctatacacaatttctgaacagaaacaatgttctgttatagaagttggtggttcggattttgaataa

SEQ ID NO: 60625 - DNA, 330 bp, Glycine max
  Peptide Sequence Number=SeqID_177403
atggctattgcaagaagcaccccaaacaccaccaatcacccgggaaagattactagctcttctaattcggtctcgatctttctgctgagtagtggtaacaatggaatcataaagggtaggtgtaggtcattggatattgttccaagaaaaagagattgtgaaggtggtggtgttgatcatcatggtcatagtatgagtgcctacaaaagtggattttggttcaacttgcttcatcctagaagtaagagaatgaaggaaaaatattatagggaggacactaagcagctggttcgttctatgtctatagaaataagagaaacaatggcttga

SEQ ID NO: 60626 - DNA, 1545 bp, Glycine max
  Peptide Sequence Number=SeqID_177404
atgcagaaacgcaagtggattccgttggcggtgctgagaaagttgctaattgcggccatatgctccatagcgtttgtggctctcttctctgttcgcgtacacattattccttcttctaaagatcacaggttcaacgacaagatctcaacgactcaggatccacaaagctggacgcgggagctcgcaccaccccatttatccaaagctccacttcctactcccaagttgagtggttcaagagggaattttgattaccagaagctgtggaagactccatcaaatcatgggtttctgccctgtacaaaccctacacctaattacaccactcctgccgaatcgcgaggatatcttttagttcatacaaatggcgggctcaaccaaatgcgttctgggatatgtgatatggtagcagtagctcgaatcataaatgccactcttgtaattccagaacttgataaaaggtcattttggcaagatactagcaatttctctgatatttttgacgaagagcattttatgaattctctagctaatgatgtaaaaatcattaagaaacttcccaaagaattggttaatgcaaccagagtggtcaagcaattcataagctggtctggcatggattactatgagaatgagattgctagcttgtgggaagattaccaagttattcgagcttccaaatctgattcacgattagcaaacaacaatctacctccagacattcagaagcttcgctgccgggcttgttatgaagcacttcacttctctcctctcattgaacaaatgggaaaattgttggtggagaggatgaggtcatttggtctctatattgcattgcatttgcgttatgagaaggatatgctcgcatttagtgggtgcacccatgatttatctctagttgaagctgaagagctacggttgatcagagagaacatttcctattggaaaataaaggacattgatccaatagaacagaggtccaaagggctttgctccttaactccaaaggaagttgggatttttcttaccgctctcggatacccatcaacaactccaatatatattgctgctggagagatatatgggggcgagtcccacatggctgaactgcattcccgatatccattgttgatgagcaaggaaaagttggcatccatagaagagcttgaacctttttctaatcatgcatcccaaatggctgctcttgactatattgtatctattgaaagtgatgtatttataccttcttattccggaaatatggcaaaggctgttgagggtcatcgccgttttcttcgacgtggaagaacagtatctccagacaagaaagcccttgttcatctgttcgataaactggatcagggaataataactgaggggaagaaactatcaaataggattattgatctccacagaagacgacttggttctcccaggaagagaaaagggccaatttctggaacaaagcacatggacaggtttcggtcagaagaagccttttatgctaatcccttgcctgattgtttatgccagacagagacataa

SEQ ID NO: 60627 - DNA, 135 bp, Glycine max
  Peptide Sequence Number=SeqID_177405
atgggtgtctccttcctctcaacttgcccttctctgcttccactcgttgcttatgatacaccaccctccgccagataccaacctcgttcattgcaaatcatgcaagttcatggatgctgttatgtcgcattgtga

SEQ ID NO: 60628 - DNA, 792 bp, Glycine max
  Peptide Sequence Number=SeqID_177406
gaattaattggaagctccggatctcttgttgaaatggctaatgctgctgacctgatacagcgcagacagcgttctgaatttcaatctaagattaaggaaacactttttacagccataaagggaaatcctgatcttattccatccttactgacactggctctaaatgatgctttgacttatgataaggcaacaaaatcaggtggtccaaatggctctatacggttcagctcagaaataggtagaccagaaaatacagggctttcagcagccttgaatttattagaggaagccaaaaaggaaatagactcagattccaaaggtggatccatttcctatgcagatctgattcacattgcagaagttgtggaggtatgttctaattcccccgacttcattgacttaatttttgtagcacaaagtgctgccaaggctacatttttagctgctgccattcgcaaatgcggtggaaaagaggagaaagggaaaacactgtacaatgcatacggatcaaatggacagtggggtttgttcgatagacaatttggtagggctgatgctcaagacccagatccagagggaagagttccactatgggagaaggcaagtgtacaggaaatgaaagacaagtttgttgctgtaggctttggtcctcgccagctggctgttttatctgcattcttaggtcctgatcaaaatgcaacagaaaccttattggccagtgatcctgatgttgctccatgggttcagaaataccaacggagccgtgaaactgtctctcagacagattatgag

SEQ ID NO: 60629 - DNA, 474 bp, Glycine max
  Peptide Sequence Number=SeqID_177407
atgggttggtctcatggatgcatatgcaataaggaattaagttgtgagaacaagaacaaggacaaatttaacaaattgactttgctgaaaacacctgacactacacatagttggctggatcagacaattgggttagaggaatgcaaagccaagtgcttggataactgttcttgtatggcttatgtgaatttggatatcagtggacaaggaagtggttgtgctatgtggtttggtgatctaattgatattagacagtttgcaattggaggccaggatgtatatgttcaaattgatgcttcaaaattagaaagaaatcacgttgcagtgtcaaagttttgtctagataatgtgttggaaaaggtaaatcaaaatgaacgtttaattgattatctcaaaattaacttcgttaaaactgaaacactttttcctgtgtatagtttctacttggaggtgctagctctcttgtttccttaa

SEQ ID NO: 60630 - DNA, 240 bp, Glycine max
  Peptide Sequence Number=SeqID_177408
atgcataagcgcggagaaaagaaacggaaaccctatgagaaagtgtgcgtgagagagaaaatgaagttacaaggtcttggaggatctcgtagcacggtgcaagctcagcacgaggacgccttggtggcgttgacggtgaggtggccttggtccctctcgttgggaaccctagaggggaatgagagtgagaatgagagtaagaatagagagcgccagagaatagcaggagctagatattaa

SEQ ID NO: 60631 - DNA, 639 bp, Glycine max
  Peptide Sequence Number=SeqID_177409
atggatcacaaacactgtcaaactcctttagactcatcatcatcttttcccactactacttctactaccaacagagatcagtatctcaaacaacttaacaagctttcacataacatctccaaacccaacaacattaagaaaccaactttttttgagtcttctcaaagcctcactcacaacaacaccttcaataaacaatacgctctcccctccgagtctcagccacaagtctacaacatcagcaagaacgatttcagggacatggtccaaaagctgaccggctcacccggtcacaccccgcaaccaaaaccggttgcaacctctcgcctccaccgcctgcggcctccgccgctacctcaggttgttagccaccgccctccgcctccgaactccggcaaagtcgccgtcgcgcctccgtcgcctctgccgccgtttcccaccgtccacgcggagtcgccggtctccgcgtacatgcgcagctttctgcggaactccgtgccgtcttcttcttcggagtcggagtttcagttaccgttttcaccggtcacttttggatgcttcaattcgttggggggtggttctccgattcccctttcaccgactgtgccggtttcgagccctagatggagagatctttga

SEQ ID NO: 60632 - DNA, 399 bp, Glycine max
  Peptide Sequence Number=SeqID_177410
atggtttggcgtgcttgtgctaatatcctcctagttggaagatttcctcgattcaggaggcatgccattgtcgatctcatttgtggatggtgtggagaggtggtggaaacagtgacccatgcattgttaacttacccagaatcgaggaaagtttggttcgcatcacctatggtcattcaggcaaacatcactaaccgtccaaaaaccccaacaggttttgttgaagctcagtacttgtctgaggtagtagaggctcttactttatgtggggccttgatgatggctcgtgatttttgtctattccatgctatttttcttcttgaccaatggcagagtaaggatgcaagaactagaagatatttcatggttgtattggaagactgcaaaaactatagttga

SEQ ID NO: 60633 - DNA, 2703 bp, Glycine max
  Peptide Sequence Number=SeqID_177411
atggctgagaacactcgtttaaaagaattgcagactgaaattcgtactcacactaatgatatctgtcgtattggtaccacgatggatctttgttaccaggaacaaaatgataaaatgcttcacatgcagacttcgatggatcagattcagttgacgatgaatcaattgttgaaaactatttctcaacctcatggaagtcttgtgaacaatgacactcctattgtgatgtcgattagtgtagcattgccgacgaaggagatctctcttggattttcgcattttgatgggactaccccggaagtcgaaactatagaacctgatgatcattactcgtctctgaatgctttgaagggtggtgtaggagttggtactataagatttatggcctatattgataaactttctgtgactgtgctaattgatagagggagttcaaacaatttcttacaacctagagtggctaagtttttgaaattactggttgaaccaggtaatgttgttcccttgccagtgtttttgcttcctatatctggtgcagatctcatcttgggagcaagctggttgaaaacaattggaccccatattgcagattatgatgcattgcaattgaaatttctaatgaatggaaaattcactacacaaggagatcataatttgattcttaagcagactcaattacaccatattagaaggatgataactactaattctattgctgaggtttataacatgcatttgcttaaggagaatgtcacacctaagtccttcgtgaacctgcctgcaaacatggagcctgagttagctctattgctacacacttatagtgttgtctttgccacacctatcagtttacctcctcagcgatctcatgaccactcaattcccttgttggaagggtcacaacctgtcaaggttaaaccttacaggtgtccacatagtcacaaggaagaaattgagaaactagtctctgccttgaatgctatcacaattaaggattcttttcctatacctatgatggatgaactcattgatgaactgtttggagcaacattcttctctaaactagatcttaggactcatcatggccactatgagtggttgggtatgccttttggcttgaccaatgcacctgcaacctttcagagtctcatgaatgatattcttgttggattgttaaggaaatttgtcttggtattttttgatgacatattggtttatagtgctaattggaaagaccatttgtaccatttggaggttgttttaaatattctgccaaagcatcagctatttgcaagattctctaagtgttgttttagggttcaacaaattgattatttgggacataccttatctggatcaggcatagctatggatgcaaacaaattagaggcatcatgtgctaccattgcagcacctctaactgatttattgaagaatgactctttcaaatggattcaagctactgctcaggctttccaacaacttaagatagccatgacttctgcacttgtcttggctattcctaatttcaatgaaatttttatattagaaacggatgcttcagggagtggagttggtgttgtgttaagccaaaacaagcatcctattgcttatttctcaaaaagttgtctgcttcctaagttcctaggatatgactttactattcagtacaagcctgggaaagagaacataccggcagatgcattgcctaggagttttatgatggccatttccagcccaattcattcttggataaatcaagtaattgacaggactcaaactgatcctcaattggggttttccattatccttgtggttgtggataggctttcaaaattcggttatttcatccctttaaaagttgattacaatgctaaagtggttgctgagtctcaaggtacaataatgtccatgagctcttcttaccatccacaatccgatggacagattgagaatcttaataagacactaaagatatatttgagtttgggaatgacccttttccaagctgtatttggtagagctccaccctcagtgagtcattatgaagctgatccgatagatcccaatcagcttaaggagtccttgcagcaaagagaccaacttctttccaagcttaaagcagataaaaagaggagagatttgcaattcaaagaaggtgatttggttcttgtgaagcttcaaccatatcgacaacattttgtcactttaaggaaatatcaaaaactaggaatgcatttttttggtccttttccgatgctggagaagattggaaatgtcacatacaagcttaaacttccggaatcgacaatgatacatcttgtttttcatgttgctctgcttaaaccattccatggcatggtttctcaaccttatgttcccttgccccttaattccagtgatatggctactaaagctaaagatgctacttgggaagatttgcaagacattgtgaactcttatcctcagttcaaccttgaggacaaacttattttcgatgagaaggataatgtaacatacgtaaagtctgaagaagttttggcgcaaaattctattgagaaggaaggacacgtgtcagacgatctgcatcacatgggagttaggaaaagcacacggggagctttggtgacttgttctgatctcaatgataggatttacgaaattttgtaccacgaggaagctgaagttatgatcactctatga

SEQ ID NO: 60634 - DNA, 237 bp, Glycine max
  Peptide Sequence Number=SeqID_177412
atggtgtgcttgatatttgatggcgttagctccgaagcagataaactggaatcaaattatcaaagcacattcattgtgtttatgcctaaatcatcattaccaatgctgccccaagattatcaaagtgtttgtttttccatgggctttgccgctttcacattaaagaggcaaggtcgtcgcattcgtttctgggctagtggctctgccagaaatcaacagaaacgggtgaaaaactaa

SEQ ID NO: 60635 - DNA, 759 bp, Glycine max
  Peptide Sequence Number=SeqID_177413
atggaaaggagcaaaatacaagtgctttatgatgctagccatgccgtgttttctcaagaggggcttccaacctttcaacaaatccactatctaaaaactttgctagacaaaattgaagctattgatgtaggagtcgacgagtccgggttgtgtgattctccaacatcagacgcaaccgttgatagcagcagcagcagcagcaacagcaagggtttgctttgtggacacggattctctgagataacatacattcacattcatgaatgtgactatttctctatgggtgtattctgtcttccagcaggaaaagtgtttccacttcatgatcacccgggaatgacagtgttgagtaagctcttgtatggctctacctgtgtcaaagcttatgactggatcgcattggattgtgctggaagccaaacaataggattggctgggagggtagtggatgaagtaatcaaagcaccacaggaaccatccatattatttccaagaagtggtggcaatattcattctttcacagcgttgacgccatgtgcaatactagacgtgctatctccaccatactctgaagagtttggaaggccttccacttacttctcagatatccctatcccttctcttaatggttatgccatacttgaagagaaaccaatgcctagtaacctagttgttcaaggagcaccataccttggaccttcaattgtaaccgttgaccattacaacttcggtcaaatcgattttgataatcacgtgtaa

SEQ ID NO: 60636 - DNA, 312 bp, Glycine max
  Peptide Sequence Number=SeqID_177414
atggaactttcatggacatggttggcagagcttttcacaactatcacttttaatgaacctactcttggtctgaaggctatctttagtttcaaagttcctcaccaaaggtctggaaaggtggaagttcactacttgcatgactatgatgaaataagcacgagtgttaggttgactgcaaacccaattgtcaacttctctggtgttataggaactaatgttcttgctcttggtgcttatctttctaaagctattggagccagtagacatgctgcaaataaatttgctatacgtaggatacgagaatgttgctaa

SEQ ID NO: 60637 - DNA, 1242 bp, Glycine max
  Peptide Sequence Number=SeqID_177415
atggctgctacatttcctcaacaacttctggtgaagccaatccactttttcaagatcataaccgctcacaatgttcatgaaggaaagctacatgtgctgagaacaatactaccgatatcgatgatgatcccaaataagtttgtgaagaaatatggaaaacgcttacaaaatactctatttctgaagactccaaatggtgctgaatggaaaatgattttgaaaaaacgtgacggtaaaatatggtttcaaaagggatggaaagagtttgcagagtatcactctctagctcatggccatcttttggttttcagatgggatattgagtaccctaccgaaataataaaaggtaaaacagcctccaatagaaaaggaaatgaatctccaggtgatgaacatttggagtgtcacagatcaggtcaaaagagaaaagttaactcagttgaatttcttcaacaatgtcaaatgagaagtcgcaagtgtgttaaagttgagaacacgatgatactgccaaggcaggctctgcatcacactgccacaaaatgcaaaggaaaatcgaaggctatggataaccaagttacagctcttgatagagcaagttctttcaaatcttgtaatccattcttcttgaccgtcatgcatcgaacccacatcagttctcacggtagtctgaacttaccaatgaagttctgtaggagtcaccttgatttgcacaagaagcggagacttatcagccttcaggtgttaagtgggagaatttggcctgcaaagtatcagatccataaacaaaagactgctataagatttaaactctcatggaacgcatttgtcaaggacaataacttgaaagttggtgatgtttgcatctttgaactcgttcatggaactaaactaaccttcctggttcacatcttcagagagacagatagttcaaaattgttcaacgtctcaagggattacctgctacttgatgacatatgtatttatgaaagtggagataacttcagaactcgttcaggcagttatcactatccggatagtgaaggtactcagtcactcaattatagctatttggatagttatactcattctcgacgtctcgttctgaaagaagatattgggccactctcactcgctaatcgctcaagcctcaagggtcaaggactctttctctacttcgttgccctttctgtagctaccattggcatcgctctccaatgtccccacttttgtagccaccgttag

SEQ ID NO: 60638 - DNA, 345 bp, Glycine max
  Peptide Sequence Number=SeqID_177416
atgagggttcatatcaccagaagtcatcgcctagagcattttctgaacatgctttgggtggttctagatgtcttgatttatttgatgacgaggtggcatgctagtgctgaaagcatgagaagccaatcattttttctactttacgcaagttatgcaaataccaaaacaataatcattcatttgaaagcaaaacccacaaaaaatggaggtttaccaatttgcgacactgacggaggctacaaaagcgacgacaccggagagagagccttgagcaatgccaatggtggctatagaagcggcaacaccggagagagagtcatggcaacattagagagagagccttga

SEQ ID NO: 60639 - DNA, 360 bp, Glycine max
  Peptide Sequence Number=SeqID_177417
atgtgtgtagactttaagttttgctccaaaataaagctgcatgtataccacagatacattactaagctcaaggctttatgggaagaattgggagggtataaacccatccttcttgctcttgtggggaaatcagacttcttcttgattacaaccataccaagatatatccttcttaaggatcctattccaccaattaacaaggtgttctccctagttatgcaaggcaacgtgccattggctccactgcctcagtatctgatgctccacttgcttttgatactcaacgtgctcctaaaaagtctactgaatactgatgctaagccaaaacatggcattgtttctgattctaacgctgattaa

SEQ ID NO: 60640 - DNA, 900 bp, Glycine max
  Peptide Sequence Number=SeqID_177418
atggagcgctatgagatcctcaaagatattggttcaggaaattttgctgtggccaagcttgttagagacaactacaccaatgagctttttgctgtcaagtttattgagagaggccagaagattgatgagcatgtccagagggaaatcatgaaccacagatcattgaagcaccccaacattattagattcaaagaggtcctgttgacaccaactcatttagccatagtaatggaatatgcttctggaggagaactctttgagaggatatgcaatgctggtagattcagtgaggatgagcaaatctgtcatagagatctgaagcttgaaaacacactcttagatggaagcactgcaccacgagtcaaaatttgtgactttggttactcaaagtcatcagtattgcattcacaacctaagtctacggtgggaacgccagcttacattgcacctgaggttcttacaaggaaagaatatgatggaaagattgcagatgtttggtcttgtggagtcaccttatatgtgatgttagttggggcttatccttttgaagacccagcagatccaagaaacttcaaaaaaaccattggtaagatacttagtgtccagtactcagtcccggattatgtacgagtttccatggaatgtagacatcttctatcacaaatattcgtggcaagtcctgaaaagagaataacaataccagaaattaaaaaccatccatggtttttaaggaacttgcccatggaactgacggaaggtggaagctggcaaatgaatgatgtaaataatccatcacaaaatgttgaggaagtactgtctattatacaagaggcaagaaaatctcttaatgttcccaaggttggaggccttcttactggggggcagcatggacctggatga

SEQ ID NO: 60641 - DNA, 423 bp, Glycine max
  Peptide Sequence Number=SeqID_177419
atggctcctacaacaaatccttcttcatcttcaccttctaatggtgaacactcgtatccttctccagcctcacctcctcatgatgacaatttaggttggccaattgcttataggaaagaagcacttgaccacttaggatggcgacaagctaagactgttgaaatacacgctcttgaacataatggtacatgggagttagttactcttcctcctgggaaaaagactattggttgcaggtgggtgtatgccatcaaagttggaccaaatggtgaggtagactatttgaaggcccaattagtcgccaaaagctacactcaaatctatggccttcattatgaagataccttttctcttgcacagtttgtttgtttcttgccatggcggttattcgacattttggtcacttcattagctaaacaataa

SEQ ID NO: 60642 - DNA, 480 bp, Glycine max
  Peptide Sequence Number=SeqID_177420
atggcagttgaaggtttctacatgagctgttgtgggacccacgattcttcctcagcggaccatgtaaagaacacgaaagaactacaagttcacttattttgggttgggaactttgaggcccaatgcgtatggccatttcaccaaccaatatatgggcctcaaggcccatcattgattgcgccaaaaaatgatgaagaaaaaattcttgacaggatggtgataaacctagcgagcctcttggctgagagcacaacaaactcatttagaaatagattctttcaaggtccagctgaggaactgctcaaagctccctcagcatgccctagggtgtttatgggaaaggggcttaccctggctatactgggaacttgctcgtcgactcttccattggtgctagctataatgcacatagtgctaatggaaggaagtacctgcttcttgtgttgtatgaccttgccacatcatcgtgcaccacgctag

SEQ ID NO: 60643 - DNA, 2549 bp, Glycine max
  Peptide Sequence Number=SeqID_177421
aaaaccgcaaatgctaaatccgcaaaggaagcatgggacattctgaacaaggcttatgcaggagttgataagatcaagaaggttcttgcaaattcaatcactagttgtggtgatacaattactaatctgacgttagttgagaaagttctgaggaccttgaatccaagattcgatcacattgtggttgcaattgaggaatcaaaggacttggaatcattatatgttgatgaattacaaggatcacttgaggcacatgaacaaatattgcaagaaagagcaaatgataaggctacagaacaagccctgcaagcacaccatcagtcaagaaatggtggttttgataatcacaaaggcaagaaaggaagagggagattccagaacatgagaggtagaggaggttactccaaagataaaggtaaacatcaacctgatcaaagaagtggagatagctgcagtaaaagaagtggtggttttggtactcgtggaagaggaggcaaaaagaaatgggataaaagaaatgttgaatgcttcaattgtggaaaaagaggtcactatgcagaagaatgttggtataaggagaaaaatgctgatgatgaagcacaattagccacaagagctgtttctgacactgaaccagtgctgttgatgatcacaacaaagactagagctgatgcagaaaataaatggtacttggacacaggatgttcaacacatatgactggtcacaaggactggtttgttagcattgatgagtcagtaaatcacgaggtcagatttgcagatgacaacactataagagttgaaggtcatggcaaagttgtgattaaaagaagggatggtacagtgtcatacattgaggatgtgctctatgttccaaacatgagatgcaatcttctgagtcttggccaactacttgaaaagaaatacagaatggtgatggaggacaaagaaatgaagatctatgacaaggacagaaggttgatcatcaaagctccattgaacaggaatagaacttttaagatctggacacttgaatttcaaggatttgagtcaactgcacagaatggctcaaggaatacctcagctgaaaagcaaccaaggaatgcatttcagaaatttgtaccagtaaagtcattacagaaattggaggtgatccattcagatgtctgtggtccttttcaggttgaatccctaggtggaaacagtggccactgtataaaaacattaagaactgacggaggtggtgaatacaccttcaaggaatttgctgagttttgtgatgaggcaggtatcactcatgagttcactccaccttatacaccacaacacaatgctgcaacaacagtctatatactcaacaaatgccttaccaagagactgaaaggagtgacacctaaagaagcctggactggctatcatgcaactagaggttacgagctacttgatccaagagatgtgatatttgatgaactaaaggaatatgagtggaaggaggaccctataaacaatacaaccaaggttctggtagattcaatcattccagaagaattgagtgacacaactgatgaacttcctacaaggaacactgaaggaggaactaggaggtctcaaagggttttgcaaccttcacaaatgttgaaagattatgaagtcatgaaagacagccaaatcacagatgaaggtgatattgtacactttgccctatatgcagatgctgaacctgtgagtttcaaagaagccttgaagaatgacaaaaatcctgctggtgaagtagttaaacacaaagccagattggtggcaaaaggattcctacaaaaagaaggtgtagactatggtgagatctttgcccctgtggcaaggattgaaatacttgatgtgaaatctgcatttctgaatggtccccttgaagaagaagtgtttgtcaagcaaccacctggatttgaagttgttggacatgaaggaaaggtatacaaactgaagaaagcattatatgaccaaaagcaagctccaagagcttggaacaagaagattgacagtgtcctaattcagattggctttagcaagtgcatatctgaacatggagtatatgtaaaagaagaatatgagtcagacttagaaatattgtgcctctatattgatgatttactcatcacaggaaacaacaagataaagattgacaagattaagcaactgctgaagaatcagtttgaaataactgacttaggatctctctcatacttccttggaattgagttcaaggaaactgaagctggaattgtaatgcatcaaagcaaatatgctacagacctgttgaagaagtttcgaatgactaactataatgcagcagccaccccagctgaaacaggattgacattgagtttgagagataaaggagaacctgttgatgaaactcagtacagacagattgtgggttcattaaggtacttgtgcaatacaagacctgatttggcattcagtgttggactaatcagtaggtttatgcaagctccaaaaactcctcacatgatggccgcaaagagaattctaag

SEQ ID NO: 60644 - DNA, 150 bp, Glycine max
  Peptide Sequence Number=SeqID_177422
atgttagaaaaatatctatggagggagaaatatgcatcgcacgaagacagtataaatgaaggcttcaatcccttctccgtttctctaacgtttgggaattctatcggagcagtcagaggaaaaattggaggagtatcagggaatcactaa

SEQ ID NO: 60645 - DNA, 252 bp, Glycine max
  Peptide Sequence Number=SeqID_177423
atgtttaacacccatcgctatggaatccgtaaagttcagggatgtttaggagagaaatcggccaaaaacacaaaaattggagtgtatttagcaaaccgggggtgtgtaaatagattgttacaccctaatttcttcctgggatcgctgttgatcacttcggaaggcttaacacccattaccgttgaatccgtaaagttccgtgaggtttcacaaggaaaacaaccaaaaacacaaaaacaggagagggggtga

SEQ ID NO: 60646 - DNA, 579 bp, Glycine max
  Peptide Sequence Number=SeqID_177424
atgggacccacatacagtgatatggggtgcaaactagcccttgaagacaaaaaaagagtcgcatttaggaggaggcagaggcatgaacatgttgatgcaacaaggcatgccaaaccttgcaattgttcaagtttggcctctcagcaacaaaaagcctgtgtctgttgtttcatcaagctaccatgcaaaatctgtcatcaagcactgaggtgtgcccggaaatgggcatgttatggatcaaagaataatagggctgggtttgtgaattccttggcttttgcaaaatcaggagaattcttagttgctggagttggacatgtgaaaattttctcaaactatgtcctgcttactgttgtcctcaaagttggtatgtcatgtcaagggtgtgctggagcattaaacaggattttgggaaaaatggaagactcttcttctacttgcacttgggttctttccaattttaattccaacattctaactccaaccatcaactatggatgccacctccactcttccgacaccggcatcaccgacattgctttgcactcctccgggatcaagtcagaaaaaggtatgtga

SEQ ID NO: 60647 - DNA, 150 bp, Glycine max
  Peptide Sequence Number=SeqID_177425
atgacgccacttccaaagagggaagatacgatcctcatcaaaggagaaggggaagtcgaagcagttgtcaaagggaggaaagggaaggaggggatgttagaagcaacattcattagaggcagcgttggagggaatgaaaggatgttttaa

SEQ ID NO: 60648 - DNA, 689 bp, Glycine max
  Peptide Sequence Number=SeqID_177426
agtggacccttgggtacaagtaccctcaccttcggaaggctacacgccctcgccttcattgggctacatgtcctcgccttcagagggctgcacgccattgccttcagagggctacacagaggactacacgacctcgctttcagaggactacacatcctcgcattcaaagggctacacgccctctccttcaaagggctacacgccctctacttcaaagggctacacgccctctccttcagaagactatgcgtcctatcctttagaggaccacatgtccttgccttgagaggaggactacaagccctcaacttcagaggactacacgtcctcgccttcagagggctacatgccctcaccttcagaggactgcacgtccttgccttcagaggactacacgtcctcccattcagaggactacacgtcctcgccatcagagggctacacgtccacgccttcagagggctacaagacctcgcctttagaggactacacatcgtcgccttgaggattacacggctacacgccctcaccttcagagggctacaccccctcgcctttagaggaatacacgtcctcccctttagaggactacacgtcctcccatcagaggactacacgtcctccccttcaaaggacaacacgtccttaccttcagaggactacatgccctcaccttcagaggactacac

SEQ ID NO: 60649 - DNA, 162 bp, Glycine max
  Peptide Sequence Number=SeqID_177427
atggagggccagaaagagtttgttcaaattgacactaatgatttgtttccttatcttttagttaatattggatttggtgttagtatgatcaaggaagcagaggtacaagacccttattggactcctccccctagatggaagcttgagaactcagagaggtaa

SEQ ID NO: 60650 - DNA, 369 bp, Glycine max
  Peptide Sequence Number=SeqID_177428
atgattggaacagtagtcgctgcacttctttccttcacgacgaacaaatggggacctttgctactattgaaagagaaaattgagacaacgatagagcaagcagaacgtgtggcagatatagtagaagaagtggccgagagggttgataaaattgcggaaggggctgccaagaatcttcccgaaggaaaacttcaggatgttgctgaatttgttgaaaacgtagctgaaaatgtagacaagctcgccgaagaagcaggggatctattggaaaaggttttaacctgtgtcccaaaaatcactctaaacttcctcatttttatttttcaatcacaattacacctaatgccttgttttatatactttacttaa

SEQ ID NO: 60651 - DNA, 348 bp, Glycine max
  Peptide Sequence Number=SeqID_177429
atgagtgacaatggtgaagaagctggagaaaatcgtctagttccccgtttgaatgaaaggattctttcatcattgtcaaggagatcagtagctgcccatccttggcatgatctagaaattggacctgaggctcctcagattttcaattgtgttgtggagatcactaaaggaagcaaggttaagtatgaacttgacaaaaagactggattgattaaggttgatcgggttttgtattcatcagttgtttatccacataactatggttttatccctcgcacactgtgtgaagacaatgatccaattgacaaaattcattctaagacaaaaagaatgagcacaaggaggtag

SEQ ID NO: 60652 - DNA, 156 bp, Glycine max
  Peptide Sequence Number=SeqID_177430
atgtttcagggtggtgttgaggggaaaagacaagtggataaagtcgttgacaaatgtgcttcaatgcagaatttggaattctgtggtgacaaggtcctaatggaaagagggaaaatattcctaatggcagacaagatcaaggagttgcctccctga

SEQ ID NO: 60653 - DNA, 282 bp, Glycine max
  Peptide Sequence Number=SeqID_177431
atgagtcatcgctggccttctaggttgtgtgtgatgagtgatgatgatgtattgaggttaaggtcgtaccttaggttttatcatgcagttgaagttcctgtgtattaccaggctttgaggaatggtgataggtatcctagggacaaggatcggtttataactagttatgtaaggatctctcatcaggtttataatactgttgatgattatgagaggcttaagactgcgattaatcaacttgtggaggacgggaaagtttgcagtgggattcctaaggagtga

SEQ ID NO: 60654 - DNA, 439 bp, Glycine max
  Peptide Sequence Number=SeqID_177432
atgaagttgagcacgaacggaggaaacgtccctgcacaattgctggttcttgacagaaaggtcgtgaagaatggcgtagcagcggaaccagcagaacacgcaactgaggcggtgaggaatgcatacaaggatagcaagaagaaggatgcgaagacaatattcttcctgcatcagagtcgacagtttgactcgatgacgatggaagagaatgagaagattgttgacttctttgcacaagtaaagtatgcaattgaggaatccaaggaagtaagtgaaatgagtttagaagaattgcaaagttcactcgaagctagagaacttagattgctagagagaaataagcaaaaaattgctgaacaagccttattggctcaatctagtaacaagaattttggtggcagtaacagaggaagaagtggttttagaggaagaggtcgtg

SEQ ID NO: 60655 - DNA, 918 bp, Glycine max
  Peptide Sequence Number=SeqID_177433
atggatcttcctccagaaatcgacggttacatcaaggaatccatcgatcacagcgtgggccttcccgtatcctcgcaaaccctcctcttcaagcttcacgcttccctagaatcgcagcgccaactccgcgaccagcacctcttcctcctcgcgaaattgaaggagaaagacgctctcatcgaacgcgctagatgtgaggcgaacatgaacgcccaagcggtgaagaggttcgttgaggagaatcagaagttggcggcggagtgtgagagtctggtggagcagcgcgtgaaattggagcaggaatgcgcgctctacgaccatgacagggaagcgttgatggagtttgggaacgaggctgatgaacgcgcacaggaggctcatgagcgtgcactcgagttggaacgagatttgtgcttgttggagcaggaattggtcaaacacaagcagcagaatgattcggtagattcgtcttctggaagtacacttgatgaagagaatttgcttgactcccttttggctacagttactactactactatagatgagtctactacatatgcatttttgaatgcaaacagtgaaaatgagcactgtgagaagttgctgacaatgtggaactgcttgaagccatcaacacggagagttttgtgtcttgttgctgaagtcaaatctctagagaatgataaagaaaatctaagggttaaccttcacagagctgaagaggaggtcaaattattgtatgatgaaaatagcgtgttggatgaggagaacaaaagattagcgaagcgatgcaagggaaggtaccacagcagttctggtgggaaacttaccggaagtgcatctgcgaagattaatgttctagatccaacattttggtatcagagcctaatcgagcctgggatcggaaaacacgagtga

SEQ ID NO: 60656 - DNA, 759 bp, Glycine max
  Peptide Sequence Number=SeqID_177434
atggcaaggtcttctaccaaaatctggagagatgttcctaggaacttcaaattatttgaagagtttgagagaggtgagaagggaattggagatggaactattagctatggaatggatgatgctgatgatatctacatgcaatcctggactggactattattggcccccctggtaactttgcaaggcattcaaattatacaagctgccgttggggctgggaggacaatgttggtaagtgattctagtcaggtttatgcatttgggaaaggctcatttagggaaactgagtatggagtccaaggttctaaaactgttgcagctccacagatagtggagtctttgaaaaatatatttgttgtccaagctgcaattggtaactttttcacagctgcgttatcaatagaaggcagggtttatacattttcttggggcagtgatggaaaacttggtcatcgcactgatcaaagtgatgagaaacctcatcccttgttaggtgctcttgaaaacatatcaataggcaacaggcatgcaaatgtgttaagtccaaagtttgtcacttcactgaaacagatcaatgaaagagtggtacagattagtctgaccaattccatatactggagtgcttatacctttgcccttactgaatcagggaagctttatgcatttggtgctggagacaaaggacaactaggaattgaacttgttgctaatcagactgaaagggaaaatccagaaagggttgaaattgatcttggttaa

SEQ ID NO: 60657 - DNA, 453 bp, Glycine max
  Peptide Sequence Number=SeqID_177435
atgttgaaaataaacctgatcaggggcagaggctactatcgaggtggtagaaaaaggtttgataaacagaacatccaatgttataactgtgataggtggggacactttgcagatgagtgttatgcgaagaaggattcccaagttgatgaggcaaatcttgccaaaggtgatgatgaggaaaatgagctagtgatgctcatggtgactactgcagatgaaacgtgcaccattgatgaatgcaagaaaaatagaatcaagtttgctgatggtaaagctatgctggcagaaggagttggaaatctgatgatcaagatgtcaggtggcaaaaatagtttgatatgtgatgtttctatgtctagaaacaggacatttagagccaatcttgaagcactttgtcataaatgcctaattgcagtagtgagtgaagatgattgggtgtggcatcacatttag

SEQ ID NO: 60658 - DNA, 225 bp, Glycine max
  Peptide Sequence Number=SeqID_177436
gagttcgtcgagccacccatccccgaggtttcagtcgcgaccgatctccctatgcattcagtggatttaggagcgattgctgaggatttggagcgggtcatcaacctcaggatggtcactgggggcactgacttacatgacatcatgactcgttgtctgagaagagctagaggtgacgccgcagatggaagtcttaggccgcgccagagacgccgcatagattag

SEQ ID NO: 60659 - DNA, 710 bp, Glycine max
  Peptide Sequence Number=SeqID_177437
attgccgaggagctgcgtcaggccggccgcgaggtgttctgtcggtcggtgagcactaccgcccgccacgcgcctatcgcgaccgtgattactgctggtggcttggcgcgctggggctgtgggacgaagtgaaaatcaagccgaagaaacagcacgtggcctttgccgtcagcggctatgaaggcggtaaaaccgtggatttccgccggctggcccatatgggcattacgctggtcggcatcaccgagcgctgggataacggcgtgctgcgctttgcgccggggctggcagagaatatcgccgaaggtgacagagcttatttcgaggtgctgcgcgatgcggatgcgtacatagaacgcaacgggctggatttaccggccgagccgcaggcgtgggagctgttgccggatccggaatgcctgttaaatccgctgatgcagctggacgtgcaggcggcgggcatcagcaccattatctgggctaccgggtttaaatttgatttcagctggctgcaggtggatgcgtttgatgaacagggcctgccattccacaagcgcggtatttctgccgagcgcggtatttatttccttggactgcccaatctggtcaatcgggcgtcgtcgtttatttacggcgtgtggcacgatgcgaaatatattgccgaccacatcgcgctgcaaaatgcctattcggattacgttaagtcgtaa

SEQ ID NO: 60660 - DNA, 291 bp, Glycine max
  Peptide Sequence Number=SeqID_177438
atggatatgaacgtgaaggggatgacaaatgtgttgcatagcggaaaagaagatggaggtgataatagtgaacacgtcttctggatggggaaggtgggtgcgatgctggtagctccatattgtgcatcaaagttggcgataaaagggctgagcaagtctggcaaaagaggtgttggaaggtatgccagtggtcgcactcaattggaacataatcaacaccaacatgctctcctcttgctttggtgcatctacttctctctatcaagcaccgcagcacaaccgttaagttag

SEQ ID NO: 60661 - DNA, 213 bp, Glycine max
  Peptide Sequence Number=SeqID_177439
atggaggataccttccaagaccaggcgttgcatttgcagaagcagaaacaagatccacaagcacgcgatgtacctaatggttcatgtgatgatatcaatagcaaagcaaaacctgtaggtgcatcagtaactgatgcaaagaaagcaaagattactaaaaagtgtttgccgaacttgaaaattggtttagagctgttgaagataaaacattaa

SEQ ID NO: 60662 - DNA, 282 bp, Glycine max
  Peptide Sequence Number=SeqID_177440
atggaaaggcaacgccgagaagaggagcttaagaaccggtcatccaaaaagacacttgatgcagaacagtcaattctaaatagggcaactagtcctcaaacaagtcaacaaagtgggggaaacttaaaatcgatgaaagataaatccagtcagcaagacagggatacacaagagggatctggcttgaagactgctgggcctgaaggggagataaccgcaggtttaatatcaccaaggtctctctgttcggtcacctgtgctgtaccatcattgaagtattaa

SEQ ID NO: 60663 - DNA, 1329 bp, Glycine max
  Peptide Sequence Number=SeqID_177441
atgatgatgatatcgatgatgggtggtcgatgttatagttcatatggtggtagtaatggggacaggaaatctatgtctaagtcaaagtcagaagctgatgttgttgtgattggttttggatgcgctcggcgagtctcttccatacctgaaggacaattcttgtcgcgcataggccctacggagtttttcaaggaccttcaacagtatgcaggtccaaatgctgtccttgaatggcggaaacttttagatgctgtgcttccattatctacagctgcaatggctcttcctcctctctctattcgtggagacttgggcgttctttccactgctgcagccagatatggcccctctctaatcaaatcctttcttcaaatgggacctggagctgctcttggggccacaaaacttctcagacctttctccgaaatacttgatgatttgcaactcaaagaccctttcatacggaattggattgacctcctctccttcttgcttgctggggtcaaggctaatgctgtactctcagcagagatgaatggtacaaaccgggatgctgtcttgagtaggcttcatggaattgcagctattgttgatgctcttgtgcgaggactagagaaatttggtggaagaatttctcttcaaagtcatgtggaaaacatcgttgttgaaaatgacagagccattggagtcaagctgagaagtggtcaattcatacgcgctaaaaaggctgttgtcagcaatgcgtcgatgtgggacaccttaaaattgctacctaaagaagttgttccaaaatcctactcagacagggttaacacgactactcagtgtgattcattcatgcatctccatttgggatttgatgccgagggtatacgcagtgatctggggattcatcatatagttgtaaatgactggaaaagaggagtagacgccgaccagaatgttgtgttgatatcaataccaagtgtacttagtccaaatctgacaccacatgggaaacacgtgctacatgcttatatgccaggaactgaaccatttgagttgtgggaaggacttgatcgtaggagtgctgaatacagaaatctcaaagctgaaagatcagaggtaatgtggaaagctgttgagagagcaataggcccaggtttcagcagggagaaatgtgaagtgaagttggttgggagtccactaacacgaaagctttattgttgcggagactccacctttcctggcattggagtcccagcagttgctgccagtggtgcaattgtagcaaattcattagtctcagtatctcaacattccaaactgctcgatgcaattgccatatga

SEQ ID NO: 60664 - DNA, 1875 bp, Glycine max
  Peptide Sequence Number=SeqID_177442
atggatcagaggggtgtttctgcttcatcccactattttgatgacatttcctttcgctctgagaggaatgttggattacggaaaccaaaatccattaatgaccattacccacaaggaaacaatggaatggtagcatcacctggcaacattttgaacgctacacccccccttgatgtaaatgcaaaagctggcttactgttgccacaggctagtctacctggggataacatacattccacggaatcatcgaattaccgtaccaaatcattgtctaatgcatgtctgcagtcagcacctacctcttatggtttaattggcaacaagattgtgaccaatgctgccccttttgaaagtagtttattctcaagctccatgtctgagatatttagccaaaagtttaaattgatgtcattatctgtctacttatttgctaatcttggtgcagtaaggttcttcgggaatgatgttcggtctgatcatcccattactgctggttctcctcccaaggaagaaccatataaatctcttgaagaaatggaggctgacactataggcaatctccttcccgatgaagatgatctgttttctggtgttgttgatgagttaggatgcagttctcatgccagaacaaatgatgattttgaagattttgatctgtttagcagtggtggaggcatggagatggaaggagatgaacatttaagttcaggaaaaagaatgagtgctcttgatggagattttggtttctttggaagttctaaaggaaaacttcctttagttgaacagccttctagaacactttttgttagaaacattaatagcaatgtagaagactctgagctaaaggctctctttgagcaatatggagatatccgaaccatttatacagccagtaagcatcgtgggtttgtcatgatttcttatcaagatctaagggcagcacaaaatgcaatgcaagcacttcaaaataggccattggggtctaggaaacttgatatacattattcaattccaaagatgtatattaacttgaagacatgtcaggtcaatgctccagaaaaggatattggccatggtacactgatgctttctggtcttgattcacctgttttaaatgatgagcttaaacaaatttttggattttatggagaaattaaagaaatctatgaatattcagaaatgaataatcacaaatttatagagttttatgatgtccgagctgcggaagctgctcttcgtgcattgaacaagattgacattgctgggaagcagatcaagcttgaacctggccaccctagtttgatgcaccagtctcaaaaggggcaagaggagcgagatcttggtcaaagtattattgacaacttatcattaagacaaaaggcaacactgccttctggagtaattggatctggttgcttagaaaatggatataatcagagatttcaatctacagttaggcaacctttgaatgcatttatggataatgcattcattcatgtgaattctggcattcacaacactgtgagaggggcacctgccggaaaagtgtccagtgtttgtgagtcaagtaactttgttgatgcaatgaaatttgcatctggttcgagatttcatcctcattccttacctgagtatcgtgatagtttagctaatggtagtccttataacttttctagctccattagcaacatggctaacaatataggtgctggagcaacagaagcctctgatggcaggcatattcagggaatgggctcaactgggaacttagcagaatttaatgcgggagtgcgctatagcaatgtggagcagcccttgcccactacaggggctgctgtagtggagcagtttagtgtagaggccatagcgggctga

SEQ ID NO: 60665 - DNA, 238 bp, Glycine max
  Peptide Sequence Number=SeqID_177443
tgcactcttgcaggctatactatgtgcaggtttatatcccaatgtagcagctggtgaacaaggcattgttgcagcagttctcagcagccttaagcagtcttctagctctgcaagttctggccgtacagtctggtttgatggaagaagagaggttcatattcacccttcttctatcaacaataactcaaaaggattccagtacccctttcttgtcttccttgaaaaggtctgtgaatag

SEQ ID NO: 60666 - DNA, 870 bp, Glycine max
  Peptide Sequence Number=SeqID_177444
atgagtaagcatccctataaaacggcgttcaaaacggaacacgatcaaaacgccgtcgtcaatactactagcagggaagaacacgaggaagcattggtggctctcgtcgaacaccgtacccgtgaagtcaaaaacggaaggaaagaacttgaggaattgtttcctttaatatgcaagagttcttcaccgggctcagtgttttgccaaaaattaagcagtcagttgccaagtctgcataaaaaaagagtgcggcgaattgctgtgtgccctgtgaatgatcatcgttttgtgaccagtgctttggacggagtggtcaacttgtgggaagttcatagttctggatcaggagcttctctgcttagaactactgattgtgcatcccaaaagcagaggagatggccagaagatgtagcctggcacccagatgtgaacagtgtattttcagtatataatgctgatagccaagactctcagatatcagtaacagattttagtaagagagaacgtgttaatttcttagaggacaagcctcatgttaagggtgttataaatagcattgtttttctgccctgggaaaataccagttttgtaactggtggaactgaccatgctgtcataatgtggaatgagaatagtgagaacaaatggaagccccaactattgcataattatgatcattcttctgccgtcatgggagtggctggtatgcagcagaagcaaattgtgttgtccgccggtaaagacaagaagattttggggtatgatgttcatgcaggaaaacaagagttcaagcatcaagttgatagtaaatgtttgagtgtgcttccaaatccgtgtgacttcaatttattcatggtccaaacggggtaa

SEQ ID NO: 60667 - DNA, 315 bp, Glycine max
  Peptide Sequence Number=SeqID_177445
atgacaatcagtaaatccaaatgggcaattgacagtggcctcattgacccatctatagaagaaaaactaccgaaacagagaaagaaattgaacaagctgagtgaaacgacttgggaatcaggaagagagagcgtaatgaacctcgatctgagagaagaggccgttgtagccgcgagacctgaggaagcgatcgacggcgtcgttgggagcgttggccggattgaggtggccggcggcggtgccgccgatggcagattggccgccagcgacgtcggagcagcagttgcccatagactgactgactgggtgaagtaa

SEQ ID NO: 60668 - DNA, 225 bp, Glycine max
  Peptide Sequence Number=SeqID_177446
atgtcggctgttgtgtcagctcttgctcaagtcattggtggcaatccaaaacacaaagatccaacaacagtgtctcagttaagtgtggttgggaatgattcgaatgaacaatcacaaccacctcaacatcaaaaacaatcatctttagggtttcttaacctgcctctcaaaatcatcgtgtgcccctgcaagttacatgatgtgaggttcatatacatacactga

SEQ ID NO: 60669 - DNA, 510 bp, Glycine max
  Peptide Sequence Number=SeqID_177447
atgcttcggatgccattagttgaattgtgtttgcagattaagttactgtctcttggatatatcaagccatttttgtcagaggcattagaacctcccaaggttgaagcaatggattcggcaatatctttactgtatgagaagcaaatgtccccagacctatcatcacgtttatggaaatactcttacgttggtgctcttgaaggggatgaggagttgacaccacttgggcatcatctggcaaaacttcctgtggatgtgttaattgggaagatgatgctgtatggtgcaatgtttggttgtttgtctccaattctttcagttgctgcatttctgagttacaagtctccatttgtatatcctaaggatgagaggcaaaatgttgaaagagcaaagttgacattgctgaatgataagctagatgggcctggcaacacaaatgatattgatcggcaatctgatcacttactgatgatgacagcttataaaagatgggagaggattttgactgag

SEQ ID NO: 60670 - DNA, 270 bp, Glycine max
  Peptide Sequence Number=SeqID_177448
atgggacaacgctacttccttttactacaccctcctacccttcgacaacttcctctgcaatgtttgggagaaacgaggacccgtcaagtggatcttctcctcctccgggatggttgctcatgtgatctacactggcaggctcctgtttactgttttggggacgctgagacactgaacaaaacaagcacctccctcttacattcacaagatggtgcttcttctcatgggatgttaatcggacagatacttcattctgcatatgctaagtaa

SEQ ID NO: 60671 - DNA, 723 bp, Glycine max
  Peptide Sequence Number=SeqID_177449
atggaaacagtgaggactagagaaggagcaatagccaaagacaccactgaaactgaactcaccaaaatccctctcctccgggcaactgttgaaacacttcatccctcttccaaggaagaggatgattttatgattagaagattcctgcgtgctcgtgatttagatgtagagaaggcttcggcaatgttcctcaagtacttgaaatggagacatgaatttgttccaaatggttctgtatcagtgtctgatgttcctatcgaacttgcacaggataaggtgttcatgcaaggacgcgacaagataggtcgacctatacttattgtctttggtagaaggcattttcagaacaaagatggtctagatgaattcaaacggtttgttgtttatgttcttgataaagtatgtgcgagtatgccacctgggcaagaaaagtttgttggtatagcagaactgaagggatggggatactcaaacagtgacgtgcgtggataccttagtgctctatccattttgcaggattactaccctgagagattgggaaagttgtttattgtgaatgcaccatacatttttatgaaagtgtggaaaattatttacccattcattgacaacaaaaccaagaagaagatagtatttgtggaaaaaaataaggtgaaatcaacactgctagaagagatggacgaaagtcaggtcccagagatattcggtggctcactgtcattg

SEQ ID NO: 60672 - DNA, 1752 bp, Glycine max
  Peptide Sequence Number=SeqID_177450
atggagcacgtggggttttcgaaagcggcgatagccgatcatggccgcggcaagaaaacgggtccggtttcgatggatcacgtgcttcttgctctgcgcgagaccaaggatgagagggatcttcgaattcggagtctcttcaatttcttcgatgctgcgaataatgggtacttggactatgctcacattgaggccggtttgtctgcactgcagattccccctgagtataagtatgcaaaggagcttttcaaggtgtgtgatgctgatagggatggaaggatcgattaccgcgactttaggcgttacatggatgacaaggagttggagctttaccgcatatttcaggctattgatgtggagcacaatggctgcattctccctgaagagctttgggatgctcttgtcaaggctgtgggcatggcggaatggcatggtgaattttttgccaactgccatggccaatttatgaagggaatcctgccaagacggcgccataaggtgcaatggcatgtttatatggcagaatttcagcctgccgccatgtgttgttgtttgctatctgtcctctttatcctttctgtgcttatagtgatatgtactgctgttttgtctatagattcagagagagagagacagaactttgggaataattctatgagtatacatgggattgaaattgacgaggaagagcttgctcgctttgtggagcatgttgacaaggataataatggaattatcacttttgaagagtggagagattttcttctactttatcctcatgaagcgactattgaaaacatatatcatcattgggagagggtgtgccttgttgacattggagaacaagctgttattcccgaaggcatcagcaagcatgtgcacaggagcagatattttattgcaggggggatagcaggagctgcttctcgtacagcaactgctcctcttgatcgtctaaaggtgctcttacaagttcagactggacgagcttctattatgccggcagtgatgaagatatggcgacaagatggtttattagggtttttccgaggtaatggattgaatgttgtgaaggtagctccagagagtgccatcaagttttatgcttatgaaatgctgaaaaatgtaattggagatgctcaagatggcaagtcagatattggtactgcaggaagactttttgcaggtggtatggctggtgcagttgcacagatggctatctatccaatggatcttgtcaaaactaggttacagacttgtgcttctgatggtggaagggttcctaagcttggcacacttacaaaggatatatgggtccatgagggacctcgggctttctacagagggcttgttccatctcttcttggtatgattccttatgcagggattgatctcactgcatatgacaccttgaaagatctatccaagagatatattctttatgacagtgatcctggtcctctagtacaactcggatgtgggactgtttcaggtgctcttggagctacatgtgtctatccgctgcaggttattcgtacaagcgttatcatgattctcagactgcaggcacaacctgccaacagtactagtgcttacaagggaatgtctgatgttttctggaaaactcttaaggatgaaggttttagaggtttctacaagggactcattcctaatctcctcaaagttgtgccagctgcaagcattacttatatggtttatgaaagtatgaagaagagtctagatcttgaatag

SEQ ID NO: 60673 - DNA, 945 bp, Glycine max
  Peptide Sequence Number=SeqID_177451
atggggcacaaagaaaaatctaaagagcgaaaagagaagagattgcaagagatatctcttctgaggaccattccatatgctgatcaccagaggtggtggtctaaggaaacaattgccgtggttactggaggaaacagaggaattgggttcgagatctcaagacaacttgctgatcatggagtaactgtaatacttacatcaagagatgctagtgttggtgttgaatcaatcaaggtcttgcaagagggtggtattcaggacgtggcatgtcatcaacttgatattctagatacttcttcaattaaccaattctgtgagtggttgaaggaaaattatggtggcttagatattctggtaaacaacgctggggttaacttcaattttgggtctgataattccgttgaaaatgctaaattggttattgaaacaaattattatggcaccaagcgtatgattcaagccatgattccattgatgaagtcatcctctgctggtggacgcattgtaaatgtgagctcgcgtctaggtcgattaaacggcaagcgaaatagattggagaatgaagcattgagggagcaactaagtgatgaggaatctctttcagaggaagtgattgatgggatggtatcaacttttctgcaacaagtggaagatggaagttggaaatcaggaggatggcctccaacgttcacagactactcggtgtcaaaactagcagttaattcttacacaaggttcatggcaaagaagctttctgagagacctgatggtgaaaagatttatattaactcctattgccccggttgggtcaaaaccgctctcacaggttatgcaggaagtgtttcagttgaggatggtgctgattctggtgtctggctttcccttcttcctgatcaagctattaccggcaagttctttgcagagagacgggaaattaacttttaa

SEQ ID NO: 60674 - DNA, 150 bp, Glycine max
  Peptide Sequence Number=SeqID_177452
atggagcatttgaattttggagtaccgaaagatgctaaatttggcctcagatctgcacagcggttacgtgggtggttttttcagggaggtattgtggaaaccgaatcagagtatttaagaggggagagaggtgcttcacattgtaattga

SEQ ID NO: 60675 - DNA, 201 bp, Glycine max
  Peptide Sequence Number=SeqID_177453
atggcttccaacgaaaacacaggaaaatattacatttcctatatctcaaatcactcactacctccctacctcatgagtaaaccattcaaacttacaactgtgacaagaataggtggaaaaagaaacagaacgctggctgaatcaccagtgcaggcacagcttcgtgaattgaacctggaagaaaggctttgccttccctaa

SEQ ID NO: 60676 - DNA, 821 bp, Glycine max
  Peptide Sequence Number=SeqID_177454
atgggtttgtactttggtgggctgcctaagagtaagagtttcagatttacttttcaacacataaagccaagtaaaacgagtgtgggcatcaacaaaggttacataatatctgtaacctgtgttggacaagagagaagacccccacagatctgtataaatgagttcaaagggagtggaatattcaggtgtacatataagatacttgccaaggttctgactaacaggttgaagaaggttatgcatctcatcattaatgaaagacagtcagcattcattcaaggtagacatatgcttcacagcgtgatggttgcaaatgaggtggttgaagaagccaaaagaggtcaaaagccttgctttattttcaaggtagattatgagaaggcatacgactctgtgtcttgggagtttttgacttatatgatgacaagaatgggtttttgcaccaaatggatccaatggatagttggatgtctaaaatcagcatcggtctcggtcttggtcaatggtagtccttcatctgagttctcaccccaaagaggacttagacagggagatccattgtcacctctactatttaacattgttgcggaaggtcttaatggattgctgtccaaagcgatagagaagaggttatacaggggattcttagtgggaacaaacaaagtggagattagcctcctccagtatgcggacgatacaatattctttggggaggcatctatggagaatgttagaactattaaagccatcttgagggcttttgagcttgcttcgggcttaaaaatcaattttgctaagagtagctgtggggcttttggagt

SEQ ID NO: 60677 - DNA, 781 bp, Glycine max
  Peptide Sequence Number=SeqID_177455
atgagagagagagagagagagacagagcgagacagtgagagagacagcgggtgggaaagagtgaggtcgagaagggagagaagagagaatgagaggacgagaggtatggagggtccatgtctgtttatcgccagggaagggaaaggaggtcaacaacgtcgcttgcgagtcaactggagagatcatcggaatatatcatcgttttatttcacacgttttcctgaagatacaacagaagatgagctatggaagatattcagaagagcgggtgatgtcagggaggtgtttattcccaacaagaggaataggaccggaagaaggtatggatttgtgagattcatcggagtggataacgtccaacagttggaaaggcgtttggataacatagtcatggggggattaaagttatatgttaacatccctaaatttgaaagaggtaggggtcgagtgcaaccacaatcaacagggggacgagaacacaccaggcttgtcgaacaggggcgcagagaaacttaccaggcacagaaacacacagcgacgccgggcctggtacgcgggtcttttgcagatgtggtagctaggagagaaccacgtatacagcagaggaggacatcggcagttcagaatgctaaaaccaacacttcgagatcagaagtacatctcgacagacctatgacagcaccgaaatggctacaggatgcatgggtgggaaggctaaaaaatcttgcactccttgacagagtagaggagaaatatgctatgggactggggattaaactaa

SEQ ID NO: 60678 - DNA, 309 bp, Glycine max
  Peptide Sequence Number=SeqID_177456
atggtaactgattataaactagaaacagaggcactgtgggaagaagataacaggtgggtaactgagaaagttaaaaataggctaaggattgagaccggattgtttacctttacgaagggcaatgggaagggggaccaaagcttgtctggcattactcatatcatagttgatgaagttcatgagaggtctttgttgtttacactgaatgtaattctcattatttataccttggctgattggatgtgtgaagttctgagtaagatgtctaggaataccatgtgtcatgaatcaactattccaaaagcttaa

SEQ ID NO: 60679 - DNA, 483 bp, Glycine max
  Peptide Sequence Number=SeqID_177457
atgttgaatatcagagctacgcttcctattgcagctctaaagggtgatatattgaaattgatggaggaacatgattttcttgttgtttgtggggaaacaggctctggaaagacaactcaggttccacaatttatattggatgacatgattgagtcaggacatggtggatattgtaatattatttgcacgcaaccacggagaatagcggctgtttctgtggctgaaagggtcgcagatgagcggtgcgaaccttcacctggttcagatggttctttgattggttatcaagtccgtcttgatagtgccaggattgccaaatcctttctcaaggttcctcagtcaagtccagcaaaagaagatggcatcatccagtatcttattcagctgtcgtttgaaaagatcactcggtttctatggttccatacacaccaagatagtgccacccaccaaattagccatctctgcgatttaataccaagatag

SEQ ID NO: 60680 - DNA, 159 bp, Glycine max
  Peptide Sequence Number=SeqID_177458
gttcataatgatgatgaggtaagggcattgttcaagcaagttcaaggtgaagttccgggttcacccatatttataatgaaggttgcatcccaggctattcctgtctccgtccacataaaaggtgggacagacgagttcaagtatgaaagaaatgattaa

SEQ ID NO: 60681 - DNA, 309 bp, Glycine max
  Peptide Sequence Number=SeqID_177459
atgggccttccagaatgttttttgaagctggattgcttctggaggaagcaacccagctcgcctgggcgagctgggcggcaacctcctccccttattcctataaataggctgaagggggctgttctaaggatcccggatgcccctgaaaatccatgccgaggtgcttccgtaacgcttccgagatgtttccgtaagcaaatccgtgaaggttttcctccgttattcaccgttcttcatccgttcttcgttcttcaacggtattcgttaatttctgttaaaatgaattccgatcgttcggtcgtgccttaa

SEQ ID NO: 60682 - DNA, 504 bp, Glycine max
  Peptide Sequence Number=SeqID_177460
atgtcgttaagcacttacgacatcagttttaaaataaccgatgttaatatcacactaaatcgagcagttaacatcggttatttcaaaactgatgttgcacaaacatacaactccataattgggttccctgaccccaattatggtatcaaaactataatcaaccagaaactctcctcacctatctatattctcccgttagctcctcgcaacgttgttttgagatctcttaggttcatgtctgttactctgagcgtagagctcttgtcataccctaatttcgtctggggactattgtttgatggcatgcaacctttggttgaccgcttcgaggtgaaagaacccggtggaccattcggtcccgccaccaaatcttatccggagccccatgaattgattgtcattcatgcatcctccaccatcgagtttggagccctacgaattgattgcctagcgctgttcgtctatcctccaccctcaaatcttatccggagccccatgaattga

SEQ ID NO: 60683 - DNA, 307 bp, Glycine max
  Peptide Sequence Number=SeqID_177461
atgaccatcgatgactgccatgagccaccgttgattgctgtcagaccaccacacggagaggaacactgtaatcggagcggaatctccaaaactcaactagaggattcagaagagaatgaagcctttgaccctgccttcgtggtttattcaagagctgtcgcaacctaccctttgcgggcaagcgaggcgaggctcacggattcgggagttgtatttacgtttgaggaaggtattagcacctctcacgtcgacaaaagcggggctcttgctcctacgtaccctccatcgaagaggaaatcagacctac

SEQ ID NO: 60684 - DNA, 999 bp, Glycine max
  Peptide Sequence Number=SeqID_177462
gacttagacaaggccactgatcactttaatataaatagagtactaggaaagggaggccaaggtaccgtttacaaagggatgctagtagatggaaatattgttgcagtgaaaaaatttaaggtcaacggaaatgttgaagaattcatcaatgaatttgtgattctttcacaaattaaccatagaaatgtggttaagttgttaggatgttgtttggagactgaaatcccattgcttgtttatgaattcattcccaatggtaacctttatgaatatttacttggacaaaatgatgacttaccaatgacatgggatatgcgtttgagaattgccactgaagttgctggagctctattttacttgcactcagctgcttctcaacccatttatcacagagacatcaagtcaagaaatatactattggatgggaagtataaagcaaaagtagcagactttggtgcatcaagaatggtttccattgaagccactcacctcactactgcagttcaaggaacttttggatacatggaccctgaatatttccatactagtcaattaacagataaaagtgatgtctacagctttggagtggttcttattgaacttttaactgggaaagagccaatatcttctgcaaaacaacaagagcttagaagtttggcttcatatttccttctctgtatggaggaaaatcgtctttttgatattattgatgaaagaatcgtgaaggaagcggaaaaagaacacattgttgttgttgccaatcttgcaagaagatgcttagagttgaaagggaaaagacgaccaactatgaaagaagtcacatcagaattggaaagtatccaaaaatcaagaaaacagtctgcttcacaagaacaacatgatgctggaattgatgagtgccaattttggtctgtgatttctccaacttcaaatttgggggaaacttcggatagcaaagcatcaaccttggagattatgcctactcatcctaatcattga

SEQ ID NO: 60685 - DNA, 753 bp, Glycine max
  Peptide Sequence Number=SeqID_177463
atggagtatgtgaatgatgtatacttggaaaacaccaccgccaaccatttccaaaggaaggagcaaggagagccaaggaagtgctggaattggtgcacacagaagtgtggtcccatgagtaccttgtctcatgctcaaaacatgtactttattttattcattgatgacttgactcgcatgacatgggtttatttcataagacaaaattctgaagtatttgttatgcttaagaaatttaaagcttttgttgagaaacaaagtggcaaacttataaaagtcttgagaagtgacaagggaaaagaagtgagttttgagaggcagttgactgttggctatacacctcaacaaaatggtgtatctgaaaggaacaatcaaaccgtgatggagaaaggaataccaaaagaattatggcctgaggctattaatacaaccgtgtacttgttgaataggtgcccaacaaaagcaaaaattttgaagaagcaattaaggaagatgcttggtggaaggcaatgcaagaggaaattggtctacaaggtgaagcataatctagatggttcaatccaaaagaacaaagcaagacttattgcaaagggctattcacaacagctcggtgttgattatgaagaaacatttgcacctgtggaatgtctagacaccattaggacgacaaaaggtgcagaagacgatgttagtgtctgcgcgtcaacagactcgtttcccctggttgacgaaaggtgtaggagacgatgttag

SEQ ID NO: 60686 - DNA, 918 bp, Glycine max
  Peptide Sequence Number=SeqID_177464
atggttctgaaatttgcttatatcaaagtaattttgatgatatggtgcatgtatccattaacatctgcacagtatctcgatgagactataacatcctcgcagtacgagaatatgactatagcacgaccaggttgtgataggaaatgtggaaatgttttcattcctttccctttcggaatgggcagggaaaattgctatgcaagctcgtggtttgaaatagattgcagaaacaataatactactactaattcatcaggtgaacagaaaccttacctcaaatacatagatttggaggtaaaattcattgatctctggaatgaggctttgatcatcatgaaccctatttatcagagtgggaagaactgtgaaaggaacaagacaggaggaataaatctgaaaggaggaagtccttttgtgtattccgcgcgttacaacacattcctggccgtaggttgcggaaacactgcttctttctggtcaaacggagaggaagttagtggttgtgcttccatgtgcaatggcgatgacctcatcaaagttgataattgtcgtggcagaaaatgctgcgaggcgtcacttccgcggtatctttcagaatataacgtgagttttgaaggccaagagtgtgcttacgggctgattatagcagttaggttgggttactggaatctgacgattaaggacgtaaagcatttaaatgaagttcctgcagtgcttaaatgggagattccatttgacactttttactctaacatttccttctttcgtgaccctgatattgtatcctgctacgacacttatcttaaacattcactaaacaactcttctcagtcttctggtagacggtgtcattgcagatatggtgcccccccggccaatccctacatccggggaagctgcttaggtgtggccccttaa

SEQ ID NO: 60687 - DNA, 453 bp, Glycine max
  Peptide Sequence Number=SeqID_177465
atgaatcgcttgaacctcatgctctctttcgacaacgattctaagcaacctcaccaatgtgtcgtggatgatgacgatgctatgccgcctcctattctgcctcctttgtccagtggcgatgaggttttcgatgatgtcatcaatcaggagttttgcgtgagaagtgtctctaacctccttcgtagcagctttcgtgagagtcttgatcagttgatacagtcatatgttgaaaggcaaggtcatgctagcattaactgggaattgcaagaaacaactctttcttctgcctcagtagagcaggaccttgagcagcatagtagggatcaaattgtaggtcaggaggaggttactgttagtccacttaacctgccctctttacctataccacctcctctgcctatttgggaccaccaccaccatcgtgacaactggtcacagagtaactcctcgtga

SEQ ID NO: 60688 - DNA, 759 bp, Glycine max
  Peptide Sequence Number=SeqID_177466
atggttctgaaatttgcttatatcatagtaattttgatgatatggtgcatgtatccattaacatctgcacagtatctcgatgagactataacatcctcgcagtacgagaatatgactatagcacgaccaggttgtgataggaaatgtggaaatgttttcattcctttccctttcggaatgggcagggaaaattgctatgcaagctcgtggtttgaaatagattgcagaaacaataatactactactaattcatcaggtgaacagaaaccttacctcaaatacatagatttggaggtaaaattcattgatctctggaatgaggctttgatcatcatgaaccctatttatcagagtgggaagaactgtgaaagggacaagacaggaggaataaatctgaaaggaggaagtccttttgtgtattccgcgcgttacaacacattcctggccgtaggttgcggaaacactgcttccttctggtcaaacggagaggaagttagagcttgtgcttccatgtgcaatggcgatgacctcatcaaagttgctaattgtcgtggcagaaaatgctgccagacgtcacttccgcggcatctttcagaatataacgtgagttttgatgggcaagagtgtgcttacgggctgattatagcagttaggttgggtatgacgacgacgacgacttcaagggcagtccctacatccggggaagctgcaaaggcccgccgccgccagacatcaaaagtcatgggaagtgggccataa

SEQ ID NO: 60689 - DNA, 2229 bp, Glycine max
  Peptide Sequence Number=SeqID_177467
atggttctgaaatttgtttatatcataataattttgatgatatggtgcatgtatccattaacatctgcacagtatgagaatgggactataacatctgcgcagtacgagaataagactatagcatcaccaccaggttgtgatagcaaatgtggaaatgtttccattcctttccctttcggaatgcacgatcccaaatgctatgcaagcaaccagtttgaaatagaatgcagacacaataacaatacttctcaaggtcatcagaaacccgtaccccacctaaagtatataaatttggaggtaatgtatattgatattcaatacggtacggttgggatcaagaatccgattttccatcctggctgtggcaagactgttacaggcataaatcttgaaggcagtcctttcgtgtattcccagaattacaactcatttgttggcgtaggttgccaaaacgccgccataatgttgtcaaacgacacgatacttacagcctgtatgtcggtgtgttacgagcacctcgaaaaaggcaatgacatcgacatttcgagttgtcgtggctcctactgctgcgagacttcactgccgccgtatctttcagcatacaacatctcaactgaaaccgtggaagtgaaaagtaatatcaaagcagaatgttcaaattacttgctgattagagcagaatatagtaacttcaagtacgagtacgatgagtacaattccagttactgggttcccactcttggagacctaaagaaacaaaaagatgttcctgcggtgcttgaatgggagattccgattcacacgcccaacaattccttccctgaattccgtacagatgcatatggccatggcagctacaactgcagttacactaatgttacatcttcactatatccacaatcgggttggagatgttcttgcagcgatggcttcgagggaaacccctacatacaagaaggctgtaaattaagtctcgatggacgcaagataataatagatccgacgaaaagttatggaaaggtggccatgataggagttttttcaagcatcgggaccatcattctactctttggtttgtggcggttgcgtaaagttgtaaggaaaaagatagcaaagaaacgcaaagaaaagttcttcaaacaaaatggaggattgttgttagaacaaagactatctactggtgaagttaatgttgacaaaactaaactctttagcttaaaggaattagggaaggccactgatcactttaatataaacagaatacttggaaaaggaggtcaaggtacagtttacaaaggtatgttagtagatggaaaaattgttgcagtgaaaaaatttaaggtcaacggaaatgttgaagaattcatcaacgaatttgtcattctttcacaaattaaccacagaaatgtggttaagttgttgggatgttgtttggagactgaaatccctttgcttgtttatgaattcattcccaatggtaacctttatgaatatttacatggacaaaatgatgagttaccaatgacatgggatatgcgtttgagaattgccactgaagtggctggagctctattttacttgcactcagctgcttctcaacccatttatcatagagatgtgaagtcaacaaatatattattggatgagaagtataaggcaaaagtagcagactttggggcatcaagaatggtttccattgaagccactcacctcactactgcagttcaaggaacttttggatacttagatcctgaatattttcatacaagtcaattgacagagaagagtgatgtctacagctttggagtggttcttgttgaacttttaacaggacaaaaaccaatatcctcagtgaacgaacaaggacttcaaagtttagcttcatattttcttctttgtatggaggaaaatcgtttttttgatattgttgatgcaagagtcatgcaggaagtggagaaagaacacataattgtagttgccaatcttgcaagaagatgcttacagttgaatgggagaaagcgaccaactatgaaagaagtcacattagaattggaaagtatccaaaaactggaaaaccagtgtaatgcacaagagcaacaagaagaacttgagcttgctggaaatgaagatagccaattttgggctgcgtattctacaacttcgactgcagggcaaacttcagacagcaaaacatcaaccttggagattatgcctattcttatcaaataa

SEQ ID NO: 60690 - DNA, 818 bp, Glycine max
  Peptide Sequence Number=SeqID_177468
agctttacgtttgggattcagtggcttcatcagctaggaaagtgcttggcctacgctatcgtcttctcccttatttctacacactaatgtatgaagcacatacaaaagggactcccattgcaagaccccttttcttttctttccccgaggatgtcaccacatatgaaataaactcacagtttctattaggtagaggagttctggtgtcacctgtgctacaatccggggcaaccactgttgatgcatactttcctaaaggaacttggtttgatctcttcaatgtctcaaattcagtgaatgcagaatcaggcaagtatgtcactcttgatgctccatatgatcacataaatgtgcatgttggggaaggtaatattttggccttgcaaggagaagcaatgacaactgatgctgcgcggaaaactgcatttcaacttgtggtggttatcagtagcagcagaagtagttatggacaattgtacttggatgatggggaggcacttgatatggcaggggcgaaagatcagtggacactggtaagcttttatggcgcgttacacaacaatagcgtttctgtaacatctaaggtcactaatggaaggtttgctctggaccaaaggtggatcttagacaaggtgactttcttgaggatacctaagctagcagggaatgagttgagtattgtgaatggaacaagttcaatgaagaaggcaattgtgaagtctcaatttgatagctcctctcagtttgtcaatgtacaagtttcaaaattgtcgcttcttattggagaggaattccagctggagatagaaatcaagtag

SEQ ID NO: 60691 - DNA, 1947 bp, Glycine max
  Peptide Sequence Number=SeqID_177469
atggatacaaccaccacaatcgctcctctactcttctgtacctgtgcttgtctcatcttcttctccgcttcattgtcagaagcaacagtagttggttatggctacaccatctcttctgctaacaattatcccataaagaattctttgactgcaaaccttaacctcatcaaatcctcctctgtttccggacccgacattccacacctctccctcactgccagttttgagaacaaggataggttgagagtaagaatcactgactccaatcaccaaagatgggaaattccacaagaagtgattccaagagactcatcttcccaacattaccctcttggcttcctcaataccaaacaaggttcccatcagccaaaagactctctgagcctcacacattcagactcagaccttgttttcagtctccacaacaccactccatttggcttcacagtctctcgcaaatcttccaatgatgtcctcttccacgccgcaccagacccttccaacccggaaacttttcttgtcttcaaagaccagtacctgcagctctcttcctcccttccatcgcaaagagcctctctttacggcttcggggaacacaccaagagctccttcaagctgcgaccgaaccagacccttacactttggaatgcagacattgcaagtgccaacctagacttgaacctttatggctctcaccctttttatttggacgtcagatcacactcctctgatggaaaagtgaaggctggcaccacacacggggtgttgctgctcaacagcaatggaatggacattgtgtatggtggtgatcgaattacttataaagtcattggtggggtttttgatctctactttttcgctggatcctctcctgaattggtgttggagcagtacactcaactcattggaaggcctgctcccatgccttattggtcctttgtttttgggatagctggtaaatggcacaagtgcacgacaccaaagcagttagctatgccattgatagagttgtgttctgttgctacacaaatacatacacgcactgcagattcttcaaggcagaggatcagttttcatcagtgtcgatggggctacaagaatgttagtgatctcgaggatgtggttgccaactatgcaaaagcaggtataccccttgaagttatgtggacagatattgattacatggatgcatttaaagatttcacattagaccccattaactttccgctggataagatgagaagttttgttgatactcttcacaagaatggtcagaaatacgtgcttatattggatccaggtatcagtgtaaatgagacatatgcaacctatgatagaggtttgaaggctgatgtctatataaagaggaatggaaacaattatcttggtcaagtttggcccggaccagtttattatcctgattttctaaaccctcgcagccaagcattttggggtggggaaatcaaattatttagggaccttctccctattgatggtatttggcttgacatgaatgagttatctaatttcattacttctcctcccattccatcttcaaatcttgataatcctccttataaagttaacaatgttggagatcaacgacccattaatgacaaaactgttccagcaacatctttacactttggtaatatcactgagtataatgtccacaatttgtatggactactagaatccaaagtaactaacaaagcattaaaggatataactggtaaaaggccattcatcctaagtagatcaacctttgtgagttctggtaagtatgctgcccactggactggagacaatgctgctacatggaatgatttggcatactcaatccctgcgatattaaattctggaatctttggaattccaatggttggagcagatatatgtggtttcgaaggaaatacaactgaagaactttgcgggcgttggatccag

SEQ ID NO: 60692 - DNA, 444 bp, Glycine max
  Peptide Sequence Number=SeqID_177470
atggcttgtccatggagggatgatgctgatgagtttgggggaaggaaccacgatgagggggaaaaaagagagaaacgtagtgggaagatgaaggaggagccagaaaaaagctatgagcatggatacaacactggctataagaagggctatgaggagggttataaacaagggtgtgaaaacagtactagggaaagtgaatatggttacaataatgatagtggtaattacagcgtgaagagtgaatatggttacaataataatagtggtaattacaccgtgaagagtgaatatgtttacaataataatagtggtaacaccgtgaatagtgaggatgctgagtatggtcacagcagtcacaacgaatatggctgcacctacaattctctatctcgctatgaaaatgcgttacgcgattctggtgatcggaagaatgactgtgattaa

SEQ ID NO: 60693 - DNA, 360 bp, Glycine max
  Peptide Sequence Number=SeqID_177471
atgagtacaaagagaagagaagatatgattgatgtgctagttatacgtgtttctctatgtccacacccgatcaatgttccacgagctcagacgttgtttcttgaagaagagcatcatcggcgtgagggactcatcccgagtttgaaaatgagatttcgaaaactttcgggtagaaaaaatgataaagaatctccgcacttgtttagctaccgacaacgatttctggtgactgcgtcgaaattgaagaagaaaaagaaggtgactgtggtttctgaacctattggtttctataagagccgcctcacattggaactcgcaaagcgcctcaacgatgaaatcgtccgtgctgactccgtccag

SEQ ID NO: 60694 - DNA, 351 bp, Glycine max
  Peptide Sequence Number=SeqID_177472
atgaaggttgaaggcataaggagcgtgaggatgaaactccatgatggtgctattcgaactttctcaaatgtgaggtgtgtgccttctgttgttgtcaatatgatttctatgagggagatgacatcacaagagtacaaatatgttggttcaaagaggggatgcaaggtgtacaagggaagatacttggtgttgcaaagacagaaaaataaaggtaacatttgctatttggatgatcaagtcttgaaaaggaaccatgatagcaaaatgaagaagaaagtgaagttttctaatgttgtggaagtattgggagatacttccgttggagggggagtttgttcattttcaaattga

SEQ ID NO: 60695 - DNA, 249 bp, Glycine max
  Peptide Sequence Number=SeqID_177473
atggtgagtcacaatcaggggcttatgcttgtttcattgctggttcaggattgttccttgcatggtgctagttttgcctttcttggtcaagaacttcgcaagatatccaaagaggcacatgtgcttcctgcaattctctttgtgaaagcaacaatgaagagtcgtgatgtagggaaagcttacaatgaatgcaggcagggagaaccagctgctgaacgcttgcttgccatgagcaggttcaaaaataag

SEQ ID NO: 60696 - DNA, 348 bp, Glycine max
  Peptide Sequence Number=SeqID_177474
atgtcaagcaaagccactagtcagattaacgtaatcgagagcagaagaggaagtaggaatatagagaactgtaaaacagttgataccgacgttaagaagagtgtacagggtaacggcgaggtcggaggcttcggcggtgattcggtacgccacgtcaccggcggacacgccttccaagtacgcgagctcccggtggaggacgcggtcgaagacgtggagccggaggtcgtagacggcgccgagcgcggcctcccaaaggttggttttggcgcggttttggcgggggtggttgtggcggttgggggagtgatggttgtgacggttgggggattggaaatggaggaatga

SEQ ID NO: 60697 - DNA, 534 bp, Glycine max
  Peptide Sequence Number=SeqID_177475
atggcaattacactggtcaaagctggtcttgcaaagttgcaaacctcctttggcaatgacagaattcctgattttcatcttttggagcaagccgaacaatctgccaagaagcaaaagctaaaaatttgggagaattatgttgaaggggaggaagtatctaatggtgtacctgctgagaacaaacagcaagaagtgctcaaggttcttataatagaagtctcgggtagaggcaaattctatgtccagcttattgaggatcaaaggatagcatccattcaacaacaactttcttttttgaaccttcaagaagctcgagctttcaatcctaagaagggtgacatggtcctttgtctttttggtgctgataaatcttggtatcgggcaatggtagtcaatggacctcaaggacctgttgaatcttcaaatgacatgtttgaattattctacattgattatggaaatcaagaagtagtaccttactctcatctacaacctattgatccatctgtatctgttattcctggtattgcataa

SEQ ID NO: 60698 - DNA, 315 bp, Glycine max
  Peptide Sequence Number=SeqID_177476
atgtcgttctctgtcctcatatttgttgtcttgcggctctctcacggcaacgaggtcttcgccgatgaaatcttcttgttcatgacattgcaaaaggcaatgaccggcaaggatgttgacgtgcacgagctggggcggctgacggtggcatggttcttggaggatcttggatctatgagtcttggagcaatcgggaaccaagcgtccgaggaacctcacttttctctattgcttgtgtttggtggccttgagcttgagccggttggtgaggatggctcgactccagcgcatcacccccttggtcgtcacggctag

SEQ ID NO: 60699 - DNA, 867 bp, Glycine max
  Peptide Sequence Number=SeqID_177477
atgactgctgaggttatggctcaagaggagacacaagcagctgaggttgttgttgttgctgttgctgagccccagaaagagaaggatgctgaagaaaatgtggaaccaagagagccatcatcagtggatgaaaccaaacccaaaacggtggagaaaagctcttcttacaaggaagaaagcaactacctttctgatctcaaggagtttgaaagaaaggccttgagtgaactcaagtcaaagcttgaagaagctatcttggggaacaccctttttgatccaaagaaggaagctttaccagagaatgaagagaagaagaatgaaggtgaagagaaagaggaagaggaggagaaaaaggttgaagtagaggagaatgatgtgtctatttggggagtgacccttttgccaagcaaaggtgcagaaggtgttgatgtggttctgttgaagtttttgagggctagggagtttaaagtcaatgatgcatttgagatgctgaagaagacccttaagtggaggaaggaatcaaagattgattctgtggtggatgaggattttggctctgacttggcctctgcagcttacatgaatggtgttgatcatgaggggcaccctgtgtgctacaacatctttggtgcatttgaaagtgaggagtcttatcagaagacttttgggactgaggagaagcgcagtgagttcttgagatggaggtgccagttgatggagaagggtattcagaggcttaatttgaagccaggtggtgtgtcttcattgcttcaaatcaatgaccttaagaactcccctggtccttcaaagcttagggttgccacaaaacaaactcttgcaatgtttcaggacaattatccagaaatg

SEQ ID NO: 60700 - DNA, 674 bp, Glycine max
  Peptide Sequence Number=SeqID_177478
atggcccatccagctgttaatggtggtggtgataacggcgttccgatgattttaactgatccagatgtatttgtttgttgtgggtgtcgtgatacattaaccattccaatctacgagtgcaccaaagggcacgtaattctttgttctccctgctgtaacaagcatgggtacaagtgtcccttttgctcaatgttcatcggggacaagcgttgccgagctattgaggcagtgatggaatcaatgaaaaccgtgtgctgttatgcaaaacatggttgtaatgcaattgtgaggtacagtgagaaacgtgatcatgagaagacatgcacctttgtaccatgtttatgtccccagccacgttgtgattggatttccaattccaacgaattagggcaacatttcaaagtgaagcatttctacaagagaataccattcaaatatggagagtttttttatgtgtctttgaggcgcgacacgacgactcgtgttcttcaagcggtaagtgatggaaaattgtttgtgatcagcaatgataagagggagaagaaaaattcattgattcttttccatgttgggcctaactcgtggatccctaagtttgattatgaagttagggcaacgtctgatggtgcagttctattgcctcaaacttttgtggagacaactcaaggactgaa

SEQ ID NO: 60701 - DNA, 1569 bp, Glycine max
  Peptide Sequence Number=SeqID_177479
atggagttgcagttaaatattttgaaaaagaagttggaggctattggagtggaaactgaaatgtgtgagccagggcagtacaatcacttgctttgtcctgagtgcctaggtggcgaccaggaagaaaggagcttatctctttacattgcaccagatggtggatctgctgcatggaattgctttcgcggaaagtgtgggtggaaaggcagtacacaggcctttgctggtagcaattctgcaagaactcaactagccccggttaaaaagataagaaaaatcacagaggaggaattggaactagaaccactttgtgatgagctggtcacgtacttttctgagcgcttgatttcaaaacagactctggagagaaatggtgtgaagcagagaaaatatgatgatcagttcctctacattaaaattccttatgattgtctggtttctttgattgaaaaagagatccaaaagcaaacatttgagattgtgattgcattcccgtatcatcaaaatggagggcttattagttgcaagtatcgagacatcaacaaaatgttttggcaggaagcaaatactgaaaagatcttttatggattagatgacattgtgggacataatgacatcatcattgtcgaaggtgaaatggacaagctggcaatggaagaagctggcttcttcaattgtgtcagtgttcctgatggtgcacctccatcagtctcctcaaaggaggagttgccacctcaggataaggcaactcgggttatacttgccactgatggggatccacctggtcaagccttggctgaggagcttgcacgccgcattggaaaagaaaaatgctggcgggtcaggtggcctagaaaatcaaggtcagacaattgcaaagatgcaaatgaggttctcatgtatttgggccctgatgcactcaaggaagtgattgagaatgctgaattatatccaatacgtggattgtttaacttcagagattactttgatgagattgatgcatattaccatcgaaccttaggatatgacattggtatctcaactgggtggaataatctgaatgacttatacaatgttgtaccaggagaactgaccatagtaactggagttcctaattccgggaagagtgagtggattgatgctcttctttgcaatcttaatgaaattgccggctggaaatttgcactttgttctatggagaacaaggttagagaacatgctcgaaaacttttggagaaacacttgaagaagcctttctttaatgaacgttacggtgaaagtgttgaacggatgagtgtggaggaatttgaacagggcaagctctggttaagtgatactttctctctcataagttcgtgtcaagtagactgtaatcactgtacaatacctacatttggttacaccgtgcttggctacttggttgttgatactaggtgtgaagataactcccttccaaatataagttgggttcttgatcttgcaaaagctgctgtattaaggcatggggtgcgtggacttgtaattgatccttacaatgagctggatcatcaacgacccccaaaccagtaa

SEQ ID NO: 60702 - DNA, 165 bp, Glycine max
  Peptide Sequence Number=SeqID_177480
atgggtttggaacagaacacggtgaagaagggtctgtggcagggaaaacggtgccgttgggaaaagagagtgtttttgaggtttgggaatggagaagagtggaagaagggcttcatggtgtttgtgagtggaagtggcagagagggttttgccgttttggtctaa

SEQ ID NO: 60703 - DNA, 1860 bp, Glycine max
  Peptide Sequence Number=SeqID_177481
atggctgtgtcttcctctcactcattcccttttctccaagttacttcccagaacaaaacatgcagcaacagtgttatccccaagactatgccccgtggggcggagcaggttgtggacagttcgtttgatgcacctaaagtgaaattattgaagcagaaaatggaacttcttggtatcaacttggaaaagtcttgtttgcctgggaagtttctgaatcttgtttgctttgatatgctagtgcaaaggtgggcagttaaaggagaggagtgttttcgagctcaatgtggttgggctggtcaggtttctgcagatgacaaggaattgtacagtggggtttgtactaatgccaatttatataggcaattagcagaggagagcttaggattggaaccacttggtcctgagggaaaaggcgcggacaagatactgtatggaatagatgacattagtcaagcctctgagatcatcattgttgaaggggaaattgataaactttcactcgaggaggctggctttcagaattgtgttagtgttccagtgggtgcaccagaaaaggtttcttcaaaagatttgccaccaattgaaaaggacactgcatttcgatacctgtggaactgcaaagagtacttggataaggcagttcgcattatcctggcaactgataatgatccaccaggtcaagctttagcggaagagctggcacggcgccttgggcgagaaagaaaagcagaaccctccaacaacgacgtcgtttcttcggaacacagaaactggagcaacatcttcaaatcgctggttcagatggtgtgcagccagcagaaccagcttcactccttcgcgagccgccacaagtttctcgaagaccgccttcgaatgcagcacgaagggtgggtctccgatgttcgatgtcacaaggatcaaatttctcagatgaatgggatgttgacgtttgaggagaagaaacagtcgctcgaggcggcaaaggcggattttgcgcttagtttgaagcacagagaggctgctatgttgaaatggattttagagcatgcagaggatgagttggcggattttaaagcctggtttgaaatcctttcttgtaaatcctctaatggagaagatcaaggaacagcatttaaggatactgacttgaagaagaaaggaagcacggatagagggaacatgtccactaggaatactgcagaaaaagagaagtattccagtgaaaacaaagatgaatttagtaggttaaaaggtgaatatgataagcttgctttagaaaaatattcggaggtgacgacactcttggcagaaaagaaatttatgtggaatcaatataatgtaatggagaatgattatgctgataaattaaggactaaagaagctgaagtagaaaaagcaaatgaaaagataaagatacttgtttctagcatggagcagctacagtctgaaaattatgaaaaggatagtaaaatatcagagttacaaagtaaaatggctgagatggaagctgagacaaaaagattgaacaatgaaatatctgaactctcagtggagttggaatctttaagaaagttcaggaacagccaagttacaccatctgttttaaatcgctgcacagaaggaactaaagcacctgagtcaggagttgttaagagcaacaagagtagaagaaatatgactctgaaaaaagaaatatgtactcctgatgctccagttcctgccaaatcctctgaaaaggggacaaaaacaaaaagcatgaagaggaaagaggctccagttattcccacttctgagactccgaaactgttctcttccggcttcaaggttccaaaactgaagtcctctgtaagggtcacatga

SEQ ID NO: 60704 - DNA, 1002 bp, Glycine max
  Peptide Sequence Number=SeqID_177482
atgtctattttcgcaatctccatatacctccttcttagtaatctaggtgcttcaatagccgaggttgcaaatgatgccattgttgcagagatggctaaacagactccttcctcaaccaagcacccccaaccatcctcctcaggcaatctccaatcatttgtttggatagcttcctctgcaggaggagtccttggaaaccttcttggcggaatttttattggccggttctccccacagtccatgtttttatattttggccttctccttgctctccaattttttataaccatctcggttcgtgagagttctctcaggctcccaaagagtccatctggtggaataaggaaacagctttcacagctattggttgctctaagaaagcctgaaattgcatattcaatatcatggtttacagcatcttatgccattattcctgcacttacaggcaccatgttcttttaccagacacagtatttgaaaatagactcgtcagtattgggtatctccaaggtgtttggccaggcaacaatgctcctatggggcatcatatataatcaatacttcaaatctgtctcatcaaggaaactgatatcggccattcaagttatgatggcattcttaatggtttcagatttcttgttcgtgcgaggtttttatcgacaaatgggcatgccggactcgctctatgttgtgattttctcaggattcttggaggttctatttttctttaagattctgccattcagtgtcctaatagcacagatgtgtcccccaggatgtgagggttctgtaatggcatttcttatgtcgtgtgttgcccttgcattcattgtgagtggataccttggtgttgcacttgcatcgtgtattaaggtaacaggaaatgacttttcaggacttccatttggacttctgatacaagctgcatgcactttggtgccaactttttggtcatcatgcataccagacaaggtagaatcaaaagccaaaaggaaagactaa

SEQ ID NO: 60705 - DNA, 351 bp, Glycine max
  Peptide Sequence Number=SeqID_177483
atggtggcatcagacggtggcggtggagggagattgatgaagaaagttctgggcttggggttttgggtacaaggattcaggtgttttccatggttggtagtgagtttctacctcaaagatggtctgaatgtggacccttccactcttcaaattcttcagagttccgctaatcttcccatggttggaaaaccactctatggccttctttcagactctgtctacatctctggccagcaccgagttccctacatcgcccttggagtttgttgttggttccgtgatgtggggattttggaatcgaggattggttcttccttcttatcccaaatggataagagaattgatgaatga

SEQ ID NO: 60706 - DNA, 201 bp, Glycine max
  Peptide Sequence Number=SeqID_177484
atggaggaaatgtccatcaagaaaaagagggagaaattcatgaaaattcaaggcaagcaaaatgttggacccagaggagtgatgactggtcaaaatcctggagatcctttttttgccttaggcttgatacaaggaaaaacagataatatattaccagtaaccagtaaccatcagtatctaacgactttaaagaatctataa

SEQ ID NO: 60707 - DNA, 863 bp, Glycine max
  Peptide Sequence Number=SeqID_177485
atggcacctttaagaggtcttgcgcctgaaggtgctgagatccgtggttggaaaattgtcatccgtagttggaagataaacaatgctgggagcaaggatactccaaagctttactgtgacaaagaagaattcccctatgaattacttcatccccttgaagattgcaatgtgaactcatccttgtcattcacacttcagatctgtagagtcgaggacatccttgttgaaggccttataaaaggttctattgttcatttccatagggcaaggaccataagtgttgaatcttctagaacaatatctgcctctagaataggctgtactggtggtttgggccatggaaatactctaagtaatggtattggcagtggtggtgggcatggtggtaccggtggtgaagcattttataatgataatcatgttgaaggtggctattcatatgggaatgcaaccctgccctgtgaacttggtagtggaagtggaaatggcaactctactagaaccacagctgggggtggtatcatagttgttggatcattagaacatcctttgtcaagtttgtccattcaaggttatgtaaaagctgatggaggaaattttgaaccgcaaattagaaacgaaaaatttgcaatatttgacaattttactggaggtcccgggggtggatttggtggcactatactaatgtttctccatatgctcaccattgggaaatcagttgttctttctagtatagggggatatagcagttctaatggaagtggtggtggaggtggtggaagaattcattttcattggtccgacattcccactggtgatgtttatctgccaattgctagtgtgaaaggagacattcagatctg

SEQ ID NO: 60708 - DNA, 333 bp, Glycine max
  Peptide Sequence Number=SeqID_177486
atggacaaagatcaatggatgtatgacagtataatatctgaagaagttgatatggatgatcaaaatgaacaagaatgtggtgtgaatgaacaacatgttgattatttggatgcgttcaatacttctcagactcgatccgttgctcatgaaaatggatttgtggcggtcattatgaggtctgacacaaacactggtagtagaggaaggacttcatttgtgttaattagttgtgaaagaagtggtcagtataagtgtaggaagaaagattttgttagaagagatactgagactaggaaatgtgggtgtcccttcaagcttcatgggaaaccagtg

SEQ ID NO: 60709 - DNA, 486 bp, Glycine max
  Peptide Sequence Number=SeqID_177487
gtgcttcctgcaattctctttgtgaaagcaaacaatgaagagtcgtgtaagaatactaggtttaagagactggccctggtggactatactgcaaggcagaagaaaaagaagatgaaagcattgattcctcagattatacaagctatatactttggagtcctttccatactcaagagccaatccagaatcacgcaggatgtagggaaagcttacaatgagtgctggcagggagaaccagctgctgaacgcttgcttgccatgagcaggttcaaaaataagcaacttcggtcattcttgattgctagcatgaatagtttacatctactgacacttttttcaggtacagttgctgcaaacattggctatagggatctgacaacaaaaattgacatggacagggtgaagcatgcatctgaaactgctcatgcagatgagtttgttaaaaaactaccagaaggatacaaaatcaatattggatatttataa

SEQ ID NO: 60710 - DNA, 1443 bp, Glycine max
  Peptide Sequence Number=SeqID_177488
atggcatttcacagagcctcaaaggcgaagccaaaatccgcgagatcccgaattctgctcctggcggcagcagtgacagcgattgcgcttctcttgctgttctcctcgcttctttccaccaccgtctcgaaagccaacctcttacaacagcccttcgaaaagtacctctattggggcacccgcatcgactgccccggaaaacactgccgatcttgcgagggcttgggccaccaggaatccagcctccgctgcgccctcgaagaagccctcttcctcggcagaacttttgtgatgccttcggggatgtgtattaatcccatacataacaagaaagggatccttcattccactaatgccagttccgaggaactgtgggatgcaagttcttgtgccatggactctttgtatgacacagaacttatgtcagatactgttcctgtgattttggacaattcaaaagagtggtatagggttctatcgactagcatgaagttaggggcaagaggagttgcacatgtgggaggagttagccggtttgaacttaaagaaaatagccgctactcagatttgttgctcataaacagaactgcaagccctctttcttggtttatggagtgcaaggatcgaaacaacggcagtgccataatgttgccatattcatttcttccctcaatggctgcagggaaactaagagatgcagcagaaaaggatttcttgagtctatccttgaaacacatatccttttgtgggctagcttgttgcaatatgtcagcaacagcggccgctatagcggcggggcggagcggagcggcacccattcgcgacgtacacgtgtgtagcggggcggtttcgggtcacggctggagcggccgctattgcggcggagcggcgcgggttgcggagcggtttttcgcgccgctacttcgaagcacggtggttctgagtgggttcggtgagcttgaaggcctagaactaaaagcagttgcagctgtcttctttgatcttgtttaccgcctagtttatgttaaaagctctctaatcctagttgcattggcaacagctccccaggtccaggagaatggaatccatcccatcatgaaactcaaaatgttcttcgagagtttagttatattaatgaaaatgaagtcttgcaaccttgatgcccaaaatgttctgacatatttggctttcttggcagtggctcaatcaagaatgcttggctttcttctttgtgcaggcttctctgagtatgtttatcactttggaaggagtctttctacaactatcaacttcttccctcattctcatttgatgtctctttgtttgggtaataccactggtgatgggtttgccacaaaagttgcaagtaatagcctctatattgttgatgaagagattgatatagaggtagaggcaatgctttgtggtgttccctgtggctga

SEQ ID NO: 60711 - DNA, 273 bp, Glycine max
  Peptide Sequence Number=SeqID_177489
atggcaagtccacctcagaattcagacctaatattcccagcagcagacgttgctggagaactgaatcctgggagaaacacacactttcatgttgatcctacgtcttctgaggtggatgcctccaaggaacaagccgaggccaaacagaagaaaaatgaaagacaaaagaaggatgcattgcaaacaataaaatcagcgattataatttcaggcatagttgttgctgtggcaggagctgcctttgccataaccaagaaattaagagagaaatag

SEQ ID NO: 60712 - DNA, 654 bp, Glycine max
  Peptide Sequence Number=SeqID_177490
gaaacaccagattacaaagtaataattgagattgcttgcaccagaacttcagaagagtttcttgctgcaaagcgttcataccagtttcaatgcaagcattgccttgaagaagatgtggcatccaaaacaattggtgattttcgtagattgttggttgtagttacaagcgcctataggtatgatggagacgagtttgatgagaatctggctcattcagaagcaaacattcttcatcaagtgatcgaaaacaaggcctttaacaacgatgaaatcataagaattttatgcacaagaagtaagaagcagctatgctcaactttcattgcctttagaaatatgtatggcacgacaattaccaagggattatcaacagatcatccaaatgatgaatacatggaagcactgcgtactgtcattcgctgcattaagaaccctcgaagatacttggctaaggtgttatactacgccctgaatgatttgatagctgaagagcatgcattgagccgtgtcatcatctctcgtgcagagaaggatttaaacgaaatcaatgacctttacttccagagaaatggtatcacacttgatagttccgtggctaagaagacctcaggaaattacatgaattttcttcttgcgttgttaggaaacaattga

SEQ ID NO: 60713 - DNA, 1557 bp, Glycine max
  Peptide Sequence Number=SeqID_177491
atgagaatgattgctccaagcattattgtattacttcttaacaagcatgagaataaattttccgaccccatattactgaaagaaaaaggcctaggtccaaactttgttaatttcgaaaaatcggcccgacccataaatcccggcgtagcgacggtgtcggtgaggttaagagggcctgatctgaagggcccatattcaatacccaattcgaaggtgaaggtgatgatggaattggaagtccacgagaacgacttgaaagccgccggtgctgagctcttcgccgccggtggtcggcgcggcattcgcatcaatggctgggtgatcgagactcggaggcactccatactcaactcttccacactccaagagtgggaatcatgtttgttaaaactttatttgactattgatttagagagatacagttatgtgaatgtgtatatgaagtggaaaaaggattcatactatgactcaattgagcacatccactactccgttcagctcaagcctatcattgccctcaaaaactgcattgtccgggatcccaatggctgcattcctatctctgcagtgtcaaagaggggattagagttagatgttcccatgaaggttgcaaggtttatgaggcagtatccatccatctttgaggagtttacgggtcctgaatacaatcttccttggttcaggttgacaccggaagttgccgagattgacagggatgagaagagagtatatgaagaatgtagggaggacttaaggtccaggttgaggaagatgatattgatgaccagagagcatgttctacctttaaagataattcaagggatgcagtggtatttggggttgcctagtgatttgctgcagcacccggaacaaattcttgatgaatctttcaggtttgtagagatggaagatggattgaaggggttggctcttgaaagtggagaaaagatttattctgtaatggagagaaatgcaatgaaaagtggtttttactctgggggtccaatggaagccattgaatttccattttttccatcaaagggtttaaggttgaggaggaagattgagaactggctaaatgaatttcagaagcttccatatatttcaccttacgatgatttttcaaacttggatccaaactctgacatagcagataaaagacttgtgggagttcttcacgaactgctttccctttttgtcgagcattcagccgagaggaagaagttgttttgcctcaagaagtattttgggttgccacagaaagttcatagagcgttcgagcggcatccccatatgttttatctatctttcaggaacaaaacttgtacagtcattctaaaggaagcttacagcaataaatctgctattgagaagcatcctctgttgagggtcaggaagaaatacatcaagttgatgaagaaatcagaagtgattttaaggaacaggagggtgaataatcgattttctaatagtaatgcaaaattggatatcgattcaaatgatatagatgaaaagggacatgagatggcaagttgctctttggaacaggttgcgtga

SEQ ID NO: 60714 - DNA, 369 bp, Glycine max
  Peptide Sequence Number=SeqID_177492
atgactacgctaattgctgcgaaagattcttcttcgattgaagatgctgaaaatatcaggaaagcttgcaaaggatttgggacagatgaggcagttcttatatctatactagcacatcgaaatgtagctcaaaagaagcttgtgaggatggcttatgaagaactttatcaggaagatcttatccaacaattcaaatctgaactctcaggaagctttgaggtcaaaacattacaattcatagcaatagtttttgcatatttgcaaaatgaaattacttcctcactttctttctatgctcacacttggatgggcatgaatatattcgtcgaaataaatttcgcattagctaactggctagctaatggatga

SEQ ID NO: 60715 - DNA, 222 bp, Glycine max
  Peptide Sequence Number=SeqID_177493
atgactgataaatcagtgtgggcagacccgggattagcggagaggcggaggttggagggtagcgtcgagagaaagtggggtgtagatttgggacgacagagtgtggtgcgtccatttgtgagaagtgacttggacaaacagccatgctggatgtgtgaagagttcagacaaatgagtaagaacaaagattataggaattgttcaatctattatgatttttag

SEQ ID NO: 60716 - DNA, 585 bp, Glycine max
  Peptide Sequence Number=SeqID_177494
atggcattacattcgccgcggcttttatcactcacccgaagggccttttcttcttctccttcttcctttcaaggaggggtttctatggttcaaggagcttccagaggaattggcctcgaatttgtgagattcttttcttacttgcacatcaacattgcttatctgggcactgctcacattgtcaaaattttcatttttaacactgctttcagtttcttccatctacaggttaaacagattttagaatacgatgataaagagcatgttattgctacctgccgtaatcccagtgcatcaactgggcttatccatctgaaagataaatttgcagaccgccttaaaattttgtcgttggacttgactgttgaaacttcaattgaggcatctgcattgtcaataaaagagacatatggccgtctaaaccttcttattaatgcatctggcattctttcaatacctgaagtaatgcatccagaaacaacattgaacaaagtggagaaatcatctttaatgcttgcgtatgaggttaatgcagtgggtcctatcttagttatcaagaggctccacaagaatattattgcttag

SEQ ID NO: 60717 - DNA, 684 bp, Glycine max
  Peptide Sequence Number=SeqID_177495
atgtcaaaggttgaaggttttaagtacgaggaacttagaatgcagagaattacagagaatcaagcaaaaatagaagctttagggttgtccaaattggccatcattttcaaggatagaattcaaaaagctaagaaaaaggataaaaagccaataatgatgatgaagactatgtacctaaatatgaagggggacttggatcaaattcttagtgaaaattacaagaatgacaaacgtgatgagtttgctgctacaaatgatcttaagtcacggaaaagaaaggtgataaaatcatcgatattgaattctaaaagagtctataatgattcgtccatacaccactctcttgataaagaagtgaaggagtctttacctaataatgcatctcatgcctcagaattgaccaatgtagaacaagttgaatcaaatgcaggccagcatgtcataaagaagggacgtgggcatacaataaatgcaaaatttcaaaagaaaaaggaaaatcttatggcaaaggaaaaaagtatcgacatccaatttcctccaccattttataagatttacgaaaaacatgcaaaatatttcaagtctgagacacaagtgcgtattcaccagaaagctcctttacaagttaatggttggagtgaaattagtaaggatgatgtagatgaaatgtggcgacatatgaag

SEQ ID NO: 60718 - DNA, 135 bp, Glycine max
  Peptide Sequence Number=SeqID_177496
atggttcgatgggttatagttttgagtcttggagttggagcagtgaaggtgatgtgtcgaggactcgaggttgttgatagaggcgaatttgggtgcgacaacggaaaaggtgttgaagctggtggaaactgttag

SEQ ID NO: 60719 - DNA, 633 bp, Glycine max
  Peptide Sequence Number=SeqID_177497
atggcagaatccttgaagaagagaaagggatcctcctccaccaccaccgctgcaggccaacgccgccatggcacatcggttagagtcttttacaataatctgaaaattcaagacagagttattttttctgaagtgcatcaaattcctattattgttgatcaatccttattttattcactgactaaactgagcagtcaaggtgttccttttgagggcactctagttgatgactggaaacaggtttattcgagtcatgatgctcgtaaaatgattgactgggcttatcttgttcgataccgaatgcataaggcattacgggccaatccacctcttccatatcctcatctaattactttatttctccagcatttcaatgtacctttagaagatgaaccttttgttaagtgggtacgtaagcaacacctgccacctcccattcctgatgaacgtacactgtctccaccaccgcaacgggatacctcttcctccctattgactgaagtcctcactaagctacgagatcttagagcttttgtcggtgatcgctttgatgccatggactcctgtatcacgcgtcttgaagacgatatgagttttatccagcgctgctttgatgcacttgataattcttag

SEQ ID NO: 60720 - DNA, 212 bp, Glycine max
  Peptide Sequence Number=SeqID_177498
cgcgcctcttctttgctcagcctggaggtgcaagcggtgcacttagcgagtttgactctcactcaacgcacttgtacaagtcatcttcttccaggttcttctatgcgctcatccaatcatgctgcacccagtggatcatgcgctcagccagaggaggatggctcagcgaactgcaaaaatcaaacttcaccaaacttgcttattttacctga

SEQ ID NO: 60721 - DNA, 534 bp, Glycine max
  Peptide Sequence Number=SeqID_177499
atggtggcgggtgttgcagtggacgtcgacatcgatgatggacagagcaagaggttgaggggcgacgacgcgaacgacggagagaacggcgagtgcaagaaggagcccgatagagacaaagcgatagaccatgactgtgaacgttcctatggccgtcacaggaaggtggaggtggcatgctcaagcatgcgtgacttcacttcggagcttccatgggaagctgacatggggagtggtgctgacttgggtgcgggactaggtggcatgatcatgcgtgacttcattacggagcttccatgggaagctgccatggggagtgatgctgacttgggtgctagactaggtggcatgggtgcagggcatggaattggagttgtcataggaaggggagtcggcattggggcatctgttggtggtggctgcaccgaagaagaaaatggggagcgttggctagataccatggtatccagtttcaagataatggcatcgagtttgaagatcatggaggcttgggtcgctgcgaaacgaagttga

SEQ ID NO: 60722 - DNA, 939 bp, Glycine max
  Peptide Sequence Number=SeqID_177500
atggattccaatgctacatttggaaatgcttgcctgctgccaatgaaagccacatcaaatggtgtgtttcagggtgacaacccacttgatttcgcgcttcccctggctattttgcagatatgcacaaatgttggcaaaacaactctgtcagctataacaattaacgatatagctgcctgggttctacttgctctggctattgccttatcaggtcatgatcgatctccactcatgtcattgtgggtcttcttcgttgggggtgattttgacatttgcgcaatccttattgtgcctccaattttcaaatggatgagccatcgatgccatgagggtgaactagttgaagaggtatacatatatgctaccttagttgttgttttggctgttgggtttgtctctttgctctacgatttgcagaggaggtttttaagggtggaacattcgattgaggggacatggaacccaatatggaagatgacaacaatgcatcagacttcaagcatgagtggtgggattgtgaaatttgtagaaagaaagagaaagggtcattggaaatatcttttcaccgtggcatgcgagggttcaagagaaggggaagggaagaaagagaataggggaagaaaggaggaaataaaacatgaagcttcgttctcatcaatcacctccagcaacaatgaatggtctggtacgtttgtagcttgtcctgtgcatcacctgatgatgagaatgacgagggtcatcaaagaagaaagggggtctgtttgtgggtgtaacccgccattgccactggcggcaaaggtggagagagtaggtggtatcgttactggtagtggcgatataggtggagagagaacagtgtcgccaatgggaatggcgacacccaagctgggactcgccgaccgtgatggcgagatagggcaagggcaatctcgccgttag

SEQ ID NO: 60723 - DNA, 348 bp, Glycine max
  Peptide Sequence Number=SeqID_177501
atgtcgcagaggagcaatgcatcatcatctcgaacaagagtttcatcacaagttgttcttttttgtggttgtggtagaagggctgttaggtgtgttgctggaacaaatattagcagaggaagggcgtttttcacttgttcaattaataaggatgaagttggatattgtgggtactttatttgggttgatcaattgattgaagcacttggagttgatgattcacttgggacattttccatggaacaaagaagacaatttggaagagaggaagataagacaatgtggaaggctcaatatgttcattttgttgcaaaattgcataagattcagttctgcataagggcataa

SEQ ID NO: 60724 - DNA, 822 bp, Glycine max
  Peptide Sequence Number=SeqID_177502
atgtatactcttttaagaattttggtgacatacttcgaggggagtatcgccgagatatgttacatcattggtgctttccatgctctcagcttgagcggcttaaatggagatcctaagaagattgtaatcaagttaaaagatcttaattatgttaatttagatgattcccaggaattatcaagtcagactctaaatctcactcaattgtctgctatttcccaattttctgaattggagaggtttctctggaatgtcaaagtgattagtattagtgaaatgaatgaacttaaagagatggaatttgtgccactattgccactactcgcaactttgttgaagggaagaatggctggtgctactttgcatgcaaaaaatgcaataaaaaaactcaaattcagaatgagccttttacatgtgtgcattcatgggtacaagctagagataaaggtcgaagataagaacaatgcaaaattcattttctgggatgatcagtgtgttaagtttatggaaaaatcagttgccagccagatacaattaatgaaagatgagggtgaagatgatcttaaagtacatctagatccacttgacaaaatgttagaatgtacattggccatgagaattaggatgcaacccaagggtacatctgaagctgttaatactttagctgatgtgaatcaagcttcgcagtgtgacagtactcagtctttatctgcaaccgcagataaagactatcatctgaaagtctctgtgatggcttcttatcccaagatttgcttctgcataactctcgtcaacaaagatctcaaagcacatcaaaagtga

SEQ ID NO: 60725 - DNA, 336 bp, Glycine max
  Peptide Sequence Number=SeqID_177503
atggttgtgcagaactttgtagttgatttgaataaggcccttgttttccaggttgggcatcttggaggagcttatgaagagtgggttcaccagcccattgtcagcaacgaaggcccccgtttctttgaaaatgagattctggagttctggaacttggtgaagctcatggcgaccccttcaactgctcctgctttgtttggcggtggtttattgggttatgtaatgtatgattgcacccattattacttgcaccatggtcagccaaagactgaagtgccccgaaatctcaagtccttagaaattgaagggcattactctgagagtgagatacagtga

SEQ ID NO: 60726 - DNA, 354 bp, Glycine max
  Peptide Sequence Number=SeqID_177504
atggctgtagcggagtgcgacgacggcgttgagggtttggatattgaaggagatatggtttttggtatcggttccgaatccaagcttttcaaccaaatctgtgggttttccgacgagggtgttcgtggtgggtttcgtgacgagagctggtttgcgtttactattggggtggttcgaagggttcatgggtcacagtgggactatccattggagaaatttgttggatttcaaaagttcctagttcctactatcaatattttgtatctggatcaactacgtcacaagttggatgatgggtttatcttcggaatctttgttggatttgtcaaattctttaacaatatcaagtgctga

SEQ ID NO: 60727 - DNA, 1137 bp, Glycine max
  Peptide Sequence Number=SeqID_177505
atggaaaaaccaattccattggccactatgctccccattgttattgtgtatttgttttcactccatgcctcatgtgctgccccaactacagaatcagtacatgaaacttttgttgattgtctaagaaacaatattaaaacgagaagcggtggccatggctttgagggtcgctcatacatctctgatgaacccttcatcatgcttgacatgttcaacctccgcaacatcacagtggatgtgcaaaacgaggttgctgtggtccaagctggcgccacgctcggagaagtttattataggatttgggagaagagtgatgttcatggctttcctgcaggggagtgtcacactgttggtgttggtggtcatttcggtggaggagggtatggtaacatgatgagaaaatatgggttatccattgatcacatccttgatgcaaaaattgttgatgtcaaaagtaggattctgaacaaggagtcaatgggggaagaccttttttgggctattagaggaggtggaggagcaacggctgttatgactaagtttctgggaggaacagaagagcttgtgtcacttttggaaaaggagcttccaactttgggtctaaagaaggagaattgcattgaaatgagttggattgagtctgcagtttggtgggatagttttccaaatggtgcccacccagaagctctacttggcagaaaactcaactcagcaaagttcctcaaaaggaaatcggattatgtgaagactccaatttccaaagacgggttagaatggatatggaaaaagatgattgaattaagacaaacaagtatggctttcaacccaaatgatggaagaatgaataagatttcagcaaatgccacagcatttcctcaccgacaaggaaatctgttcaaaattgagtattctgtgaattgggaggaaccgggaatctctgcagagaagaactttacaatacagattagaaggttgcacagttacatgaccccatttgtgtcaaaaaatccaaggagggcttttctgaattatagagaccttgacattggtattaatcaccatgataacaatagctctaccaagaagggggggtttatggtattaagtacttcgataacaacttctacagattggtga

SEQ ID NO: 60728 - DNA, 1172 bp, Glycine max
  misc_feature (1168)..(1168): n is a, c, g, or t
  Peptide Sequence Number=SeqID_177506
atggttctgaaacgtgtttatatggtcattttgttgatatggtgcatatatccattagaatctgtaataccgccgcatcggtatcggaatcagaatcagacgatagcacgacacggttgcaatccaaaatgtggaaatgttactgtttttttccctttcggaatggacgatcccaaatgctatgcaagcaagccgtttgaaatagaatgcagacacaataacaatacttctcaaggtcatcggaaacccgtaccctacctcaagtatataagtttggaggtaatgtacattgatattcaagacggtacggttgggatcaagaatccgattttccatcttggttgtggcaagacaattacaggcataaatctggaaggcagtcctttcgtgtattcccagaattacaactcatttgtcggcgtaggttgccaaaacgccgccatattgtcgtcaaacgacacgatacttacagctcttacagcctgtgtgtcgatgtgttacgacgacctcgaaaaaggcaatgacatcgacatttcgagttgtcgtggctcctactgctgcgagacttcactgccgccgtatctttcagcatacaacatctcaactgaaaccgtggaagtgaaaagtaatatcaaagcagaatgctcaaattacttgctgattagagcagaatatagtaacttcaagtacgtgtacgatgagtacaattccagttactgggttcccattcttggagacctaaagaaacaaaaagatgttcctgcggtgcttgaatgggagattccgattcacacgcccaacaattccttccctgaattccgtacagatggcagctacaactgcagttacactaatgtcacatcttcactatattcacaatcgggttggagatgttcttgcagagatggcttcgagggcaatccctacgttcgtggaggctgcaccgccttgccagattacaataaaaatctaacgaagaagtgggctatagtaggtgtttcgtcaagcctgggatctatcattttgcttctttgtctatggttgttgtataaagtgcaaagaatgtcatctaatgaagttaatgtagacagagctattctgttcagcttaaaggatttagagaaagccactgaccgctttaacatgaacagattcttgggaagggagnccaa

SEQ ID NO: 60729 - DNA, 339 bp, Glycine max
  Peptide Sequence Number=SeqID_177507
atggctgaaattcctcaccgtaaggggaaactgttcaagattcagtacactgtgaactgggttgatccttcgccttgtgcggctaagaatttcacgaatcaggctaggaagctgtacagttacatggccccttttctttttcagaggctggtcaaggttaagactgcggttgatccaggaaaatttttcaggagtgaacagaatgttcctaggggagacgctgagcatgggaccgccaccgtggcgtttacagcgacgccgacagggactcactccatgtggcgtctgctaacgaggccatccgaagcggaccgccaccagcgcagctcagttacctaa

SEQ ID NO: 60730 - DNA, 327 bp, Glycine max
  Peptide Sequence Number=SeqID_177508
atggcgtacaatggtgcaggtcccataggtggttcgggttcgacattgacaataaagcaagtgtttacttggtatggtgcaaccattgaaatggatggtgctactgaaactgattatactgctgatgaggaaaaactgtgcagcatgctcaaagatgtgctcaagagtgagcccaaacttttcctaatggcatccgctacaggcatttacttgctgtcaaatccaaatggaactatgaagctttatgagtttgtagtgatatttggatacttcatgctgattttggctcagatgccacatattaatctggtgtctttggtcatgtga

SEQ ID NO: 60731 - DNA, 1275 bp, Glycine max
  Peptide Sequence Number=SeqID_177509
atgattctgcaacttataccattttctataatcgttttgataatattccctctggcatcggaaacatatcagattatagcaaaacctggttgtaattcaacatgtggagaagtttccatcccttacccttttgggatgaaagatcccgaatgctacgccgacgggtggtttgaaatagaatgcaaagacacttctcaaggtcaaaaaccctacctgaagtctttaaatctccaagtgacatccatcagtgatttcctaggcttggttacaatcatgaatccaatttaccgttggaactgcccaagcaaaagagcaatgccagcaataaaagacctgagaggaagccctttcgtgtattcccaggagtcgaacaaattcgttgccgttggttgcaacaaccttgcctttttgaagtccggtggggatactgtcggtggttgtgtgtccatttgcgataacaatgaagaattcaaaaacatggacttcattagcagtgatggttgccatggcaggtactgctgcgagacttcactgccaaactatctttcagaatataacgcaacactgcaagattttaacaaccagaacagtagtgttgagagtcatcagtgtagttctgcatttattgtaaacaagtactggtcccagcgatactatatgcctcatttaaacaacatggactatgttgatgcggtgcttgagtgggagattttgaacaacacactttccgattctgtccttcaatttctttcagatcatgcaaggtgtcatggatctaatgtcacatcttcgtttaccagagtctcaggttatacatgtagatgcatccaaggttaccagggcaatccctacgttcgtggaggctgcaccgccttgcctgattacaataaaaatctaacgaagaagtgggctatagtaggtgtttggtcaagcctgggatctatcattttgcttctttgtcgatggttgttgtataaagtggtaaggaagagaatgataaagaaacgcaaacaaaagttcttcaaaaagaatggtggtttgttgttacagcaaagaatgtcatctaatgaagttaatgtagacagagctattctgttcagcttaaaggatttagagaaagccactgaccgctttaacatgaacagaattcttgggaagggaggccaaggtactgtttacaaaggcatgctagtagatggtaaaattgttgcagtgaaaaagtttaaggtggaaggaaatgttgaagaattcatcaacgagtttgtcattctttga

SEQ ID NO: 60732 - DNA, 312 bp, Glycine max
  Peptide Sequence Number=SeqID_177510
atgcataccagggcaagatttcccccgtgccgctacaaaaagacgagtgcagaccatgcgcaccaacatgaccacccttacgtggatgacgttgctatttggcaacattctgcccagcgaccacaatgccaatctccccctgcagatgtatcagttggtctgtgccgtcatgacataggtaaggatcgcgcccacgagacacccagtggacccaaagaagtccaacagggccctggggtttccagctctggttacgggcctctgtcagtcctaccgggtgcccgttcccccagcgaggtcatgccatcgtga

SEQ ID NO: 60733 - DNA, 211 bp, Glycine max
  Peptide Sequence Number=SeqID_177511
atgggggtgcaaatagtaatttcgaatctgggcccttctagaggtttctgggcaatttcttgcttaaggttgaacctcctccccctttttcctataaataggctgaagggggttgttctaaggatcccggatgcccctggtttccgtaagcaaatccgtgaaggttttcctccgttgttcaccgttcttcgttttcttcagtcttcaactg

SEQ ID NO: 60734 - DNA, 321 bp, Glycine max
  Peptide Sequence Number=SeqID_177512
atgagagagaaagagagagagagagggagagagacagagagagggcgcgagagaaggagagtgacaaacagagacagaagaaatgagagatggagcgaaacagacacggcgaggacgagtgtgaagcaaagatcaatgaaggttatgcagaaatcctctttagcgggaagacaatcacaaaatctggagataggggacaacaacaaacactatcgccttaactggaggaacaatgccgacattacctccttttatttcacccatttccccgacgaagctaatgaagagttgctatggaggcacttcaaaaactggggtgac

SEQ ID NO: 60735 - DNA, 225 bp, Glycine max
  Peptide Sequence Number=SeqID_177513
atgatgaaaacgccacctgttcaagattatattggaaacggggatttaccccctgataggataagatctgcattagtagggaacgatttcaagaaactatacaagcagggaagatttgaagaggctttggctttgtatgaccgagccattgctattgactccaagaaagcaacatatcattgcaacaagagtgcggctttgataagcttgggaaggtttctgcag

SEQ ID NO: 60736 - DNA, 1941 bp, Glycine max
  Peptide Sequence Number=SeqID_177514
ctgtcacagaattaagtggtcaaatttgtcagatctgtggggatgagctggaagttactgtgaatggggagccatttgttgcttgcaatgaatgtgcattccctgtgtgcagaccttgttatgagtatgaaagaagagagggcaaccaagtttgtcctcagtgtaaaaccagatataagcgcatcaaaggtagtcctagagttgagggtgatgaagaagaggatgatactgatgatttagaaagtgagtttgatattgggagtgtgttctctgctcgccttaactatggttcacaggtgaatggttcagtgatccacgcaccatcagagtttgatgcagcttcggtggcttctgagatccctctcctaacatatggtcaagaggatgtcggcatttctgctgataaacatgctcttattcttcctccattcacggctcgagggaaacgggtttatcccatgccttttcctgattcatctgtacctgtgtccttatttaatgtgacaattaatgatggtgatgcagttcaaccaagacctatggatcctaaaaaggatattgctgtttatggatatggaagtgttgcatggaaggaacggatggaggattggaagaaaaaacaaagtgaaaaacttcaggttgttagacatgaaggggataaagatagtgatgagctggatgatcctgacttgccaaaaatcctccatccagtcaatgatgcatatgcattgtggctcacatcagtaatatgtgaaatctggtttgctgtgtcatggatttttgatcagtttccaaaatggagcccaattctgcgagaaacataccttgatcgtttatctcttcggtatgagaaagaaggaaagccatctcagttatctgatatagacgtgttcgttagtacagtggaccctatgaaggaacctccactcattactgcaaacacagttctgtctatccttgctgtggattatccggtggacaaggttgcatgctatgtttcagatgatggtgctgccatgcttacatttgaagcactctccgagacttctgagtttgcaaggaaatgggttccattctgtaagaagttctgcattgaaccacgagctcctgaatggtattttgctcagaaggttgactacttgaaggataaggtggatgccacatttataagagaacgtcgtgccattaagagggagtatgaagagttcaaagtgaggattaatgcattggtggctttggcacaaaaggttcctgaggatggttggacaatgcaggatggtactccatggcccgggaacaatgtcagagatcatcccggaatgatacaagttttccttggtcagaatggtgttcgtgacattgaaggaaatgaattacctcgtcttgtctatgtgtctcgtgagaaaagacctggatatgatcaccacaaaaaagctggggctatgaatgctttggtgagagtctcagcaataatcaccaatgctccctatgtactgaatgttgattgtgatcactacataaataacagtaaggcccttcgtgaagccatgtgcttcatgatggatcctacatcagggaaaaaaatatgctatgtacagtttcctcaaagatttgatgggattgatcgtcatgatagatactcgaatcgcaatgttgtattctttgatatcaatatgaaaggtttagatggcatccaaggaccaatatatgtgggaactgggtgtgtcttcaggaggcaggcattttatggatgtgatgcccctacttcgaagaaagcaccaaggaagacatgtaactgttggcctaaatggtgctgctgtctgtgttgtggatctaggaagaaaaagattaaagcaaagtccagtgtgaaaaagaagataaagaataaggatgatttaaagcaaatgcatgcactagaaaatattgaagagggaattgaag

SEQ ID NO: 60737 - DNA, 607 bp, Glycine max
  Peptide Sequence Number=SeqID_177515
accaactgaaggagtggtggatattgctgtttctgagcatcaaattgccaaggaaatcactgccaagcaagtccagcattggccaaagaaagggaagctttctgcagggaagctaagtgtgaagtatgcaatcttgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 60738 - DNA, 285 bp, Glycine max
  Peptide Sequence Number=SeqID_177516
atgaccgtagttatcgttgtaggccttgaagtgatcgatatccagcagcagcacaaagtggctgccggcatgattttccatgatggtatccagccggttcttcagcccgcgccggttatacaggccggtgagcggatcaagcatgctcaaatcgctaaaactttgcttctcctcatacagctggcgcaccagccgcagggtgaaggtgtcgaagcggcggcgcatcaaatggtgcagcgagaagccgatcagcggcagcgtaatggtgaacagaatggtcattaa

SEQ ID NO: 60739 - DNA, 813 bp, Glycine max
  Peptide Sequence Number=SeqID_177517
atgggcgatcaggcgctggcgcgggtgtcggttgccattcgcgatgcggtgcgctcgcgcgatgtggtgacgcgctacggcggcgaggagtttctggtgctgatgaccaacgttaacgcctcgattgccatgaagctggccgaacgcatccgccagtacgtggttgatctggaaattccccaccgcttcaatgataaagtctcgacccacgtgaccatcagcgccggcatcgcgccgattttcgcagaagacttcgaccaggcggtggccaacgccgaccgcgcgctgtacgtggcgaagaatcagggacgtaacaccattctggcgtgggaggatttaccgaagctggcgccggtaagcagcgatctggtgagccgcatggccatcatcacgcgtcaggatcatcgctttagcgcgcatccgctgatctttatgcagagcgatcgcagcttagccagcgcgctggaagatctgatgtgcgaccagcgcagctacatgcgggaaaacgtgaagctgggccagccggcccccgcaggcacgctgacgctggccgaatggtccacgccgtttcactatcgccgcctgacgcagcgttacagcgactatctctatcgccaccatcccgatgttccgcaggaagccaaaccgctgcagtcgctgtgggcccagtggagccgcgcgcgctcgactgctcgccgcagcgtatccacgttgagttccacgaaaacggccatccgtgcgccttctggattgatgtgcaggaggatgaggatgcgcgctatctcaatccgcagcagcgtatcgaacgcctga

SEQ ID NO: 60740 - DNA, 147 bp, Glycine max
  Peptide Sequence Number=SeqID_177518
atggaggtacatgtggagatggggtgcatagttgaagcagaagtggctcaggtttctttggactcggatcatggcgtcgtcatagaagtagggggctgtttaatcaacattgtgaaacggcaaagacgatgcatgcccaagcattga

SEQ ID NO: 60741 - DNA, 702 bp, Glycine max
  Peptide Sequence Number=SeqID_177519
atgtggttatatctaattaaaactaagagtgagacacttaaaatattccaaaggattttcggatcactatgcttcagtcatgtacctaatcaaaggaaaagaaagttacaagataagagtgagcctatgatcctggttggctatcatcctacaagtggatataggatgtatgaaccagtgaaatatatagtagttataagtagagatgccattgtagttgaaattgacttttgggattggaagaataagagcaaaagccttccacaaatttcttcatcaatattggatgagttgggaaatcaaacagatgaagaagtgatcactgaaaccagtataattgaaaatcagctccagcctcgaagagtacaaaggaatagtcaacttccactgagatttgttgatcatgaagtgttcccatacaatgcaggaaataatgaatgtgatcttgtacacttttctttatttgttaacaataaaccactgaacctagaggaatcaatgaagaaacaagcttggaaaaaagctacggtagaagaattgagatccattgagaaaaatcaaacatgggagttgattaacctaccccctgacaagcatccaattattgttaagtgggtttacaagttaaaatggaatccagatggattaataatcaaacacaaagaaaggctagtagcaaagggcttctttcaaaggaaatga

SEQ ID NO: 60742 - DNA, 186 bp, Glycine max
  Peptide Sequence Number=SeqID_177520
atggacacccatctccatgtcattggtgatctcatgaatggagttcaacggtataaaaaaacatctcttaatgaatccgatgacaattattgtaggggtggaggtcacaaaccactctttgaggattcacctagtgagtgtggtggtggggctgccactgtaagatatgggctaatctctaagtga

SEQ ID NO: 60743 - DNA, 492 bp, Glycine max
  Peptide Sequence Number=SeqID_177521
atgaatgttggagccctcgtctctagacagatcactcttatggctcagtccaactcctcgaggctcggatttccagtcctcatcattgccttatgcatggcccgaggagaccctatggtcagctttctagggacccgcaaggccagggctagaggatctgagggtccatcttctgctgctccccagacatctactgcaccagctcctattccttcagcaccagttcccgctacttccgatccctctgctcagagcatagacctcatgatggcattcaccaggccagaagtccagccttcttctcatgtaggaggtgaggcctccatagctcaggagcctcaaccaaatccgaagactacacctgctgctcaggaggatgatttagaggccactcccccatacaccccgctaggatcactagcaggcacgcctatgctgcattttaccgatgatgaggccatggatcaggacccaccgcatgaccagtcacag

SEQ ID NO: 60744 - DNA, 360 bp, Glycine max
  Peptide Sequence Number=SeqID_177522
atgacacaaaccgtttatacggataaccgcttgggtatctcgacatgtcacccgacttcatgggtcaggatgacaaaggtgctgaagacgatcttgggtatcttcgcatctcacccgacttcacgggtcaggatgacacaaaccgtttgtacggataaccgcttgggtatcaccgcatgtcacctgacttcactggtcaggtttacgaaggtgcagaagatgaccttgggtatctccgcatgtcacccgacttcacgggtcaggatgacacagaccgtttgtacggataaccgcttgggtatctccacatgtcacccgacttcatgggtcaggattacgaaggtgcagaagatgacgtaa

SEQ ID NO: 60745 - DNA, 297 bp, Glycine max
  Peptide Sequence Number=SeqID_177523
atgacaatctccccctgcggaaatatcaattggtctgtgtcgttccgacatagggatcgtgcccacaagacacccagtggacccggagaagtccaacagggccctggggtttccagctctggttgcatgcctctggatcgcgcccgcaagacacacagtggatccaaagaattctacgaagcgcccgtcgcccccaacaaggcccttaggccccctattaatcgggttttcatcaagaagtactacacccccaagcaggcgcagggcgagacaccacagcagcctggggatggctga

SEQ ID NO: 60746 - DNA, 333 bp, Glycine max
  Peptide Sequence Number=SeqID_177524
atgttgcggaaccttacgaattacgtaatcatccctttgttgccttccggaacgttacggaactttacggattgcgtactaacacttccttttaatttccgacatgtcacgaagcttcacggattgtgctacaacgcttttcttttggcttccggcatgcctcggaacttcacaaattgcctaacgatgggtgccaaatacctcaaagtggtcgagcgagggtcgcatccaacaacggatggtccccggacgaaattagggacattccctttatccccaaaccgctggccaaaccctgacagatatcatgtccagccgttttacaagccttga

SEQ ID NO: 60747 - DNA, 303 bp, Glycine max
  Peptide Sequence Number=SeqID_177525
atgcacacacaaagtttcacaattccacaatttcctaaaataggtccaactcacaaaaactgtccccaatggagttgccaactgtcgcaacctacccttttgcgggcgaacgaggcgaggctcacgggtgcgtcttccaaaggaggaaaatgcacggagtcgccaccaacgtttatttgtggaaaacgttggaaaaaccgaaggaaaccggccataaagaatattccagatttgggagttgtatttacgtttgagaaaggtattagcacctcccacgtttgtcccaaaggacaacagccttaa

SEQ ID NO: 60748 - DNA, 432 bp, Glycine max
  Peptide Sequence Number=SeqID_177526
atggaagatagcattggaggcagttcctcaaacgacaacaacatcatcaaggaacaggaccgattgctgccaatagccaatgttggtcggctcatgaagcagattcttcctcagaacgcgaaaatctcgaaggaggcgaaagaaacgatgcaggaatgtgtgtcggagttcataagcttcgtgaccagcgaggcttcggagaagtgcaggaaggagagaaggaagacagtgaatggtgatgacatttgttgggccttggcaacactaggctttgatgactatgctgaaccaatgagaaggtacttgcatagatatagagaggttgaggtagaccataataataaggtcaatcttcaagaaagagagaataatagtcctgaagagaaggacgatgaagtatttcaattgagtaatagaggggttaggttttga

SEQ ID NO: 60749 - DNA, 820 bp, Glycine max
  Peptide Sequence Number=SeqID_177527
tgcattgaattggcgcggcattcacttgaatttgcaacgtgggagccggagctgcgatgaagtgtggtgcttggagggtattctcaaagtagcacttaattcgaggttgaatgtttggtcagagcatggattctgcaagggatgctgcgggtggtgtggcagggacagtgctaattcccatgcgttttgtgtggccatatggaggaaggagtgtgtttctcagtggttctttcacacgttttggtctgaaaggtggttggagcttctaccgatgtcgccagtggaaggttgtccaactgtgtttcaagtgatttataacttgccacccggttaccatcagtacaagttttttgttgatggagaatggcggcatgatgaacatcaaccttatgtacctggagaatatgggatagtcaacactgtcttattggccactgatcctaactacatgcctgttttacctccagacgttgcttctggaaatagcatggatgtggataatgatgcttttcgccgaatggcccggttgaccgatggtactttgagtgaggtgctgccaagaatatcagatactgatgtacaaatatcccgtcagcgtatttctgcatttctatcttcacacaccgcttatgaattacttcccgagtcaggcaaggttgttgctttggatgttgatctaccagtgaaacaggcatttcatatattgcatgagcagggagttttcatggctcctctttgggacttctgcaaggggcaatttgttggtgttcttagtgcttcggattttattttaattttaagagagatagaagaggtatga

SEQ ID NO: 60750 - DNA, 705 bp, Glycine max
  Peptide Sequence Number=SeqID_177528
atgcatgcagggccatatgataatctgaaagatattgccatgaagatcttgcaaaaggaggtttcaactgttcctattatccattcatcttctgaagatgcttcatttccacagttactacatcttgcttcactttcaggaatacttaaatgcatgcttgatccttaccaaattgatttttcaggcatttgtaggtattttaggcactgctctagttccttgcctgtacttcaacttccaatctgtgcaatacctgtgggcacgtgggtgcccaaaattggggaatcaaatcggcggcctctagcaatgttgagaccaaccgcttctcttgcgtcagccctaaatttattagttcaaggtgtgaactttttgtctgaccctgaacatagtgtatcaaaaagaaaagcaacagagagaaaggatgaagaaattgcccaagtaagctcaataccaatagttgatgataatgactcattattggatatatactgtcggagtgacataacagctttggcaaagaacagagcatatacacatattaatcttgacgaaatgactgttcatcaggctttgcagttgggccaggacgcatatagtccctatgagcttagaagtcaaagatgtcagatgtgtttgcgttctgatcctctgcataaagtgatggaacgcttggcaaatccaggtgtgcttgttttccctttctga

SEQ ID NO: 60751 - DNA, 261 bp, Glycine max
  Peptide Sequence Number=SeqID_177529
atgctggagtcaggtgtcaggcggcttgtcatcgtggaagctggcagcaagcgtgtagaaggcattgtttcattgagtgacatattcaagttcttcattggtgattttaggctgagaaagaggcctgtaaattcagagtatttgattgcccaaaatttattcatctctccccattcgtattatcttcaaatgtattgtgctcctgacatagataccagcaaggtgggggagcacaacttctgtaatcattccatgctgtga

SEQ ID NO: 60752 - DNA, 103 bp, Glycine max
  Peptide Sequence Number=SeqID_177530
atgtgggatcgacacaaacttcaaggagcactcaaaccgggtgtatttacccccaagacctacactccaaagagtccgtcaggacctctccctccagattcag

SEQ ID NO: 60753 - DNA, 426 bp, Glycine max
  Peptide Sequence Number=SeqID_177531
atggacagagatacactggggtatagtggccagagaggttcgaggaacctaaggggattaatgagtggtgactactcaacatttggtgcaatcatttggcgcggcggaagactcacctatataaccaacaactctcagcacacaaagagagcgggtattgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaagggcccaattggcaacctaggcatcagccttttgggagaccaaatggtggctgacttgttggctgttgggggtttaatcctagacgatcctaagtcagcccttgttccatga

SEQ ID NO: 60754 - DNA, 171 bp, Glycine max
  Peptide Sequence Number=SeqID_177532
atgtccattggatttaatgatgaaatctgtgcattttcaggagaatctggcagagcatcaggatcaaggccgcgcgctaagcgcaagattagtgtgctaagcacagcaggtgtcttcagccaggctcagcgcacgactggcgctaagctcgaatccacttacccgcgctaa

SEQ ID NO: 60755 - DNA, 303 bp, Glycine max
  Peptide Sequence Number=SeqID_177533
atgcatcgagcacacccagtagaggttacaaaggaccgaggtgtccatttagacatgtcatctgaggagatggaggagtggaagactcaccctatagccaaaaaatctcaggtactaacaatgttgagtacatcgaggcatttgtgggctcagtgtagcacacaaagagagcaggttacagaggaccgaggtgaccatttagacatgtcatccaaggagatggaggagtatcgagaactactaaggcaattggaatcgacgtttgaggaggagagtaacggttctcccaaggatgcattttag

SEQ ID NO: 60756 - DNA, 268 bp, Glycine max
  Peptide Sequence Number=SeqID_177534
atatggaaaaaccgaaaacaacaaacaatatccaccattgcagatacatgcctttgtaaagtggtggtcacaatttgatacctcaaaggctgctccagaacaagtcaagaattggtttcagagcaaccctgagtttctcaagcctgctgatccagagacatcattgtttctaaatcaaaagtctcaacttgcagcattcttagcaagctcaaaatctaaagagagtcttgctcagaatcttaaggaagttctccagctacttcaatag

SEQ ID NO: 60757 - DNA, 363 bp, Glycine max
  Peptide Sequence Number=SeqID_177535
atgggtttggatgcagatgccctcgacgacattgacaaggacgagggcgtcattgctgagtcgggcagtggtggagacctcgatgtagaagtcgatgtggtacgacacgtcaaacaccctgattacgatgacacggtgcacaccgtcagcgacgatgacactgccaacacaggaaactggcctgtagtacttggagcagtggtggtgtttgagggaagggttctatggtgggggtggttagggttttttgtggggaagggggtatttagggattgggattggtggttgtggagtggcggagacggtggtggcaagatctgtgggtggcggcatttgttctggagggggttatttagtgtttga

SEQ ID NO: 60758 - DNA, 528 bp, Glycine max
  Peptide Sequence Number=SeqID_177536
atgcctatgacataccttttagtcaattgcctaccccttttcatgaagggtgatgcttttgtggtaaagatcctagaatatgaatatcaagttggattggaaagctggaaaaacaaccttcacggaaggatggttttgacaaaagcgcaagaacctatcaagcttcaggacccacatttggtttacaaaaaactatcggccttttgtgattcttgtaaggttgttggacactcatttttggaatgtcaacttttgaagaagccaaccctagaatccgaaaaggatacccattatgttcctaagcaaaaaggaattgttattggtaattctgaaaagcaaaaagattttgtaactgataattctaaaaaggctggccctagccatgtgaacatgaatgtcatggttgctaattcagttgaggtggttcatgaaaaggcattagaagaagtgttagataattatggatgtactgatgctggtggaagggttatagagatggtacaagctatcaaagatgattctttgtag

SEQ ID NO: 60759 - DNA, 421 bp, Glycine max
  Peptide Sequence Number=SeqID_177537
cgctgagcaccaacagcgtttcgaaaccatcaagggatggtccttccaccgagagagacgcgtccagctcagggacgacgagtacatagatttcctggaggagatagcttgccggcgttggacgtcgctggtcactcccatggccaagtttgatccggatatagttctcgagttttatgtcaatgcttggcctacagaggagggcgtgcgggacatgcggtcatgggtaaggggccagtggattccttttgatgcagacgccctcagccagttcctgggatacccgctagtgttagaggagggccaggagtgcgagtacagggaggcgcccgcagaggctcccggtgatgcagatgagacccgcatggacgaggagatgatagatttactcgatttcttgggaaggagcggagccacatga

SEQ ID NO: 60760 - DNA, 1758 bp, Glycine max
  Peptide Sequence Number=SeqID_177538
atgtcttcattcttatctaactctaccattgacatgggtggtagtgattctggggacatgattgagcaacccatgatgaaccgggaggtcatttctattggcgcttcctcatcggaggatactcatcatggtgcctccgacaacaagtccttttcttcggagaggcttttcctagttactctaatccttcccccttctgcttctgggggtgtgaggagaggtagtggtggtggagatgttagggtgtccactttcgtgcaacgtagccatagcgttgggtcgctatcatcccaacctgccatcgctagctgtgagtgggtgagggatgatgttctgaaatataagtcctctctcacctctatggcgagtgttgttgctcttcaacgtcagggcggcatcgggcagttgcctagcaagattggttgggtatccttcaacagcgtgtccaagaagttatttgagtttgactcaaacgtctttcgctgctttaaggaccatttctttaaggtcctggctactgatgtcatggatctattgacccttgtggaaaaggtcgacaaggctattttagagcagttgcctgcctcgctggacgcgccagccattctatctcttcccttggtgagcaatcccctcattgccttggatggtattgtgggtgacttcaccttgaggccactcatgaagggtcaacttactggtgaggttagctctattgttattgttgctgaggtcacctctagcactccttcctctattttggcaaagaggaacgagatgaaggctgcaaggttaacgctcggtgcgggttgcccttcgatcgtgcaggatgtgcctctagctccaccggtcatcgaggctcttgctgctgatactactactcctgccacttctgttgttgttgttattgtgccaatcactttggttggtcctatagtggtttcaccgtccaccgtcactacacccttgttgagtgctgttgtggcgactattagtgctccaatagttccgcctcctccttcttcaactccaccggttccaccctctactgtatggctagatcaaaagaccccgactggctttgtgttggccttcgacaaaagtttgattgggttggctggggtgcaaaacactatggattccaccatctcctttgctgaggtcgtaaggtcaaacttcaaaagttgcgcgaacctgtctagcaaggtggagggcattgcggcgaagaaggacgagcttgaaaaagtggttgctgatttagaggccatgcttaaggagttggagttcagacttgagaaggaggccagcaaagagcttgaggaggagctgctcatttacaagaaggaggctatggagaagtacgaaaagggcttcagcaaggccattaggcatgctggtgttctgcttgaccaggaggaaattgctgtggagaaggaggctgttgatgaggagcggggtgctgaggagaagcaagaccttgtcaatgtagagggcttccttctgctttgcaaagcttcaaccctgatggttgtgaggagtatgtttgacttgtccttggttgaaggtcttgccaaccagtgtgggggtaggtcacttgacatgctgagtttctcctttgatggttatgaggaaaatgactcaccaagggtgaaccttgggtttgtcaagccttggactggagatgtgtgttgccctgggttttgtcaagcctatgaggctacgtcaaggcttataggagatgagccttggattttgtga

SEQ ID NO: 60761 - DNA, 822 bp, Glycine max
  Peptide Sequence Number=SeqID_177539
atggatggtgaggtccctactgagccgcgtacactgcccgagtttaggcaaggctcgaattggagaccattcacctacactcatgacttgagtgtcttcagccactgtgggataaggcttggcaggctccctgcctctggtctctatcctctctcgtgcaaagccaaggagtggaccagcataaggatggacaatgtcgggggagacctcaagtctctggaaagttttccaatacatgatatcaatggaactgccctaatcaatgaggaccttggacaccatgaagtttgtaataatgatggagacaaccacggggtcgtcctggttgacagggttgatacccttgaggttgttgctcatgccattattgttggtgtctctgtctaccttggtcttccactctatcttttcttctgtctgcttcttggttcctatgctgctcctcttgttgtcctccagactagccaaggcagccaaggtcatgcgatgagatctgttagttgcatactgtgcattgaagcattcaacgagggtgtcgaagctgtctatggacctagtcaggaaggcatccaagtgctcatctggatttgtggtctcatcataccgctcaaagttgagtggtttctaccccaagggtatgtcagcctccataatgtggtggacgaagtgatgccgatgagtagtccgccctactggacaatgcatcctctagctgatcatggtcagccttttgctttctcatctcctccttgtggcatcactccatctaatacggtgggcaccaaatgtatttaccaaaatccagagctaggacacatcaag

SEQ ID NO: 60762 - DNA, 307 bp, Glycine max
  Peptide Sequence Number=SeqID_177540
atggcggccattctagaggcattacaagctttggaaaagaaaagctttgaaaggaccccttcaatgagtaaagaagaacaaactatcaccctaacagctagtggtgcaacaataggctcaaccgcagatcttgttcagaacatgtctcagccccaaaataataaccttgcttctcaaggaaattctttgaactatcaagacactacaaacacccatcaagtggctgttgaaggtagaagttatgacatcagagatgttgttgatctctgcttggttccagataaagtaattgcccccgaatttaaag

SEQ ID NO: 60763 - DNA, 1299 bp, Glycine max
  Peptide Sequence Number=SeqID_177541
atggatgggtttgatagcaattcttcagtgattgttcttggagctactaatcggtcagatgtcttggatcctgcacttcgccggccaggaagatttgatcgtgtagttatggtagaagcacctgatagaattggaagagaagccatcctaaaagttcatgtttccaagaaggaacttcctttagccaaggatgttgacctcagtggcattgcttgtatgaccactggttttactggagcagatcttgcaaacctagtaaatgaggctgctttactggctgggagacaaaataaagttgtggtggagaaacttgatttcatccaagctgtagaaagatctatagctggcatagagaagaagactgccaagttgcgaggaagtgagaaggctgtagttgcacgacatgaggctggtcatgctgtagtaggtactgcagttgcaaagcttcttcctggacagccacgtgttgagaaactaagtatattgccaaggtcaggaggggctttgggctttacttatattcctccaacaactgaggatagatacttgctatttgtcgatgagttgcatggtcgcctggtgacccttcttggaggacgtgcagctgaagaagttgttttttctggtcgagtgtcaacaggtgcacttgatgacatacgacgagcaactgacatggcatacaaggctatagctgaatatggtcttaatcagaccataggtcctgtttcaatagccactctttctagtggtggaattgatgagtctgggggagcagttccttggggaagggatcagggacatcttgttgatcttgttcaaaaagaggtgcaaacattactgcagtctgcactggctgtagcactttccattatccgagccaatcctactgttttggagggccttggtgctgatttggaagaaaaggagaaagttgagggtgaagagctacagaagtggttaagattggttgtcgcaccaacagagcttgatgcctttgtcaaaggtacacagccacctcttcttccatcgcagacagttccatacctcaacccttatttcaaattgcttcccaccaacaccgttcctcacaaggttcgattcacgccatttcatgcttcatcgtcatggcttcctttaactatgagttctttgtgcattgaaaagcctcggtcaacgatggaccggtgttgcggcaggggagaatgcgacaacaatgaagagcttcaagaagtttctgtccctgacaacagttccttgatgcctccctccttggctattgaccacaatgataggacgtga

SEQ ID NO: 60764 - DNA, 1718 bp, Glycine max
  Peptide Sequence Number=SeqID_177542
gactcccacagttgcgcaaagagtgggttgataggagggagaaactgggttatccaagatttactcagatgtactatgctaagcaaggaatcatcacggaagagatgctttactgtgccactcgtgagaaccttgacccagagtttgtgaggtcagaagttgctcgtggacgtgctatcattccttccaacaagaaacacttggagttagagcccatgatagttggaagaaactttttggtaaaagtaaatgccaacattggaaattctgcagttgcaagttctatagaagaggaagtttacaaggttcaatgggcaactatgtggggagcagatactgcaatggacctctcaactggtcgccatatccatgaaactcgagagtggatcctacgcaactctgctgtaccagttgggactgtgcctatttatcaagcacttgaaaaagttaatgggatcgctgaggatcttaactgggaggttttcagggacaccctgattgaacaagctgagcagggtgtagattacttcaccatccatgcaggagttcttctgagatatgttccattaacggcaaggcgcatgacaggaatagtatccaggggagggtctattcatgcaaagtggtgcttagcttaccacaaagagaattttgcttatgagcactgggatgagatacttgacatctgcaaccagtatgatgtggctctatccattggtgatgggctaagacctggatccatctatgatgcaaatgacacagcacaatttgctgagctcttgacacaaggagaactgacccgtagagcatgggaaaaggatgttcaggtgatgaatgaaggacctggacacatcccaatgcacaagattcctgaaaacatgcagaaacagttagaatggtgtagtgaagcgcctttttacactcttggtcctttaacaactgatattgcccccggctatgatcacatcacctctgcaattggtgctgccaatattggggcacttggtactgctcttctctgttatgtgactccaaaggaacatcttgggttgccaaaccgggatgacgtgaaggctggagttatagcctacaagatagcggctcatgctgctgatttagccaaaggtcatccatatgctcaagcctgggatgatgcattaagcaaggcaagatttgagttccgatggatggaccagtttgctttgtcattggatccgatgacagccatgtccttccatgacgaaaccctgccagcagatggtgcaaaagtggctcatttctgctcaatgtgtggccctaaattctgctctatgaagataacggaggatgtgaggaagtatgctgaggaacatggctatggaactgatgaagctttgcagcgtgggatggatgctatgagtgctgaatttcaagctgccaagaaaactatcagcggggagcaacatggtgaagctggcggagagatttacttgccagaagaatacgttagttccaagagggatcccaccattgagggtttggggaggtttattagacttgtacaatcttcctctgaggggaaaggcttactgttgcatcaagacttaaatggagcaaatcagttggaagaacttggagctagcttcccaactggcttatcagggtgtggagaagcattattaagccttaggaataggagagatacatgtcttcttctatttggattactggtttattaa

SEQ ID NO: 60765 - DNA, 288 bp, Glycine max
  Peptide Sequence Number=SeqID_177543
atgttgaatccgactcagtttcaggctaaaaaagagaaggttcaagtagttgatgactcgcttagcgaggcagattcgctcagcgagtggcatccgcttagcgaggcatacaactcacttaacagaagagaagattttgaaatgctgctgaatggctcgctcagcgagccagattggctaagcaaggctcatccgcttagtgaggaagtcagcttgctaagcgagtcgaaacccaagagaatgttgagtcggagagcagcacgcttagcgcgtagccaacccgcctag

SEQ ID NO: 60766 - DNA, 264 bp, Glycine max
  Peptide Sequence Number=SeqID_177544
atgaagattagagcatacagtgttcaattgaacgataccgcaggcataccaagcatgataatccaactacattcagatcagttgaacaaaatatgcaggactatagtgtataagcctctattgttcaagaccaaagaaaaattgttttggtatttcctaacaatttatatcccctatactcttcttctcattgacaatgaaaccctccctaccaaaaagaaatacaactcgaaagtttgcaaatctcaagaacctgctacttag

SEQ ID NO: 60767 - DNA, 387 bp, Glycine max
  Peptide Sequence Number=SeqID_177545
atggagagtggagacaatgttcaacccaaaaaggggtgggaaaagccaatggatgtggtgcatccacacgtcaaattcacaacctcagcagatttctcagcttgcaacatggcttccatcatcatgtcatttgctccagcaactggtagagtctttgcagccacagcggcaaagggtgctggtggaagcaaagaagagaagggtcttcttgattggatccttggagggttgcagaaggaagaccagctgctagagactgatccaatcctcaagaaggtggaggagaagaatggaggcaccaccagcaacactggccgcaacaagaactctgtggcagtgccacaaaagaagaaaggtggctttggaggcctctttgcgaagaactga

SEQ ID NO: 60768 - DNA, 273 bp, Glycine max
  Peptide Sequence Number=SeqID_177546
atggtttttgatttgagtcagcagcagaaagaactcaaagaagagatcatcatggtgaggggaaagactcagataaagcgtatagagaacgccacaagcaggcaagtaactttctcaaagcggcgaaatgggttgctgaagaaggcctttgagctatcagttctgtgtgatgctgaggttgctcttatcatcttctcttcaagtgggaagctctatgaatttgctagctccagttgtcataaacatgaaaacacagtgggggatactgggtag

SEQ ID NO: 60769 - DNA, 204 bp, Glycine max
  Peptide Sequence Number=SeqID_177547
atggagatgggcgagagtgcattgctgaaaaatgctttatgggaagaacaaacactatgtctcaagctaattagaaggggaatgaagttaaaagaagaagatttaaagtgctttggaggaaaattgatgcaaaaattggaagaaaaatccttgaagaaaaaattggaagaattggacaactcgcttagcgcgcaccctcactaa

SEQ ID NO: 60770 - DNA, 420 bp, Glycine max
  Peptide Sequence Number=SeqID_177548
atggagcaaggcaaattcatgttcaagtttttccatataatggacctagacaagacatataatggaggaccatggaacttcaacggtcacatgttggtgttgaacaaggttccaacaggggatataactttaaatcccattgtttcatattcccctgttagttcaagaactcacctaggaaacttcattggcaagttccaggagtatgatccaaagaacaacactggagggtggcagacgttcatgcggatcaaggttcgtgttgatgtacaagaacctttgaagcaagggaagaaagttaggaaactaggtgccttttgtccagcgatattcgataagggtgtcgatgatggtagaagagattggagtatcgagctaagagatgatctgagaggaagagaggtggtcgataatacatga

SEQ ID NO: 60771 - DNA, 1071 bp, Glycine max
  Peptide Sequence Number=SeqID_177549
atggtcactcgttattggaccatccgccgatgtttaaatcttgcaaactttgtgtttgagatgtccagtcctttacatgaagacagtgtgttggatatggtgggctaccctaaatctcatgagctaacttcatggggttgggtaaatatgagcattgctatacttcctatgtctgcagagtacaactggaacccgagcactgtaggtttaatacagtcttctttcttttggggatacctcctcactcagattgctggtggaatatgggcagacacagtgggaggaaagcaggtattgggatttggtgtggtttggtggtctgttgcgacagccctcactcctatagctgccaaacttggattgcctttcctactagttgctcgtgcattcatggggattggtgaaggtgttgctatgccagccatgaataatattttgtcaaaatgggttcctgtgtcagagcgaagtagatcactagcgctggtctacagtggcatgtatcttggatcagtcactggactggccttttctcccttcctaattcatcagtttggatggccatcagtattttactcctttggttctctagggacagtctggttttctgtgtggcttagcaaggcacatagttcacctcttgaagatcctgaactgcggcccgaggaaaagaagctcattactaccaactgttcctccaaggaacctgtgaaaacaataccttggagattaattttgtcaaagccgccagtctgggctctgatagtgtcccatttttgccacaactggggaactttcattctacttacatggatgccaacatactataaccaagaaaaattcttagggaaccacaccttaaaatatatattgcatcgtctggttctaggtataatgtgttacaatggacaaagaggaagagggaaagctggtgatataactgacagtaaagtagcaaaccatgcaaatgatgaggatctagggccagaagttggaggatatgagcttgtagccttgacatttgttcctatcaatgaaatctttgtgcctttccaaaacaaaaatgctgggtga

SEQ ID NO: 60772 - DNA, 171 bp, Glycine max
  Peptide Sequence Number=SeqID_177550
atgggggcagagcatggagttgttgaaggaggagagaaacaggagataatggctctgccactcatcgtggcttctgcaaaggaacaagacgaggatttttatcagcactggctctcgtttttacacgtggacactgcatacagaacaagacccctccacttgggtgactaa

SEQ ID NO: 60773 - DNA, 428 bp, Glycine max
  Peptide Sequence Number=SeqID_177551
gatgaggagaaagggttgtgggttctcacatgtttctataagatcctagatcgggctcatagaagggagtcatggcagttactcaaggatcttcattccaacatctttctcccttggtgcattgttagtgactttaacaatctcttttcaaaagaggataagtgtggacgagttaagcacccaccttggctcttccaaggtttcagggaagctatctttgagcgcttagatcgagcaatggttgattcagattggttccaacttcatggccaggagaggggtctagaagaggttgtgtcgggggaatggaacaagttggcagatgaagagattgaaggaaaaatcaagaactatgtagaaaagatggaagcttggggagtatttcctgtggaagcaaagcttcatgatgaatcaacaatgattcaaag

SEQ ID NO: 60774 - DNA, 183 bp, Glycine max
  Peptide Sequence Number=SeqID_177552
atggggtgtggtttctgcctggtgtttggttctgctagaattaatttattgacgtgcagtgaagaagatgacaatatatgctatgcaagaagtgataacaaaattagagaaagcaaggtccaggcaaaccatagttccaaagtagatatatctttaacagatcaaagccaattgaaagtgtaa

SEQ ID NO: 60775 - DNA, 954 bp, Glycine max
  Peptide Sequence Number=SeqID_177553
cgtttcgtgcccgaatccggcatctctaccgacaccaacctcttcttccctctccgcaacgacatcttcccctgcactgcgtgcggcgagattttccagaagccccacctcttagaagcccatcaaaccctcaaacacgcggtttcggatctacccggatccgacccgggtcacaacatcgtccaaatcatcttcaaatcgggttggcccgaatccaagccattcccaaccataacccgcattctcaagatccacaacagccccaagatcctctccaaattcgaagagtaccgcgaggccgtgaagtccaaggcggcgcgtcacggcgcccatacgcgccgccgcgacgagcgctgcatcgccgacggaaacgagctcatgcgcttccactgctcgacctttttatgcgacttgggacacaacggggattccgcgatttgttcgcagcagttttgtaacatttgcggaattattaagtccgggttttccccgaaactcgacgggatcgccacgctgtccactagttggcgggcacacgtggcgatccccgaggacatagagcgggagttccgcttcatgaatgtgaagcgggcaatgcttgtttgtcgggtgattgcgggtcgggtcggatcggattcggatgaggtggaaaaagaggacggagggtttgattcggtgatggcgagtggagagagtggggtctacacccgccttgatgaggaggagcttttggtgtttaatcctagggctgtgcttccttgctttgtgattgtgtatactatgagatgcttctttttgcataatccgggttcttggacccttgtgcacgaaattatgtgcattaaattgacacattatagtatagaaactgaatgtgctgtatctgatgaccacatgctgccagccctgtgttctgtttccgatgaggttgctagggaggttcattcaaactga

SEQ ID NO: 60776 - DNA, 780 bp, Glycine max
  Peptide Sequence Number=SeqID_177554
atgaaggaatcaaaaacaattaaggaatactctggcaggcttcttgacatagtcaacaatataaggctccttggttttgatttttcaaatgatagaattgttcaaaaatttctagtcacggtgcctgaaaaatttgaagccacaattgcatctatggacaactcaagggatttatcaagcattactctggcagaatttttgaatgcactacaagcacaagaacaaaggaggcttttgaggcaagaaggatctgtagagagagcatttcaagccaagaactacaaaggtaacaaatacagccaaaacaatgatacatgtgtcttttctccttgtccctattgcaagaaaaataatcacccacacaagtgttggtggaggccagatatgaaatgccacaagtgtggtcaattaggacatgtggaaaagatatgcaagcctcatcatcaacatctggaggtcaaggttgcagaggatcaactagaagaggagcaactctttgcaacatcatgctttacaaccaacaactccaaaaaaaaagatgcaagcaacttagaagtgttcaaagttcatatgaaaggaaagagtttttccttagatctgatgaaggagcaagacgagcaagatgacaatggtgacaagaaacaaccaaagaagttgcatgagataaaacttgaagaccataagcctcaagagaataagcctacaaagcttgagatggtttggaagatcaatttgagcaatgacagttgcatttcaaaaattccaaaaagcattctctga

SEQ ID NO: 60777 - DNA, 1056 bp, Glycine max
  Peptide Sequence Number=SeqID_177555
atgtcgtctgattttaagttagacattttttctcagcatgattctgaagaacccgggttaggcaccaccataacatcgaaaatgtttctagatgaaaaggctaattctgtacaaacaattcgtgagcaaggaaagttgtcaatcaacaactttgccacaaatgcagagcgcagaactttgaatgatagatttctgaaagcaaataaagctacaattggtgataatgtcagtcttcttgatgaggaggaaaggcatcatttgcatggatcagctaagaagtctggacctcttatctcaggagcggcctactgtatttcttcttgctccatgataatgctgaacaaaattgttttatcaggttataattttgatgcaggaatatcattgatgttttatcaaaactttatcgctactctagttgttgttctgttgtctctctctggtcgaatttcagttgaaaagctcagttggaggctgatcagggcctggatccctgtcaatgtgatattcattggcatgcttgtctcaggcatgtatagtttgaaatacataaatgttgccatggtgactattctcaagaacatgacaaatatcttaacagcaattggagaattgtatttatttcggaaacgtcagagtcccaaagtgtggactgcaatgtttatgatgattatctctgctgtgagcggtggtattacagatctctcctttgatgcagttggttatacctggcagattatcaattgtgttctaactgcaagttattcacttacccttaggcgggtaatggatgaagcaaaaaacgcaacaaaatctggatctcttaatgaagtgtcaatggtgttgctgaacaactcattgtctttaccttttgccatcatcttgattttcctttttggcgagtgggattatccagtggactgcttggactttccatcagctttacctcaatgtggttcttacatcaaactagccctacaacatatagggacaggaaaggatgccaaggattttagtgaacatacaaacagactaaattctcttgcattgaactaa

SEQ ID NO: 60778 - DNA, 1521 bp, Glycine max
  Peptide Sequence Number=SeqID_177556
atggaggtatccggtatctctttctcatcccagataaagctatctatcatatatctcataataaaacatacatcgtcaccacttcccaagaagatgatggtgcattctaatagaatagaggaagttcgaatggctttgggtttttataaagcctttatggttgataaccaggggagaagcggagggctagctatgctttggaggagttcagtccgcggggaaatggtgacaatgttggcagctggattttatgggatccttgatagagctaaacgtagagattcatggaatttgtttcgcactctggcagccaatatttgcttcccctggtgcgtgatgggggacttcaacgacttactgtccaatgaagataaatgtggtagagtagagcatcctttttggttaatgcaagggtttcaagaagctgttggagattgtgggctgagagacattgtcttagaggattacccttttacttgggttaagagtaagagtattgattctgcagtggaggagcgtcttgaccgggggccatggctaatagagctagaagatgttgttcttggtggttggagttttaatccaaatgcagatgttattgccaagcttcaaaattgtgcttctggtttggatagctggggtcgtattttgaaatcccggttccgcgaggatattgatcgttgtaagaaggatctggagtattggagggataaaggagactcatactcggagctggctaaagaggatggttatgttgtccaaacccaagaagatttgaaaagcttagctgaggatcacttcaccaatttgtttgcaaggcagaattgtaacaatgctgatgaagctttgatggatatggatccgaacaagtctccatgccctgatgggttaaatcctactttttttagaagattctgggaaagaggaagcatgccaccagctgttaacgcactttctgccttgattaaaaaagctgaagcaagtggtgatgttcatggcataaaggtcagcagaggcgctcctatagtgtctcacttcatgtatgcaaatgattgctacttgttttttagggcctctttgttggaagctggtcagcaagatagaaggcaaattcttggtattagagaggggctgccaagtgggattttatctggagctagaagagagattatgctaaagtcagtggctcaagttgtgcctaactatgaaaagggacaaaatacccatgggtttaatcttgctcagcgaggaaaacaagattggaaccttttaaccaacccagatactattatttcaaagtttctcaaagctaaatactatctaagaagggatttcttagagactaaggtggggtacaacccatcttactctaggcgtagtatctgcgtttcgcaggtggtggtaaggaaggactttaggtggaaaattggagacgattccctcattaacatttggtctgagccgtggataaaaggtgagtgcaaacatctaaacttcctattcctgaagctgaagatctaa

SEQ ID NO: 60779 - DNA, 1125 bp, Glycine max
  Peptide Sequence Number=SeqID_177557
atgtggcctaataataatagtactactcaagaagtgagctatgctgaacagatcatttttgcaaataataatgaagaggctctgaattggtcacaacaagtgtgcttcaaagaagatgggaagaatattgccaaagtggtgggaagaagacctaagaaagggtcttctgtgcccttgatcaaaggacagtggactgatgaagaagacaggaaactgttgaagttggtgaaacaacatggtgtaagaaaatggtctctgatagccgagaagttggatggaagggctggaaagcagtgtcgagagagatggcataatcatctgcggcctgatattaagaaagatagttggagtgaagaagaagagaggatattagtagaaactcatgccaagattggaaaccgttgggcagagattgcgaagtgcattcccggaagaacagaaaatgcaataaagaaccattggaatgcaacaaaaaggaggcaaaactcaaggagaaagaacaaaagagcaggaacctcaaatgggaagccacaaccctctattctccaagactacatcaaaagcttgactctgatcaccagcaccaccacctctcccgtggaacaacaaattgcacctcagctctctaattctgttaccaataatgaaaattcttcactaatggctgagtcttatgatgatgagttgctattcatgcaacaacttttcaaggagaataatgccaataatgttgaatctcttaagcactccaagaatattatcaataactcttctgcagcctccttggattgttattatcatcaaactaattacaatggtggtggtcagcttctcactgatgtcactcaatgtgggtttgttgttcattccaaccctaacacaacaaactcacatcacaacaacatgtgcttggatgagagtctcttcatctctagaaagagtactactcctcatgctcctatcaactaccttgattccgatcatgtctatctctctcacttgcttaatggaactgctggttcatcattttgctataataattatggggttcacaaccagaacaacatggagttgcagctggggaatcaagattgttttgaggaaagagggagatggatatggtag

SEQ ID NO: 60780 - DNA, 132 bp, Glycine max
  Peptide Sequence Number=SeqID_177558
atgagggcgcttgccagacatggacctggctccgccataggagcagcaaagagagtcagatttgactctgccatgactttggatctgacgatgatcgaagccaagggcgatgactctactggagagatttga

SEQ ID NO: 60781 - DNA, 387 bp, Glycine max
  Peptide Sequence Number=SeqID_177559
gtgtttggtaatgctgaggggagaaccaaactcaacttggatctcaagcttggcctttctgacatttattctgcacaagcaagagacaaccattacaataaccatacttttaatcaagttgaggagaatttcatccatggtagttcttcaactcatggtgttggaatcaatttcaacactaaccaaacttatgaaggacaagcaagtaaaccgggcttggatctcaacatggccacaaaaatggaggatccaaaaaggctaaagaggatgagggaaaaaaaaggcactccgtacctttctatcataccactctacacttttgagagagatctagagagagagagggccggaagcaagattagttatgacataggaagagtgaaatga

SEQ ID NO: 60782 - DNA, 189 bp, Glycine max
  Peptide Sequence Number=SeqID_177560
atgtctgggtcctgccccgaggaaccaaccttaggcttaaagagacagtcttcgggagccatggatgatgacgtgagggagctccttgaagtcggtccaaattattgtttgatcgtgacatcggctctagcagcacagacacaaccagggtgttttggtcgcccaatggcagtagttagtacattctaa

SEQ ID NO: 60783 - DNA, 357 bp, Glycine max
  Peptide Sequence Number=SeqID_177561
atgtggtgcttgttaggttatgtgtgggacttaacgtctatgtttgtgcttctgaaagggatgaagtacttactcctagaaaactcaatgttgcctcccccgatctacattgatgctatcgagaccaagtgggaacatgatgatgtgttccatatggatcacttctttgagttcctatgttgtcgtctaccacctgggttgaatatggtggatcctgtgtcaaaggatgagggagcggatatgaaggaggacacgtcatataaggaggatctatctatggatgaggagcaccctgccatggagcctaagatcatggaggaggattcctcacaagattcatctaaggagtcttactag

SEQ ID NO: 60784 - DNA, 477 bp, Glycine max
  Peptide Sequence Number=SeqID_177562
atggtagcgagaccatgcctgctttgctgcactcttctaacaccagcaactgtttcaccaatgttgctggtgaaacaccctccacgtcagtcggtatgtcgccaatgccaatggtggcttacctgtatcgccaatacgagtggtgggaggcgatgcataagtgattctgttaggtcaatttgccccaaagcaaacatccaaaatgggaagcgcccagcaggcgacggtgtcgttcctgacgaacctggcccgcgcggtctttgggctgggcgcttccgcgaccctattaagctcctccctctacacgtcgacggtgggcaactcgtcgtcctcttcgaccgcttccgtggcatcctcgatgagaccattggcgagggcacccacttccttatcccgtgggtccaaaagccctacatcttcgacatccgcacccgtccccacaccttctccttcgtctccggcaccaaggacctctag

SEQ ID NO: 60785 - DNA, 750 bp, Glycine max
  Peptide Sequence Number=SeqID_177563
atggacccctctcaggaagtagaacctccaaaggttgagtgtcagaagaaggcagatgaggtagaagtggtgaacattcccaaaaattggagttctctctttacgggtaagaagttgattcaagatctagacgtgtatgatgcaaagacattctggaatcagatagtatggaatgacactttaaaggcttcaatatctagatatgatagaaaagataacactgatcaccatgaattcattcaagtgctaagtcctatcaagacgtttcacttaggtgatgcttgtgtgtgtttcacaaaagatgctgacaactatgactttatcactaggttgaagaaccttatcatcatctttcatgaaacaacttataatcttacaatgatggatgaaagggacttcagagatcatgggactcaactccatggtgctcaaaaggcaaaaagggcagagatggaagaagatatagttgttgcaaaggctgataaagagaaaactgataaagcacaggctgaggctattgccaaggctatggatgacaacattgtgtcacaaccttcccttcagaggaggtgtgaaaaaggcctctttgatgggccaagggtgtgtcttccattgaaggaaaatgcgtggagtcgccaccaacatttatttgaggaaaatgtcgaaaaaaaccaaaatggaaaaggtcgaaggtctacgtattttgaaaataaaggttcgggagttgtttacgcatggggaaggtattag

SEQ ID NO: 60786 - DNA, 729 bp, Glycine max
  Peptide Sequence Number=SeqID_177564
atgctgaatgaattccttcagactccagtggtgttagaggagggggaatctttacccacctactctagattttacaagttaaggactaaccaccaggagattaaagccaggctttgtattccccgtaaggggtttgttttgaatgctgagggccaaccatggaaaattctcagaaaagatctgacgacactggcccagacatggagtgtcttttcttactccaacctagctcccacttcccagacctcagatttgaatatagacagagctaggttggtctatggcttggtaaccaacatggacatgaacattggagcccttatctcaggtcagatttcttctattgctcagagtaactcctctaggctcggatttccagccttgatcactgcccatgcagagctagagaagttacctctgacattaactttagaggggcaaggaaggcaagggttcgatcagctggtgtttccttcttcttctactcaaccaactccttccacttctactactcctacaccagctcctcgaggcccatatgctcaggactctcagcgctttgaatccatgcttcagagtcttcataaaggacaaattttgttaatgcagagcttgcaggttatagctcctccaggatccattctgatagtggagcagtttttagagaaggtatcctggccaggaaccctgccttcttttgagagagaaggtggggttcccagtgcttag

SEQ ID NO: 60787 - DNA, 408 bp, Glycine max
  Peptide Sequence Number=SeqID_177565
atgaaggcagagcaggagaggcaggcagcgattattagagccgagggagagagtgacacggcgaagctgatctcagatgccaccgtatcggccgagatggggctgattgagctcaggaggattgaggcttccagggaggccgctgccacactggcgaagtcaccgaacgtggcatacttgcctggtggaaagaacttgctcatggcgctcaatgccgttggccattacaggttgatgcagtttgcaatcagaaacttatgtggttgtggctgtgtaaagctagtcaaccctgagtgtttaaatgtgaatgccatgtttgctactattagtgatcttcctgtttatgcttttgaccatttatacagcataaaccatcaaatcattagtgatcttcctgtttactattaa

SEQ ID NO: 60788 - DNA, 258 bp, Glycine max
  Peptide Sequence Number=SeqID_177566
atgggtgactcagacaaatgcgggctgtacatcaaagaaaatccttctcgcctagttgccctaggaagagtttatgagggatccacagcggttcacaacatccctttgttgcatggccaagtgaaggttggtgttgaagaggttaaaaatgcagaggctcccattcctatacccactgacgaggaagttatgtctccagcaaaacctccagataggccagatcatgagatcgatgatcccctatatttaatgacatga

SEQ ID NO: 60789 - DNA, 207 bp, Glycine max
  Peptide Sequence Number=SeqID_177567
atgaggaagaccattttgagccttagaatgagctgtggattgttgattccaccttggagaaagaagaaaaagatgaagaacctttttgaaaaggcagtaaaggttgaagttgctacagagactgctcagaatgaaccagatgttgtagctggtgaaaggacccctattgggtctacaaaggattcctttttcaacactgaaacatga

SEQ ID NO: 60790 - DNA, 395 bp, Glycine max
  Peptide Sequence Number=SeqID_177568
gttcagactctaattttttaactgcctatgaggattgccaatctccaactaatcagcctgtaatcaacactgaagatatcagtgcacatgctcttaaattaatattcataattgttatcatcatattgtactatgatattaaacaatttcaggatattctgatcttggtgatcaactcatgcaatgtagatattgtaatgcacaaatgtggtatgataaaagaatatcaaaagataaaaattgtgggagtccaaggttcagcttatgttgtggagatggcaaagttgaattgtcattattacaaaatccaccccaatatctccaacaacttttgtttgatgataatacaattgatagtaaaaattatcaacataacttacgagcatacaacatga

SEQ ID NO: 60791 - DNA, 129 bp, Glycine max
  Peptide Sequence Number=SeqID_177569
atgggcctcctgcatgcatctcgccagctggactacggggttccttcattgcacgcatctcgccagtattgttggcggaaccctcacgtgttgaagcaagggtatctcaccagtggaatggtggaataa

SEQ ID NO: 60792 - DNA, 213 bp, Glycine max
  Peptide Sequence Number=SeqID_177570
gcagaactggcataaggccttgacccagtttatggatgggcacattgatatggccctggtcaaggagttttactcgaacctagggtggctgattaagttcgatgcggcatcactgaatgcctttctagagacgccaccagtcattcagccatgggagcagagcgccctggaagctcctgaggaaggatttgacaaccttggcccagacttgga

SEQ ID NO: 60793 - DNA, 299 bp, Glycine max
  Peptide Sequence Number=SeqID_177571
gctcatacttagcccatgggcccgaaatataccttaaggctcatgagaaccctaaggccttctcttgcatccctgggccaatcttcttggagtcttctatccaatgcccttgcggggtaggatttcatcagctaagctccttaaaggctgcacttagcagcaccaactcttcaaaaatttcactaagtattgagagcttagcgagcgaagctcgcttagctcagcagatgccgcaactaatcatgcttggcccaggaaagctcgacttagcgcgtggctatcaacaaaaaattgtctaa

SEQ ID NO: 60794 - DNA, 543 bp, Glycine max
  Peptide Sequence Number=SeqID_177572
atggaagtagtccttcatcaaggagcaatcccttgcgggaggagaaactgggtagaatacataggtagaagctattatatttttctgaactcaagcccaactctatatctttgttcagcattgagaaacatgaaagttgccatttcccgttggtctagagctacaaccagaactaccaaggttgacaatggtttatcaaaagattacaaagctcaaaaagattttgaatttgaacctctattgaggaacatgaaacctgccatttctcgttggtctagagctacaaccaaagctgccaagggaaatgatttttgtttatatttttgtctttctcaaattctgcccattcacgtccaatctttggacgtaacattcaatgctccacagttcccaaaccacttaacttgccgccagttacagcctccaaaaggcaatgacccttccatcacccactacctcacaccatcaaaccacccttcctttttctaccacctccacttcaactctaagcaaatcattctgtcaaagcgactaccaccatga

SEQ ID NO: 60795 - DNA, 570 bp, Glycine max
  Peptide Sequence Number=SeqID_177573
atgacatcagcgacatgctcttctgctgatggattgagagcaatatcaacacagcttccctttgtgctgccacgtgctgccaatactagtacatctggctcaatcgagggcaactgttgtgggttgattgatgtagttgaactgttggagccatgtgatgcatgtccaaagtattggctgattgtcacaccaactccgatagctggaacacaacctgggtgctccgatcgcccaattgtaatgtcatctgcccatattgctttgtgcaggccaacttccacttcacatgtctttcaattagagatggaggatcaacaatcattactgaatcctcagtcaacattgcttcctcttatcttttcttccatttctcctccattagcttcttctcaagcaactcgtaaccctcatgagacaaaaaacacatcctcatctaacctaccaagtaggggttttgcggcttacaacaaattcttcccaactttgtggatccaaaccatacttaaaacaaggagtttggtcatcttgaccctccctgtcttcatatacatatttggtggtcagcgatga

SEQ ID NO: 60796 - DNA, 612 bp, Glycine max
  Peptide Sequence Number=SeqID_177574
atggagtcatggcaacaccaccaaggtctcctcccccttgatcagctccttccgagtgtacgtctaggaagagtagacaaacaatacaactcagaagctcgagaaaagattcctattgtccatcccaattggaaagctatgccgaaatctctaaagaatctaatttgcgatgacattttggtacggaaaattgatattcgagaagtatccaatgtcaagaagaaggtgatgtcatcggtggctacaagatggaggcaatttaagtcatcgctgaccaccaaatatgtatatgaagacagggagggtcaagatgaccaaactccttgttttaagtatggttgtgttccagctatcggagttggtgtgacaatcagccaatactttggacatgcatcacatggctccaacagttcaactacatcaatcaacccacaacagttgcctgagataataagaacccttaaagtagagtggaagagagaagtcgaagaggataaaaaatcacgtggcagcacaaagggaagctgtgttgatattgctctcaatccatcagcagaagagcatgtcgctgatgtcattgtgtatattgtaacgacccgcctcgtcgctacg

SEQ ID NO: 60797 - DNA, 489 bp, Glycine max
  Peptide Sequence Number=SeqID_177575
atgggtatacctgagcagttacatccgatatcacaaggtcgacaaactgtgaaagttccacaaggatactcttcaaatatcaagagccttctatccgtgaatgatttcaaattagttggcttgaagtctcatgattaccatgtattaatgcaacaattgatggctatagccatacgaggtatcttgcttgacaaagttagggttgccataactcggttgtgctttttctttaatgttatcgatagcaaagtcactgaccctcaaaagttggatgatttggagaatgaggctgccattatcctttgtcaattggagattgcatcagataaaaacccgattcaagcgtccatgccttactttggagttattgaagaaatctgggagcttgattatagtgaattcagagttgcttacaaggacaagcctttcatcatggcagaacaagcaaaacaagtgttttatgtccaagacccgtgtgactcgagatga

SEQ ID NO: 60798 - DNA, 612 bp, Glycine max
  Peptide Sequence Number=SeqID_177576
atgggagtagggttccggcaggagatgactcgtcttactggctggatacatattttggacagcatcaagaatggtgttggtctccctctcaatcatgttgctgctattgaaccacccaataatgtcactatagcaacctcaggaggatcagaagtgtgcttcccttcaaatgccactccagaggatctttttgaccatttttgtgacggtgctctgagtaacggctccagtaagctatctaatgggaacaaaacgagagttttggttaattattctcaggaaaggggggcacccactctgaatgaaggccgtgattttgatggtgaagaaaggtgcagcaaaagggctcagcttggtggctacaataatgaccggccttattatggtagagggaattatcaaggcaaggagagggagaggtgttttagtaataataggaagaggccgcggggggatagggatgaaattgataggagggataaggatggtggagggatgctagagatagggattgttccaactgctatatccaaaaaaggacttcaatttgatgttccaactgctatatccaaaaaaggtgatggtggtgagtcttggaatgatttggtgtaa

SEQ ID NO: 60799 - DNA, 1593 bp, Glycine max
  Peptide Sequence Number=SeqID_177577
atggagacttggtggggtgacggttgcattgaggttatcgatggcaccacaaattcgagagtagaggcacacgagaatcccattttcattttcttcttcaaccttgaaaatcctaatcccatttctcttcacggttctctcacctccaaaacaatgccagtcatcgccgccaagcgcacgttgcgatctcacccttcctcgccccctcgcaaatctccccgccgatgcacagccgcaacccccaattccacccctacgaaaaacagattgggtggcgccgacgaaaaccaagctgatccggcagctgtgaaacccaagtggaatcccaaagatggtgagcaattgaagagggcaaaaatggcactgcacttgtccactgcaccgtcttcggttgtgtgccgcgaggaggagcagaatatggttttggagttctgcaaggggtgcgttgagcaccagaaggctgggagtctctacatatgcgggtgtcccggaaccgggaaatcattatctatggagaaagtgaaagataaattactcaattgggctaaggaggaaggtcttccactgccagatgttttgtctgtaaattgtacaacccttaccaatacatcagatattttcactaagatacttgggttaaaccaaacacagggtaaaaaggtttcagccttgcccttgcagcagcttcagaacatgtattctcagaaatcatctgtcaagaacatgacattgatagtagctgatgaattagattatttgataaccaaagacagagccgtgctccatgatcttttcatgctcaccacctttcctttttctagatgtatattaataggtgtagcgaatgcaattgatctagctgatcgatttcttccaaggcttacatcattgaattgcaaacctattgttgtaaattttcgggcttactctaaagatcagatcctcaagattcttgaagaaaggttaaatgaatttccttacagtgttttccaacagcaagccctggaactatgtgctaggaaagtagctgcaacttctggagacatgcggaatgctctttgtatatgcgggagtgcaatagagatgcttgaagcagaaattagagaatctgcctgcaatttgaatacctcattggaagagatatcatcctcaagacaaaattttgcaacagctcctgattttatgaaaaaacgagaatttgatactgtaaagactgatcatatggctcgtgccttgtccaagacatatagatcaccagtggtggatacaatacaatctctgccacatcatcagcagattgtactctgctcttctatgaaacattttcgtggagccaagaaagatgcaatccttggagagttgtataaatcgtatgtgggggtatgcaaatcttgtttaattcctccagcgggaatcttagaattttcaaacatgtgcagagtgctaaatgaccagggccttattaaacttggacaatctcgagaggataaattgagaagagtgtcacctaaaatagacgagggtgatattacgtttgcattgcagataagtttatttggttcaaaccggtgtcttcaactattcattgtatga

SEQ ID NO: 60800 - DNA, 861 bp, Glycine max
  Peptide Sequence Number=SeqID_177578
atgcagaagattatcaacttgagcccatggaactttgacaaaaggatcattatattggtggaactgaagagtgatgctaacctggaggagtttgatctctcaacaagcctgttttgggtccaggagtcagacctacctagagcatcgaggtcggaggcagtggcacaaactatagggaattccattggaacttttttgacatgggatgatattgacgaaattatgtatggcaaggttatgagaataagggtgcagatctctcatcctttcttagcaaatgatagtgttatcttcactagagccactctagaaaaagcttctcacttggcttttatcattagacagtatgaagaagccttcgggcaaatggctatggaaaactccatgacttacttggggttgcctacaattgttggcagatccacaacttttgtatttcaatttgttaaggaacgtggttggaaaaagttgaaagggtggaaggagaagttcttgtctcaggcaggaagagagactttgattaaggcggtggaaatgttgatgagaagaaaatccactggatcagataggataaaatggcaaaaccaaagaattgtgatggaatgggcttcagaatggtttcaagcttcaacaaagctcttttgggtaaacaatggtggaggattctttctcggccaaaatcgttcatgtgttaaggggattgtggagaaaggaattatttggaaagtgggggatggaactcagattaagtcctggacaaatacgtggatcccatccaatgtcaagttcaaaacctcagctcaaccccaagatgatgatgataagagtttattagtctttgagcttacaaaccacaagtag

SEQ ID NO: 60801 - DNA, 501 bp, Glycine max
  Peptide Sequence Number=SeqID_177579
atggatagaaaaaaagaggcaaagctaagcacacacagccacaaagacagaagaaacgatgcgtggagaatcgaaacgattcgggcaagaccgaggcatatgggtgaacttcgaggcaatcctgaacaagctgatgtaccagtagttgctagattccccatgattgggcaagctgatatacctacaggtggacccaacaccaacccacccaacttgtttccccagttcgaagcattaagagtgacggtgcgagaaaaccccccaaattttgcagcctatacttcaggaactaggacaataaaatcctcagctaatgtagatcatcaagaggacatacttgaccttataaatgaaccagaaggggacgagagaattagccacaagactcagcatcagagccatggccatgttgagaaggatgaatcatgggttccgaagaaaaagggatatctagggagatgtgaacttcatgaagtggttcatgattatgtgtcttcatga

SEQ ID NO: 60802 - DNA, 405 bp, Glycine max
  Peptide Sequence Number=SeqID_177580
atgacagatgaaccaaaacaaatttatcacaaaattatgcaagctgtcaacaacaatgaaggtggcatgtttttcctatatggatacggaggtacaggaaaaacatacatatggagaacattagcaagttcactgagggcaaaaaatcaaattgtgattatggttgcttctagcggcatagcttctctattattgccaagaggcaggactgcccattccaaatttaagatacctgtgccaatttttgaagactcaacatgcaatatacttcaaggaagtcagctagcagaattgttaaatcaaacaaatatgataatttgggatgaagcacccatggctcacaaattttgttttcaagcacttgatcaaagtttaacagacattattaaagaaaaaaaaatctga

SEQ ID NO: 60803 - DNA, 1581 bp, Glycine max
  Peptide Sequence Number=SeqID_177581
atgcagaaaaggattgaagatcttaaaggagtggggaaagatgcataccaagaaaccttgtggggatcccgatgtaactacactgagaataggtatggccaacaatcagcggtgacattggcggcacaactacaggaacacggaaggacaaattggagggatgcaccggacgtcttcattgcgaagaaaaaaaacagaagtggtcggaagtatggctttgttagattcaagggagtggaggaagtggggatgcttgaatgtcagttggacaacatggttattggggatttgaaactgcatgccaatctcccaaagcatggaagggagccagtgataaacgacaaatctatcatagacatgaagcacaaggtagggttagtcatggacaaggtagcagaggatgagcagcaacaaggcaaaaaggaaacagaacacacgttcaagaacagaggactactaaagcaacatccacaacgaatgcaatccccagtctcgtacgcgaaaggaaacaacaacatggagaggagatgttttccaaggcatgtgactccaacgagatcaatctctcattcgacgctgcagccgagtatacccatagaggaaaataaatggtactataatgcgtgggttggaagattaaggaacttggtgctattcgataaaatggaagatcaaatcatgtgggttggaggagaagatatcactcctaaatacctaggtgatgatatggtattattgttgggactcactgatacaagagctaaagaaatgtgtaggaagggagcttgttggggaatcccactacacgcatgggacaaggagaatattaagaagaatgtgcctgcggtaggggaagtagtggaggtggatgatgaggttggcgaacttcagcagctggatagggctcgggagacatgctacagtccaaacacctgtaaatggcatatgaggagcatgatggggtcatcagaggagattagctctaatgagagcaaaatggggttgccattaaccgcggccaatgagtcatcagaaagcaagtttccaatgaacatcagcaatgaaaatggaggaggcggaaaactgggaggtgttgctcgtgataagcaattctccgacggacaatgccccacgcttggacccaagggaataccctatggacctactcaacaactacagtctagaggcaaggatacgaaacatacgacagccagagatcacgaggaagagacaggagggaataaggaaggggggccatccaggttagcaaattttgaattaaagtggagggggtcacaagctcttgaggaagctgaaagccctttaatgggccttgctactcaaaaccacaatggaacaaatgcaggagaaaaggacaacttggaagttaaatcaaatgggtcagctcacacttggcaagtatactcaagaaataaaggacgtaaaaagcaaatgggacttaacaaaacagctgacctcaaagttggacattcaacacacaaaaataccaatgcctcacgtatatgtaatatatcatcatcagtgatgaggggtaacaggctgaaggaagtggctggatag

SEQ ID NO: 60804 - DNA, 624 bp, Glycine max
  Peptide Sequence Number=SeqID_177582
atggtaaagagagaaagaatagatatattgtgcctacaagagactaagaaggaacaagtagataaggttgtatgccaagccttgtggggtgatgcggatgttagctgggaactgcagccagcatgcaatagtgcaggtggaattttatgcctatggagtcaaaaaacctttagattggagaggaagcacattggctgtaatttcatttatttggaaggaatttgggttgctgatggagaaaaagtaaatataatcaacatctactcgctgtgtgatctgaatcagaagagaattttgtgggagcaaattagacggctaagaaactcaaatatgggtggcttatggtacattttaggtcactttaacagcattagaagatcatctgaaagagtgggcacctgtcatagagggcaagatgaaaggagtttgcaggaattcaatgaatggatagcaaacttacaggtggaagatgtgccttgtgtagggagaaaattcacctgggaccgaaacctttctgggttttggattgttgattccaagataaaacattcagaaaagttgtccaagagtgctggacaaccaacaatgtcagaggttggggaggcacttatttttcaatgctga

SEQ ID NO: 60805 - DNA, 1617 bp, Glycine max
  Peptide Sequence Number=SeqID_177583
atgggagaaccaaaacgaatctatctgcgtatctttgcgctgctcctcttcatttccgcctcttcgtttcagcttctccgcgctttcgatgacgcgatcttttacgagtcgttcgacgaggatttcgaagaccgttggattgtgtctcagaaagatgagtacaatggtgtctggaaacatgccaagagtgagggacatgatgattatgggcttcttgtcagtgagaaagtaaggaaatatgctatagtaaaagaacttgatgaggccgtgggtctcaaggatgaaacagttgttcttcagtttgaaactcggcttcagaatggccttgagtgtggtggtgcatatctaaaatatctccgaccacaggaggctggatggaaatccaaggaatttgataatgaatctccatattctatcatgtttggtcctgacaagtgtggtgccacaaacaaagtacacttcattttcaagcataaaaatcccaagagtggggagtatgttgaacaccatcttaagaatcccccttctgtcccgtctgacaaattatctcatgtgtacacggccattttgaagtctgacaatgagttgcaaatattgattgatggggaacagaagaagaaggtaaatttcttatctgctgatgattttgaaccccctcttatccctcccaagacaatcccagattctgatgataagaaacctgaggactgggatgagagagagaaaattccagaccctagtgcagtaaagccagatgactgggatgaggatgcacccttggaaattgttgatgaagaagcagagaaacctgaaggatggttagacaatgaacccgaggagattgatgatccagaggcaacaaaaccagaagattgggatgatgaggaggatggtgaatgggaagccccaaagattgagaacccaaaatgtgaagcagcccccggttgtggtgagtggaagaggccaatgaagaggaatccagcttataaaggaaaatggcatgccccacttattgaaaatcctgcttataagggtatttggaagcctcgggatattccaaaccctgattactttgaacttaagaaacctgattttgagcctatcgctgctatcggtattgagatttggacgatgcaagatggcatattgtttgacaacatcttgatatctaaagatgataaaattgccgagtcttatcgggagactagatggaagcccaagtttaccgttgagaaagaaaaacagaaggaagaagattcagaagctggatcaagtggccttgctggcttccagaagaaggtatttgacctgttatacaagatcgcagatattcccttcctgagtgcctacaagcttaaaatatacgatgtcattgagaagggtcaagagcaaccaaatctcaccgttggaattgttgtcgccgttgtggttgtcatcttgtcaattttcttgaggctcatatttggagggaagaagaagccaacaagggtggagaagacaaacccagaacccgcagaaactgcgagtagccaaggcagtggtgagaatgaagaaaacaaagagaaggaggaatcatctgcccctgcacgtcggaagccaacaaggagagacaattga

SEQ ID NO: 60806 - DNA, 1623 bp, Glycine max
  Peptide Sequence Number=SeqID_177584
gacttccacaccttcccctatgtcatcaaagcctccgccctactccattccctctccctcgcccaatcccttcactcccaagccctcaaattcggtcttttacccgatttattctcactcaacaccctcataggtgtctactccatccaccaccgcgtcaacgatgcccacaaactgttctacgaatgtccccacggagatgtcgtctcctacaacgccttgattcatgggctcgtcaaaacccgccagatttcccgcgctcgggaactgttcgacgaaatgcccgtgagagatgaaatatcatggggcaccatgatagccgggtatagtcacttgaaactgtgtaaccaagccattgaactctttaatgaaatgatgaggttagaggttaagccggataatatcgcgttggtgtcggttctctctgcttgtgctcagttgggggagttagaacaaggtagcattgttcatgattacattaaaaggaataggatacgagttgattcatatttggcaaccgggttggtggacttgtatgcgaaatgtgggtgtgttgagactgcgagggacgtgtttgagtcatgcatggagaaatatgtgtttacgtggaatgccatgcttgttggcttcgcgattcacggggaaggttcgatggtgttggagtatttctctagaatggtttctgagggagttaagcctgatggggtgaccttgttgggggtgttggtggggtgtagccatgcgggtttagttctcgaagcgcggaggattttcgatgagatggaaaatgtttatggagttaaacgggagggaaagcattatgggtgcatggctgatatgttggcgagggctgggttgattgaggaaggggtggagatggtaaaagcgatgccgagtgggggtgatgtgtttgcgtggggagggttgcttggagggtgtaggattcatgggaatgttgaggttgccaagaaagcagcgcagcaagtgatggagataaagcctgaagatggtggggtgtattctgtaatggctaatatttatgctcacacggagcaatgggatgatttagtcaaggttaggagatcgttgagtgctaacaagagggccaagaagattactgggcgtagtttgattaggctgaatgacgagggaagcgtggcacttccggaggcttctatggctaccgtgtcaactcaaaaaactgacaagtgtcttttagcttccacattcagctacgtggctccggaaccttctttctttaccgagactcacatcgctttctgtacaaattccaacggaatcatattcatcaaacaatataaatcagtggaaccgacattcaggccaatactatccagacacagtggtaattggttagcagtgttagaaagagagttggaggaaaggctgcgtacacaacctcaacagacaccaaagatgaaagcgtatgcacctgcggctgattacgggtacgttcaccaccgacaacatgggaagtctgacaagttcatcaagcaatccttcttcaggaaagtggcgcacgtgcaagaccgtagctaccctaaccccattctcagagatgcctatgcttatacccctcgtgtcgatccctcgcacgtgtaa

SEQ ID NO: 60807 - DNA, 1050 bp, Glycine max
  Peptide Sequence Number=SeqID_177585
atgacttcgggatcaaaatcattcaaaaatcaagttattgacatggaagcttgggtctataaaaggttgaagtccgctggggcagttcttgttgcaaagcttgtttctggatcattggcatatgatgatatctggtttggtggcagaactaggaatccatggaatattgaggaattttctactgggtcatctgctggacctgcagcaagcacctcagcaggtatggttccatttgcatttggtacagaaacagctggatccataacttttccagcaactcgatgtggagtgacagcattgcacccaaattttggtactattggtcgaagtggtgataagattggccctttctgtagatctgcaactgattgtgctattattctcgatattgttggtggaaaagatcttgatgatccctcatcaaaacatagctcccttgatgatcgattcctggttgacattacaaagttgactgttggatatcttgatgatgctgaaatggagatggtcccttacaaactgaattacacagttgattctgttcaaggtatcttaaatttcacaatggatgttgacatgctggcccactttgatgagtggcaacgctcaggcgaggataatgtgtatgaagctcaagatcagtggcccactgaactgcgccgtgctggcttaattccagccgtggactatatacaggcacaaagagcacggggaaagctcataaaggaaataagagagtcgtttagcgtggatgcattcattggcagtgcaactgactgggagaaagtttgcctaggaaatcttgttggtttacctgtgatagtagtaccaacaggacttaaaaacatctctgatccaccacctgatggaactagaagaactaccatcaccacgggcatttatgctccccctaactgtgatcacattgctccggagttggcaatgacttaccaagaggttaccaatcaccataaacagcgcccacctatcaaagatctggggccaaatgataagtttcctgatccagttactgctacttaccctcccagg

SEQ ID NO: 60808 - DNA, 231 bp, Glycine max
  Peptide Sequence Number=SeqID_177586
atggagggttttttgcctctggtttacaaagcaattaagaaacgcaagactcgcaggcaataccagtgcctttcttcaggggacatgaacgtggctgagttctaccctccaagtactcatcatcatggccatggctatattaattacatgcaggagccttcaacgtcaacgcaaaaagtggttgatgatgatgatgatacagaaaacattggttatatgcgatataattct

SEQ ID NO: 60809 - DNA, 309 bp, Glycine max
  Peptide Sequence Number=SeqID_177587
atgttagttatttacttgcagaacgaagatggagggtggggaatgcatatagaagggtccagcataatgtttacatcagctttgaactatgtgaccttaagattgcttggagaagacattaatggtggagaaggtgctatacaaaaagcaaggacatggattcttgatcatggtggagccacttatattccttcctggggaaaactctggctttcggtgcttggcgtatatgaatggagcggaatgaagccaatcccaccagaaatatggttgtttccctattttgttcctttatccaggttgtcatga

SEQ ID NO: 60810 - DNA, 717 bp, Glycine max
  Peptide Sequence Number=SeqID_177588
atggcggtttctgaatcttcgtgtctcaattttcagtcgctgcttcaactcgctaatttttacgccatctcgagttcgtcctcgtcgcacgcgcgcaaatcagtaacactcggcgataagatcggtttgtgctacgtcttcaagaatcgtttatcttcttctgacgagttggcggtcgcgtacaatcccgtgggaaacttcaacctacgcgatttccaccatgctgttaacaacttaccttatgatgcttttctggctgatattgatagcatttccgatttaatgatttcaaatgttttgagtgaacgagtgttgtattcgtggcaaggcaaagatatagagagaaaagtgattgtcataacttcgaccttgcctgaagacatagactctatagtgcagaagagtcttatgaagtcgatccatttgactgatacgcgtgaaaacataaacaatttccgtcgttgcatttctcatcttgataattgctcagttcagacctatattccagatttcagagtattccacagccttgttaaaagatggctgctgattttgaaagatgacatggaagagccgttgctagctcgcctcatcttcaaagacaatctttttgattctgtgaatcatatattctgcaacctgtttgcaccagtcaatccaataaccaacatcttcactcaatgtcgggtaatagtgcttacaatccacattgactga

SEQ ID NO: 60811 - DNA, 465 bp, Glycine max
  Peptide Sequence Number=SeqID_177589
atggatgaaagagatgatgagaaatgcccagcaagtcacgctaagtgtgcatgcaaaagcaacactgtattaagtgactacgcactgagcctgacatgtatgaccccttcaatcttgaaaatttcctttaacaggaaaacatggcaaaggttgaagacttcaaatatacttcatgatgccatccctcatccacatgaaagaataggtcatccaatgcatatcaaggtgatgcgtagatgcttctggtctgggagggatgcaccttccgttggttgggtatactccgggtctcataattttagtgctgctgcctgggggcgacaaatttcaaatccatttaggacaaaggctgatagacctaaaaaagaggatccttctgtgaattatgggcttcatatttgcaattatgagcttgggattatattacttttcctcctacagaaaataatggttgtcttgaagtaa

SEQ ID NO: 60812 - DNA, 843 bp, Glycine max
  Peptide Sequence Number=SeqID_177590
atggcagaggctccttatcattgctattatattctgcagccatcagataccggaccaatgcttatgagggtgagaactagccccctttcgctgctttttatccctcttgttctctgcacattcacacaaagtagaataatgcgccttgcaggggcagaagaagtccttcgagttcctgataatcaattagttgattcatcaatcaacaaggaaattgagagctctgttcaagcctgtttgctaaagatcgatctaacagactatgatccattgctgcatgaaagaggctttcatcaaaaactaaatgtgcttgtcaaagagagcctacaattttggtcagtattttctaaatcagaaggtgcattttcagaattaagcgcaagtcaacagccttcgtcagaggtgatgggtaaagcagaaccagcaactggtgtcatagtgaatgaggaaactttggcattggatattacggatcatgacgacaaaaccatggcctgtattacagaagaatggaagcaattggttgtaagcgaagaccccaagttgtactctccctctagtatgcccaaagccaagttgggtcaatcgagtgtatcgccacgagatggtaataggaagttagacagagaaacttcaaggattttggagagattagaggttccgaggccattaaaagcaaagaccacctctcctggttcaaatgaaagttgcatgaaaaataccagtgtacccataaagaagcctcttgtaccattccagccaactcaaggtacagaacaagtccttgttggcagccagctaatgaaacctaatttccagaggcagaaaaggaaacataaatga

SEQ ID NO: 60813 - DNA, 1233 bp, Glycine max
  Peptide Sequence Number=SeqID_177591
atggctcatttggatgtttgtcatcaagtcaggttcattggtcagcttgaggaatatggaagtagactttcttccagtattcctacggtagaaggatcaaaagataaagaagaaatcgttgaagttaaacctatcttcatgccaaattttaagaaaagaaaacgccttagccttaatcgtcttagagagatcaaagcagatatgtgtgcaaggcaaagtagtggcacacctaaaacaaagtgtgaaagcatagacagatggtcagctaagaggtatgagttggctcagcaaagcatgtgggaggtcttaaagggcgaaggtgcaacttttgaaaatccaattacccgacctgcactaagaatggctgcccgtaaacacattggtgatactggactgttagaccacttactgaagcacattgatggtaaagtggcacctggaggaactgagcggttccgtcgatgtttcaacaccaagggaatcatggagtattggttggagagtgctaatttggatgagattcgccaggagactggggtgcaagacccttatattggtgaactgaaaatgcttaaaattgaaatggcccagatgaagaaagacatgcaagagctcattgccaagaagcaagaaaaaagtgaaatgtgcttgatggaggagacacagaaaagttttgtgaattggaaagctatgactgagcagcgtgtaactgagattatgacttctttgaagggtgtgcagggcatgcatgaaaacatgttgatttggaaaactaaagttgagcaacagctaatagaaataaccaataaattgagtgatgtgcaaaaattgagagaagacaccacttcaagttatcctccagtaagttgggaggattggctaggaagcaccaacacagacaatattcagggaaatgaactcaacctggagctgcttaatgttccaaaagaggttgtacttcaagatctgaactcaaccctaccaactcagctgcaatgtgtagaactgactaacatgaatagcaatttgctggagttggtgccaaagataaaggaagatcaacctaatgtgacccctgattcttctatgactgttaattcaaagtcagaccttgacaattcattgatattgtatcaggaaatgatcatggaattatttacatcgagggataaaatggagcagcagttattgcagatagcaaatactgtatatggcatgctgacaatgaaatag

SEQ ID NO: 60814 - DNA, 570 bp, Glycine max
  Peptide Sequence Number=SeqID_177592
agcacaaaattagatgatataattcttccgtttgttgtgcctgctcctaaatatagatctagtgatcggccagctacaaagcaggctatgagggaggttatggttgaacttgctgagcgagagaaggagaaacatacagaagaagaaatgatggatgagcttgatgatgaagaggaatatgttgagcttccagaagaactggaagcaaccaattatgttgaacaggagaatgaagatgagaaagcatatgctgatatactctggagtcaggatttgaaagtggtggctacacatcatgcaatagctgcagcagtgaactgtgcaataaccccaagaagatacaagatcttgatactttggaaatgtgcaattcgacaagaggctgttggtccggctgttaaatggattccagggaaaaacgtattggaatctcttccaaaaactgagcaattaactcaaggtgttgctgatgctaacctagactcaggacaagatgatggtgaatgggtggtatatgcaaagaaatccaagaatagagcctgcgaaaccatggagtcctccagttcataa

SEQ ID NO: 60815 - DNA, 525 bp, Glycine max
  Peptide Sequence Number=SeqID_177593
atggagaagccaccaatccacggtgcagcagcatcagattgcaaaccactaaccacctttgttcagacaaactcagatgcattcagggaagtagtacaacgtttaacaggtccctcagaagcaagtgcagcaaaagaaggagatgcaacaaaggttgcaactgtgaaaaggaacacatcaaaacttcatgagagaaaaaaatacatgaagccaaaacttgagattgttaaacccacttttaattatagaacaggtgcaagttttcctccaagccctggatcagggagttcaagccttcttccaagccccaccaccccttcaacactgttctctcagttgaaaattaatttggaagatgaaaagaaagaagagtcagtgaacacagcagaagaagaagaggagaaagcaatcaaagagaggagattttatttgcatccatcaccaagggctaaaccaggttatactgagccagagttgcttaatttgtttcctctggcatctcgtaatgcaagtgagaaagtataa

SEQ ID NO: 60816 - DNA, 435 bp, Glycine max
  Peptide Sequence Number=SeqID_177594
atggttgcttctaacttctcagagtggctaaggagatcaaaggaaagacactcagctgtactttgtcctcaatgcagagcagctgttcattttgttgggaaaaaccactttttgcgtacctttgctgagtctagagctttggggttcaatagcccctcaggctcagctctaaatgagtgtacatccataaccatgaagggggaggaacttgatctgattaaattaaagtatgttaatcaggatatgctaagggccgattcttcactaagacgctcacatgacgaagttgcgcttttagatacttatgcattagtacgaccaaacctggtgagtcattggatctggaaagaagaatcgaaaggagggcctacacaccagatgatcaaagtgatggcacatatcagtgctcacagtgtgttttgctgtccatcataa

SEQ ID NO: 60817 - DNA, 1728 bp, Glycine max
  Peptide Sequence Number=SeqID_177595
atggctgaggagactccaaaccagacaaccacaccaccccctcctcaagagtcagtggtgcaagtggaggaagtggtggtaaccgatgttccacagcccgacaaaacaacaactacagttccagttgaaagagattcgcaacctcaaccttatgagccagagaagaagaagcccgttgaggaaaccgtcactctcgagactcacctctccaaacccaacaatgctgaccacaccaacaacatccctgaattcattgaagaaagcaccaaactttctgacctcccagaaaacgaaaacaaggctctccaagagctcaagaagctcgttcaagacgctctcaacaatcaccacttctcttccaaacatgataacaagaagccaccacaaacaactgctgctgacaacaaggaagaacaacaaccacaagaagttgtaactgaaactaaacctgatgctgccccagcaaaaaccgaagaggagcatgttgaaacaaagaaggaagaggaaaaggaggaagaagaaaaggagcaagtgacagaaacgaaggaagaagaagctgcggtggatgatgatggagcaaaaactgtggaggccattgaagagaccgttgttgctgtttcttctaccgttcagcctcaagctgaagagaaagcttcagaaccagaagccaccaaagaagaatcttcaccgccacttccacctgaagaggcttccatttgggggataccgctgcttgcagacgagaggagcgatgtgattctgcttaagtttctgcgcgcgagagagttcaaggtgaaggaggcattcaccatgctgaagaacacgatccagtggaggaaggagtttgggatggaggagctgatggaagagaagctcggggatgagttggagaaggtggtgttcatgcacggctttgacaaggagggtcaccctgtgtgttacaacatatatgaggagttccagaacaaggagttgtacaagaagactttttctgatgaggagaagagggagaagttcctgaggtggagaattcagttcctggagaagagtataaggaagcttgatttcaaccctggtggcatatgcaccattgttcatgttaatgacctcaagaactctcctggacttgccaagtgggaacttagacaagccaccaaacatgccctacaattgcttcaagacaattaccctgaatttgttgccaaacaggtttttattaatgtgccttggtggtacctggcagtgaataggatgataagcccttttcttactcagaggactaaaagcaagtttgtctttgctgggccttccaaatcaacggaaacccttttgagatatatagctccggagcagcttccggtgaagtacggtggactaggcaaagatggggagttcggaaataccgatgctgtcacagaaatcacagtgaggccggcagcaaaacatactgtggaattttcagttactgagaactgcttactctcttgggagctcagagtaataggatgggaagtaagttatggcgcagaatttgtgccaagctcagaaggaagctacacagtaattgtccagaaggctaggaaggttgcttcatcagaagaaccagttctttgcaacagttttaaggttggtgaacctgggaaagttgttctcactattgacaacacaagctctaagaagaagaagctattgtaccgcttgaagaccaagccttccctctctgactaa

SEQ ID NO: 60818 - DNA, 657 bp, Glycine max
  Peptide Sequence Number=SeqID_177596
atgggtagaactccttgctctgataaagagcaaataaacaaaaagggaccttggtccaaagaggaagatgaactcctcatcaactacatcaaccttcatggccaaggcaattggaaatccattcccaaagcagcaggcttgcttcgatgtggcaaaagttgcagactcagatggacgaattacctgagacccgatctcaagaaagggaactttaccgaagaagaaagtaacctcatcattcacctccatagcttacttggaaacaaatggtctcaaatagctacaagtttacccggaagaacagataacgagatcaagaactactggaaaagccacctcaagcgttacctctatgccctaggaatcgatcctgtaacccataaaccattcaaggaagacaccaacaccacaagtactccaccaaataattctatggccaccaccacaagcaccatcccccgcatctattattttaatgtctttctcaattcaaaggtgcatattagcgccgatgatgattattcagctgatggtggtgcagactcaaatagcagcagtggtgttaccatagaggaagcttctcctcaagtcaacttggagctttccattgctccaccctctcagcctcatgaagatgctgcttccgtgaaaccctga

SEQ ID NO: 60819 - DNA, 645 bp, Glycine max
  Peptide Sequence Number=SeqID_177597
atgtatcgctgctctggaggccatgtggagtcttctactaacattaatcccttgaaaaattgtgtagtgggaagaagtactttaggatggtttgaaactcaacccttggtttctgagcaattactcaacaggcgcttgttgtcagtggaagctttagtcactcccacagttcaagatttttctgatacacctcttattggtgatgataagattggagtgttattgttgaacctcggaggtccagagactttagaagatgtgcagccttttttgtttaacctttttgctgacccagatattatacgactgccaaggttatttagctttcttcaaaagccattggcccaatttgtatctgttttaagagcacctaagagcaaagaaggctatgcttcaattggtggtggatctcctcttagacgtataactgatgcacaggcacggcactttccaataacttattttccatacatcactacagctgaagaattgaggaaatctctttggtcaaagaatgtcccagccaaagtgtatgttggcatgcgttactggcatccattcactgaagaggctattgaacagcatttccttaagattatgcctggtactgcctttttttacaagtttcaatgggttcttatctga

SEQ ID NO: 60820 - DNA, 1086 bp, Glycine max
  Peptide Sequence Number=SeqID_177598
atggataagtatgaggctgtcaaggatttgggagctgggaattttggggtggctaggctcatgaggaacaaggagaccaaggagcttgttgccatgaaatacatcgagcgtggccaaaaggtggttttgacccccacccatttggccatagtgatggagtatgcggctggaggagagctctttgagaggatatgcaatgctggcaggttcagtgaagatgaggttgacaacttactctcagtattttctgctttatttcacactcttgcttttagtaccattactattgtagccatatctcatttatttttccatttgattgttcaggctagatatttctttcagcagctgatttctggtgtacattactgtcatgccatgcaaatatgtcacagagatttgaagctagaaaatacccttttagatggaagccctgcaccccgcctgaaaatttgtgactttggttattccaagtcatcattacttcattcacgaccaaaatcaactgttggaactccagcttatatagcaccagaggttctttccaggagggagtatgatggcaagttggctgatgtatggtcatgtggagtgactctttatgtcatgctggttggagcttatccctttgaggatcaggatgaccctaggaattttaggaaaacaattcagcgtataatggctgttcaatacaaaatccctgattatgttcacatatctcaagactgcagacacctcctttctcgtatatttgtagcaaatccattaaggaggatctctcttaaggaaattaagagccacccatggtttttaaagaatcttccaagagagctgactgaatcagctcaagctgtctattaccagagaggcaatccaagcttttcaattcaaagtgtggaggagatcatgaagattgtgggagaggcaagggaccctcctccagtatctagacctgtcaaaggttttggctgggatggcgaagaagatgaaggggaagaagacgtggaggaagaggaggacgaagaagacgagtatgacaagagggtcaaagaggttcatgcaagtggagaatttcaaatcagttaa

SEQ ID NO: 60821 - DNA, 2235 bp, Glycine max
  Peptide Sequence Number=SeqID_177599
atgagagataatggttccttaacatggagtagtgattatttgaagcaattgaatctataccgccagagggtttggatgtgtaaagtcactggaaaaactggcttgacttatgaagaggctttggtgtctgaacaacttgctaccgagaaagttcaacagtttcctaaagaactgatgactgttgctttaagcattattcaatacagtatgctccctttgaaggatcttgctgattctattgctgagaaattgcaggaatgtttgtttgtgggtgctgaactacatgggaaaaaggatgatggagttcatccatgcaaaatattaaaagtcattcagaaaggagttgacacagtctcttatgaggtagcttggcttgacaaaaacaagaatattagagaacaagcagaagtcagcgcagaagatttggtgcataagaagccgctttttagtagaaatattttgaagtcttttattcgtgagtctacatatcggaatgccccttgggttttacatgatgagctagcaaaaaatcatggaatatcaactgacattcctgaggacttacaaggaagggttttctacaaatatggacttttagtttgctccaagaaaaggaaaaacgaggaatcactggaagacactgataactgtaaaaggaagaagttggatggcgcacaagttgacgattctagccaagagaaagaaaatggtcaacacaatgatgaagcaatcaaataccccattgatgatctattggtgacgcctagtccagatgatcctgtattcactgatcgtccttctccagcaaaagacttcaatattccaatgagttgtgtaggggaactcttgatggtttgggattttcttagttcctttggtagactgttgcagctgagcccctactctctagaagattttgaatttgcaatctgccataaggatagcaatgtggctctccttatggaatctcatgcagcactttttcgacttctcatcaaagataaggatgaatactccttggttgtgaagaaccgaaaactgaagtctaagattacaaccaataattggacagaatatttatgtcattttctagagatgatcaatattcctgaactacggcaacataaaacaactataaaacggggacattatggccttgtagatgccagtgctaaattaaaaatcttaggcgaattggtcaatcgagcccttgaaactgcaatattcagggaaaagttagatgagattattgaacagcggcaggcacttggggccactagaagggaagaagcattggaaaatggtaggaggagaagagaagaaaaggagcggatgaaagctgagtcagaaagcaatggatttgtggatgggcatctaaacggtgcaaatgtcctagcaaataatattcacggtatacaaaatggagacgtgggagagaaaagaattatagagatagaaccatcagggcaaaacgatccattgggtagaagtgggatcaagcatttaaatcctgctccgaaaaagacacttaagaagttaaattcagagctgaaagaaccaacggaaaatggaaaagaattatccagaaaggaatcaccgaaacagttgaaggctgataaggattcatcagagaagaatagtaaagaacagaggaaagaatatttcgaacgggagatggagaaacggtttattcgtagaagcccattaggtaaggacagagatcacaataggtattggtggttctgtcgctatgggaggatatttgttgaaagctgtgactccaagaattggggatactacagcagtaaggaagagcttgatacattgatgagttcactgaattgcaagggtgagcgggaaagggcactgcaaaagcatctagaaaaatattataatacaatatgctcagaactccagaaaacatcgaaggatttgatgcacaggtttgtagatgagtctgtgcttcgtaggtctactcgtgttagagctcaacctaggcagaacccctccgatgcttgcctcagatatagaaacaacaaggataagttattccagtactgccagggcacatgtatgtatcctttaggattttcttacatgaacacaactcacttttatctcctgggcattagggaatctctttggaaaggaatgaccattgaacgagaccgtgcttgtcaaactgaaaaaattcttagcagcagtattttaaaaattgaaccaaaaatccaataa

SEQ ID NO: 60822 - DNA, 300 bp, Glycine max
  Peptide Sequence Number=SeqID_177600
atgggaactatacatagaaatctgggtatatggtggcaaaaggtgactctcatggaagtcatgcatcaactagtgcagttccaggagattttgaaagtaaagacagtcccagagtgtagtaacttgatttggagggcgtcttttaaatggagcattcaagtggttgctcatatgtgtttttcccacacatttttgaaactgatagccaaatgttacatgaactttggaagcgcaaaagtacacatgacctctcttatgctgccagatttctcaacgagtgtggaactttgtctcacgtag

SEQ ID NO: 60823 - DNA, 1030 bp, Glycine max
  Peptide Sequence Number=SeqID_177601
ggatggaattacaaagcttgttgtgcttccactttatccacaattttcaatttcaaccagtggttcaagtcttcgtctcttggagagtatattcagagatgatgagtacctagtcaacatgcagcacacagtaattccttcatggtaccagcgtgaaggatacattaaggccatgacaaatttaattgaaaaggagctaaaaggttttgactgccctgaggaggtcatgatattctttagtgcacatggggtgcctcttgcttatgtagaagaggctggtgatccatacaaggcagagatggaggaatgtgttgatttgatcatggaagagcttgaaaagagaaagataactaatgcatacacccttgcttatcagagtagagttggacctgtggaatggttaaaaccctatacagatgagacaataattgaacttgggaaaaagggagtaaaaagcctgctggctgtaccaattagcgagcatattgaaactctcgaagaaattgatgttgagtacaaagaattggctctaaactctggtatagaaaaatggggtcgtgttcctgcgctaggaactgaaaccactttcatttcagatttggcagatgctgtaattgagagtctcccttatgttggtgcaatggcagtttcaaaccttgaagctcgacagtctttggttccactgggcagcgtagaagagttattgacagcatatgactcgcaacgtagggagttgccaccaccagtaattgtgtgggaatggggatggaccaaaagtgctgaaacttggaatggaagagcagctatgcttgctgtgcttcttctgttgtttttagaagtcaccactggtgaagggtttctgcaccagtggggaatattgcccttgtttagtggagagttggagaaggagagggatttctatgacatcaagttggacttgcttacgatgactgtaggaagagttgagttggagaaggaagaactagaaaaggggtctagacttgtgtcgcgggaagaagagaagaagtga

SEQ ID NO: 60824 - DNA, 642 bp, Glycine max
  Peptide Sequence Number=SeqID_177602
atggtcaactacaaagttgcaagtattattccaaatgactttaattggaatcaactaaagaagttcctccatgatgcatgtttctatgtctgggatgacctatatttgtttaaaattggagcagataatatattgagaagatgtgttaccatggaagaagccgggagtatattaaggcattgtcataattctccttgtggtggacattacaatggggacaagacaattgctaaggtgctacaagctagattcttttggccttcttctatctttaaagatgcccatgatcatgtgcttcattgtgatcatgatcatgtgctttattgcaaaacatcaaggaaagttacagaaggtgagaagcagaagcggaagctgcaacagttagagctagaggagataaggctcaatgcctatgaatcttcccaaatttataagcagaagatgaaggtgtaccatgatcgaaagttgataaagaagaactttcagctcgaacaacaagtattgctattcaattcaagactaaagctcttcctaggtaaactcaagtctaaatgttctggtcccttcaccatcaaagaagtgaagccttatggagcagtgaagctgatagatcttgccttaagtgaacctgagcaaagttag

SEQ ID NO: 60825 - DNA, 165 bp, Glycine max
  Peptide Sequence Number=SeqID_177603
atgtggaaagagactggggggtccgtagcgcctgcagcaggggcgccaccagtagtgcctgacccctgggcactaccaaaggcgcctgcgtcaggggcgctacctccctgtgccacgtgtcacgtgcacagtggaggcgcctgggtggggggcgctttgcaataa

SEQ ID NO: 60826 - DNA, 1650 bp, Glycine max
  Peptide Sequence Number=SeqID_177604
atggctcaagatgatgctaaagaagccaaggctggagatcccgtcctaggaataacttcaacaaagatcaatggtccatctatccggcctcccaatcaagggctgaatctctatgagaggaccaccaagctagaagatacttcaactcaacttatgcaggagggccaattagctaagcaactagatgaaaggtccacgggaagttttgtggccaacactgagaagaatcctaaggaagagtgcaaggcggaaatgataaaaaatgagagtaaggagagttgtggtgaggtcttaaccactaagaccaagagtcaattagctcgggaggctagaaaggagataaccttagacctagtgaaggaagtcccatatcccttggtgccatcaaagaaagagagggggcaatattttgctcgttttcttgacatcttcaagaagctggagatcaccattccctttggagaggccttacaacagatgcctttgtatactaaatttttgaaggatttgctcacaaagaaaaggaaatacataaataatgggagcatcatggtggaagggaattgcagtgttgtgatccagaggatcctaccaaagaaattcaaagacccaggaagtgtaaccatcctatgctctattggggatgtgtcaatggaccaatatggtgtagttgaagatgtcctaattaaggttcaccaattcacctttccgatggactttgtgatcatggacatagaggaagattctgatatccccttgatattgaaagtaaccttcaacttgttggaggcgataaagcatcccggtgatagtaaagcctgcttcaaggtagaggcaattgagcaagaagctaacctcgctatgcaacacatgactactcactccctattggaaaaggaattgataaatgcctttgaagaattgaagaaagatagcccaacaaagaagcccaaagtggagttgaaagccttacccactcacctaaagcacaaggcagctattgggtggcatatctcttatctaaaaggaatcggtccttcctactgcatgcacaagatcatgatggaggatgactatagactagtgagacaatcgcagaggagactcaatccatctatgaaagaaaaagtgtggaaacaagtactcaagctacttgaggctgaacttatctaccctatttctgacagtgcttgggtgagtccaattcaagtggtacccaagaaaggaagaatgattatggttcgcattgaaaagaatgatctcatttcgacttggattattactggatggaggatgtgcatagactaccacaagctcaatgatgccacaagaaagaatcactttcctttgcccttcgtggatcaaatgttggagcggtgcatgctagccatatttccttacatggtagagaagtgcatcgaagtttttatggacgatttctcaatctttggtccttcttttgactgctacttgaccaatctagagcttgtgttaagatgttgtgttaaagatttctccaacattgccaggcccttgagcaattttttgaacaaagatgcagtgtttaaacttgatgaagaatgtttgacagcttttcagaccctgaagaacaaactagcatctactccaataatagtggcacttgactag

SEQ ID NO: 60827 - DNA, 204 bp, Glycine max
  Peptide Sequence Number=SeqID_177605
atgggagaggtttgcaggagagaaatgtatgctggaggagaagagtttaaagcgagatgttatggacttagcacgtctttcatatcaggatatccatgcttagcacaagatggcgcgcttagcgcctacagacttatcgagaaagacatcgatacttcattaatccacttcactagcacttcctacacccctataaaatcatag

SEQ ID NO: 60828 - DNA, 507 bp, Glycine max
  Peptide Sequence Number=SeqID_177606
atggcatcatcattaccaataccagaagtatcaccccccttacagaaggaagctagactcctagccaggaaacctgagataggaatgcctctggtgtcatcacttgctactggagagataactagtgaagactctacatcaagagatactggccatggtggaggctttgcagcatggggaaaagctactccaactgagacgaagaagaaggctggccgggggaagatgaggtggctggaggaggaatggttggtggtggtgctggtggagcatcctgagtggctcggggaagccgagcctggacgtactggactgggcaatttgggtaatctgcaaagagatcatgttgtccacatccatgtccatcttcacaatgagtctgtatatcacactggcttggtccatgttgaggtcagaggtgtgggaggtaggagcgaggttgaagtaggaaagcatactccatgtctgggaaagggtagtgaggtcctttcacataatcttccatag

SEQ ID NO: 60829 - DNA, 168 bp, Glycine max
  Peptide Sequence Number=SeqID_177607
atgcacggtgcgactcgaagaagaaaaaggtgcaacgaaggcttccatgggttcacggctgaaacaaacagtgaagaaggaacggtgaaacgaacagtgaagaagcggataagtgaagagggtgaagacagtgtgaaacgggtttggctaatatttgtgtctttgtaa

SEQ ID NO: 60830 - DNA, 742 bp, Glycine max
  Peptide Sequence Number=SeqID_177608
atggatgatgatgctagaatttggaaatttgctctcaacggaaattggaagaagatatgggccctaaaagttcctcccaaagtcaagcatcttattcggaggattcaacgtgattgtcttccttccagagttcgtcttcatgcaaaaggagttcaatgcccttcaacttgtgctttctgtcacaacaaccttgaatctttggatgtgaacatgcaaaatgagaaagtttgggaagatgttgaaaccgctccagttatggcgatgttactagcttatcaacacttgttcaagtggaaacaagcgcgatacaatccttcttccatggctgcgacccaaaatcatcatgtcccttggaaacctcctttgcctagagatgaatggggacgttttgtaattgccaacactgccaccatgtttggagtcccagaaccaatagaagtagaggcttggagcttactacatccgttgtgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgg

SEQ ID NO: 60831 - DNA, 273 bp, Glycine max
  Peptide Sequence Number=SeqID_177609
atgaccccctccccttcttttctcttctctgcacatcacggttgtcactcttcccttagtgccatcgaccaccaactaaacgccagccaaactaggcatggcacccgtgtggggctggggcggatagtactcccccgctccccgtccccgaaccttaccctgctccctgtccccgtctctgctccccgtggtgggggtattttttgccctgtccccgttcctcagctccctgcggggactctgttttacattaaatttttactacagaaataa

SEQ ID NO: 60832 - DNA, 1227 bp, Glycine max
  Peptide Sequence Number=SeqID_177610
atgaagcctccaaagaaccacaacctcacgcttctccctctatataaacctcttcaccctcgccacgtttgttttcccttaacgcaaactgtcatcttgtcattcaccgagaaagtcgtactgattcctcttcatctttcgttaaagcgagtacttttcgttcttgatctgttggttacgatgtcgtattcaaggagatctaggtattctccttctccttctccttctccatacaagcgatacggtaggagtttatcaagagatgcagaaaatccaggaaacaatttgtatgtgacaggattgtctcctaggattaccaagagagaactggagaaacattttgctgctgaaggaaaagtgatagatgtccatctggtagttgatccttggacaagggaatcccgtgggtttggctttgtgacaatggagactcttgaggaggctgaacgatgtgtaaagtatctgaatcgctctgtacttgaagggcgtgtcatcacggtggagaaggctaaaagacgacgtggtcgaaccccaacgccagggaggtatctaggactgagaactattcgtgaattattattattattatttgtttaccttgctaatccctattatgtattgcattacatacagctcgacgtcgctctccaagttactctcctcgtcgctctcctagctattctcccttcagaagaagctacagtcgctctccctattcttcagaccgaagtaggagtcgttcttactctcctgactatcagaggaggaggtcttactctccatatcactccaggcggaggtcttactctccattctatagccggtacaggtcctattctcgatatgatcgacacaggtcatattctcgatctcgctctccgtatagcaggtcacctgtcagcatgcatgacagatcatactctccctatgaaatacgatatgactcgccggatgcgcactcctacagaaggcaccgttaccgatctgtttcacgaagtgcctcgcctgatgatccttattatggaaggcaccgttacaggtctgtttctcggagtgcctcacccaggccaaggagaaggtcaaggaggagctactcacggagtgctacacctgtttcaaagagaagcaactcacgaaatgtgtcccccaggtcaaggaggagccattcaagaagctctaagaggagtggcaaatgtgagaaacgctactcaagaagctcgagtgtga

SEQ ID NO: 60833 - DNA, 174 bp, Glycine max
  Peptide Sequence Number=SeqID_177611
atggtgatactagactatgacgaggtcttcacagttgcaaacctcaacaccagaaccgaccctcaagagcaggacgcttgcaagggcaattctaggcaataccatgcaggggaatgtggtgctgctcctcatcacaacgaaactggtcgcgagtgttcgaatcacgagaggtag

SEQ ID NO: 60834 - DNA, 2502 bp, Glycine max
  Peptide Sequence Number=SeqID_177612
atggatccgatccaagctgccaatgagctcgctttccgggtcgggttctccggccacagtggccacctccgcctggagccgctctccacggaggagcgccgcaacccgctccgctccattcccgatttcattccgtgggttttccataccatagtgtaccgagtagtaaaaccacctgcctttcctagcgagacgcctgaatctataaagaagtacatagaagagacatatctccagccaagattggatcctgatgatttttcgccagaaaaagttgggaggcagtgggaatttgattggtttgacagggctaaagttcctctagagccgtcattgccacgaactatggtagttccagtttgggaaccaccatttcgacgttcaaacaatggatcagtgaaaggaatctgggaaccaaaatttgaggaggtggatgtagcagatctgacatcaggagctgtagaatctgggccattaccgcgcacttctggaaaggactttgttagaggaagcatcaataatcgtccttttcgtccaggaggtttggatgattcccgaagtttagacagaattcttccagaaggtgcttcaaatggtgaatgggtgcatgaaattttgaatggtggtcctgctcagacaattcctccaagcttaaagcaaggattggactttggcatgctcaagccctatccgtgctcgtggaatgtctgcaaggaagccaattccctcaagagttcatcagatgaaaaattgagtggattgtccgtacaatttgatgacttatttaagaaggcatgggatgaggatgctgttggagatcaagaagatggtcatttatcagaagtggagactattacattggaagctgaagttggtacaactgaggtatccagtagagcacatgagagtgaaatgtcacttgatgatattttgtcagctgactcagaaggatcaaaactgcatttggatggatttaatgatgaaattggacagcagaagaaggaagcttgggctatacatgaaaccagtgaacaaattgtagattcctttcatgaacttgttcctgacatggcgctagagtttccctttgaattggatgcatttcagaaggaggctatttattatcttgagaagggggaatctgtttttgtggctgctcacacatctgctggaaagacagtggttgccgaatatgcatttgctctagcatcaaaacattgcacgagagctgtgtatactgctccaataaaaaccatcagcaatcagaaatatagagatttatgtgggaagtttgatgttgggcttcttactggtgatgtaagcttgaggccagaggcttcttgtctcatcatgaccacagaaattttaagatcaatgctctaccggggtgctgatattattcgagacattgaatgggttatatttgatgaggtgcactacgtcaatgatgttgaaagaggagttgtttgggaagaagtaattatcatgcttccaagacatatcaatatcgtcctcctttccgccacgaaaagagacaacaataacaaaagccttatcccaccaggcaaggttcctaatactattgaatttgccgattggattggcaggacaaaacaaaaggaaataagggttacggggacaacaaaaagacctgtcccattggagcactgcctgttttattctggagaactttacaaaatttgtgaaagtgaaaaatttctgcctcagggattgaaagctgctaaaaaagaggcttcaagaaaaaagaatttgactgctggtggtggttctggaccaaagccaggtatttcaccaggtcatgacaaagctcgagttcaaaaacgtgaaaatacatctcacactaaacatcatggagctaatttctatggaactggtagaggctatcagaataatggcaatggccagagcaattgggaactgaggagagcagatgcttcaatgttgttgatgcttatcaacaaactctccaaaaagtcattattgcctgtggttatattttgtttttctaagaatcgctgtgataaatcagctgatagtctgactggaactgacctcactagtagctcagagaaaagtgagatccgacttttctgtgacaaagcattttcacgactgaagggatctgacaaaaatttaccacaggttgttcgagtacaaaatcttcttcgcagaggtattggtgtgcatcatgctggccttcttccaattgtaaaggaagttgttgaaatgctattttgtcgtggggttatcaaggtcttgttttcaacggagacatttgcaatgggagtcaacgcacctgctagaacggctccttactttgcaaaggtatggaggagggtaattgtatgcactcgcagccttcccctttcatatgcaaagatgctgcatccggatttgagcccatgcccaactgatcaccaaggcacaactttcccgttgtgcccaggctcaccctctactttaagttttgcgagaatttga

SEQ ID NO: 60835 - DNA, 435 bp, Glycine max
  Peptide Sequence Number=SeqID_177613
atgggtctttgtattagagatgaatggggacgtttagaaattgccaaaactgccaccatgtttggggtcctagaaccagcaaaagccgaggcttggagtttaccacttgcattgtcatggataaaagaacaaaacttatactatgttgatatagagatggatgaaaaaggattgcataataagtcatatggagattcagcttttcaaattctaataaatagttgtaaatctcttgtttctagtttcccaaactcagtgatgagttttgtacaagatgaatggggaacttttgtaattgccaaaactactaccatgtatgaagtcaaccagcagaaacttggagacttggagtttcctacatgtgttgtcgtggataaaagagcaaacttatactttgttgatatagagatggatgcaaaaggagttgcacaataa

SEQ ID NO: 60836 - DNA, 480 bp, Glycine max
  Peptide Sequence Number=SeqID_177614
atgaagaacggacgaagaatgatcgaagaaagatcaaagaacaatgtagaaatcaattgcagtcgtgattcatcggcgagccagaggctagcctgggtgagccaggggtctgaaaaagtgcaaaatgtcctcattgccctcccttttgagtattttttgcattcttttccgaaatgtcaaaaaaccttacagattgcgcggcaactggcgttaagcagctcaattcggctagcaagaatcaaaatgttagcgaagatgatgacaaaagcccaagacaatgagttcaagattgaatcaagaacacttcaagaatcaagaggaaatttgatttcaagattcaagaatcaagtttcaagatttaagttttcaagaatcaagaataatcaagatcaagattcaagactcaagattcaagaatcaagaaaaggctcaatcaagataagtacaaaaaagtttttcaaaacattgagtagcacatga

SEQ ID NO: 60837 - DNA, 345 bp, Glycine max
  Peptide Sequence Number=SeqID_177615
atggcacctacacctcgcacacacattgagatattagtccctacacccaggtctatgaaagaacgcgctttatggtgcccttaccaaacacgtactttagggtgcccttaccaaacacccttgcatttcgtggtggggagagtccctcctgttatggtggaaaggggaaaattggatcatatagaggtaagactcaagaccattgaaggaggcggagattatgctttcgctgacatggtagaattatgcctagtgcttgacaccgtcattcctccgaagttcaaggtgccagactttgataagtacaaggggactacttgccccaagaatcacctgaaaatgtaa

SEQ ID NO: 60838 - DNA, 114 bp, Glycine max
  Peptide Sequence Number=SeqID_177616
atgccttctgcacctagcaacacccaaaaacctgcggactcaagtagctcgttctgcgaggcccgtaatcaaacgagctttgttttagcgagcccgtggactaaacaagtctga

SEQ ID NO: 60839 - DNA, 1374 bp, Glycine max
  Peptide Sequence Number=SeqID_177617
atgacgagaaaggtctcgaatttctcggatctgatccaaagggtcaccgcctcctgcctcctccaccccctcgccaccgccgccgccaaggaagacgacaactcgccctacgagtccgaggaagaagtagagaatgacgaggagtacgaggaggaagagaacgaggagtacgaggaggaagagagaatgttggggcccttgaaggctttcaaagtaaaacagatggaggtgctgatggaggaagtgttcgacacggtgtcgtcgatgaagagggcttacgtgaggcttcaggaggcgcattcgccgtgggacccggagaggatgcgagctgctgacgtggcggtggtggcggagcttcggaagctcgccgtgctcagggagaggttccggcggagcggcggcggcggcgggaggaagaagggcaggagaagaggtggcggcggccgcgatggggtggcgtcggtgagggaggtagtggcaccgtacgaggcggtggtggaggagctgaagaaggaggtgaaggtgaaggatttggaggtgaagaatctgagggagaagcttgatagtgctgttgctctcactactaatggaagtgctgaaaagaagcctgggaggtctctgtctaagaggaaactgggaattcaagcaatggcagcagtaccaacccctgaactctttgaagcaacgatgatgcaagtgagagaatcctcaaagtctttcacatctctgcttctgtctctcatgcacaatgcacattgggacataacagctgcagttcgttccattgaagctgctaccgcctccactgataaattccataacacttcttcaaccacatccattgtctcggcttaccatgccaagtatgcccttgaatcctacatatccaggaaaatcttccaagggtttgaccacgagactttctacatggacggaagcctctcctcgctcctcaaccccgaccagtttcgccgcgattgcttcactcagtaccgtgacatgaagtccatggatccaactgagcttcttggaatcttgccaacatgtcattttggcaaattctgttccaagaagtaccttgccattgtccatcccaagatggaggagtccttgtttgggaacttggagcagcacagtcatgtccaagcagggaaccaccccaggagtgagttctacaatgagtttctaggggtggccaagacagtgtggttgcttcatttactggcattctcgttgaaccctgcaccaagtcagtttgaggcaagccgtggagctgagttccatccccagtatatggacagtgtagtgaaattttcaggcggccgagtgccggctggtcaggttgtagggtttccagttagccctggattttaa

SEQ ID NO: 60840 - DNA, 894 bp, Glycine max
  Peptide Sequence Number=SeqID_177618
atgtcagatcccaaccagatttcgttcgctcaagccttcttttgcagcgctttcgccgcctgtttcgccgagttttgtaccattcctctggacaccgctaaggtcaggcttcaactccaaaagaaggtaggggttgatgagggagtgggtttacctaaatacaagggcttgctgggcacagttaagaccattgctagagaagagggtatatcagccctgtggaaaggcattgttcctggtttacaccgccaatgtttatatgggggcttaagaattgggttatatgatcctgtgaaaacatttctcgttggtagtgcatttgttggagaggttccgttgtaccatatgatactggctgctctgctgactggtgctttggcaatcacaattgctaatccgactgatctagtcaaagttaggcttcaagctgaaggtcaattgccatctggggtacctaggcgttattctggcgctatagatgcatatttaactatactgagacaagaagggataggggccttgtggactggtcttgggcccaatatagctaggaacgcaattataaatgctgctgaattagcaagctatgataaagtgaaacggacgattttgaaaattccagggttcatggacaatgtctatactcacctacttgctggcttaggtgcaggtctttttgctgtctttattggttctcctgttgatgtggtgaaatccaggatgatgggggattcaacctacaaaagcacatttgactgctttctcaagactttgcttaatgagggatttttggccttctataaaggtttcctacctaattttggtcgagtgggaatctggaatgtaattttgtttcttacccttgaacaagcaaagagagctgtaagaggataa

SEQ ID NO: 60841 - DNA, 378 bp, Glycine max
  Peptide Sequence Number=SeqID_177619
atgaaggtttcagtctcgggaaagctcttcacagtagggttgataagtttctgctacgttgccattgcatggctcaagatggtgcccatgcaaacggtgcgttcgagggtgcagtttgtgaagatatcgtcgctgggactcatattctgcttgtccgtggttgggggcaacatctccctccgctacctaccggtgtcgttcaaccaggccgtcggcgctaccacgccgttcttcacggcggtgttcgcctatttgatgaccctccggagggagggttggctcacgtatgtcacactcctcccggttgtcgctggtgttattattgctagtggggtatcacttctctcttacctctttgaattgaaaaattaccgatga

SEQ ID NO: 60842 - DNA, 180 bp, Glycine max
  Peptide Sequence Number=SeqID_177620
atggtttttgaggattccttatcgcaatctgctccatcatcggagctcttccgtatcgcttcttcatcttcttctgctgaatcccactttcgtgaactcgatgatgcattcctccaggggctttcgtttcttcaatgtggaatttggggtggtaatgttggtgcaaacttcaggttttaa

SEQ ID NO: 60843 - DNA, 291 bp, Glycine max
  Peptide Sequence Number=SeqID_177621
atggagagaaatggtgcgaccaaggtgagaaatggtgcgactgagaacaaccagcatcgtaagcatctagacacaacggcggttgaaaatcgttgtcatgatggagcacggtcgccagagatcactggtgtgacggcggttccggattttgacattgtgatctgtatggtagccatgcccaaggatttggttggatgcaggcgtagaagcatagagctatcgcacaacatccttgctgattcctctggtagctattacttacaaaagcatgcaagaagaaaatctagacag

SEQ ID NO: 60844 - DNA, 1914 bp, Glycine max
  Peptide Sequence Number=SeqID_177622
ggttaccccgttacagactccaccaaagactatgagacgtattcagatcaatctgtggacacagaaaacaaacatctagtgcttcaatttgatgacttgcatactgatgacttgtatgattatacatcagacataaactacaacatagcgtctccaatggttgaacgtgattatttgccagaagatttacatcaattggacatccaaaaccaacagagaaacggaatttttaatgatgactttgaattgttatgttcaaaggaatccttgcaatatcattgctctgaggatataaagcatgactgtgagctgacttggtcatcatcatcatcatctcctagtggggacttacatactgaccttattgacatgacatctcatttagatactaaaaaggaacaagtccaggaaagtaggaggattatggacttggattactttgagaatttgtcgttaagcagtaattcttctgtcattgtgactcctaagaatgacaaaacaccaggtaaaagagatgctagcttgcttacaaaagatagaaagggcactgatctgtttcatgaagacaatagtacaccaaatgtatatcaaagtgccagctctcatggttcaaatccaactccacagacagctgaaaatggtaaattatttgaaattggtgacgacaaggaggttctgctagtagcttgcgtgaactgttattcaagggaagtgctgaacttgggagatcaagtcgatgcagagaacaattttaaaaatattgaacctttcaaagtgcacaatgacaagaatggtcaattggacacgataaaaaaagaacatgaatctcaaggcatagtaaaatgtaaggacatgccgtatcaaatcatttctagcacaggatattcttattctgtaaagaaatttgaggaaactgagcctttgttatattcacctgattgttacttctgcaatactaattctctggatacagttgttcttcatagcaatgacactagctcaacttcactgaaaaaatttctggcatatgaagagagagattctcaacttgatttggataatgctagttgctaccaatctcaggagtcactgtcctgtcagtcttattatttgcccgagtcttgtaaatgggatcagaaaggaaaatgcgctataacatcatataaagatgagaaaatttcgcattttttggaggatggatcacatgaggaaattacaccttgtaaacaaaaagctcctgaagtcttgatgtccactgttgttaagttggacactgatggtgaaaagctaaacattgactctctggctctggcctcaaatgctctagctgctgatgactgtgaaaaatgttccactcttggtgatggtcctaatgatttcttcaaaggtgacacaattcaagacattggagaacaaggtcagagagtgctagatatgttaaccaatgaagttgtagttcctgccaactgtgatgatgatatatcaagtcctgaatcttgcataagctcaaaacttgaattgaatggtgatcatcaagcatgtcaatatgaaaaggatcctgtttatcgttcagaacccactcgtgtggtgcatcttaaagaagaaataaaagcagaagatgagagggcgcacttcttagaaaattttgctggaacagaagagggagataaagaaataacaaaagcaaaacctcaaaagaggctactgctaagatcagtattgggtggtgcagctgcagttggtttgttattcatgattatgcacctaaggaggaatggcggggaaaaagctccagaaccaagtatggcatctagtcataaaggcaaagagaagattaagaaaaaatctacttggaaagtaaagacaagtacaacaaaaggggtttatccagctgaaaggatcaagttaaagtga

SEQ ID NO: 60845 - DNA, 1893 bp, Glycine max
  Peptide Sequence Number=SeqID_177623
atggcagggaagaaaggggtggcggcagaagacgcaataagggccattggtttaggttacgatctcacaaacgatctcaagctcaaattctgcaagaaccactccagattgatcgctatcgacgatgacaaccttcgaactgtcgaactccctcctcgtatttctatccctaatgtccccaaatccatcaagtgcgataaaggtgaccgcatgagattgtgctccgatgtcctctcttttcagcagatgtcagagcagttcaaccaggacttgtcactgtctggtaagattccaacgggccatttcaacactgcctttgggtttacaggagtttggcaaaaagatgctgccaataccaagactcttgcttttgatggtgtatccatcacactctacgacattgcatttgagaaaacccaggtagttcttcatgatcatgtcaaacaagctgttccttcgtcctgggatccagctgcattgaccagattcattgagaagtatggaactcatgttatagttggggtgaaaatgggaggaactgatataatctatgcaaagcaacagtactcatctactgtcccacctgctgaagtacagaaaaaattaaaggacatggcagacgaattcttcattgacaaagccggacagtataacagtattggtgggaggtttaatgcaaaggaaaagggggagcctatggaagaccagggaagatatcaacaacttgtaggcacacttaattatctcactgtcaccataccaaacatcacatttgttgtcagtgtgtttatgaaggacaatgtgctgaatttcatggatattcaagcccgttcctactatgaatcagaggcgcaggatatcaagttcatgtgcaggaggaaaggtggaaatgggaaaagatttttgtcccatagtgagtggtgccaaactgttctgtctcaacctgatgtgatatcaatgtcatttgtaccaattacatctctacttggtggaataaatgggagtggatatttaactcatgccatgaatctctatttacgctataaaccaggaattgaagaactgcatcaatttttggagttccagcttccaaggcaatgggcccctgtatttggtgagcttgcccttggtcctgaaaggaagccacaaaatactgcttctttacagttcagtttcatgggtcccaagctctatgtaaacacaacaccggttgatgtgggaaagaagcccgtgacaggccttcgattgtatttggaaggaaagagaagcaactgcttggcaatccatttacagcacctctcttccctgcccaaaactttccaactccaggatgagcctaacgggaatgcgtctaatgactcttcagaacgcaagtactatgagaaggtccagtggaagagtttctctcacgtttgcacagctcctgttgattcagatgatgacaatgctgtcgtgactggtgctcactttgaagttggagatactggccttaagaaagttctattcctaagacttcatttctgtaaagttgttggtgcaacccgtgtgaaagtacccgaatgggagggttctcctggcttgacccagaaatctggaataatctcaacattgatcagcactaccttctcaggtccacaaaagccaccaccaccacggccatctgatgtaaacatcaactctgctttataccctggggggcctcctgtgcctactcagtcacccaaacttctaaggtttgttgacacaactgaaatgacaagaggacctcaagattctcctggctactgggttgtgtctggggcaaggcttttggtggagaaggctaaaatatcacttaaagtaaaatattctcttttgactgtgatacctgatgaagagggggcaagtttttga

SEQ ID NO: 60846 - DNA, 1128 bp, Glycine max
  Peptide Sequence Number=SeqID_177624
atgccttctctctcggaagcctttagaggtcaccccgtgtaccttcatcagaaacaccacgacttcaactcacttcaagaactccctgactcttacgcttggacacaacctgatgatgatgatcaccgtctcacaaattacccttccaacaataagactaagaccgttgtccccatcatcgatttgaacgacccaaatgctccaaacctcataggccatgcatgcaaaacatggggtgtgttccaagtggtgaaccatggcatccccacgagcctcttcagtgacattcagagggctagtcttgctctattctcccttcctcttcaccagaagctcaaagcagctcgctcccccgacggcgtctccggctacggccgcgctcgcatttcctccttcttccccaagctcatgtggtctgagtgcttcacaattctcgattcccctcttgatcttttcctcaaactctggccacaagactatgctaaatactgtgatattgtcgtggaatatgaagcagccatgaaaaagctagcagcgaagttaatgtgccttatgttggcttcccttggtattcccaaggaagacattaaatgggctgggccgaaaggagaattcaacggggcttgtgcggctttgcattggaattcttacccgagttgcccggatccggatcgggccatgggtctggccgcgcacacggactccactctcctcacaatcctgcaccaaaacaatgtcaatgggcttcaggttctcaaggaaggggaagggtgggtggcggtgcctccgcttcccggagggctcgtgatcaacgtcggcgatctgctccacattttgtcaaacgggttgtacccgagtgtgctgcatcgagttcgggtgaaccgaacccggcagaggttctcggttgcttatctatatgggcccccaacaaacgtccaaatcagtccacaagtaaaattggtaggcccaacaaggcccgttctttatcgatcagtgacttggaacgagtaccttggcaccaaagcaaagctttttaataaggctctttcagctgttaggctttcttcatctattaacggtttgtttgatgtaaacgaggataagagtaacgactttcaagtgggctag

SEQ ID NO: 60847 - DNA, 237 bp, Glycine max
  Peptide Sequence Number=SeqID_177625
atgtcattaccagtattaattagttattgggatggtgataaaagaaaaagtagtgaaagatatatagataggaccgacaaaaaagaggcactaaccaatatgaaagaggcattgcttgcttgcactatcatgctccttaattatatcccttctattataaggtacaagcttgttaaagtggttgagaaatttgagtatgtgggttacaaagggttgttgatgaatatggtgatctag

SEQ ID NO: 60848 - DNA, 1158 bp, Glycine max
  Peptide Sequence Number=SeqID_177626
atggtgtcaaaagtaatgactcggagtcctatatttgtgacatctgacatgctagctttagaagctcttcagaagatggtccaaggtaaattcaggcacctccctgttgtggaaaatggtgaagtgattgccatactggatatcaccagatgtctttatgatgccataactaggatggagagggctgctgagcagggcagtgccattgctgctgcagttgaaggggtggagcgccaccggggtagcaatgtatctgctagtgctttgatagaaacattgaaggagcgcatgttcaagccttccctgtcaactctaatgggtgaaaatacaaaggttgctattgcatcacccgcggatcctgtatatgtagctgcaaagaagatgcgggatttgcgtgttaattcagctgttattgtgtccttgtcgggaaccaagattcagggtatactcacttcaaaggacatactaatgcgtgttgtggctcaaaatctttctcctgagttgactctcgtggaaaaggtaatgactccaaacccagattgtgcatcaatagatacaacgatactggatgcactgcatatgatgcatgatgggaaattcttacatcttcctgtggtagacaaagatgggtatgtagtggcttgcatggatgttttgcagataactcatgctgcaatctccatggttgagagtagctctggagctgttaatgatgtggcaaatacaattatgcaaaaattttgggactcagcttttaatctagaaccaccggaagattctgatactcatagtgaactttctgggctagtgatgtcagatggggctgatacatcaaagtctggatatcaatctgtaggttttggaaattcatttgccttcaaatttaaagatctcagtggtcgtgtgcatcgattcaactgtggtactgaacatcttgatgaactagtttctacaatcatgcagagacttgatgttaatgatggagaacgccctataattttgtacgaggatgatgaaggtgacaaaattgttcttgcaaccaatagtgatcttgtttctgctgtcagctatgctaggtctgcaggagtgaaggtgaagatatttgcttctactggctttttcatgacactccaatttgctccatacattctaatataa

SEQ ID NO: 60849 - DNA, 156 bp, Glycine max
  Peptide Sequence Number=SeqID_177627
atgtcattgccagcttccattatcatgacgaactcagattgtaatgtatttatggagcttctaaagttgttgaaaatgcagaaaccaactcaggaaaagcttggatcagcaatatcagcttcatatgctaccttttcgtggagtcatagtatgtag

SEQ ID NO: 60850 - DNA, 501 bp, Glycine max
  Peptide Sequence Number=SeqID_177628
atggcagtgagctttctggcacgtgatgtatcggacctctgccttgggaagccgccgctgaggtcgctctccgcctccgccaccgtcgccgacgccttggctgcgctcaagagctccgaccacgagacccacgtcaccttgtggagcttctgcgagaacaagaacgagagaggacaatctctcgtctccaatactctggacccacccttcccctaccttcttctcctcggcgatacggaggcggtggcggtgtcgccggaaaatgacggccccaccatagaactgccgtcgggcgccgtctacgccgtgtacgacacgaacggcgacgttcagttcatcggtttgtcgcggatcattgccgcgagtgttgcggcgcactggaaatcggtgccggagctgtgcggttccgttaaggttttgcagcgtcctcaaatgcttgttggtggtgaggtggaacgccaacgaacaagagtggttcgatggcacactgaagtgtggtga

SEQ ID NO: 60851 - DNA, 1080 bp, Glycine max
  Peptide Sequence Number=SeqID_177629
atggaaccgcctctgcctcaggaatactttggaaactcagttcatgtagtgagtgcagaaacgacgacaggggaattgcttgagaatggtataggatgggctgcatggaagttgcacatggctgttgcaaaccataacaatggagtggtgctgcaatctctgaaggtgtggttagagtctcctttcgtaattcaaatgggtagctcgcccaggttcaacgtgtatggaatgggaaaagcggtggcggcaagaagtggttatgccaacaagtttgaggggaaagtgacatcatacccaggccatgaaggaggtggaagcattgatttggaagtgtgcctttcaccagatgaagagttcctgaatgctgtttctaagtccaatccttttattgaaaaagatgatggcaagtgttttactactttgttaagtcaaaaaaatgatcctcttatgctttggctaaccgatggtcctggctactcttcattttcaggtcctgcctttcaaatagaaagagagaattttgatacaaaatctgagacattattgcacttaaaccaggttttatgtttgacagaagagttcaatcaaatgagtttaaccatgattgatttggggaattcctttctgaggcttgtcacaagccctgatgcttccagtgcatctatttttggatggctgatcactggatcatttggactaatggctctcatatatgctgttctcaagtggcagcgaaggtcctcattgaattggattaaagctgcagcaagagaaaagaagaaagtttggaaaaagtttaaagttccgctatccgagcatttgtgggttgaagattttacttatagggaacagccatccacttgttgtttctgcttgacttccctttggccttttcaaaatttaggtacaacagcctcaccgcatgctcctctccatcgttgctctgtttgtggtgtcgcagcttatttcctttgttctcagtttgcagcaaaggattgcaaatgtgtggctcaggctggctttggccatattcgacaccactggtcagaaagatgggttaatgtggaggagggagcatga

SEQ ID NO: 60852 - DNA, 3165 bp, Glycine max
  Peptide Sequence Number=SeqID_177630
atggtgaggcgaaagactagtgtgggaataactacgggagtgaagacttggatggtggtgtcctcggagacaggagagcaacgccttgaggatgtcggcaagcactccctaatgcggcggactggcttgccggcgcgtgaccttagagtcctcgatcccatgctttctcacccctcttccatccttgtacgcgaaagagccattcttgtcaacttggaacacctcaaaggaatcatcacttccaccgaggttctcatgatcaactcttccaaccctttctttcttctcttccttcaagaccttctcacccgtcttactcatcaacctccctcaccgatgagcaatgacatgaatcctggttacgaagcaaaacctccagcgatgtgtggttctgaagattcttcccaaaatgtttcgcatgtgaaaatatctgaggaagtaaaagcagatagccctaagatggcacctatagctcccaagcagttaccttttgagttccgagccctcgagacatttattgaatctgcttgcagattggaggaagaggcatacccagctttagatgaattgacctcccaactttgcacactcaatcttgaacgtgtaaggcatatcaagagtcgtttggttgcactttctggtcgtgtgcagaaggtagcagatgaattggaacatttgctggatgatgataaagacttggctgaaatgtacttgacagaaaagcttaatgctagtttattagatcaggcatcattaaaagaagagtacaattctgaatctgaagataccgatcaaagcgatgaatcaaattcggaaaagtatgacaaattccctggtcttaaacttaatgttgaggaattggaaatgcttctagaagcatattttgcgcagacaaatggaatcttgcaaagattgtttagtttgagtgagtacgtggatgacactgaggactacatcaacatgatgttagatgataagcgaaatgagcttctgcaggcaacaataatattcaacaccctaaacatgatactaaatgctggtattgtggttgtaggattgtttggcatgaatattcaaatcgaactctttaatggtaaacctcgtcaattttgggctaccacaggtggtacatttggaggatcgccctttctatctctgagcttcttcttcccctatcactctgctaacaatggcattgcggtttcttcaacccagtgcaaacccagaatccggtgcgacaaagaagtagggaatggtaataataatggaattgaagaagatgaagaggctgaacgtgaggtgcagtgtgaggttcaagtggtttcttggagggaaaggagagtcaaggccgaaattcctgtcaatgctgacattgaatccgtttggaacgctctcactgattatgatcatctcgctgatttcattccaaatcttgtgtggagtgggaaaattccttgcccgtatcctggacggatatggttagagcaaagaggatttcaaaggtcaatgtattggcacatagaagctcgtgttgtcttggatcttcaagaactcatcaattctgcatgggatcgagaacttcacttttccatggttgatggagactttaagaagtttgagggcaaatggtctgtcaaatctggaacaagatcttcatcaactaatttatcttatgaagttaatgttataccaagattcaatttcccagctattttcttggaaaggattatcaaatcagatctccctgtgaacctccaagccttggcatatagagttgagaggaatatttcaggaaatcagaaactctcccttccagaaaatcacttggataaaacttctagtgatattaatgagtcatctgcccaaaagataaatagtgctttgtgtgaaaacaaagaagatttagtcaactcaattcctggcaccttgcccatgccttccagtgaggtgaacatcaataattggggtgcatttggaaaaagttgcagacttgacaggccttgcatggtggatgaaattcatctccgtagatttgatggacttttggaaaatggaggtgttcatcgctgcgtttttgctagcataacagttaaagctcctgttcgtgatgaagggtgtaaaggtctgctttatatggtgcttcatgctcgagttgtgctagatttgtgtgaatatctagaacaggagatcagtttcgaacaggttgaaggggactttgactcattccagggaaaatggactttcgagcaactaggaaatcatcacacactgctaaagtactccctggagtcaaaaatgcgcaaagacactttcctttctgaagctatcatggaagaggtcatttatgaagatctcccatcaaacttgtgtgcaataagagactatatcgagaacaagacagcatcaaatattttggaagcatgtaagcagaatacaaattcagggcaacaaactgttccatctggctttgaagatgatgacagctattgttcagctgaagacttgtctgattgcaatgctcaaagctcatctcaacaaagaccaagagttccaggcttacaaagagatattgaagtcctaaaatctgaacttctgaaattcattgcagaacatggacaggaaggatttatgccaatgaggaagcaacttcgtttgcatggaagagtggatattgagaaggctataaatcgcaagggtggattcagaaagattgcaactataatgaacctctctctggcttacaaacaccgcaaaccaaagggttactgggacaatcttgaaaatttgcattatgagcaacaaaccataggtttgcttactttcaagtctagcaaagaaagatggataaaactgatggctgtagcttcatcccacttccaatttgaagttagtatacaatggaattttcccgcagggcggtttgatatagcacgggcactggaaaagtggggcggacttcgtcaggtttctcgcctcctctccctcaaggtgaggcggcaacgaagcagacagggcaagcttgccaaggataagaaagttgatgatgatgtagcatcacctgatgtagatcgtgagatcaagacaccatctagacccactgtttctcaagatccacaaaaatggcttacagaactaaaacagttggacataaattgggttgagtag

SEQ ID NO: 60853 - DNA, 603 bp, Glycine max
  Peptide Sequence Number=SeqID_177631
atggctgaaatcatgcattccaagtccaatataaaccgcattaaagaagtcattgccaaactcacctccacacaatttcatctcatggctacccagaactccatggccaccaagctagacaacttgcttctgaagatggcacagttagaaaccagtcaacattctccaacttcatcaactgtgaaccaacatatagtctccccatctcctaaccctcatcgtatgaaactagaggtaacgggtctaactagactacaggaggagaagttttgtgacttccgtcgttctcctcgtgacaagcccacctctcttcccctttcagcaccgcactatgcactcgccgtgaaccaacatccttcatcacttctgttaccatctcctcccaaaccaccatcaattctcttcaaacatttatctcccgagaagttggcgacacgccgcaagaagggcctcttcttcaattgtgatgagaagtaccacagaggtcacaagtgtgcctctaaggttttcttgctgattgcggaggaagctgacaaatcgcaagtggaccatgtccttctggatccgtcacctgataaaagctacctatcacctcgaggataa

SEQ ID NO: 60854 - DNA, 3168 bp, Glycine max
  Peptide Sequence Number=SeqID_177632
atgaagtttccgttttcagccattgttgctctctggtttgtttgtgaccttgttctggcaaattcacgctaccctgggggaatgtatagttttgataggaacactcatgtaacctataagtatgatcgaatgagtgaagttcagaaacagtgtgcctctgtgttatctgcttcatctgaattgagatatcaatatagtgttactggtatgaaaggagagctttcttttgtcaatggggattggaagcaggatgggggtaagtttcccataatgccatttgatgctaacaaatctcctggtcctgggaccttgtctgaagaccgtgctccgttgaacttggtttctttttgggtatccgatgttgatcatgaccaccggttgaagaagttgattcctatcaatggtttcatggtgatgggaattactcgagacggtaattttgtggacagttcatatgatgggaatgctgaatttcagctatggcccagccattctcagctctcaattcccttccaagggatttacactgaatcaaagaaaaatggtggggaaagggtgttgtgtttgttagggaacactatgcttcccactcgagaggctgaccctgtcaatccttgggaagggatgaagaatcctggtgatataccgttgtcagaagatgatcaaattatgctagttcttcactatcccatgacattcactctaactaacagggtgatcagtggagagttaagaagtttgaaccgtgaatccaattctaaatactttgatgtggttcacatatcttcgcagttgagcaagtcagcaaagttcacatttggctcacaacaaattgtatccaaagcatgcaatccatacccatttaaggataacctgatggatgatggcattagtgtctacaaaggggtgaggttttgtgaaatccttgaagaaattactagagatagacctttatccattgtgccaaactggagatgcaatggcacagatgatttctgcagtaaattaggtccttttttgacagataagggaatcaaatcgacagatggaggctttcaagatgttaaactttatatgcaggatgttgtctgtgagcgagcaactagtaagagtgatactggttctgctagggtatcaacggtttttagagcagtttctccatcagagaatcagtatactgcagcaaaaaggtctgggcccagcaacacatctcttgccgccgaagggatttggaagccttctagtgggcagctttgcatggttggttgccttggattcgttgatgctgaagggagtagctgtaatactcggatctgtatgtatattcctaccactttttccttgaagcagcatagtattattttgggaactttgtctcccattaataacagtagtgccttctttcccctatcatttgagcaacttgtgctaccttcagaactctggaattatttcaagctcactaacccaaattacagttactctaaaattaatttggccggcactgtcctagaaaaaaatgagccctttagttttacaactgtcattaagaaatcattgctgacatttcccaaacttgaagataatgaggcataccgagatagcctgtctgttctttctgaagatctcacttttcatgtctctggttttcctgaccctgtgcctaatgtcctggccccaagaattgacattcaaatggaaattctctccattggttccttgtttgggcactattggaatgctaaaaatacttcggaatctgaacaggaaacaccagatcttgccaaggctgctgaatatacagaaaaacagcttcttataaatgtatctgcgcagctcagtcttactggaaaaggttatagtttttctgtgctttttctggagggtctttatgatccacatgttggaaagttgtatctaattggctgcagagatgtgcgagcatcatggaaggtcttatatcagagctatgaccttgaagctggaatggactgtttgattcaggtggtcgtggcttatcctcctaccacaactcggtggctagtcgatcccagagcttcaatttcgatagaaagtcaaaggacggatgacgacccccttcgatttgatccaataaagctcaaaacatttccaatcatatacaggaagcaacgtgaggatgttctctcacgtagaggtgttgaagggattctccgaatcttgacgctttcatttgccattgggtgcattttaagccaactgttttatatacaaaaaaatgtggattcacttccatatatatctcttgtggtgctaggtgttcaagctcttgggtatagcattcctctggtcacaggtgcagaagctctttttaagaaaatggtttctgaatcttatgatgtgtcgtctagtgaattggagagcagtgagtggctccatgtcattgattacactgtgaaactgctactgattgtatcattgctagtaactctgcgactttttcaaaaggtatggaagtctcgcatcagattgcaaaagcttacctctcttgagccacatggtgtccccagtgataaattagtatttctttgtaccttcaccatacatgtgatagggtatgtaattgttctaataattcatggcacgaagaccagccagaaggctcttatagcaaagacatacttggttgatggaggaaattctcattccttgccgggttgggaaacagaattggaagaatatgtaggtcttgttgaagactttttcttgcttcctcaaattattgggaacttaatctggcatatcaattgcaaaccactcagaaaactatattttattggaatcactctggtcagacttcttcctcacatatatgactacattcgagctccagtttcaaatccttacttttatgaggaatctgaatttgtcaatcctaatttggatttttactcaaaatttggggatattgccattcctgtgactgctatcgttcttgcaattgtggtctatattcaacaaaggtggggctatgagaagttgagtcagtttctgacatttgggcggtataagattcttccaactttcagataccaaaggttgtcttctagggctggtgaatctgaactagttcctggtatcaatggtgctgctgctgcaaaagagaatgagcaagttgatgtagaatga

SEQ ID NO: 60855 - DNA, 312 bp, Glycine max
  Peptide Sequence Number=SeqID_177633
atggttcaaggcaaatttgtcccaaatttcggggagccactgggtatggaagctaagtgcctgaaaaaaaagggcaagtatggggaaggaacaaatgcaaaagtgaaggttattctatggatgaatgctctcctagaacctaagcttttgaatcctagaaaaaccatgaattgttggcagcctaaccccattacaagcctagaaagtccttcggattcatttttgtgtgttcattgctgtatgataggagatgaaatgcaaaggttggaacttgtgttggttgtttatgatggaataagcctaaacacttga

SEQ ID NO: 60856 - DNA, 426 bp, Glycine max
  Peptide Sequence Number=SeqID_177634
atgctaggtgcaccctgcaacattgctgaagaaccttcttctggagaagctatcggaagaagttcttccgataacttctccggaagaaggttcttccagatgaacaatttgttctaccggaagaaccttcttccggtagtttcttcgaaagaaggtttttccggaaactttccgaaagaaggttcttccgttagaacacaaattgttcttccggaagaaggttcttccgaaaagctttcggaagaagttaacttgtattggaagtatggagtctcccagactaatcccatgggggtgaagattttgaggcctgattctgctctaggagctgcgagtagtggtggttctgtggagtggagttgggtgctgtggcagctattcacatgccatttcttcatgtatcaaatttcaaagttcaagcactag

SEQ ID NO: 60857 - DNA, 114 bp, Glycine max
  Peptide Sequence Number=SeqID_177635
atggacttcatgggtcccatatggtacaaaagtcctcaagctctaagttcaatgagaaagaaagagcttgagattaatggagatatggcaaggatgattatgttggatgaatga

SEQ ID NO: 60858 - DNA, 282 bp, Glycine max
  Peptide Sequence Number=SeqID_177636
atgtcaatggtcgcaagtagatggaggcaatttaagtcttccttgacttctaaatttgtctatgctaacaattacgatcaacaaatatttgatcctacactaaagtatggtcttgatcctgcaacatgggctgaatttgcaaaaagccgtcaaacccttaattggggtatacggaagaaggcacaggaaattcagaaatacaataattgtccccacttactatctcatgggggttatgaacttcttgagaataagcttatggatgagaagaggaagcattga

SEQ ID NO: 60859 - DNA, 165 bp, Glycine max
  Peptide Sequence Number=SeqID_177637
atgacattgaattctattcctgtgagcgaccctgatgtgttggagataagacagaccaagggggtgaagattttgaggcctgattctgctctaggagctgcgagtagtggcggctctgcagagctgggtgctgtggcggctatatacgctcttattacttgttag

SEQ ID NO: 60860 - DNA, 252 bp, Glycine max
  Peptide Sequence Number=SeqID_177638
atgtcagaagtcacaagcgattgtcctcctcgaattttacccagcccgcatcaattagactttgcaccttatgtttcagggtcatacaatgctcaatggaatgccccagaactcctccatgataagcacatgttgcattcgagttgtgtccatagaaaaatggaggtgggtttcatggctgatttaggagtggcctttgtggataattgggtgttcttggatgatagggtggtggataatgagaagggataa

SEQ ID NO: 60861 - DNA, 375 bp, Glycine max
  Peptide Sequence Number=SeqID_177639
atgaggcaggggacacttgaaaagagatgtcttagaacgaaagacatatgtaaaggatcagagaaaccaagccacctaaaatttaaaaaaaaagagttttatgttgatccatttggctgcattctgcttgtcttcttttgtgaacaaggcagtggcaattctcagggaacatcaagctcactttcggatgaggtccgtcaagttgaatgggaattttttagcaccctcatcttgtacttggatttaaacctcatgcagatggataaggaatctgttttgagtgaagctctagcagaacttgcgggtaaaattatctccacgtgtttgcctgatgctggctttgcactcttgagcattaatcctaaaggtgcctga

SEQ ID NO: 60862 - DNA, 459 bp, Glycine max
  Peptide Sequence Number=SeqID_177640
atggcatgcggtaaaatctacctctacatagctaggcctgtacaattattggttggagtaatgaaattttgccgtggcattcaatgcataaattcgagggcgagccctggtgcagcggtaaagttgtgccttggtgacttgttggtcatgggttcgaatccggaaacagcctctttgcatatgcaaggggttttccgcattaaaatattgcttgcaatcctcaaggacgtagagaaggtctgcaaaacaaaacaaaaaaatcagaaaatacagcaagttcaagttgaagaatatcaagagcatgaggaagagaaactcttcgtcaccaactgttatgtgctttatgctgcagagagcaacatagatgcttggcagataaacaaaggcagcagcagtatcattgcttctcatgcaaacaattccaagaaaccagaaaagacctactctccgaagtcatga

SEQ ID NO: 60863 - DNA, 594 bp, Glycine max
  Peptide Sequence Number=SeqID_177641
atggctaaggtcaacgaagaaggggttcagctactctcaggcggtgtggacgacaatcccagcagcctgatgatggatttatatgtgagaaacatcctgcggttcagactttggtatgatcctgggggaggtacatctggatttatgttattatgctcgtttttgttggaggtgaataggattggctgcgaaattgcggaaacagaggttccaaatgttaggaaggtgcttgtaagggtcgtcctttcctggaactccctctcttctgggaggctcccgccttacaacgaatactgcacttccacccccaccctcaccgtcagcgcccgctacaaaatcaatgttgccgtcgatttttccgacacatgcaaaggcgagaaatggagaggaaaatctattcttccaacgccgtcaacaatgattgcaaccatccctcaaccacgtataaacctcgagtccttatttgattccaacggcaacaacaatcacagtggaagtgcaatatccgttgcaacggggaaggagactggaaacattaacttaacggtgttaaacaattttaacagtagagacctatcgggaattaaatggtaa

SEQ ID NO: 60864 - DNA, 216 bp, Glycine max
  Peptide Sequence Number=SeqID_177642
atgggtgacgtagacgaggtgcaagaacaaatgaaggttgatatgtcgaccctgaaagatcaaatggcttccatgatggaagccatgctaagcatgagaagattaatagaaagtaacacagtcgcgactgctgctcccagcaccgccgccgagacagatccagctcttccaacttcaacaaatcaagcacaccaactcaccccagacatgaggtga

SEQ ID NO: 60865 - DNA, 327 bp, Glycine max
  Peptide Sequence Number=SeqID_177643
atggggaccatcatcaaccagtacaaggaaaagctaagcctagcagcgactcatgagcaaaggctagaggacgagtacgctaaggtgttagtcttgcaagcggaaagggaagctagggaaagggtgatcgattcattgcacaaagaagcgatgatgtggatggacaggttcacctttactttgaatgggagtcaagatcttcctcgactgctagccaagcccaaggcaatggcagatgtgtactcggcccccaaagaggttcacaggctcctcaattattgccaacacatgattgatctgatggcccacataattaggagccgctaa

SEQ ID NO: 60866 - DNA, 270 bp, Glycine max
  Peptide Sequence Number=SeqID_177644
atgtttctggttttctttaaagctcctcctccagtttctctgttagggttcccaaatgttagggagaaggagaaggaattgaagcctccattccatggacctacatgcgatgcatctttcttcctccacagagactactttgcaaatctcaacgttttatcgagacaactctgggtttttgcgggaaaggaaaagttacaattcgaagggtatttctctcagattcaacacgttctcataattcccaatggtggaaaggctacgaattga

SEQ ID NO: 60867 - DNA, 2079 bp, Glycine max
  Peptide Sequence Number=SeqID_177645
atgatgcacgttgaagaatgtaacgtaacaggatcatgtcatcagcagatatttttattctctcaatgttggattcaatggagtcaatttgagaagtccttgatggaccggaggagttggctttggcgcaggaagtcatctgagaaaagtcccggtgaaacggagagttctggttcaatatcatctctttcagaaagattctctgatgaacaggtgggcattggaatagaagtggtatatccaacccaagctgctttttctcctgaagtcacctctaaggctgcaccgaatgaagaagttagtaaccccaaaaaaagtaaagaagatacgggtttgaagattcttacagacaaattagctgctgctctgctgactattagtgcaaaagaagacttagtaaagcagcattctaaagttgcagaagaagccgtctcaggctgggagaaggctgaaaatgaagtgtcatctttaaaacaacagcttgatgctgcaaggcagaagaactcaattctcgaagatcgagttggtcatcttgatggggcactcaaagagtgtatgaggcagcttcgacaagctagagaactgcaagagcaaaagatggttgaggctgttgtgaatagttctcgtgactgggaatccaaaaaatctgaacttgagaggaaagttgccgagtttgaggctcaacttcaaacagctaaagcagatgctgctgcgtcaattcattttgatcttcaccagagactagaggctgtgcagaatgagaattcaagtcttaaacatgagctgcaatctcgactagaggaactagaatttaggatagtcgagagggatttgagttctcaagcagctgagacagctagcaaacaacatttggagagtgtcaagaaggttgctaagcttgaagctgagtgccgtagactgaaagccatgactcgcaaaacattttctgtcaatgatcacaggtctgtaactgcatcttcagtttatgttgagtccttcacagatagcatgtcagatagtggagataggctacttgcagttgaaagtgatatgcgtaaattaggtggctgggagatgaatgaatgtgagctacgccgtttcgattcgtgctcatcttctttcgttatggaacttgatcaatttaagaacgaaaaggctaatggaaaaaatcatgtggtctcttcaactgagatcaatctcatggatgatttccttgagatggaaaggcttgctacattgccagatagtgaaagtggaagcaattttgttaggaaagaagtggcatcagatcaatctaatgttggtcaggctacaataaaagctgaaatagaagctatgattgaaaagaatgctgaattggagaagaagctggggaaaatggaagctgaaatggaaggtatgattcaaaagaatgttgaactagagaagaagctgaagaaaatggaagcaggtaaggttgaggtagacatggttttaaccaaataccaaatgcagctcgagacatcagagagtcagataagggaagcagagttgaaggtagcagagtttcaaactcagttagctcttgcaaaaaaatcaaatcaagaagcatgtgaagaactgaaagcaacaaaagcaaagaaggagatagttgagtctacactcaaacatactgaaactgaggttgaagaactgatttcaaaaattcgttctttggaggaagagattcataaggagcgagctttgtccactgagaattcaatcaaatgcggaaatttggaggttgagctttcaaaaatgaagcacaaagttcaagttcagcaagacactgagataaaacatacggaaggtgttaatctcgatttgaagttaaaacaggaaaaggatctagcactggctgctagtagatttgctgagtgccagaagaccattgcatctcttggacaacagttaaagtcccttgcaactttggaagactttctacttgattcagacaaccctatggagtcaacttgtgaagtcacaaaagaagcaaaagaggaactcactgaagggaattgtggagaagctagaaaggataaggttgaggttgagttgtaa

SEQ ID NO: 60868 - DNA, 222 bp, Glycine max
  Peptide Sequence Number=SeqID_177646
atgaagacagcaggaaacaatgaggcaaagggaatgtggagaagtggaattgataatggtagtggggatcttgaagcagcaaaatgcttcttttggtcatctatcaagccaatcaactttaagaaagcagtgaaacttgttgtttttactgcaagaagctggtttctcttttactttccagctttgccttgtgctagatatttgaaaattctcacaaaatag

SEQ ID NO: 60869 - DNA, 237 bp, Glycine max
  Peptide Sequence Number=SeqID_177647
atgagtggtcacataacgaggaggaacagtgcccctcacaaacgccctccctcgttatccaagaagctccaaaacggaagccttagcgaacctcccagcaaggcttcttctccgccacctcaagagtaccttcttcttctctatctcatttcatctcttcattccttttcgctttcctctgctttcaaccatacaccgatccgtacaaatccaactaaaccgttttatttaatttag

SEQ ID NO: 60870 - DNA, 393 bp, Glycine max
  Peptide Sequence Number=SeqID_177648
atgtgggctgtgggatgcatttttgctgagttgttgaccttgaagccgctatttcaaggggcagaagtcaaagctacatcaaatccctttcagagtttttctttttccctgctggtggacattcattctgttgatgaatattctagagctatatcacaggacattgttactgtgccaggccatcccacattagaaaagtggccttccttagcaagtcttccacattggcaacaagatgtgcaacatatacaaggacacaaatatgataatgctggtctctataatgttgtacacctgtctccaaaaagccccgcatatgacctcttgtcaaagatgcttgaatatgatcctcgtaagcgtttaacagcagcacaagctttggagcatgagtag

SEQ ID NO: 60871 - DNA, 558 bp, Glycine max
  Peptide Sequence Number=SeqID_177649
atgccgactgcacctccatgccccatgccgatgcaacaaagccaagcacccatgcctgctcctcaccttgccgccaacagcaagcaccacatgccccacacgccgtcctccgtcttcaaccaactcggccaggcacgtgccgttgtttccctcgacaatctcttaagtgttgttgttcattatggtcgtgcagcggctccacatgacaagcttttggaaaatagagacatggcactgtttgagatgggagttgagtcctatgggtctgccatggtcgcacgcaagcgccaaccagctgcttttgcactatggacggctgctaaaccaaatgagtttcgccgggacagaccttgggatcctggtattacttttggaagtcatggtttgaagccccaacaccttgaggacaaggtgtttttgatgggtcagggaatgttaggaattaggaaccaagctctaaacgtgccactaagaacatgcaccaacaacccaaacgcaggagcaaaccacccaagcacttggtggattacatctaaccgagtctgcttgaagtgctga

SEQ ID NO: 60872 - DNA, 501 bp, Glycine max
  Peptide Sequence Number=SeqID_177650
atggagcagattgttcttgttgaccagtctgaatgttttgttttcaagccaatgttgtatgagcttctatccggagaagtggacaaatgggaaatagctcctcctttctcagatttgctggcaaatactagtgtgcagtttttcaaagacagagtaaaagttttgaatccctctgatcattggggaatgaatggatccaaagcatctagttgtggaggaactgttcatcttgaaagtggccttcttgttgaatatgactggtacaatatgcactgtttaaccaggctggttcttgcgttgggagctgaatctaaactggatgttgtaccaggggcagtagaatttgcaattcctttctcaatgctagaagatgcacctaaagtcaatgataaattaacaaaattagagagaaagacctttggtaaggactttcaaattagtgtggctgttattggttgtggttactctggagttgaattggctgcaacactggcagagtga

SEQ ID NO: 60873 - DNA, 510 bp, Glycine max
  Peptide Sequence Number=SeqID_177651
atggtggaggcagaacagcagcaaagcttgcaactatccgcttttcagattacaatgttgcacattgctttagctgcaccggtctctcctaccgtcgtcgattttcattcatcatctcatccacacacaactacttgtttggaatctgagaaaaccgagggaaaattatcgtgcggagcgaagcaatggagcgcgctatttccgagttttcggaggagcaggggagccggttcctccttgttcgcaagctctctcaggaaacgattgcaattgcggtttttcgcttcgggagaaaatggcggcactggaggtgctgtggaggagatatccgaagccgaaaaggagcctacgaatttcgcgtggcctgataacaagaattatctgattgcagaacccagggtgtgcatattaggtggtggatttggtggcttatatactgctttaaggttggaatcattggagtggcctgatgataaaaaaacacagctagcaggtttctatggttgctga

SEQ ID NO: 60874 - DNA, 567 bp, Glycine max
  Peptide Sequence Number=SeqID_177652
atgatttgcccaaatgcccaacctggcaatagggaagttgcactaaaaaggctcagtgaattagagtcttcagataccctgacaggggcagatgaaaatagtactgaagtagtgcctgattttgagaaatatatattggagctacaacctgctgaaaggggaatgcaaagtaaaatcgttgaagcagatctggtattgtggactgctggaaccaagcctcctcttcctcagctggaaccttcagatgttgcatttcagcaagcagacttcactggttggaatttgtgggctgcgatcaatgggcgtccacttttaccatttaggtttcagaatctaggtgagatgatgaccttgggaagaaatgatgctgccatttctccgagttttattgatgggctgaccctagaaggttctgttggtcatactgcgaggaagatagcttatttgatcaggttaccaacggatgaacataggcttaaagtggggattagctggcttacaaagtctgctattgattctgtgtcatcgctacaaagtaccttgtacaaggtggtttcgggctcttag

SEQ ID NO: 60875 - DNA, 1296 bp, Glycine max
  Peptide Sequence Number=SeqID_177653
atgaagatggggaaagtggtgatggtggttgcagtgatggtgttgttcaacatgtcttcttgttctgcttggtttggtggtaacaaacacaaaagtggaaggaactcgattctcccaagtgaagccacgtcatcacggtcaaggcttttgaaccctgctggctcctctattgtgctccctctttatggcaacgtttatcctgttgggttctataatgttactcttaatatcggtcagccagcaaggccttattttcttgatgtggacacgggtagtgatctcacatggctccaatgtgatgccccttgtactcattgctctgagacaccccatccactctacaggcccagcaatgactttgtaccctgcagggatcccctttgtgcatccttgcagccaactgaggactacaactgtgaacaccctgatcaatgtgactatgaaattaattatgcagatcagtactcgacctttggcgtgcttctcaatgatgtctaccttctcaacttcaccaatggagtccaacttaaagttcggatggcactcggatgtggatatgatcaagtattttctccttcttcttaccatcccttagatggattacttggccttggaaggggaaaggccagcttgatatcccagttgaatagtcagggcttggtacgaaatgtgattggacattgtttgagtgcacaaggaggagggtatatcttctttgggaatgcatatgattctgctcgagtgacttggactccaatttcatctgtagattcaaaacattactctgcagggccagctgaacttgtttttggaggaaggaaaactggggttggaagtctgactgctgtttttgacactggaagttcttacacttacttcaattctcatgcttaccaagcactactttcttggctgaagaaggaattaagtggaaagcccttaaaagtagcacctgatgatcagactttacctctctgctggcacggtaaaagacctttcacaagcctacgtgaagtcaggaaatacttcaagcctgtggcacttggtttcaccaatggtggaagaactaaagcccaatttgagatccttcctgaagcttatctgataatatctaacctgggaaatgtttgtctgggcattctaaatggctctgaagtagggttggaggaactgaatctaattggagacatatccatgcaagacaaagtgatggtgtttgaaaatgagaagcagttgattggttggggacctgcagattgcagccgtattccaaaatccggagatgtcagtatttga

SEQ ID NO: 60876 - DNA, 226 bp, Glycine max
  Peptide Sequence Number=SeqID_177654
ggaagtagaggtcgcacatggatctggtggcgttgaggtcgacggcagagaggtgtgcgcggtgacaaggctgattggtgcggtgtgcgcggtgacaaggctgattggtgcggcgtgcgcggtgatggggctggttggtgcagtgcttgcgccagaggaggtggtgcaggcggtgacacgacgcagaggagacgggatgctgattgtgatggcggtgcgatggtaa

SEQ ID NO: 60877 - DNA, 2223 bp, Glycine max
  Peptide Sequence Number=SeqID_177655
atgagggctaaaagggataagttgcacactcctgatatcggtttatcctcggaaccaactgccagtgcatctaaaacaacccccacttcagcagaagaccctttcaaagtatttgaatcagcttcagccccagtggattcatctgcaggccactttatggacccattggaggaaattagtaaatttagtagttccagaagcacaaaaaatgatagttcttcaacttcaaatggcaaagtatatgaagatattgatccttttgatggtcttggaaaatctgcaccagctttctcatcagagagaaatagcaggaagggtagcagttccccaaggttgaatacaagcacaagttggactggagataaagaaccagttgataaaatatctgggaggagtcctgagaggcacacacaaaacaagattcctgttgaaaatgatcgagaatttccacatgtcccatttcacatgcctacctattcatctgattctgataaaccagttggcccaaggcctacttcccctccatatgataatgtggattttagacaaaccaatgttcaggcagatatgtctccgaaatatgaagataacttggaaccaagtgaggatatatggttgacagtatcagagattcctctttttacacaaccaactactgctccaccaccttcaagaccccctcctccacggccagtacatattcccaagtcaggaacaagttcaccagcttctgccaatgctagaaagaagactaatgaattttcttcttttcctggctctacccgattcgctcagggtcctaagtctgctccagctgctgaaagggtacccccttcatctcagtttgatgaacttgatgattttgcaatgggcagaagtcgtggtaatgataatgagagtgcaaatggttttcttcctgatgaagaattagagatgaactctgctgctgcggctatgaaggaggcaatggatagagccgaagccaagttcaggcatgcaaaggaagttagggagagagagtattcaaaggctgctaggagtaaagaagctgtgcaaatggaaaaagatgagagaactgtgctagaggagcgagaaaaccaggaaaggttagaccgtgaacggcagcaaaaggagagggaagaaaaggagcagagaagacttatgaaagaaagggaggagaaagaaagagaacaacagcgacttgagagggaaagggcaagacaggctgtagagagagctactagagaagcacgtgaaagagcagctgctgaagcacgccaaagagctgagagggctgctgttgagaaagttaacgctgaagctcgaggacgtgctgaaagagctgcagtgcaaagggcacaagctgaagctcgagaaagggctgctgcagaggcgaaggaaagagctgaaaaagctgctgcagaggcaaaggagagggaaacacgggaaagagctacagctgcaagggctgaagcagaagcacgagttaaagcagaacgtgcctccgtagaaagggctgctgccgaggcccgagaaagggcagcagctgctgcaaggatgaaccaacaaaagaatgaaaatgatcttgaatccttctttggcatgggtgcacgagctagcagtgttccaaggcctcctagggctaactcttcagacaatgtttttgaatcccaatttcagtccgatgtaacaaggaaatctacaagtgcatctacaagtatgaagaaagcatcatcttccactaatattgttgatgatctttcctcaatttttggagctgctccaacatctggagagtttcaggaagttgaaggggaaactgaagaaaggcgacgagccaggttggagcgccaccacaggactaaggagcgtgctgctaaagcattggcggagaagaatcagcgggacttacaaactcaaagagaacaagctgagagacataggcttgccgaaacactggattttgaaattaagcgctgggctgcaggaaaagaggggaatttacgagctttgctttccaccttacaatatgtactgtggcctgaatgtggttggcagccagtttctttaactgatttgattacagctgctgctgttaaaaaagcctataggaaagctacgttgtgtatccatcctgataaagtgcagcagaagggtgccaatctacagcagaaatatgttgcagagaaggtgtttgatctactcaagggtttgatctcatga

SEQ ID NO: 60878 - DNA, 1236 bp, Glycine max
  Peptide Sequence Number=SeqID_177656
atgcctgagaaccctgcagccacaaccaaccttcaagtttttggcatcgaagatgatctgccttcgcactcacagaataactccaaatgctatgatgatgatggccgtctcaaacgaactggaaatgtttggacagcaagcagcagtgataggatcaggggtgcttgggccatagctcagctaggttggattgctggtccaactgtcgtgttcttattctctttggttacttcttgggcaatcaaaaggtcaaactgtttccataaatctgggggcaaaaacccatgtcacatgccaagcaacctatacatgataatttttggcgcaaccgaaatgtttctttctcaaattcccgattttgatcaaatatggtggctctcaacagttgctgcaatcatgtctttcacctattccataattggtctctctcttggaattgccaaagttgcagaaacgggtcccttcaagggtggcctcactggagtcagcattggaccagtgtcagagacccaaaaaatatggaggacttcccaagctcttggtgacatagcctttgcctattcgtatgctgtggttctcatagaaattcaggacaccataaaatctccaccatctgaagcagaaacaatgaagaaggccacattgataagtattgcagtgaccacaacattttacatgctctgtggctgcatggggtatgctgcttttggagatgctgcacctgggaatctgctcactggctttggcttctataacccatattggcttatagacattgcaaatgctgctatagtaattcaccttgtgggagcataccaagtgttttcccaacccatctttgcctttgtggagaaagaggtaacacaaagatggcccaactttaacagggagttcaagattccaattcctggtttctccccatacaaactaaaggtgtttagattagttttgaggacagtgtttgttgtcctaacaactgtgatatcaatgttgcttccattcttcaatgacattgttggagtgattggggcattgggattttggccattaacagtttactttcctgtggagatgtatatttcacagaagaagataccaaaatggagtaacagatggattagtctcaaaatatttagcatggcctgcctcatagtatcagttgttgctgctgttggctcagtggcaggagtcttgcttgaccttaagaaatacaaaccattccactcaaactattaa

SEQ ID NO: 60879 - DNA, 2121 bp, Glycine max
  Peptide Sequence Number=SeqID_177657
atgacgtcatcagagaaggaaaattgggtggctttggtgattctgctgctagggtcttggacattagcaatggcagaggtcacatatgatgggagatcccttatcatcgatggccagaggaaaatactcttctccggttccattcactatcctcgcagcactcctcagatgtggccagcgttgatatcgaaagcaaaagaaggaggactggacgtgattcagacatatgtgttttggaatctacacgagcctcaatttggacagtatgatttcagcggcagatatgacttggtgagattcataaaggaaatacaagttcaaggattatatgtgtgcctcaggattggaccttatatcgaaagtgaatggacatacgggggattcccattttggttgcatgatgttcccgccattgtataccgaactgacaatcaacccttcaagctctacatgcaaaactttacgacgaaaatagtgagcatgatgcagtcagagggtttatatgcttctcaaggaggcccaattatattgtcacagattgagaatgaatatcaaaacgtggaaaaagcatttggagaagacggatcgcggtatgttcagtgggctgcagaaatggcagtgggcctcaagactggcgtaccgtggcttatgtgcaagcaaactgacgctcctgatccactgattaatacatgcaacgggatgagatgtggagaaacttttacaggaccaaactcccccaataagcctgcattttggacagagaattggacttctttctatcaagtttatggaggtgaaccatacataaggtctgccgaagacattgcattccacgtcactctttttattgcaagaaaaaatggaagctatgtcaactactatatgtatcatggtggaactaacttggggagaacgagttcttcttatgttataacatcttattatgatcaagctccacttgatgaatatggtctgttaaggcaacccaagtggggacatctcaaggagttgcatgcagctatcaagtcttgttctaccactttattggaaggaaagcagagcaatttctctttaggtcaactacaggagggctatgtttttgaagaagaaggaaaatgtgttgctttccttgtaaacaatgatcatgtgaaaatgttcaccgtccaattccgcaacagatcatacgaattgccttcaaaatcaattagcattttaccagattgtcaaaatgtgactttcaatacagcaactgtaaatacaaagagcaacagaagaatgacaagtacaatacaaactttcagctcagcggataaatgggagcaatttcaggatgtcatccctaactttgaccagactacattaatatcaaactcattacttgagcaaatgaacgtaaccaaagacaaatcagattacctttggtatactcttagtgaatcaaaactcactgctcagtctgccgctcatgttacccatgcttttgcagatggcacatacctaggaggagcacatgggagtcacgatgtgaagtcattcaccacacaggtccccctaaagctaaatgaagggacaaataatatatctattctaagtgttatggttggactcccggaaaaactgattttcttttctaatcaaaaggatgcaggagcatttcttgaacgaagatttgctggcttaactgcagtggaaattcagtgcagtgaagagtcctacgatttgaccaattctacatggggatatcaggttggattactgggagagcaattagaaatatacgaagaaaaaagtaacagttctattcaatggagtccactagggaatacttgcaatcaaacactcacttggtataagacggcatttgattcacccaagggtgatgagcctgttgcgttgaaccttgagtccatgggaaaaggtcaagcttgggtgaatggggaaagcattggtcgttattggatctcgttccatgattccaaaggccagccttcacaaacgctgtatcacgtgcctcggtcgttcctcaaagacattggaaacagtttggttttgtttgaggaggaaggtgggaatcctcttcatatctccctcgacactatttcatctacaaatatttcatag

SEQ ID NO: 60880 - DNA, 228 bp, Glycine max
  Peptide Sequence Number=SeqID_177658
atggccaacgtagcagagccaatccataaaaggagaacttgggtaggaaatgctttaatagttacttcaatcctcttcaaatattctcttaggaaacatacaagacagaatgaaatgaaagtaaaaagatggggacaaagaatcagcacgagctacaaagtctgggaacagctattagtgcatgaaaaagatgctttaatgggatgtggaatgagcatgtcactatga

SEQ ID NO: 60881 - DNA, 201 bp, Glycine max
  Peptide Sequence Number=SeqID_177659
atgggtgacaagatggccatggttgcttgtggctggcggcatacaagatgtgtttcatcttctggtggattatacacaactggatggggcaaatacggccagctaggacatgggaattttgaggatcatcttgtgcctcgcaaggttcaagccttgagtgacaagttcatttcgcaggtggtccttcaaattcatgcttag

SEQ ID NO: 60882 - DNA, 177 bp, Glycine max
  Peptide Sequence Number=SeqID_177660
atggcacgttctgagtctggcagggatgtatatagttggggatgtgataaggaaccaaaggcagcagcagggaacatattcatgaagctagaagcaagggtgcaagcagatgtgcaagaagtaaacaagcccaaaagaagaattacgaaaccttcgtaccttaaggatttcgtatga

SEQ ID NO: 60883 - DNA, 420 bp, Glycine max
  Peptide Sequence Number=SeqID_177661
atggtgaacttggacttggaaccacagaggactctcttctgccacaaaaaattcaaaaatttgagtttaagaaatttcagaaaccatgaggttagtaagattattttttattttttcgagaaggagaaagttggaaatacattcaaaaaggtggaactgaatgccatggtaatctttctccttgctaactcctcctccaaggtcttctcttctggtgattggtgctcgacagtaaaaggaagggagtattggtatgtccccgtgttcggacatggcaactggctgaatacaaatattcagggaatacctatcaaaatggttgctgccggtgctgaacatagtgtagcaatcactgaagatgggaatttgtatggatggggttggggccgatatggaaacttgggattgggtgacaaatga

SEQ ID NO: 60884 - DNA, 576 bp, Glycine max
  Peptide Sequence Number=SeqID_177662
atgctgggaaaatcaactttcgggttgtccatgtggttgctcaagtggttacccatgcgacttgtcgatcgattcttgctaatggtgtcatggcttctgcttggtgacacttctcatttgggattggataggcctcgtttgggtcccttagaactcaaaaacctttcaggaaaaacccctgtgctagatgtgggtacccttgccaagattaaaggtggagacattaaggtacgtccagccattaagcgacttaaacgtcacactgtggaattcgtggatggaaggacagagaattatgatgcaatcatattggcaactggttacaaaagcaatgtgccctattggcttaaggaagaagatatgttctctaagaaagatgggtaccctaggaggccatttccaaatgggaggaaaggtagaaatgggctctatgcggttggttttaccaaaaagggtctactaggtgcgtccatggatgcaaagagaatagccgaagacattgaacagtgttgggaaactggggcaaatcatagaactactcttgctccttcacacttgccgcaaccaaattcataa

SEQ ID NO: 60885 - DNA, 1548 bp, Glycine max
  Peptide Sequence Number=SeqID_177663
atgttggaaatagtgggaaacaaagacactaaatcagttgtcatcactggccattccattggaggagccactgcttctttgtgcactctttggcttctgtcttacctccaatccatctcttcatctgtgtcaatattgtgcatcacttatggggcaccgttgattgggaacgagtccttttcccaaaccattttcaaagaaagatggggtggcaacttctgccacgtggtgtcaaagcatgacataatgccaaggttgctctttgcccctataacctctctctctacccagctaaattccctgctacagttttggcacttgtccatgacttcaccagattttgggaagcttgcaaatcagatatctgaaaaagagaaagataagttgttcactgctgtaatggattacttggaagcagcaacacaagatggagaaaaatcagcgccaattttgtttcacccttttgggagctacttttttgtctcagaagaaggagcagtgtgtgtggatagtccatccgctattataaagatgatgcacttgatgcttgcaactagttctccagctagtagtattgaggaccatctgaagtacggagattatgttaataaaatgtctgcacaaacattgtatcagagcaactccatgcaaaagaacatccctgactcaagctatgaagcagggcttgaattggccattcagtcctctggcatagcaaaccaggaaccagctattacatccgccaaggaatgtctgaagacaacaaggagaatgggtccttcaccaaccctgaatgctgcaagcctggcagttagcttatccaaggtggtaccttatagagcgcaaatagaatggtacaagacttggtgcgatgagcaagacgaccaaatgggttattacgactcattcaaaagcagggactcttccagttccaaaagggacatgaaaatcaacatcaaccgttgcaagcttgccaggttttggaacaacgttattgacatgttggaaaggggagagctacctcatgattttgacaagagagccaagtgggtgaatacttcacacttctataagctattggttgagccactagacattgctgaatattatgggaaggggatgcatagaaccaagggccattacatgcagcatggtagagagagaagatatgagatttttgataggtggtggaaggataaaacggttactactggtagagaagaaaacaaggagaggagcaaatttgctagtttgacccaagattcatgcttttgggccagagtggaggaagcaagggactggttgaattgtgttagaagcgagagagacactaacaagttggctctattgtgggataagattgaaaattttgagaaatatgccatagatttaattgaaaataaggaagtgtctggtgatgttctctttaagaattcaagttacagtatatgggtggaggatttaagagaattgaaacaactgaaagctaaggtgcaaaggtttcctcgtcagtttaccggttttctagatggggaagtagttccttag

SEQ ID NO: 60886 - DNA, 285 bp, Glycine max
  Peptide Sequence Number=SeqID_177664
atgcagagggatgaacgagtacagtgggtcaaggaccaaaagggaaagaggaatgtctgcatcttccaacagggaatggtggattggttggtattggtggatgaaataaaattcacggcttggtcgtggctgtacaataaccatccagagtttaatatttcctttgtgcaatggagctctaacatagctgcatgtcggtgggtttggcacatgcacgtagggaaccacgttttctgctgtggactgcatgctaagagggagccaacatttatgtttggtacataa

SEQ ID NO: 60887 - DNA, 210 bp, Glycine max
  Peptide Sequence Number=SeqID_177665
atgaagaacgaacgaagaatgatgaagaacgatgaagaacggagaagaatcttcacgaaattgctcacggaagagataaaagggaggtggttgtcgcccagctcgcccaggcgagctgggttgcttccaccagaaggcaccgccttctgtttgaaccccctggaaggcccaagtgggcctggttgctatttgcacacctatttttactaa

SEQ ID NO: 60888 - DNA, 540 bp, Glycine max
  Peptide Sequence Number=SeqID_177666
atggctttccacgagcatctaccgcacgaaatcacgttccagccgttcgcggaggagcagcagcagcagcagttaggtcagagccgggacatgcagcggctcctgccactctcgggcggggcgccgacgtggttgaacaacagcaacgccgccacgctccgccagcagaatttcctccacctgcagccggaatccgccgcgacggcggcgcagcaaaacgacgacgttcgtgctatggatcggaaccggaccgagagcaactctgaagcggacgatttggcggaatacaaagcagatattttaggtcaccctctctacgaccagctcctatcggcgcacgtctcgtgcttgagaatcgccacgcccgttgaccagcttccaaggatcgacgcgcagcttcagcagtcgcagcgcgtcgtcgacaagtactccggcctcggaaatggaaacggcgtcgtcgatgacaaagagctcgatcaattcatggtttgcacttgcttcctctctcacaatcttcttattacgatcatggttttataa

SEQ ID NO: 60889 - DNA, 297 bp, Glycine max
  Peptide Sequence Number=SeqID_177667
atggcaacaagtccacttacgacatcggaatcggggcgaactccggaagcttcattacaggaggattcctccccggattggaactcatgccaggattggaaatgccagcgggataaggttgtgtgccctttgctagacaggtgccgggttggaagggtttccgacgtgggtcgaaaagcttggttgatgttgggcatattggtagaagcgaaagtcatagcgtgggcatccccttccttcttctttgccccagttgctccgaatcttctattgctcatactggccggagcaacataa

SEQ ID NO: 60890 - DNA, 384 bp, Glycine max
  Peptide Sequence Number=SeqID_177668
atgcgcttaacgcgagacctcgcgctaagcgcccaggggcaaccaagggacgattcccttggtgcgcttagcgaccacatgcgtgctaagcgcgcaagtcataaattcctggggagttttcaaaactccccaacccctcagttgcctcccaggggctacgacgagcgcgctaagccaacaagaataacagcagaagcacgaagcacgcgcttagccggcacctccgcgctaagcgcactcatgaatctcagtgagcgcgctaagctcgtgccccaagagctaagcgcgtgcatctgccatcagccttcacgctttactctttgcaccccaacttctactctccacatcccccttctagctactttctgcacccttctttactaa

SEQ ID NO: 60891 - DNA, 753 bp, Glycine max
  Peptide Sequence Number=SeqID_177669
atggcctcccgtaaacaccaagcagtgcccacacctggggaagcgtccaactgggactcttcccacttcacttcaaagattgcctggcacaggtaccaggacaacattcagctccggaacatccttccggagaggaatgctgaacttggacccgtgatgtttgatgagttcctccaggaactcaggaggtgtcgatgggaccaggtgcttacacgactatcggagaagaggatcgatgtggctctggtgaaggagttctactcgaacctttatgatctagaggaccacaatccccgattttgccgggtgcgaggacaggtcgttcgctttgacgcggacacgattaacgacttcctcgacaccccagtcatcttagaggacggggaggagtacccagtctacaccagatatctcaacactcatcccgatccaaacaccatccccgccacattatgtactccaggagggcgttttgttctaaacgccgatggtcttccttggaagctgctgaggaaggacatgacgacactcgctcagacatggagtgtcctctcttattatgatcttgcacccacttctcacacatatgatgttaatcttgacaaggcacgcttgatctacagcttggtgagccggatggatatggacgtgggcaactttatatctcagcagatcagtcagattgcccagtccagtacctcgaggctcgggttcccgacgttgatcacagcgttgtgtgacattcaaggggtg

SEQ ID NO: 60892 - DNA, 141 bp, Glycine max
  Peptide Sequence Number=SeqID_177670
atggctctgggatctggtctgtggaagtctcatcctcctaagccacgtgctcttgggctgtggaggccccaccccctccagaaggagaaggctaggctcctggctaggccacctgcacatcaaactcatccatgctcatga

SEQ ID NO: 60893 - DNA, 507 bp, Glycine max
  Peptide Sequence Number=SeqID_177671
atggaaatagctccaaagaagcttctatctaagagggcaaggaaagacaccactgaagaagggtctagtgcggcctcacaagcggatatggaatttgacaaacatcggttccaaagtgagaaacaccaatgccgctttgaagcaatcaagagttggtctttcctcaaggagagacgggtcaagttgagagggggagagtacgttgagttccaagaggaaatttccaggaggcagtggactcaacttgcggggcccatggctaaatatgatccagaaatagtcatggagttctacgccaatgcatggcccacagaggagggagtcagggataagcgctcctgggtgtggggccaatggatcccctttgatgaagataccattaatcagttcttggggcttctgttggtcttagaagaggggcaacgctgcaaattcagtcagaggaggagccaggcctcggggtttgatgaggaggccatcagtcagcagctatgtgttccagggtaa

SEQ ID NO: 60894 - DNA, 1380 bp, Glycine max
  Peptide Sequence Number=SeqID_177672
atggccgagtttggaacgagaacgggatctatatggacggtgctgttctgttttgcgtcggtggtggcgatcgttgcttcagaaagaagcattatgaaaatggaagtggcgagattcaatgttaccacctcccgagagcctcaacagagtttcctcaccaaagctttgaatttcttatggcaatctggagaatcagggtaccaacacgtgtggccggatatggaatttggatggcaaattgtcgtgggtacttttgttgggttttgtggtgccgcgtttggaagtgttggtggtgttggtggaggtggcatattcgtccctatgcttagcctaatcgttggatttgatcaaaaatcatccacagctatctcaaaatgtatgatcatgggcgcagccgtgtcaactgtttactacaaccttaagctaagacatcctacgttgaatatgcccatcattgactatgatttggcacttctcattcaaccaatgctcatgcttggcatcagcattggagtggtcttcaacgttgtatttccagattggattgtgactatattgcttattgttctcttcttaggcacatcaacaaaagcattctttaaggggattgaaacatggaaaaaggaaaccataatgaaaaaggaagctgctaaacgtcaagaatcaaacggttctggggctgaagtggaatacaaacctcttcccagtggaccaaatggtgccaatgaaaaggacaccaaggaacaagaggtgactattattgaaaatgtatattggaaggagtttggccttcttgtatttgtttgggtttcattccttgcactacagattgccaaggttccagtttcagttggagtaacagcatatgaggcagctgccttgttcagtggacgtagagtaattgcttccacgggagaacaagggaaagatttcactgttctccagctaattatctattgtgtctttggtgtactggctggtgtagttggtggcatgttgggactaggaggaggattcgttatgggtccactttttctggaactgggagtcccacctcaggtttctagcgccacagccacctttgccatgaccttttcctcatctatgtctgttatagaatactacctgttgaaacgttttccaattccttatgctctttacttcgtccttgtggctactattgctgccttcgttggacagcacattgtgagaaaactaatcatcttatttgggagagcatctcttatcatctttattctagcctctacaatatttgtcagtgcagtctcattaggtggagttggcattgtaaatatggtacacaagatcgataatcatgaatacatgggatttgaggatctctgcaaatacgggtcatag

SEQ ID NO: 60895 - DNA, 1224 bp, Glycine max
  Peptide Sequence Number=SeqID_177673
atggtccttctatacctcccaaggtttcctctctacctcgttaccttatctcactccctccctcgtcgaacctactccaaaaccaccctcttacgcccacccaaatccactctcacaacctcacaacccttaaccgttaacccttcccccacagagctatccctcgagaagctcttcgttccgccggagaccaccgtgtccctcgaaagttcaagagtcttgaacggttctaacattctgctgagtaactacgccaacgatgctcaggtattgcaggccgagtttgtgaaaagcagtgtgaagactgaagactgtccctccgatggaattcccgagttcgctctcgttggccgctccaacgtcggcaaatcctcgctccttaattccctcgtccgccgcaagaaactcgccttaacttcgaagaaacccgggatggagttttatgaattggtggattggaattcaatgcagacaaagccaatgacatttatttgccattatgttcttgtcattaggtatgcatctgcaccacatgaacttaggatggattgggaaaaattcaccaaggactatttccttaaccgctcaaccttagtttcagtattccttctaatagatgctagcattcctgctaaacaaattgatcttgactatgccagttggttgggtcagaatcagatcccaatgacattaatcttcaccaaatgtgacaagcggaaaaagaaaaagaatggaggcaaaagaccagaagacaatgttaatgattttcaggatttgattcgagcgttactaatcagggtcgtgatgagatactcctccatatggcccagctacggaactactggctcaagcactagttctgagaaacatgacatagttagagcaggcgttaatctgaatgggttacatccaccatggaagaaccggtctcaggcacttattcagattcagaaccgccaccggcgtggcgacaaattcctgcacgaaattaccgcggaggtggagaaagacaggcgcagggagcgaaacgagcgtttgcgcctcggcctcgacaccgccgacatcgacgccgagtcggagcaggactacatgggcgtggggcccctcatcgcgaagctcgagaaggaaatgctcaaggaatctgctgagctgaaccgctacgaggagcccaccgactccgaggacgactccgacgaggaaaccatggacgacgccgacaagaag

SEQ ID NO: 60896 - DNA, 894 bp, Glycine max
  Peptide Sequence Number=SeqID_177674
atggcaaatgtcattataccagtagccgccacaaaggcgtattcttgggctttagtaaaaggtgaaagggaaggttccgtgattttgatttacgcagcgattcggataacgaaagcaattttgatttgtgtcgaggaaaggacaggtcttagaacccttcttttcttcctcgtgtgcgtgaaaacgaagcaacgccacacgatggtgttctacttcaaagcgcgccctgaagccggcgatttcaccatcttcatgggcctcgacaagttcgagaacgaggaactcatcaaatacggttttcccgaagacatctggttccatgttgataaaatgtcttcagcccatgtctatgtcaggctgcacaaaggccagactctcgatgacctgagtgaggctttactggaagattgtgctcagcttgtcaaagcaaattcaattcaaggaaataaagtgaacaatgttgatgttgtttacactccctggtctaatttaaagaaaactgcttcaatggatgttgggcaagttggttttcacaactcaaaaatggttcgaactgtgagagttgagaagcggataaatgagattgttaacaggctaaacaagacaaaagtggaaaggaaacctgatttgaaaggtgagcgagaagcagtcggtgcagctgagagagctgagaggaaacaacaactgagagaaaaaaaacgccgtgaggaattggaaaggcttgaaaaggagaaacaaacagagcttaggagctacaagggtttgatggttgcagaaaatatgacatccaacaaacaaattgcatcaggaagcaaatcattgcaggaactggaggaggatttcatgcagatgactggtggccaacttaccacctggcagatttatgttgattaa

SEQ ID NO: 60897 - DNA, 1935 bp, Glycine max
  Peptide Sequence Number=SeqID_177675
atgcttgcagttgcaccatattccccggcggccccgccaccactgtcgttgctgtttgacataactcctccgccgtcaccttcaatgtatccgacgcctccagcacctccagtcaccccgccgccggaaactttactcgttcaagattcgccgccgccatcttcagtcacaccacttcctctcacggagccgttgttgccgtctccctcgccggaatctctgccaccgccattgccatcgtccactgttacgccatcgcctccaactccgaccgccgaatctcagccaccgccgtttccatttgccacagctcctgcaccgacaacgtttccgccgtttgcagttgcaccgtcgcctccaactccaaccgccacttttccacctgcattgccagaaatgcctccggcgacagcggcgactgtgactgttccttcgccgcctcaacatccaccattcatgacggaacctactttggcaacgccgtggtttcctgcgttgccggcatcggcgccggaagtgaattttccgtcaacagcacgaggtggaagtttgccggtggctgtggatgttcagaagccttcaacattccacgtgtcaagtggtctcatttttgggcttgtaattgcagctatcgttttcgtctttgtttttactgttggatcagtgctacgctggaataggaagaaaaacaaacacaataatctatccacccctcactataaggaatcatctccctctcttggatccaaggggtctcatgttattcgagtgtcaccaaatccaacgctgccaccaccgccacctctcactgagggcggtggagcttctggctcttttaattcagtatctgtgaaagcaattccaaatcatgctccaagaggtgcctttggtcccgcgaatggtattttcacgtatgatgaattattagtggccactaaatgtttctctgagtccaaccttcttggagaaggtggttttgggtatgtgtacaaaggagttctcccatgtggaaaggaaattgcagttaagcagttaaaatcaggaagccaacaaggagagagagagtttcaagctgaggttgagaccattagccgagtgcatcataaacatcttgttgaatttgttggatactgcgttacaagggcagagagattgctcgtttacgaatttgttccaaataacacattggaattccacttacatggtaatccggcaattattcaccgagatattaaagcatctaatatccttcttgattttaagtttgaacccaaggtttctgactttggcttggcaaaaatcttccctaacaacgatagttgcattagtcacctcaccactcgagtgatgggaacctttgggtatctagctccggagtatgcatcaagtggtaaattgacagataaatcagatgtatattcctatggcatcatgcttttagaacttataaccggacatccaccaatcactacagcaggatcaagaaatgagagcctcgtcgactgggctaggccattgcttgctcaagcactacaagatggtgacttcgacaatcttgttgatccaaggttgcagaaaagttacgaagctgatgagatggaaagaatgattacctgcgcagctgcttgtgtgcgccattcagccaggcttcgacctcgaatgagccaaatagttggagccttagaaggagtggtttctctaaccgatcttgttggggatgttacaacagggcttaccacagacacggtatacaattggtcaaatattttagattatgatgctggccattaccagcaggacatgagaaatttcaatttggcattatcatgtcataaatacagctccagcgggtatagtgaaaccactagtgcttatgggcttcactcatcaggctcaagtagtgaggctcagcaatcatttcgagacatagtataa

SEQ ID NO: 60898 - DNA, 312 bp, Glycine max
  Peptide Sequence Number=SeqID_177676
atggagacccaagatgcgaccatggccggaccatggctggagactcgaccatgtgcttcattgttgacgccagcgaaggtgacgcgagactaccatggccagaggtggagacgcgaagtgaaggtgaggccaggcgaaggtgttgcagtggtggccggaggtgttaacgaatgtagccatggaggaaaggaagaaaatagagagaaggagatgaagaagatagagaggaggagagggggaagcttatggagaaaagaagaaaagacgtgctggagagagagaacaaagttatcgagaaaagaagaaaagtag

SEQ ID NO: 60899 - DNA, 555 bp, Glycine max
  Peptide Sequence Number=SeqID_177677
atgacagttatctccttatccataggtccaacatcatttgcccctgtaatcgacgcagcagtaggcattgtggaaagaagtaacggtcaatatcatgttcttgtcattattgctgatggacaggtcactagaaattctgatacaccacatggaaagtttagtccacaagaaaaagcaactattaacttcatcattgctgcaagctattctgattatcagccactatcccctcaattattttggttggagttggagatggaccatgggatgatgcagcactttgatgataacattactcagcgcttatttgacaactttcagtcatttgcacttgctgcccttatggaaattccaattcagtaccggataacccaaaatctacaaattgcaaatgaaaatccaacaagttatcaacataaaaggcctcttccttccagttgcagtagaatcagtatgttactcactgaatcaacttgcaaggagtgtggtgtgacattatcttcatgccctatgtgccggcaagaaattacaactcgcctgagactatacacttag

SEQ ID NO: 60900 - DNA, 2934 bp, Glycine max
  Peptide Sequence Number=SeqID_177678
atggaaggtgaccagacaatccctgctgcatcagatgtggtgatagaaggtgttcagaaaattagagctcttaatgggaggactactggccctacaaggcgctctaccaaaggacaatggacacctgaagaggacgagattttgcggaaggctgttcagcgtttcaaaggaaagaactggaaaaaaatagctgagtgtttcaaggatagaactgatgtacaatgcttgcataggtggcagaaagtcttaaatccagaacttgtcaaaggtccatggtctaaagagtcatctatcgaatctgaatgcaaacaggaggatgaaataattattgatttggtgaatagatatggacctaaaaagtggtctactatcgcacaacacttacctggacgtattggtaagcaatgtcgagaaaggtggcataatcatcttaatcctactataaataaggaagcatggacgcaggaagaggagttggctctcatacgcgcacatcagatttatgggaacagatgggcagaattagcgaagttattgcctggaaggacagacaattctataaaaaaccattggaatagttctgtaaaaaaaaaattggattcttacttggcatcaggcctgcttactcagttacaaaatgtaccacttgttggaaatccgaatcaacctattgcttccatctcttcgaggttgcagcagagtggagatgataatggtcccaggggaactgaaggagaggaagtttcacagtgtagccaggagtcagctaatgctggtcacttttcatcagccagagatatgagcagtgttgttttacaaacaggagaggaatacagaccaagtgaagaacctagtcaagcatcctgttcagagccatattatgtgtctctggatgaagtaactgcatcccttcaagacatggctggccaagagatttgcacttctcaattcattgaacagaaatattcacacaaacctagaaattcctcaaacggggactgccagcttgatttacttgacttgaccaatatttcctcactggactttgggcaggaatcatcacagatgcaaaatgattgcgtagctcctagtgaaaatcacaacattgtgaatgttccgtttcagacttcgatggggttaggtgttgcaacgaccatgggacctacatctgttaaaccagaacacatgttgatgtctgatgatgaatgttgcagaatcctattttcagaagcaataagtgatgaatgcttttcttctggagattacagtaaaggtgtaaacatggttaacttgtcaggatgtacctcatttctttgtcagtcatcattaccatctgtcccatcagtagtttcttctgctggtgataggttgacgtatacatatacagccgaagccaatcagttggttgggtctgaggatcagcagtttgtctccagaacacaggacaacataatttatgctaatgacttgtccagttctccttgtatccataggatagacagcacagaaatgcaagagccatcagatgttgtgaaaggtgattcaaaattggtccctgtaaatagttttggctgtggatcagacgctaagcaaacttcctatccaacggatgaaaagccaaatatgcttacagaacaggaggacaaaggtgccctatgttatgaacctccccgctttccaagcttggacattcctttcttaagctgtgatcttatacaatctgggggtgatatgcagcaggaattcagtcccctaggtatccgccaatttatgatgtcttctatgaatatggacctaactccttttagattatgggactcaccttctcgtgatgatagtcctgatgctttgttaaaaagtgcggctaaaaccttcacaggtacaccatctatattaaagaaacgaaaccgagaccttttatctccactatcagataaaagaattgacaagagacttgagattgaaatgacatcaaccttgataaaaaacttttcccgattggatgtcatgtttgatgacaatgagactcagggagcagatttgcttcctgcatcttcaatgcaaaagagggactctggtacctctgttgaaggtgataaacagaattgtggacaagctgttaaagtggaacaagtagaggataaaaacaagtctgcaattttgaacgacaaaaaatcagaagacgattcgggtgataacaattctctggataaaattaagcagcaacctcttgatgttgattctgagataaagaatgatgctagtgctgctgctgaaattgtgcaacaaccatctggaattttggttgaacatgataggaatgatctgttactgtattcacctgatcagtctatcagttcatcaggcccgggggagaattcgggtgatcacattggaaacgatggtggtcttgaaacatgtaacatatttggtggaacaccttttaggaaaagcattgaatcaccttcagcatggaaatctccttggttcatgaacacttttttgtccagccccaggattgatactgaaattacaattgagattttaattcaccacaataaaaacagagcatttttacaggattttgggtatttcatgagccctggtgacagaagctatgatgcaatcgggttgatgaaacagatcagtgaacaaactgcggctcaatatgccagcgctcaagagattctgggaaatgagactcctaaggcattaccaaaagatgcttccagaaacgacagggatgaagatcaggaacatatcgatgctcataatcagcatgggaaccattgtcagttggcttcaagtgctctggtggagcgacgtgtacttgacttcagcgaatgtggaactccggtccgaggtgatagcagcaaatcctcagctaagaacttttcaagcccttcttcgtatttgttgaagggctgtagatag

SEQ ID NO: 60901 - DNA, 333 bp, Glycine max
  Peptide Sequence Number=SeqID_177679
cgcacacatcactcctcactcactcggcggcacacacaaaaccctttctcagtcactcactcggcaaaagagaagcgtcgacggtctgcacacggtgggtgcttcatcgacggcagcgacctgtggcggaggacagggttcccttcgctcttggagttcgcatcgggcagagaagcttctctgcattgcgctgggacgcaaaacccttgcagcaatcagcaccacggcgcagccgcacacctctgagacgccaccgcaatcaggtctcgattttgagttcggaggtggcattgatgaattgctctgcattccgcttatttcttgctctttgaa

SEQ ID NO: 60902 - DNA, 656 bp, Glycine max
  Peptide Sequence Number=SeqID_177680
atggaagatgagagccataataacattttgccaaatggattcaacacaggaagcaccgaaagtccttgcttaaagacaagcaccatgaccacacaacacaacaataacaataatcatcagaaccatagcaacaaagaacaggaccggtttctccctatagccaacgtgggaagaatcatgaaaaaagtgattcccccaaacggcaaaatctcaaaggatgcaaaagagacagttcaagaatgtgtatccgagttcataagttttgtgacaggggaagcttctgacaaatgccagagggaaaagagaaagaccatcaatggagacgatgtcatatgggccatcacaaccctaggctttgaggattacgtggaacccttgaaaacttacctccagaaatataaagagatagaaggagaaaaacttaacattccgaagcaactacgttctgaacaaaggctacatcaacatcagcaaaaccataataataatcacgacgaaaataataatcaaccattcaatggtgcatatgcctcatcaaatctcatttctcagcctccttatgtgcccactgatcagaagttttcactgcccttctccccaaactcgattcagaatcagctacggcagcaagaacagattgattcagtggggcactg

SEQ ID NO: 60903 - DNA, 309 bp, Glycine max
  Peptide Sequence Number=SeqID_177681
atgcctacaattgagctagacttcccaaatggaaagaagttccctggcaatggcaccaaaaacttgttccacccctatactacttgttattatggatgcgaaatcttattggcaagtgtaccgagtcgtgcaagtagtaacaaaacgggtatggaacctagtgaggagtgtttggattgcgggatgagaggccagttccctgtgttcgagacaatcggtgaaactgggacgaggtcaacatgcccagggttgattcattgccctgatgagttcgaccaagtggtcatcatggaagaacttcatacatag

SEQ ID NO: 60904 - DNA, 414 bp, Glycine max
  Peptide Sequence Number=SeqID_177682
atgacctctatggacggcctggagaaggaagtagcggtggaagggaaacagaatgcgggggtggcaagggttggtgtggtggagcacgagggtgagacgactgacggacgtccaagagtttctcctcttggaggcgagccagactggccgcttgcaccaagtaaggctcgatacacaacaactcaggagaaagggcggcagaaggccaatgatttgattggcgaggtcttcgaactccgacagggcttgaagaaaaatgggccaggaggtgaattggccattaccggtactgacggtagtggcggaacatacatggttgaggaaggggatgatgagaggattggcgtcatgaggtggagcagttcatcaatattgagggtcaaggactgcatggattccccaagggacatctaa

SEQ ID NO: 60905 - DNA, 1557 bp, Glycine max
  Peptide Sequence Number=SeqID_177683
atggctcaagccaaatatactagaatagataataataataagcgaccgtcgagttactgttcaacagtgactattgtcgtgtttgtagctctttgcttgtttgggatttggatgatgacatcgtcatctgttacgcccgtgcaaaatgtagatgtgtctcaagagaataacaatgaggtgaaggaacagagtgaggcgaaggaacagccaactgacccctctaataacaattctcagcagtttgaagataatcggggtgatctgtctgaggatgcaaccaaaggggatggtagtgtcacccctgctacaaactatgacgtgacagaaaaacaggacgagaaatcagacgaaaagtctcaagaaaaaccttctgaagatacaaaaacagaaaatcaagattcaagtgtgagcgagaagagatccgattccgacgagagcgagaagagatctgattctgatgagagcgagaaaaagtctgattctgatgagagcgagaaaaagtctgattctgatgagagcgagaagaagtctgattctgatgagagcgagaagaagtctgattctgatgagagcgagaagaagtctgaatataatgagactgaaaagaattctgaatcaaatgactcgagtgaaagggagaataaatctgattcagatgaaaatgaaaagaagtctgatgatgcaagtgaaacaacagataagactgaagaaaaagtggaacaaagtagtaaccaagagtctgatgaaaactccaacgagaagaaaacagatgacaatgccaacagtcagggttcaaatgaggtttacccttccgtggctcagtcagagcttctgaatgaaagtaccactcaaaatggttcttttacaactcaggcagcagagtcaaagaatgaaaaggagtctcaagtatcctccaagcaatctgctaattggaaactgtgtaatgtcactgctggccctgattacatcccatgcctcgacaacttgaaagcaattaagagtcttccaagtaccaaacactatgaacacagagaaaggcaatgtcctaaagaatctcctacctgccttgtccctcttcctgaaggatacaaacgcccgattgaatggcccaaaagcagagagaagatatggtattctaatgttccacacactaagcttgctgaatataaggggcaccagaattgggtgaaagttacaggcgagtaccttacctttccaggtggtggaacccaattcaaacacggtgcacttcattacattgacaccatacaacagtctgtaccagatattgcttggggcaatcgctcacgtgtgattttagatgttgggtgtggtgttgccagctttggtggctttctctttgaaagagatgtacttacaatgtcattggcaccaaaagatgaacatgaagctcaggtacagtttgcacttgaaagagggattcctgctatatctgctgtgatgggcacaaagaggcttccctaccctgggagagtgtttgatgtagtccattgtgcacggtgtagagttccatggcatatagaaggtattcaatga

SEQ ID NO: 60906 - DNA, 126 bp, Glycine max
  Peptide Sequence Number=SeqID_177684
atgggtcgtaacaaagatggtactcccaagactaagaaaccaagtgcactcttcagctttaaagggagggctccccaagtcttgagtgcttatcagtacgaaagcaggggaaccagagtccattag

SEQ ID NO: 60907 - DNA, 351 bp, Glycine max
  Peptide Sequence Number=SeqID_177685
atgcctgaacaaacattaggttgtcaggtgggtaatttggtggccactaactcagaaggtgagaaaataatgggttttcgcatagtaggtattgttaggcggacttcgttttctacaacccaagcagcctccaagagggttgacgtaccaaaaggctatgctgcagtctatgttggagataagatgagacggttcacaattccagtatcatacttgaacgaaccttcatttcaagaattactcagtcaagcagaagaagaattcggatatgatcatccaatgggtggtctaacaataccatacaaggaagaggagttcctaaacgttaccgctcacttgaatgagctgtaa

SEQ ID NO: 60908 - DNA, 552 bp, Glycine max
  Peptide Sequence Number=SeqID_177686
atgaaagggggaaatagttatagctttagagggaggcatatttccctggctctggttattcttgttattcttaccatgttactgtggacatgggagagaaatccaataattgccatgactttaagatcagctcaagaatggtatcgcttaccttcagaatttcctgtggaagccccaattgaatcagtgggaacttcaacactggaaaagggtgtggaaaaatccatatcccccatcactgaaaatggaacaaaacttcaacttgatactcagggtgtggaagctgtagattctacacctacagaatctccagaaactcaatacaatcaaaatgtcatgccttcttccagaagtaaagtaacaccaacaccgaaaaaaggtgtggaaaaatccacaacccccatcacagaaaatggaacaaaacttcaatttgataccaaggatgtggcagctgtagattctatacctgcagaatctccagaaactctataccatcaaactgtcatgtcttcttcaagaagtaaaggtagattctttttgttctgttcttaa

SEQ ID NO: 60909 - DNA, 1032 bp, Glycine max
  Peptide Sequence Number=SeqID_177687
atggccaccaaaattcagttccatcatatttcattggcattatttttctgtttgggattcttggcttttcaagtcgcatctcgcactctccaagatgcatccatgtatgagaggcacgaacaatggatggctcgttatggcaaggtgtataaggatcctgaggaaaaggaaaaacgtttcagggtatttaaggaaaatgtgaattacattgaagccttcaacaatgctgccaataaaccttacaagctaggcattaatcaatttgcagacctcaccagcgaggagttcattgtgccaagaaatagattcaatgggcacatgcgttcctcaaacacaagaacaaccacttttaagtatgaaaatgtgactgtgctaccagactcaatagattggagacagaaaggagcagttacacccatcaagaaccaaggctcatgtggatgttgttgggcgttttctgctattgcagcaactgaaggaattcataagaaaagtacaggaaaattggtctctctctcagaacaggaagttgttgattgtgacacaaagggtacagaccatggttgcgagggtggttatatggatggtgctttcaaattcatcattcaaaatcatggaattaacactgaagccagttacccttataagggtgttgatggaaaatccaatataaaggaagaagcggtccacgctgctaccatcactggctatgaagatgtccctattaacaatgagaaggcactgcaaaaagccgtagcaaatcaaccagtttctgtagccattgatgccagtggtgctgattttcaattttacaagagcggtattttcactggttcatgtggaactgagttagatcacggtgtcactgctgtgggatatggtgaaaacaatgaaggaactaagtattggttggttaagaactcatggggaaccgagtggggtgaagaaggctacattatgatgcagaggggtgtgaaagctgtggaaggaatctgtggcatagctatgatggcatcttaccctactgcataa

SEQ ID NO: 60910 - DNA, 603 bp, Glycine max
  Peptide Sequence Number=SeqID_177688
atggcggaagaattatcaacagcgattccacaatcgcaagcaagctccacgaagaaacgagcttcaaagaacaaaaagcggtgcctcgaggactaccttcacctcgttcactctcgccaaacgcttcatctcaccatgaatcaactcaatcagttctcgttctcaaaaaaactccgatcgttctctctgaacactcgcgattcgttttcctccttccttctatcacaggtcatccgcattcacggcttcaagaaaatccaccacgctcctaagcatcagcgagaaagtcctccaaggccgtccatatgcccgtgcctccctgttggtcccatccaaccagtcttgtcttatagtcctcccacctcagtgattcatgcatttaggacaacagaagtgattcacatcctaaagcatttgaagttcaaaagcttgcatcttattcacaagtttttccttacaatattctcttcccaagtctcgactcatacaacaacaatgggttttcgcttacctggcatcaggaagacatcaattgctgcaaaccaagcatcttccaaagctgtggaggttccaaagggctaccttgtagtctatgttggatag

SEQ ID NO: 60911 - DNA, 1965 bp, Glycine max
  Peptide Sequence Number=SeqID_177689
atgatgcaaggctgtgaggttgaggccataggcataagctacacgatccacacacacaaatcggagaacccttttaaaatcttgagcaaatctgcacaagaacaacttgacactgaacaagatggtaaaaaagaagcagcagaagaggaagcacaagttgaacaaagttgcagtggtggagtaaggcatgttctgaagaatgtgagtttccaagccaagccatgggagatcctagcaatagttgggccaagtggagctggaaaatcatcgctgcttgagattcttgctggtaaacacagccctcaaagtggaacggtgtttctgaaccacaagcctgtagacaaagctcagttcaggaagctttcagggtatgtcacacaaaaggacactttgtttcctttacttacagttgaagaaaccctcatgtttagtgcaaagctgaggctgaagctttctcaagagcaactttgctccagggtcaagtcactgattaaggagcttggacttgaccatgttgctgccactagaattggtgatgataggctccgaggcatatctggtggtgagaggcgcagagtctccattggtgttgaagtcattcatgatccaaaagtgctgattcttgatgaaccaacctcagggcttgacagtacttcagctttgcaaataattgacatgcttaaggtcatggctgacacaagagggagaactataatcctcagtatccaccaacccgggttcagaatagtgaagctgttcaattcattgttgctgttggccaatggaagtgttttgcaccatggaactgctgatttgcttggtgtgaatctaaggctgatgggtttggaacttcctcttcatgtcaatgtagttgaatttgccattgagtccattgacaccattcagcagcaacagaaatgtgtgcctgttcaggtagaaactccaaggcaactaccagggacaatgcaacaacagaagagaggtggtgatggtgaagcaggtgagggtaggaatggtaagttcactttgcaacagctgtttcagcaatccaaggtaattgatgaagaaaccatgtatgctggaatggatttcacttgtgagtttgctaattctagattgagagaaactatgattctcagtcataggttctccaagaacatattccgtacaaaagagctatttacatgcaggacagttcagatgctggtttctgggctggtcgtggggtccatcttttgtaaccttaaggatgatatagtgggagcttacgaaagggtgggtctatttgctttcatattaacgtttttgttgtcaagcagcatagaagctctaccaattttcctgcaagaaagggagattctaatgaaggaaacatcttgtggaagttatcgtgtgtcatcctatgctattgccaatggcctagtttacttgccatttcttctcatcctagccattttgttctcaatgcccttgtactggcttgtagggctcaaccggaacttcttggcttttttgcactttctgttgctgatatggctgattctttacacggccaattcagttgtggtgtgtttcagtgctctggtgcctaattttattgttgggaactcagtgattgctggtgtcatagggtcattcttcttgttctctggatacttcatatcaaagcaggaaattccaaaatactggattttcatgcattatatatccttgtttaagtatccctttgaagggctcctgatcaatgagttctccaactcgggaaagtgcttggagtacatgtttggggcatgtgtgaagagtggagaggatgtgcttaaagaagaagggtacgggggagagagtaatagatggaagaatgttggggtcactgtgtgcttcatcttggtttacaggttcatttcttatgttattcttagatacagatgttcccagatgggatttggcagggttgtcaccaactaa

SEQ ID NO: 60912 - DNA, 1059 bp, Glycine max
  Peptide Sequence Number=SeqID_177690
atgtttgccaaaaatcaattctatcaaatttcattggcattgcttttctgttcgggattcttgacttttcaagtcacatgtcgcactcttcaagatgcatccatgtatgagaggcacgaagaatggatgggtcgttatgccaaagtgtataaggaccctcaggaaagggaaaggcgtttcaagatatttaaggaaaatgtgaattacatcgaagccttcaacaatgctgccaacaaaccttacacgctaggcatcaatcaatttgcagacctcaccaatgaggagttcattgcaccaagaaatagattcaaggggcacatgtgttcctcaatcacaagaacaaccacttttaagtatgaaaatgtgactgcaataccgtccacagtggattggaggcagaagggtgcagtgacacccatcaaggaccaaggccaatgtggatgttgttgggctttttctgcagttgcagcaactgaaggaattcatgcactgagtgctggaaaattgatatctttgtcagaacaagaagtcgttgattgtgacacaaagggtgaggaccaaggttgtgcaggtggttttatggatggtgctttcaaattcatcatccaaaaccatggactcaacaatgaacccaattacccctataaggctgttgatggaaaatgcaatgctaaggctgcagctaaccacgttgctactattactggctatgaagatgttcctgttaacaatgagaaggcactgcaaaaagctgtggcgaatcaaccagtttctgtagccattgatgccagtggctctgactttcaattttaccagagcggtgtgttcactggttcgtgtggaacagagttagatcacggtgtcactgccgtgggatacggtgttagcgctgatggaactgagtattggttggttaaaaactcctggggaaccgagtggggcgaagaaggatacattagaatgcagaggggtgtaaaagctgaggaaggactctggcatagctatgatggcatcttaccctactgcataattatcaaatttggacaccactattcctaa

SEQ ID NO: 60913 - DNA, 783 bp, Glycine max
  Peptide Sequence Number=SeqID_177691
atggcgtttgaagacttcgatcctattttcagtaaacccaaagtggaagtggagtgggcttctcaaagttctcgtccctttttcttccacgcctattcccctgattcttctcaccttagggatattgttagaatagggggttcttggtcagagtttgctggttattttgtaacatccctcaagtcacaagatctgaagctgcttctagagctagattcaagctcttatggtgttgttagtcatgcaaaattagtagctcagaaatcaaaaggaatgcctttgatcaccattcctcttatcaaacttgtggactccgctgctgctatggaagttaagtcaaatttttgctcgagcctgtctgaggcatttgaaatcaaaagcatggagtgttctcttgaaaaagaaatgaagccatacaactggaacagcgacaaaagtttcaagattagcaactcagagaatggcgtttctactgacggattgcaaaactctccagataagcaagctgcttgggatacaggtgctacgaaagtcaagaatcgtaagatagggaaatgtgatgggagactgagggcaggaaaaagacggggcaatgcggatcgtgtcagtgtaagtttgcaacttttcacggcgaaagatgaaagacaccatcaaaagaagaaaatgtatttacttgtgagtgttcacagaaaagataagatagttgctggttatgtggcacttgatgataaaacctatggcgtcttagctgctgaacctggaatgaaatcttctgttggttaa

SEQ ID NO: 60914 - DNA, 447 bp, Glycine max
  Peptide Sequence Number=SeqID_177692
atgaagaagaaaggaaagttccaacactcctccaagcgcaagtgtagaagcaagcttcatgatgatgaaccaagcaattttgataatgccaaaagcccaacgtacatcctttgtggtacaagtagagcgtacatctacttgggttgtaatactaagaacaagagagggtacatctcttgtggatcagttcaagtggagcgtacatccacttggttgttcaaagagaacaaaggagggtacatcccttgtggatctttgcttgtaaaggattttacaaggttaaaggaaatctcaagaactggtggttgcttggggattggacgtaggcacgggttctggccgaaccacaaggactcaagatctaaaaagaaaaacaaggaggaaagcaatgagatcatctactttaagtgtagaaagcttggacacatgaagactgaatgtccctag

SEQ ID NO: 60915 - DNA, 366 bp, Glycine max
  Peptide Sequence Number=SeqID_177693
atggatgggcaatggttaaagaaggatgcacaacctccgcaagatgaacgtgctccctctcctccgcctcaacaagatgactccttagccctcatgcatgaagttctttcgaagttacgaggcctccgcacctatgttggtgagcgctttaattccttgggtggtcgtatcgatgccattgatgcttgctttgcaggcatggatacctacatcactcagcttgaggaggatataagttatgaattaaattatcatcatcaaaaagagggagattgtagaagcaaagactttgatgttttgatgatcccaaaggatcatgcgcttctcaagtttaattcaagaggatcatacgcttctcaaggttaa

SEQ ID NO: 60916 - DNA, 717 bp, Glycine max
  Peptide Sequence Number=SeqID_177694
atgttgttgtcagcagtgttaagtctggttaatgttaaggccagatatgagtggagtgacaaaagcttcagtttactgcttgaagtagtgcacaatatgcttccagagcaaaacatgcaaccaaaaagttactatcaggcaaaaaagatactatggccaatgggtatggagtatcagaagattcatgcttgccctaatgattgcatattatgcaaacatgagcttaaagaaatacacaattgccctaggtgtggggtatcacggtttaagtgtctctttgctaatggagacaatgcaaaagaccttacatggcatgcaaatgggagaaactacgacggaatgctttgtcatcatgctgattcctcccagtggaagaaaattgatcgtttgtatccaaatttcagcaaagagacaagaaatcttaggcttggacttgccactgatggaatgctttgtcatcatgccaataccgttaattggtcagcagagaaaattgtttgtgataatgtcattgggatgttccttaacattcaaggcaagacaaaagatggtttgaatactcgtcaagatctagctgagatgggtatacaagcccagttacatccaaggtatgatgtcccacagggatattcttcaaatattaagagccttgtgcagttgaaagatctaaagttaacaagcttaaagtctcacgattgccatatcttgatgcaataa

SEQ ID NO: 60917 - DNA, 363 bp, Glycine max
  Peptide Sequence Number=SeqID_177695
atggttagaggcattgtgaaaatcttgataagtaagcttggggtgtcactagatgactcaaaaattaatcttggagctcacagtaggtgtaggacgccactcggacttcggaaccattatattgtgtatattcacggtaaaggagattgggatagtttacaaaatgggtcgtgtaagactaaaaggggcccaaaccatgtggagatgaggaaatgtgaaaatgacgaacaggaggcaacatgtagccatacaaaggggagtgcaaatgataacgtgactaggggtactcataataggcttggctcaatcactacattagagaagctaagggagatagtgatatggaggtggtgctatgagtag

SEQ ID NO: 60918 - DNA, 453 bp, Glycine max
  Peptide Sequence Number=SeqID_177696
atggcttccaatctgattaaagtgagcacaagcttggttctagtagttttagtagctctcacagttcaaattttatacttttcacccatagatccagttttgctggatataaaacctgttactttacagaatatcattaagcttggagaaggacttttgaaggagccagaagatgttggtgtagataaagaacagattctctatacagctactcgagatggttggattaaaagattgcgcaggaataatggaaaatgggagaattggaagcatatagatagtcatactttgctagtaatcgcaacagcaaaagaaggtggtctcattgtttgtgatacttccaagataaaaggggaggggagatacgaaatactaacctcgacggcagacgcaacaaacgcaccaaaaaaacttgagcaacgagcgacaatggcagaaggaagagaaggttga

SEQ ID NO: 60919 - DNA, 1206 bp, Glycine max
  Peptide Sequence Number=SeqID_177697
atggggagtgatgacagtctaaagacatgggtatcagataagttgatgtctatactgggatattctcagcccacagttgtccagttcatgattggactatccaagcaagctacttctccagctcatttggtgggcaaactagtggagtttgggatctcgtcaatggacactcatgcatttgcggaagaaatttactcaagagttcctcatagatcatctggtataaatgctgatgacgatagtgacgatgactatgtagataaatcttcagtaactactgcatcatctagaagaaaggaaaaggagagacaagttaagagaagaacttcccctgatgaagttagtgattctgagtccgaagaagaaagattgaaagatcaaagagagaaggaggaattagagcagcatatgcgagaaagagatgcagcagggacacggaaggtacttgtcaatgttcaaattgatttggatattgctcgtttccggcctgatctcaagctgctgatatcaagtgctacacttgatgcagagaaattcactattgtcacatcacttcaaatccatgtcactcaacctcctggagatatattggtattccttactggtcaagaagaaattgaaacggcagaagaaatcttgaagcatcgaactagaggcttggggactaaaatttctgagttaataatatgccctatatatgccaaccttccaactgaactacaagctaaaatatttgaacccactcccgaaggggcacgaaaggttgtccttgctactaatattgcagaaacatcattgacaattgatgggatcaagtatgttattgatccaggattctgtaagatgaaaagttataatccaagaacaggaatggagtctttgctagtaactcccatctcaaaagcttcagcaaatcaaagagctggccgttctggaagaatgggtcctggaaagtgcttccgactgtatactgcatacaatgatttggatgataacactaggactaaccttgcaaatgtagttttgactttaaaaagtcttggtattcatgacttattgaactttgattttatggatcatccacctgctgaggccttattgaaagctttggagcttctatttgcattaagtgcgttaaataagcttggtgaattaactaaggtgggcagacagatggcagagttcccacttgatccaatgttgtaa

SEQ ID NO: 60920 - DNA, 231 bp, Glycine max
  Peptide Sequence Number=SeqID_177698
atgaacagatgtttggctgctggaaacttgagagagcaaagtgcacagagtgagaaacaggcatatgcggcttcacgatgcaaaaacaagggtgaagtagtggcaatctgctgtagcagggggtgggctatgcaatttccttgtgtttatgagaagaaggctgctaatcctaaaatgcctcactgcatggatgggtataggacaccaaaaatcctcttaacgagtaaataa

SEQ ID NO: 60921 - DNA, 288 bp, Glycine max
  Peptide Sequence Number=SeqID_177699
atggcctctgttcgtttcttactgtccatggcagctatgcagcagtggcccctttatcacataaaaaatacaatcctacacggtgttttagctgaggaagtctatatgaagccacctcctgggtttgttgctcaagagaattgtcaacccttcttgtctccccaccattgcatatccagacaaaccaggattagagttcagacctttttccaaggctcttactgggtgattcaggaatcattcagactcaccctcacacaaatcagtgacaccaccagaatggcttag

SEQ ID NO: 60922 - DNA, 345 bp, Glycine max
  Peptide Sequence Number=SeqID_177700
atggcttactgtgaatatgatgctttactcagaaatggcacttggactctagttgacttgccaccttcaagaaaagctattggctgcaaatgggtcttcaggattaaggaaaatcctgatgggacagtcaataaatatatagacaggcttgttgccaagggtttccatcaacagctagggtatgactacaatgaaacttccccccctgtcattaaacctgtcactctggatgtgaagaatgatttcctcaatggaacccttcaagaggaagtctatatgactcagcctttgaatcccccaacaagcagcttgtgggttgactgcacaaagccatttatggcttaa

SEQ ID NO: 60923 - DNA, 474 bp, Glycine max
  Peptide Sequence Number=SeqID_177701
atgtatgtgaaaacggcttgttgtttcacccctagcctgcggaaaatgctttattgtgtttcggatatcaatttaaagttcacagttatgcgaatagccagtgcattagtgaatggcagcgctcttcatttccacttacctagatttctatatgtgcgtcatcattcatcaatcaagttgtttgtcacagggctttcctatgataccaatgaaccggttctgagagatgcctttgggcaacatggtgaaatcattgaagttaaagtaatatgtgatcatgtgactggaaaatcaagaggatatggatttgtgcggttcctttctgaaactatagctgctgcaactcacaaagaaatgaatggccaggtagatttactggctaaaaacttagcttctatttcacccaacattattatatgtggaccttgttccttatcatctcatagatactggatggaagatgcattcgagtga

SEQ ID NO: 60924 - DNA, 150 bp, Glycine max
  Peptide Sequence Number=SeqID_177702
atgtctatcatggtgaatgcatcaccaagtggcttagcattaacaagatgtacattggtacacgtgtcacaacttaacaatttcaactgcaaattgaatatacacattcggctaagaaaaatgggttctctcacatatgcacttatttag

SEQ ID NO: 60925 - DNA, 267 bp, Glycine max
  Peptide Sequence Number=SeqID_177703
atgttgcagttgttcttcactgtggctttctctgcggttcctctgaccctttacgtgccaccaatccgaagcctaaacctgtttgtggaaacaatggaatatgttgtcagagaatcaagaacccacaggaacagagtttatcctcgcctacgcgtagcttggtctaggatgttggatatcatgctctgcaacacaagggaacttgatataaaattgtctttaattatagagtttacagcattgcttgttaatgtaaaagagaaataa

SEQ ID NO: 60926 - DNA, 579 bp, Glycine max
  Peptide Sequence Number=SeqID_177704
atgcaagaggaaatcgaagggaataaagagaaaattgatgacagtgatcaacatgtgcaaagagatgtcgtcaaaggagttggaaaagtaggcactacaggaaaggagatgcccaaaaaagaatatgtagcagatgttggccttgtggctaaaacgatggaaacgaaaagagacttgaaaacaactcctagtaaagagaaatacacaatagctcaaaatgttaaagatgaaaagccaaggatacaagaagaaaagataaaggctgatgttgaaaaggtggataagaaaggatatcaagcaaaagttgtagaagaagggatgtcaaaaggggaacacggagcagaagtagttcctgagataaaaagggaaaggccaaaggttgcaaagagtgaagaaacaaaagaggcttccaaactaccactcaaaagagagatgggaaaaacaacacaaagtgcagaagataggaagcctaaaatgggggaaataactaacgagtttgaaaagactagtggatccaaacaggctgtagaaaaaatgcttgaaagtctcaacagagaacatcaaaaagactcaaaagaa

SEQ ID NO: 60927 - DNA, 415 bp, Glycine max
  Peptide Sequence Number=SeqID_177705
atggtggcagagtatgcaactaggtttgagaacctggtaaggtattttccacattatcagggggaagttggggagaggtccaaatgtgtgaagtttattaatggcctcctaccagaagtgaagatgatggatcaactagagaaggtcacattttataggaatgctaatgttagtcatgggaaagagaagaaccttgtgactcacaatcgtgctaagccgtattctgtccctcctgggcaatatggcaaccactttgggggacagaagaccagcgaaggacttcacccagctggtggtggtggtggtggtgctcctgccattgtttctacaccactcaggtgtgggaagtgtggtcggcttgggcatattgcttgtgagtgcacagatagagaggtgactttctttaactgtctag

SEQ ID NO: 60928 - DNA, 240 bp, Glycine max
  Peptide Sequence Number=SeqID_177706
atgtggccgctggacggaatgttgctaagtagcaacgtcatccatatctgtgtaagagtggtcatattggtgcgcatgatccgcactcgtctctttgcagtggcatgggtgaaatcttgccccggtatgcgtagtagttgcgtgatagcctccttctctggttgtgctcgcacagttggtcgccctccaatatcagggggtggcccaagaactgataaaaggaaactactggccccttaa

SEQ ID NO: 60929 - DNA, 549 bp, Glycine max
  Peptide Sequence Number=SeqID_177707
agcaagagtaatgggagaaatagaggaggtgcaagagtggatgaaggccgacatggaggccatgaaagagcaaatggccacaatgttggaggccatgatgagcatggagaagataatgaaggcaaagagttgggaagtacgggcggccctcattttatgcaagttcagaacaagcataccttcccgccatatggcttgcctctcaactatataccaccaaatgtggcacacactcccgatgagaatgtcaataactccactcctatactcattgagatccaacaacctcaatctaatcatgcacatgtctctcaacccatgggggagacacatgaggtaccccaccacaatctagccgatttcaagccttgtctcgaatacacctctgagggtcaaacagttggtgatgaacccttgccaaacactttggagggccctcaatttttgcccacaaccacaaccattgcatttcacaacgggaagaatccctcctgctatggtggaaaaaggaaagttggatcatttagaggaaaggctcaaggccattga

SEQ ID NO: 60930 - DNA, 459 bp, Glycine max
  Peptide Sequence Number=SeqID_177708
atggataatccgctcagttatggtctggcatttggcggtgcgatgatttgggcggtttattgcgtggtgacaaaaaaaagcgcgaaaggcagtaacggcattacgctgtttttcatgttaactgcgctgacgctgtggctgaaatcgctgctatcaccgcagccacccgtggtgttttcgctgcaggcgtgcatcagcctggcgctggcagcgatggcgatggggctcggctatgcggcgtggaacgtcggcattctgcacggcaatgtcacgctgttagccgcagcttcctactttatccctatcatttcgtcgctgatagccgcttttatccttaactccagcctgaccttctccttctggcaaggcacggcgatggtttgcctcggttcgctactctgctggtggtcaacgcgcgggactgcaacgcataagctggaaagcaacacgctggaataa

SEQ ID NO: 60931 - DNA, 843 bp, Glycine max
  Peptide Sequence Number=SeqID_177709
atgtcgctgcagcacaccagcatccgctgctcgtctggtgtccggctggaagccgacgttgcgctaactgcggcgacacagcatcgcgccgatacctttctggttgccggagcacctgacgccagccagatgcagctttccgccagtgagcgccagcagattatcgcgctctgtcagcgcagccagcgttacggctcggtgtgtaccggggcgctgctgctggcgcaaacgggtttgctgaacggcaggaaagtcactactcactgggcgtgtgcggaacggctggcattactgctacccgatgcgcaggtcgaagccgatgcgctatatgtggcggatggtgcattacgcacggcagcgggggtgacgtccggactggatctggcgctgcggctggtggaagaggatctcgggcgcgagctggcgcaggaggtggccgccagcctggtgatgttcttccagcgcccggtcacacagggacatttcgtgcgtaaacaacagatgtccctggccggacgcagcgcctttcaggagatgcagcgctgggcaatcgcgcatctggcacagattcgtgggctggaagacctggcagcgcacatgcacctcagtacgcggcatttagcgcgtctgtttcagcaggagatgcagatccagcctggcgcatggcttgagcaggcacgcatcagccacgcgcgggctttgctggatgccggtgagctgccgctcaaagcgatcccggcggcctgcggttatcacagtgccgatgtgatgcgccgcgcgtttgtcaaagtgaccggcatgacgccgtcgctgtatcgcaaaatgttcccgccgccgcgctga

SEQ ID NO: 60932 - DNA, 159 bp, Glycine max
  Peptide Sequence Number=SeqID_177710
atggcttattccctagtggatggcgcctcctcccacctcttctcctttgtcttccactgcatctccatggttttactctcgtcgtccggaaatattcaagcccgacgacgtgcaagattcttctctggtgggcagggacgatcgagtgcaatggcgtag

SEQ ID NO: 60933 - DNA, 255 bp, Glycine max
  Peptide Sequence Number=SeqID_177711
atggtgcgagcattcgctaagcgcgacactcagtggataagcgcgaggaagaatccagaagaagatgagttctcaggttcgctgagcgcaccactccaagtcatcaagcgtgctgcttcagctcatccgctaagcgagagaagcgcgctgagccaaaaatcactaacgtgcgctaagcggtccatacgtccgctaagcgcccgagcacgaacaaggcaactgatcgaggccgtaaccgaatcaaataaacattaa

SEQ ID NO: 60934 - DNA, 871 bp, Glycine max
  Peptide Sequence Number=SeqID_177712
gacgtgtagtcctctaaaggcaatggcgtgtagccctctgaaggtgaggacgtgtagtcctctaaaggcaatggcgtgtagccctcttaaggcgagggcgcgtagccctcagaaggtgagatgtagccctctgttggcgaggatgtgtagtcctcttatggcgaggacgtgtagtcctctaaaggcgaggccatgtagccctctgaaggtgaggacgtgtagtcctctgaaggcgatgacgtatagtcctctgaaggtgaggacatgtagccctctgttggcaaggaagtgtagtcctctgatggcgaggatgtgtagtcctctgaaggcgagggcgtgtagccctttgaaggtgaggacgcgtagtcctctgaaggtgaggacgtatagttctctaaaggcgaaggcatgtagccttctgaaggtgagggcgtgtagccctacgaaggcgaaggcgagggcgtgtagtcctctaaaggagagagcatgcagccctctaaaggtgaggatgcatagtcctctaaaggcgaggacgtgtagtcctctaaaggcgaggacgtgcagtcctctgaaggtgaggacgtgtggccctttgaaggtgtggacgtgtagtcctctgatggcaaggacatgcagccctctaatgtcacgaaactttacagattacacaaccatcccccctttgacttctggaatgttacggaactttatggactgcgcaataatgcttcctttcgactcccgacatgtcgtggaacttcatggattggctaacaatgggtgtcaagtacctcaaagcggtcaagcgaaggtcgcataccaccaaacagatggtccccagacgaaattagggtctgacagtcgtgcttag

SEQ ID NO: 60935 - DNA, 679 bp, Glycine max
  Peptide Sequence Number=SeqID_177713
aggactacacgtcctcaccttcagagggttgcacgccctcgtcttcagaggactatacgtcctcaccttcagaaggctacacgacatcaccttcagaggactgcgcgtcctcaccttcagaggactacacgtcctcgccatcagagggctgcacgccctcaccttcagagaactgcacgttctcaccttcagagggctgcacgccctcgtcttcagaggactatacgtcctcaccttcagaaggctgcacatcctcaccttcagaggactgcgcgtcctcacctttagaggactacacgtcttcgccatcagagggctgcacgccctcaccatcagaggactgcacgttctcaccttcagagggctgcacgccctcgtcttcagaggactatacgtcctcaccttcagaaggctgcacgtcctcacctttagaggattgcgcgtcctcaccttcagaggactacacgtcttcgccatcagagggctgcacgccctcaccatcagaggactacatgttctcaccttcagagggctgcacgccctcgtcttcatagggctacacgtcctcaccatcagagggctgcatgccttcgcctttagaggactatgcgtcctcgccttcagaggcctgaatgctatcgccttcagaggcctacatgtcgtcgtcttcaatgggtga

SEQ ID NO: 60936 - DNA, 522 bp, Glycine max
  Peptide Sequence Number=SeqID_177714
atggtcggccctctcaatgagttaatctcatgctttctcataagggtgaagccttgggtactagtaccgtcaccttcggaggactacatgtcctcccctccagaggactacatgtcctcgcctttagaggactatgcgtcctcgccttcagaggactacacgtcctccctttcagaggactgcacgtcctcaccttcaaagggctgcacgccctcgccttcaaagggcgacacgtcctcaactttagagggctgcacgccctcgcctttagagggctacgcatcctcattttcagtgtgcttcatatccgcaccttcagagaactcaagggccagtagtttccttttatcagttcctgggccaccccctaatattgaaaggcgaccaactatgcaagcacaaccagagagggaggctatcacgcagctactatgcataccagggcaagatttcacccgtgccgctgcaaagagacgagtgtgggttatgcgcaccaacatgaccactcttacacagatataa

SEQ ID NO: 60937 - DNA, 195 bp, Glycine max
  Peptide Sequence Number=SeqID_177715
atgacgtcgctacttagcaacattctgcccagcgaccgcaatgccgatctccccatgtggaaggtgctcgtcgcccccagcaaggtcatcaggccccctactaaccgacctttcatcaagaagtactacgcccccctaggcaggtgcagggtgagacaccacaacagcctagggatgaccggcagcgagcaatag

SEQ ID NO: 60938 - DNA, 331 bp, Glycine max
  Peptide Sequence Number=SeqID_177716
ggcaaggctagctgaggttccttctacatcagcagctcctcatccaacttctacatcagcagctcctcctccagcacgtatgacggcaactccttctaccctacctcctgcagattttcaacactccatcccgacggtagagcaatttaatgaatgggtagtctggccagggactcaacctcctcttcacagggaagacgaagatcccaccgctcaggaagctgcagccacctctgaaaagtctcttgaagccactccagagccttcgacactagtggcagataccacttctccgcagcaggcagcagacccttccatgcatgaggattaa

SEQ ID NO: 60939 - DNA, 1323 bp, Glycine max
  Peptide Sequence Number=SeqID_177717
atgagcaagaaaaccagcgatttctttgttgaacgcctgcaggcatggggcgtcacgcgcatttatggctatccgggcgatggcatcaacggcgtgctgggcgctatccagcgggccaataaagccggtgcaggcatcgaatttattcaggtgcgacatgaagagatggcggcctttatggctgccggtcacgccaaatttaccggtgagctcggcgtctgtctgtcgaccggcggccccggtgccacccatctgctgaccggcctgtatgatgccaaaatggatcacgcgccggtgctggcgattgccggccaggcggaaaccaccgcgcgcggcgccagctatcagcaggagatgaatttagaccgcatcttcgccgatgtggcgaacttcgtgcaggaagcggcagccccggcgcaggtccagcatctggtcgatcgcggcgtgcgcattgccaaagcgcagaacggcgtcgcggtgatcatcctgccgaaagatctgcaggatgagaactggcagccgccgcagcatgcgcacggatttacccattccgggccgggctatcagcggccgaagattgtgccctacgacgaggatttgcgccgcgccgcagaagtgcttaacgccggcaaaaaagtcgcggtactgattggtgctggtgcgcggggtgctgcggttgaagtggtgcaaattgccaatttgctcggcgcgggcgtagccaaagcgctgctgggcaaagacgtgctgccggacgatgcgcctttcgtcaccggctcgattggcctgctcggcaccaaaccgtcgtgggagctgatgcagaattgcgacactttactgatgattggcagcggttttccgtggaccgaatttctgccgccggaaggtaaagtgcgcgcggtacaaatcgatatcgatccggcgatgctggggctgcgctatccgtgcgaggtcaatctgcatggcgacgcggcagagaccctgcgtgcgctgttgccgttactgacgcataaagcggatcgccactggcaggaggagatcgcggtacaggtgcgcgactggtggacgttgatggaacagcgcgccatggcgcccgccaacccggtcaatccgcagcgtgtggtgtgggagatgtccccgcagctgccggaagatgcaattgtcacctcggactcgggctcctgcgccaactggtttgcgcgcgattatcgggtgaagcaaggccagctcgccacgctgtcgggtgggctggcttgcatgggcgctgccgtcccgtttgctatcgccacgaaatttgcctttcccactcacccagtggtggcgctg

SEQ ID NO: 60940 - DNA, 300 bp, Glycine max
  Peptide Sequence Number=SeqID_177718
atgggctcaaaaatctaccctaagattcatgagaaccctaagccttctttatcaactctagcccaatcctcttggagcctcttgctcatggctctagtaactggtcctttcctagggaggattgcatcaaaatggcaaccaaaggaacacgaaatggaactcatgagactaaatcaacatgaagaaaatgacaagaaaaagaaaggaatcacacttaaagctttatcttcagttcaagaagaaagtgataaagaagacttgaatgaagtagaagagatgatgatttcagtttcttcgtaa

SEQ ID NO: 60941 - DNA, 213 bp, Glycine max
  Peptide Sequence Number=SeqID_177719
atgaaagaaactgtgcagagaaagaaaacttttaagaatgataagatgaggtcacatgaatgtctgtacttcttatttttgatttggaaacacagtcaatcaaatgtttattcaactttactcgttgcttacggcacccctaccaaatgtgtagaacgtgcaatttctgattgggcagacttggagattaacttagcagcgcaagtttcttga

SEQ ID NO: 60942 - DNA, 258 bp, Glycine max
  Peptide Sequence Number=SeqID_177720
atggcgatacgagacattttgcctaacaaagtcaagcatactgaatttgatattcccaaagcatttgatttgaggacgaagaaaaaaatacttcagaccgtaagagagcagtggaggcaatttaagtcagatttgacctccaaatgggctttggcagacggcaaggagggtaccgatgatgaagtatgtgaaaagtacaacataaacaagaagaagtggaaccaattttatcagagtcgtagagaaccttcatgggag

SEQ ID NO: 60943 - DNA, 534 bp, Glycine max
  Peptide Sequence Number=SeqID_177721
atgcataaatgccccaggtgtggggtatcacggtacaaagtgaaggatgacgatgagtgtagcagtgatgaaagcacaatgaaagtccccccagcgaaggtgttatggtatcttccgatcattccaaggttcaagcatttctttgctaatgcagatgatgctaaagaccttacctggcatgcagatggaagaaattgcgatggaatgctttgccatccagttgattccttccagtggaagaagattaatcgtttgtatccgaattttgggaaaaagacaagaaatctcaggcttggacttgcccttgatggaatgaatccctatggtagtttaagcactcagcatagttcgtggcttgttttcccaagacaaccaagaaatgacattgatgtttatatcagtctgttgattgaagacttgacaaatttgtgggacaaagtggttgcagtgcatgatgggcatcgaaatgagacagtcaagttgtgtgcaattctttttgtaccttcaatgacttcccaacatatggaaatttga

SEQ ID NO: 60944 - DNA, 468 bp, Glycine max
  Peptide Sequence Number=SeqID_177722
atgggcctctgtcagtcctaccgggtgcccgtccccccagcaaggtcactccatcatgacataaggatcgcgcccacaagacacccagtggacccagagaagtccaacagggtcctggggtttctagctctgattacgggcctttttcagttctacagagtgcacgccgcccctatcaaggtcatcaggccctctattaaccgggctttcatcaagaagtattgcgccccccaggcaagcacagggggagacaccacagcagcctggggatggccggcaacggacaatagacgcaccaccgccacctccagagcccctcagctcatctacaaaggctggagcgttgcctacgacccatggccgaccagcaggcaaccaagtccaaagccaaaggtaagcaaaagtactaggtccgtgaccgacaagtcatcacgcgtccagctcaagacgttaaagaagcgctactag

SEQ ID NO: 60945 - DNA, 246 bp, Glycine max
  Peptide Sequence Number=SeqID_177723
gagcctcgtttgaagggttcctctcggtgtggggtttcaatggagaacaacgatggtttgtggtggctaatggtggttgtgggtgatggagaaagttcttgggactttagaaatgactttggaagaaagaaagaagaagaaatgacgtttttcctaagttacacgaaagcaaaggctgaaaccaaatttcgagaagatccaatggctaacgaaggctgggcagtgtttttaccgaggcaacttcat

SEQ ID NO: 60946 - DNA, 181 bp, Glycine max
  Peptide Sequence Number=SeqID_177724
atggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacg

SEQ ID NO: 60947 - DNA, 489 bp, Glycine max
  Peptide Sequence Number=SeqID_177725
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtg

SEQ ID NO: 60948 - DNA, 234 bp, Glycine max
  Peptide Sequence Number=SeqID_177726
atgagatccaatgaggctactcatcctaggccaatgccagtatcagctgatgcaccatttccaggggtggatccatcttcacctcagcacgtagcagactcttccattcctgtcttagagatacctgagggccagaccataccagtcctgactttggacacttctcctccagctactccagtattgcatctgatagatgaagaggatgttcagacacaggacacccaggactag

SEQ ID NO: 60949 - DNA, 276 bp, Glycine max
  Peptide Sequence Number=SeqID_177727
atggttgatgaaaacctaaacctaatccaacaagatgaccaactatcatcaacagatgatgatgatgggttagaaaactcttcagccaaaccaacaacaatccaagatcttcaaacagagataaacaatctaaaaagggaagtaaaagaacttcgtcaacaacaagaaattcatcagatcattctttctcagcttgaggaagatagtgattctgaaagtgtcaacaacagtgaagaaaaccaaccagataatctagaagatgatatgtttatggca

SEQ ID NO: 60950 - DNA, 2484 bp, Glycine max
  Peptide Sequence Number=SeqID_177728
atggctcgtggcggtcaccaatggtcgtgggtggtggaaaaggagatctcgcttagtgagctcgtctcgctaagcagaagttcacttttcatgcttagtacaacttcctttgcactaagtctcgctcagcaggccaattctcgctcagtgcaattccctctcagggaggagttcatggcgtgtgagttgacaatcgacagtgagttgacgacgagaaaggattgcagcatcgcggaagtgagactatggtcaggaagacaaaggagttgcagcgctgtggaagggaaagtgctcttcaattcattttccttatacttgttctttactccaacggtttctaataagttggagatgttccctttggttgtgttgctttttcttgcgtgcaattttcatgttgcacctgtgagctctttgaccgttgaaggctctgtgcttttggcactgaagaagtccatcatcacagaccctgaagggtcactgagtaactggaactcttctgatgacaccccttgttcatggaatgggatcacatgcaaggaccaaagtgttgtctccattagtatcccaaagaggaagcttcatggggttcttccctcagagctagggtcactttcccatctccgacatctgaatttgaggaacaataacctctttggggacttgcctgttgggctctttgaagctcaaggacttcagagtttggtgctttatggaaattccttatctgggtctgttccaaacgagattgggaagctcaggtaccttcaagctctagatttgtcacagaatttctataatgggtctttacctgctgcaatagtccaatgcaagaggctcagaacactggttcttagtcataacaatttcacaggtcctctgccagatgggtttggtggtggcttgtcttctctggaaaaacttgacctttctttcaatgaattcaatggtttaattcctagtgacatgggaaagctgtcaagcctgcaaggcactgttgatttgtctcataatcatttcagtggttcaatcccagcaagtcttggtaatttgcctgagaaggtttacattgatctcacttacaacaatttaagtggtccaatacctcagactggtgctttgatgaatagaggaccaactgcttttattggcaattctggtctttgtggcccacctttgaagaatctgtgtgccccagatactcatggtgccagttcaccttcctcttttccagttttgcctgataattacccacctcaggatagtgatgatggttttgtgaaaagtgggaaaagtaaaaggctaagtaagggtgctgtggttgggattgttgtgggggatatagttggaatttgccttttgggtttgctgttctcttactgctactcaagggtttggggttttactcaggatcaggaggaaaagggttttgacaagggaaggagattgaggaaggagtgcttatgcttcaggaaggatgaatctgagaccctatccgatcatgatgaacaatatgatcttgtcccattagatgctcaagtggccttcgatttggatgagcttcttaaggcttcagcttttgttcttggaaagagtgaaatagggattgtctacaaagttgtgcttgaagaagggctcaacttggctgtgagaagattaggggagggaggttctcaaaggtttaaagagttccaaacggaagttgaagcaataggaaagttaaggcatccgaatattgttactctgagagcctattactggtctgttgatgagaagcttctcatctatgattatgttcccaatggaagccttgctacagcaatacatgggaaagctggacttgccacatttacaccactatcttggtctgttagagtgaaaatcatgaagggagttgcaaaaggattggtctacctgcatgaatttagtccaaaaaaatatgtccatggagacctgaagcctggtaacatactgttaggacatagccaggagccctgcatttccgatttcggtcttggacgccttgctaacattgctggagggtctccaaccttgcaatccaacagagttgctgcggagaaatcgcaagaaagacagaggagtttatccacagaagttacaactagtattttgggaaatggttatcaagctccagaaacactgaaagtggtgaagccatcacagaagtgggatgtttactcatatggggtgatcctgctagaattgattacaggaagattgcctattgtccaagttggtaactcagaaatggaccttgttcaatggattcagtgctgcattgatgagaagaagccactctcagatgtattagatctttatttagctgaagatgcagataaggaagaggagatcattgcagttttgaagattgcaattgcttgtgtccatagcagcccagaaaagagacccataatgaggcatgtgcttgatgttttggatagattatccataccctctgattag

SEQ ID NO: 60951 - DNA, 396 bp, Glycine max
  Peptide Sequence Number=SeqID_177729
ggtttgttggtgattggaggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 60952 - DNA, 498 bp, Glycine max
  Peptide Sequence Number=SeqID_177730
atgaaagaaattctcactctcgcgtccaagccttgctaccctgaaacctctcagtcttgtgtcgtcgtggtttcaccattgttctgtcatgtcgcaccaccactgtcatgttcttgtgtcatcgtcaacgttgaaggtgtgaacactgactctcgctttcgccttagccacaccgcgacgtcgaaggcatcaaatctcatatttgtataccaacccattattgggacaaggttcacctatacttataatgagagtgacattcgccatgatgaagagggtgttagcagtgatttgtatgactccttgcaggatgacattgttctcaatgaggagcttatgcatataatggcaaatcccaactttcagcaagttgctcaacacgacaagattgagccatttctagctacaccaagttgtgcatcaaatgactcagacatagagatcactgaaaatttcccaactagaaatgaaacaagatcatcttatgaagatgaatga

SEQ ID NO: 60953 - DNA, 981 bp, Glycine max
  Peptide Sequence Number=SeqID_177731
atgtgttgtatctctaatgaggattctatgttccttgtgtataagtatcttgaaaaccacaacctagataaatggctgcacaagaagattaagtcaagttcagtaagtaaagtggtccttgattggccaaagaggttgaaaatagccattggaattgttcaaggtttgagctatatgcaccttgactgttcaccacctgtggttcatagagatataaaaacaagcaacatccttttggatactcaattcaatgcaaaagttgctgattttggagctaagatgttaatcaagccaggggaacttaacaccatgtcagctgtgattggctcatttggctatattgctccagatagagcaaggaagccaagaacaaaacattgtttcttcaaattggattgtggccaactcaagaaagaacgagttgttagagtgacgttaaaagctgaaacttctaaatttaagctatacaccgactacatgaggagcttcagagataatatgaaagattttcttgaatctgagctcacgatagacattgaagtagggcttggtcctgcaggagaacttcgatatccttcttgcacacaaaatctggggtgggtattcccgggtattagagaatttcaatgctatgacaaatatattaaagatgatttcaaaggggctgcaacaagggctggccatcctgaacgggagatgccagataatgttggagaattgaatgatgcacctgaatctacaaaaaatttcaagtcaaggggaacttatccaacaaagaaagggaaattttttctaacatggtattccaacaaattattgattcatggtaatgaggtcttggatagagctaacaatgtatttctaggttgcaaagtgaagttagcagcaaaagttgctggaattcattggttgtataaatcaaagagtcatgcatcagagcttactccaggatatcaaaacttaaatcatagagatggataa

SEQ ID NO: 60954 - DNA, 666 bp, Glycine max
  Peptide Sequence Number=SeqID_177732
atggatatgaatgtggggtaccttatctcccaccagatctccctcactgctcagcatgacacatccagacttggattcccggccttgattacagctttatgtaaggctaggggggttcagtctgattcgagatccctggagagcctgagtcctgccattaatttggcttatattaagaagaactgttggaatctggatgagccaacagtaaccttcagaggacccaggaaggctagagacaagagatttgaggccttttccacaacgccatcagagataggaggtccttcttcttctacacttcctacttcttcctacacagagatcccagtgattcctcctgcacccacacagattccactaccagctcctctttctataggtccaacagattttattttcactcctcagatgcttcactccatgctccagagcatccatagagggcagtccatcatcatgcagagccttcagggcttaggcttgccctccattatgagcatggaggagtttgacacacgggtggcctggccaggagatcagccttcttcctctggagggggtggggcctctacagcccaggagcctgtgagtgaggaaccaccagcaccagcaccatcaccaacagcagcagaggaggagaccactccagctcagaccccatag

SEQ ID NO: 60955 - DNA, 186 bp, Glycine max
  Peptide Sequence Number=SeqID_177733
atggcaaagaatgtggggattctcgctatcgacatctacttccctcccacctgtattcagcaggaattgctggaggctcatgatggtgccagtaaagggaaatatactattggacttggtcaagattgcatggcgttttgtacagaagtagaagatgtcatctcgatgaggtttcaatattattga

SEQ ID NO: 60956 - DNA, 324 bp, Glycine max
  Peptide Sequence Number=SeqID_177734
atgtattggcgtttaaaagttcgttatgattacagttttgtggatgaggctgccaaagaaaagctggaaccttttgcaacattatctggtgatgagagctatcaaagccgggatctagaaaaggcatcccagcaagttgcaaagcctcaatacgatgcaaaggtgcagccaaccaccttgataccgaaacaagttggcaacatgtacaccgcatctctttatgcagcctttatttcacttattcacaacaagcatagcacattggtgaatattcttaacactctcttagtcaaatataagccccttctcaacaaaggatggtaa

SEQ ID NO: 60957 - DNA, 386 bp, Glycine max
  Peptide Sequence Number=SeqID_177735
atggccaaagaggtgtatgatgaaatgcttggcacgtatggtgtttctccggacacttgtacttacaatgttttgatcagagggttttgcaagaactccatggttgatgaaggagcggggaaggttagaattgctcggaatttggtgaatggtatgggcaagaaatgtgagggtttgaatcctaatgttgttacttatacgactttgattcgtgggtattgtatgaagcaggaagttgaggaggcattggttgttcttgaagagatgactagccggggccttaagccgaacatgattacctataatactttggtaaaagggctttgtgaggcacacaagttggacaagatgaaagatgttttggaacgaatgaaaagcgatggagg

SEQ ID NO: 60958 - DNA, 330 bp, Glycine max
  Peptide Sequence Number=SeqID_177736
atgatgtttacacttgttggacacattcagttctacaacaatgagtcactagataaaatgaaaagcataggaaactctttgcaatatcttgtggtggcattttcaatttatattggaaccttgttggttaatgttgtgcaccaactgactcggaagcatggtggaattgattggttgaatgatgacatcaatgctggaagattggactactattacttcctcatggctgggttagctttgattaatctcatatatatcttgttctgtgttaaacattaccattataaggttaatgtcgaagaaaaagttgtggagaaacttgagccttga

SEQ ID NO: 60959 - DNA, 339 bp, Glycine max
  Peptide Sequence Number=SeqID_177737
atgaagctcatgtcgtcttcaagatgcgtgatgcgtgagtccatagcattgaaacgatcaccggcgaaagcccgaagatacctaatctcagtgagaacgtcattcaataaggaagatgaggaatcccgttgcggtggcggggagggtgttggcaggttgtgtttaagcccgaagatacctaagctcatgtggtcttcaggaattggagatggaaggttgcgtttacgcacatccacatcctttcgctatccaaaggaggcaacaacactagcaccaatagctaataaatgtttgaccttaacaaaaggttcatcctctaaaggaacattaaaatgctaa

SEQ ID NO: 60960 - DNA, 285 bp, Glycine max
  Peptide Sequence Number=SeqID_177738
atgtcaggttttccacaaatcaagattggtggagtttatttcaaccatggcggtggggtggaactcccagctatagtggagacgtggtcacagggaggacttattgccaccaccgtggggttagcggtggtgagagaggataagcaaggtgggagtgacgacagatatcgtggtgggggaacgcaaattcaaactccagggtttcatatggcagagccttgtggcgaaaggttcttcgctgcgcattgttctttcgacgtttcttcttgtggggaagggacttga

SEQ ID NO: 60961 - DNA, 825 bp, Glycine max
  Peptide Sequence Number=SeqID_177739
atggatggtgaagttgagaggttcatcaaggtatggctcacaaccatctcatgtctatcctattgttattacatagcctctagaataccaaaaggcttcatgaggcttctctccctcctccctattctctacctcttcctctcccttcccttcaacctctcttccttccacctaggtggccccaccaccttcttccttgtttggcttgacaatttcaaactcattcttttctccttcaaccaaggccctcttgccctatcacccccaaacattctccatttcatttccatagcttccctccccatcaaccccaaacaacactcaccaaccaaaaacaaccacacaaacaacacccaaaagccaaaatggcttttgctcctaaaagtgcttatttttgcaatgatcatacgtgcttatgactatagagaaaagttgcaccctcatttcatcttagtcctctattgctatcacatgtaccttggcatagaacttttgttagcccttagtgctatcccgattcgaacccttttagggtttgagattgaaccacaattcaatgaaccctgccttttcacatcccttcaagactttggggtcctaggtggaatctcatggttaccctttttctactccccattacctcacacgtgttactcccatgtgggaagtcatgtgcttttttgtgcttcacggtgtgtgcaccgtggtggagatgacgacaaagaaggtgatgctccgccatgggtgacggctgcatcgcgttgcgtcaggaccgctcgtggtggcgttcttggcagtcatcggaaggttcctcatacttcttaa

SEQ ID NO: 60962 - DNA, 543 bp, Glycine max
  Peptide Sequence Number=SeqID_177740
atgggggggattagggcagcctatagcgggacccaaaattggccaagtgttgccaatcccctttatgattctgggattacagatgtaggtgaacaccatagcagccttccaagagacatcgccaatagcgtcggatatagaccctatgtcagggaggatgagaactaccttagggaattagagacaaggcaacagactcgccattatggtattcagaatcctaattctgtgatgagtaattatctatctgtgcatgatcctgctaatagccaccacatggggccaagttatccagcccttgctttagcatctgagccttatgtgatgaatacaccagccatgcagcgatatgcacctcgcctagacgaattaaaccatgcaaggatggatcctttggggtctgaacatgctatagttggtagaaacggtgcttttgaacgtagtgccctcccacctggatatgggagtaggatgccaggttttgcagctggttctcaccatatgtattcacgccagaattcagcagaccgattcaatgggtag

SEQ ID NO: 60963 - DNA, 240 bp, Glycine max
  Peptide Sequence Number=SeqID_177741
atgcaactaagaacacggtgtaaactttcacgtttcattgtgactttggcgacagagaaaagaatgcaaggcatgagcaactatatggcaagagcatgcgaacctaacggaaaagatccaaaagcccgctatctagtgacaactcccaaggctgaaggtatcatctcgcccaagcgagctggttgcttacgtatgaaggcattccatggcccaggtgagccagatgctggcctgggctag

SEQ ID NO: 60964 - DNA, 576 bp, Glycine max
  Peptide Sequence Number=SeqID_177742
atggaaagtgagtggatctgtcttactgatgaacttagagctgattttgagtcctaccgccaacgtacagaaaggttggagatggaactgaaattagagaagaagtcctcagtggagatggatgattcactaaagagagctgttatgggacatgctagaatggtagaacactatgctgacctacaagaaaaatacgatgacttggttactaagcatgatgctacaatggaagggatagcagaggtgaagaaggcagcagcaaaagcctcaataaaagctgttcaggctgctggagaactacttgttagactaagagaagctgaacacgcagcagctgttgcagagaactttgcaaatgaaaatttgaagatgcaaattgagaagccggaaagaaaacacaagacagagattaataccatgaagcagtacagtacaaagagcaaattaccagagtctgcattgcaaccactgtatagagaggattttgatgtgccgcataatgcaacttcctcctatacgtatgatgatcaggcatcaagagcagattttggagcaatatatcaggagcattactaa

SEQ ID NO: 60965 - DNA, 141 bp, Glycine max
  Peptide Sequence Number=SeqID_177743
atggatcttgacaccaaagaagaccttagtttgtctgcgcttagcgcgatgcacaggctcaacgtgcaacacacgcatagcgtgagacactcactgactgcgattaccaccatacttgctaagcatggaaagcgcgcttag

SEQ ID NO: 60966 - DNA, 534 bp, Glycine max
  Peptide Sequence Number=SeqID_177744
atgccgttagaagttggcgagtgggcgtgtgtggaggcgctcgacggcatgctggagaacaatttagtgttgatcagagggagggcacaggcgattcgccccatcgggaagaagatggtgtttttggtcatcaaagagaacggtttcactgttcaatgcttggtgcaagtgcagcctgatacggtgagttcgcagatggtgaagtttgccgtgaatccatcgtcgatgtcgaaggcgttgtttcggtccccaccgctcccatcaaaggcaccagtagcagcaacactctcttcgattgaccccgtgctcaccctctctgtcgctggaaacggtggtggctccgccattcttagggcggccttcgaccaatatagagggatagtgttcaagaacatcactggtgtcgggtttagtttcatcagaaagctgggggaacgattggtgtcttctattttagcaaggaatcttcccaagtcactattgagtggaggatcagtgatggcagatggtgaggaggtaaagactacagattga

SEQ ID NO: 60967 - DNA, 522 bp, Glycine max
  Peptide Sequence Number=SeqID_177745
atgcttcaaccatatgggatcaacataggcttaaaggaacactcaaacccggtgacccccaaggcctacactccgaagactccgtcagggcctctccctcctgatttaggtccaacccctaaaataattttgcatgcagatattgctcatgaattatacaatacccacgaccttacactccggcatctctggcggttccctaagattcctccaatttttcctccgactgttccgatagagttctcaaacgtcagagagactgagaagggattgaagcctccatttgtactatcttcatgcgatttcttttgctacctccacgaacattatctcaacaatcccaacgacagctatgggtttctgcgggaaagaaaaaggctacaatgcgaaggatatttctctcagctcaaacatgatatcgaaattcccaatggagagaatgcttggaattgggttgcggtgtttaaatttcacgatcatccaatggtgaatgagtccgagatcgtcatttttctgagacag

SEQ ID NO: 60968 - DNA, 513 bp, Glycine max
  Peptide Sequence Number=SeqID_177746
atggatacgttgaagaggaagtttatgtttcccaacctccaagctttgaggatcataaacatccaaatcatgcatacaagcttaagaaaactctttatggacttaaacaagctccaagacaaggattttgtgcacaagatgcaaggggagtttgaaatgtcaatgataggggagttaaattactttgttggtttccaagtgaagaaaatggaccatggaacatttcttcgtcaaacaaactgcaagaaacttctcaaaaagtttgagatggataaaagcaaggagtctgcaactcctatggctactaattactaccttagtgcagatgaaaagggaaagacaattgatcttagttccttactttacttgcttgcaagtagatcggacatcatgtttagtgtttacatgtatgcatgctatcaatccggtcctatggagtctaacatctatgttgtaaaaaaggattatgaaatacccaaaaggcactttagatgttggcctatggtactctaa

SEQ ID NO: 60969 - DNA, 261 bp, Glycine max
  Peptide Sequence Number=SeqID_177747
atgctggagttgcactgccccgaagttgcaactagacaagtacttcggtgggtttcgaacttgaaacccttcctccattgtcatgacttaagaggcttcagccactatgggatatctgatggtgaagctcctggagagcttcccatggccgaaggtggtcatcaagtccacgtagcctctgatcttgactctcttgcttgtaaagctgaggagtggtcaacgcgagagtggagagtgttaggggagacctcaaatttctga

SEQ ID NO: 60970 - DNA, 342 bp, Glycine max
  Peptide Sequence Number=SeqID_177748
atggaacaaaagaagtttgtggcactattaatggtggtggtggtgatggcttcttctatgtggaaaggatccaaaggtcttagtctctgtaacatggatgaagatggattggaggcttgcaagccctcagtgactcagccaaacccagttgatccatcccctgattgctgcaaggctctggatggtgctgacttgaagtgcctttgctcttacaagaactcatcagagttgcctcttctaggaattgatctaactcttgctgcttcacttcctgcaaagtgcaatctcactcctccagataattgctatgtgagtagcacttttggtcaaaaagtgctctaa

SEQ ID NO: 60971 - DNA, 513 bp, Glycine max
  Peptide Sequence Number=SeqID_177749
atgaaatatgaaactatccatcaaagaaaaacaagtttcaatgcaagcagcggcaatgatggtggtgatgagtgcatagaaaatgaagaacccatggagaatgatccccttgaggatggatgtgatgaacatgaaaatacaagtaagaaagttaggatttgtacatctgaagtttggaagttttttactaaaattggtgtaaaagattacaaagaaaaggctaaatgcaatgtgtgccgaaaagagtatgtaattggtggaagtaaaatagggacttcaacactaatctgccatttgaaaagaaggagtagtgctttcgctaaaaatcaagatgtggattgtatgataattgataatttgggagagttaagggctagggaacttaataacaaacatgttcgtgagcttatagtaagggctaccattgagcatgatttgccatttcaatttgttgaatatacatggattagggaattgctctcatttaaatctcgatgtcaagcatgtgtctag

SEQ ID NO: 60972 - DNA, 707 bp, Glycine max
  Peptide Sequence Number=SeqID_177750
atggctacaccttatcatccacagaccaatggccaagtagaaatttataacagagagcttaagcgaatcctcgaaaagactgtggcatcatcaagaaaggattgggctttgaaactagatgatactctctgggcctacaggacaacattcaagacccccatcggattatcactgtttcagctagtatatgggaaatcatgtcacttaccggtagagttggagcataaagcctattgggctctcaaattgctaaacttcgatgaagctgcatatggagaaaggaggaaattacagttgctggagttaaaagaaatgagattgaatgcctatgagtcctctagaatttataagcttagattattcccaggaaagctgaaatcaaagtggtcaaggccatttgtgattaaagaagtgagacctcatggagcaatagaattgatggaccctataggagacaaccttaagaggagatggatcgtcaatggacagtttttgaagatctataatggcggacaattggagaggttgacaagcgttgactacctgaaggaaggcacaactccacttgggatgtatccacaattgatgactcagaggccttcatccagtaggttgtttggccaggagtccaaccctctactgatggggggtgagccctctgaggtcggagataccactgaagttggaactaaggatgagaccatatt

SEQ ID NO: 60973 - DNA, 228 bp, Glycine max
  Peptide Sequence Number=SeqID_177751
atgtctatacaggcccatgattttagttatagaactgatagagatcaagataccctcagagtgtgttattccaaaggtgtggaagggtttaagttttgggatctaatttccaagaagatggtgattagcaatggtgcagtgtttgatgagcaatccatgttaccagagatagttgagacaactatgttagtgtctactagagctttccccaactccattgagctttag

SEQ ID NO: 60974 - DNA, 969 bp, Glycine max
  Peptide Sequence Number=SeqID_177752
atgtttgggctttcagctagtttttggttggctattgaggacctagcacaagctatgagaccacaggcggagttagaattttattttgaaccaagtgtaatgacattgtgtaatccatctgttgcggaagttggaagaaacaaccttaagacttcaattgaaagttcacaggaggctgctaagaagtcccttgaaaaagctgctgagcgtgtgagatgccttgaggatgatttagcgaagtctagatacctacatgctttctgtatagcatgtaatgtatgggttctaaatctgaaattttgtgtcttcaggagtgagattattaaaactgaagccaaaggcattttagaaagaaatgttgagttttctcagctggttgttgactaccaacgaaaattgcgtgaaagctctgagtcattgattgctgctgaggagctttcgcggaaacttactttggagctgtcagttttaaagcaagaaaaggaagtcatatcaaattctgaaaaaagagcatccaatgaagttcgcagtttgtctgaaagggtgcagcgtttgcaggctagtttgagtaccatacagagtactgaggaagttcgaggggaagcaagagctgcagagagggttaagcaagaagaatatataaagaaattggagagggaatgggctgaggccaagcaagagttaaatgaagagcgggaaaatgtgcggagattcacatcagatcgggaccagaccctaaaaaattctctgagacaggttgaggatatgagcaaagagttagctaatgcattgcgtgcagttgcatctgctgaatcaagggctgctgtggctgaggtaaaactctctggtcttcaaagaaagatgggttccacggatgacaagcttgtcgaaataggtggagtgagtggaccttccactttatcaagtgatgaggtgggcatacatttttatatatcaatttcactttag

SEQ ID NO: 60975 - DNA, 270 bp, Glycine max
  Peptide Sequence Number=SeqID_177753
atggttaggatcagggataataaatgttgttatgctagtagggaaacaagttggtggattacattaggaaaagaagttgagaatggagaacatctaactttcatcaatgcttccatcagaaaattaccacaccccacgtttttctcaccaaggatgcacaggctggtggacactgcagtgaggaacaattcatttgatgagatgttcttgatggtgggattggtactctataaggtgtttaagatacaggcatgcactgattcggcttga

SEQ ID NO: 60976 - DNA, 2634 bp, Glycine max
  Peptide Sequence Number=SeqID_177754
atgttctgtacttctacaggcagaaacagaagttcattgttaaaacaagagaagctgcgactacagtcacagcatgagagtgctttgaaggcagcagagtctgcacatgcatcactagaaactgagcgtgcaaaatcaagatcatttttgtttaccgaagaggagttcaaagcattgcagcttcaggtcagagaattgaacttacttcgtgagagtaacatgcagctcagggaagaaaataaacacaattttgaggaatgtcagaaattgcgtgaactagcacaaaaggttagagctgagacagagaacctagagaatctcctgagggaaagagaaattgagcttcagcgccataagaaagaaattggaacattaaaaatggaaaaagataatctcaataagaaggtttctgagttgcttgaaaggagtaaaaatgttgatgttgaggattatgatcgagtgaagaaacttgctagagaaatccaggataaactaagagagagagatgctcggattgaggaacttggtaaaagtctatcagaaaagcaggattctgtttcatgcctagagaaagatctttcaaactgccgattggagctagcagagagagagaagagaattaatgacattctgcataatgaggctaacctaaaacttgattcggagaagcataggaaactgctggctcagtttaagaagaggattgatgttttgtcaagggaaaaggaagacctagggaaagagaaccaacaactttctaggcaattagatgaaattaaacaagggaaaaggtcaacatgtgatacaacaggtgaacaagcgatgaaggaggaaaaggacacaagaatacagattctggagaaacatctggagagacagagagatgaattaaagaaggagaaggaagagagtcgtttagagagaagtagacgactgaagactgaaaaggccataaaggactcttacaacaatgttgaacaggagaaaataaaattgattattgaaattgagaggtataaggagtctctgaaaaggttatctgatgaagttgaaaagcttaagattgttattggcaatcttcctgagggttcaaatgtggttcaacttctttctggatccaatgtcgatgactttgctgctccttacatatctgctgtggaaagttttgaaaaggaagctcagtcagtatttcgggagcttggaggtcgcggtaatcttggagatgcagcaacaattacggatggttcagccgctgctacaggttctcttgtacatcctcaatcccaaggcattgcatctttagcggcccctggagttagcggtttaccacctaaagccactggagaaagtgagaaaagacttgcattacccaaagctagtgttgaaactcgtcgaacaggtaggagattggtcaggcctaaactactagagaaaagtgagaaaagacctgaggagcttcaaggtggtgacacagaaatgtctgatgctgaaggacctgggggcaagcctgggcagtctagtgacacagatactagtaatgttgttcaatcatctcaacaattggctcgtaagcgtgttgctcctacctccacttctgaattacgtgaagaatcagttgcacctggtgagaagagctctgatgtcttgaagaagtcaaaaggatctgagtccctagaagagaatacagaagaacaacctgctgcaattctagaatttactggcagccaccctgtcactgaagaattatttgatagcagtgacatgccccaatgccaaaatgaggaggttggtgaagctcaaaatgaagatggtgaaattgctgtcgggaatgatgaggaatccaaagatccacggcacttggatggtactggtcaagaggaattacaagctgacaaaactggaactttagaagagaatcaagatcaatctgctgaaacaaaagtgctgtctgatgagatgcagaggaatcagacagacccagacaatcagcagtcaacattggcgcccagtggtgagagagaagagggagaattgatgccagatactggagatctagagggtgctagtgatttgtctaacattgcggaaaaccaagaatctcgggaaggtcaatctgagtctgctgcaactcctgaacgttccccagctagggttgatgatgatgctctagaggctggtgagattaattctcctgagctttcaagtgatgataagaatgatgagggtgacttggtagaggaggctgctgatggttctgacaagttgattgatgtcaacgaaccaatatcagctgagagcgatcaagtggctgagcctgttgcgagtgagactgctacttcgacaagcactgttgcagagagtagctcctctaaagtgaacttacctgttccaaggcaagggacccctagtgcccccgctgaaacagaagagacaaagcaggcatcacctgttggtagtacttcaacaaccataaatttatcagagcgagcacgggaaagggctcaaatgagacaggctgggttggtttcttctacccttagaggtcgtggaagaggcggtgctccccgtggtcgagttggtcgaggtaggggagtagtacgccgaccacctccaccacctggcagtgatcaatga

SEQ ID NO: 60977 - DNA, 177 bp, Glycine max
  Peptide Sequence Number=SeqID_177755
atggagaagaaggggaaaagaagaagaaaggggttgaacggcgttagggcctgtgtgcggaaggcagaggaagaaattgtttccttgaatacaagattaccatcatacagtggaggaggagctctagagaacaccagaaacatcacaactgataacgaagaacgcttgagcgactaa

SEQ ID NO: 60978 - DNA, 264 bp, Glycine max
  Peptide Sequence Number=SeqID_177756
atgtatctcgcaaacctgctttcaatgactattaagagaatcatctactttgacttttatttgatcatcattaattggtgcatatatgcgattaagtgtcatggtgatgaggatgatgaaatctctatgaacttgactacgacattcctatcgttgttaaatgtcggtggaagctcaccagagactttggtttccagaaaatacgccttaactcttcatttcttacaatttcacgagtccccatatgcgcaagccactgcatga

SEQ ID NO: 60979 - DNA, 378 bp, Glycine max
  Peptide Sequence Number=SeqID_177757
atgactcaaggtcacaacaagcaaagaccaagcatcatcaagaacacaaatgaacaacaacaaacaagccctacccctcctaccattattaacaacaaaggcagtaatgcaaaaattgaacatgatgcagccaacaacactagatccactccccaaaagcaaaccaacaatgctcatttccttgctttgaatatcaagaaaagcatagaaacaaatgaatcagaaagaaagccaagatcatctagaggtgtttctctatcagtgaagtcaagggttgtaaatctaagtagcattgtagaactctcaaatgagacaccaccaaatctaagcacggatcagaggtcgagttccacgacacggggacgaagcacaacttga

SEQ ID NO: 60980 - DNA, 3801 bp, Glycine max
  Peptide Sequence Number=SeqID_177758
atggcactagaattggtcggtggtgctcttctttctgctttccttcaggctgcgtttcagaagcttgcttctcatcaaattcgggacttctttcgtggaagaaagcttgatcaaaagctgctcaacaacttggaaatcaagctgaactccatacaggctctggctgatgatgcagaactaaagcagttcagagatccacgtgtcaggaactggcttcttaaggtcaaagatgctgtgtttgacgcagaggatctcttggatgaaatacaacatgagatctccaaatgccaggtcgacgctgaagctgaagctgagtctcaaacctgcacttgcaaggtaccaaatttcttcaaatcttctcctgttagttccttttacaaggaaattaagtcaaggatggaacaggtccttgaggaccttgaaaatcttgctagccaaagtggctatctaggtttgaaaaatgcaagtggtgttggatcaggatttggtggtgcagtatcacagcaatcacaatcaacatctttgcttgttgaacgtgttatttatggcagagatgatgacaaagaaatgatctttaattggctcacatctgacattgacaattgtaacaaaccatcaatattttctattgtgggcatgggtgggttgggtaagaccacacttgcccaacatgtattcaatgacccaaggatagaaaataaatttgatatcaaagcttgggtctgtgtttcagatgaatttgatgttttcaatgtaacaagaacaattcttgaggcagtcactaagtccactgatgatagtagaaaccgagaaatggttcagggaaggttgaaagaaaaattgacaggaaagagattttttcttgttttggatgatgtttggaacagaaatcaaaaggaatgggaagctttgcaaactcctcttaatgatggggctccagggagtaaaattgttgtcactacacgtgacaagaaagttgcttcaatagtgggatcaaataaaacacattgcttagagctgttgcaagatgatcattgctggcaattgttggctaaacatgcattccaagatgatagtcatcaaccaaatgcagacttcaaggagattggtacgaagatagtagcaaaatgtaaaggactgcctctggctttgacaacaattggaagtctattacaccaaaaatcatctatttcagaatgggaaggcatattgaaaagcgagatatgggaattttcagaagaggatagctctattgtccctgctttagcactaagctatcaccacctcccttcccgtctcaagagatgttttgcttattgcgccttattccccaaagattacaggtttggcaaggagggtttaattcagttgtggatggcggaaaactttttacaatgtcatcaacagagtaggagtccagaagaagtcggtgaacaatacttcaacgatcttttgtcaaggtccttctttcaacaatcaagcaacatagagggaaaaccttttgtcatgcatgaccttctcaatgatttggcaaaatatgtttgtggggacttctgcttcaggttggaagatgatcaaccaaaacatataccaaagacaacccgtcatttttcagttgcaagcaatcacgttaaatgctttgatgggtttggaactttatacaatgctgaaaggttacgcacatttatgtcattaagtgaggaaacgagttttcataactacagtcgttggtattgcaagatgtcaacacgtgaattattctccaagtttaagttcttacgtgtcttatctgtgtctgattattctaacctaacagagttgcctgactccgtaggtaatcttaaatatctccattccttagacctctcaaatactggcatagaaaaactacctgaatcaacatgttcactctacaacttgcaaatactgaagctaaatggttgtaaacatttgaaggagctgccctcaaatttgcataaactcactgatttgcatcgccttgaattaatgtatactggagtgagaaaggtaccagcacatttgggaaaactggagtatcttcaagtattaatgagttcgtttaatgttggcaaaagtagggagttcagtatccagcagctaggagaactcaatcttcatggaagtctatcaattgagaacctgcagaatgttgagaatccctctgatgcattggctgtggatttaaaaaataaaacacaccttgtcgagctagagttagaatgggattcagactggaaccccgatgattcaacaaaagaaagggatgaaattgtaatcgagaatctacagccttccaaacacttggagaagttgacgatgaggaactatgggggtaaacaatttcctagttggttatcggataattcatcattgaatgtggtgtccttaagcttgaggaactgtcaatcttgccaacgtttgcctccccttggacttttgccatttctgaaggagctttcaattgaagggcttgatgggattgtgagtattaatgctgattttttcgggagtagctcttgttcatttacatccttggaatctttgaggttctccaatatgaaggaatgggaagaatgggaatgtaaaggtgtgacaggtgcttttccacgtcttcaacgtctttctatagggtattgtcccaagctgaaaggtttgcctccccttggacttttgccatttctgaaggagctttcaattgaagggcttgatgggattgtgagtattaatgctgattttttcgggagtagctcttgttcatttacatccttggaatctttgaagttctccgatatgaaggaatgggaagaatgggaatgtaaaggtgtgacaggtgcttttccacgtcttcaacgtctttctataaggtattgtcccaagctgaaaggtttgcctccccttggacttttgccatttctgaaggagctttcaattcaaaggcttgatgggattgtgagtattaatgctgattttttcgggagtagctcttgttcatttacatccttggaatctttggatttctacgatatgaaggaatgggaagaatgggaatgtaaaggtgtgacaggtgcttttccacgtcttcaacgtctttctatatataattgtcccaagctgaaatggcacttgccagagcaactatctcatttaaatcgtctagggatttctggatgggactctctaacgaccattccgctagatatcttcccaatactcagggagcttgatatcagggagtgtcttaatctacaggggatttcacaggggcagactcataatcatctccagcgtctgagtatgagagagtgcccccaattagaatcattgcctgaaggaatgcatgtcctccttccatctcttgattatctgggcataattcgttgtccaaaagttgaaatgtttcccgaaggaggtttgccatcaaatttaaaaaatatgcatctctatggtagttacaaacttatgtcctcattgaaaagtgccttgggaggcaatcactctctagaaaccttacggattggaggagtggatgttgagtgtcttcctgaggaaggtgtactgccacactctcttgttactctagacatcagtcattgtgaagatctaaaaagactggactacaaaggtctctgccacctctcctctctcaaggaattgactctttggaactgccgcaggctccaatgcttaccagaggagggtgtgggtttctcaaacaacgttgccgggaaccccaaggcgaagactggccaaagattgctcacattgaagacgtggatataa

SEQ ID NO: 60981 - DNA, 312 bp, Glycine max
  Peptide Sequence Number=SeqID_177759
atggcaattagtgttatgaagcagggcaacatgatagggcgtatggaacgagatgaggacctaactctattcagggaattgaggaagcaccagaatgaacgtgtctctagtctcttctattgtgttaattctgaagagttcgaatgtggcactaatactcatagtggtagatccaagtcattgcatcatgcatgggctaaaaaggttgaaaacaccaccagcaacttctctcttgaagtggaacccagtcctcaacttgtccttcaaaaggagttaccaatccctcaggccatctcaagagtgcgtcactga

SEQ ID NO: 60982 - DNA, 132 bp, Glycine max
  Peptide Sequence Number=SeqID_177760
atggatggaaatgcagaagccttggtcagtggcagcagcatagtggataggtggtggcggcaacacggcgcggttgcgtgcggtggagatatggtgaacaggggaagcagaaaatatgatggtatcaaataa

SEQ ID NO: 60983 - DNA, 465 bp, Glycine max
  Peptide Sequence Number=SeqID_177761
aggaaaacggcagtgatgatattgagaaacctggaggcatttgagcctattattaaagcaggatggaggttttctaagttctactgttttatacacgttaccaaaacctatctgatcgcccctgatgtgatctcaccccgttttggtaaagttgcttgtggagatattgtagtcttgctcaatcctcaacaccctaggcactttatgaccaaacgtgtggttggattggagggtgatagcgttacatacatttccaatcctgagacctatgaatatgagggtgatagttttacacgcatttcctctcctgataacggtgataagtctaagacgattgtgggagataacaagtataaccgcaatgattcaagaaaatttggtcctgttccttatgaccttattgatggcaagatgttctggagggtaacgccacttaaaaaatttggacctttctggaataaatga

SEQ ID NO: 60984 - DNA, 3640 bp, Glycine max
  Peptide Sequence Number=SeqID_177762
atggcactagaattggttggtggtgctcttctttctgctttccttcaggttgcgtttgagaagcttgcttctcctcaagttcgggacttctttcgtggaagaaagcttgatgaaaagctgctcaacaacttggaaatcaagctgaactccatacaggctctggctgatgatgcagaactaaagcagttcagagatccacgtgtcaggaactggcttcttaaggtcaaagatgctgtgtttgacgcagaggatctcttggatgaaatacaacatgagatctccaaatgccaggtcgaagctgaagctgaagctgagtctcaaacctgcacttgcaaggtaccaaatttcttcaaatcttctcctgttggttcctttaacaaggaaattaaatcaaggatggaacaggtccttgaggaccttgaaaatcttgctagccaaagtggctatctaggtttgcaaaatgcaagtggtgttggatcaggatttggtggtgcagtatcacagcaatcacaatcaacatctttgcttgttgaaagtgttatttatggcagagatgatgacaaagaaatgatctttaattggctcacatctgacattgacaattgtaacaaactatcaatactttctattgtgggcatgggtgggttgggtaagaccacacttgcccaacatgtattcaatgacccaaggatagaaaataaatttgatatcaaagcttgggtctgtgtttcagatgaatttgatgttttcaatgtaacaagaacaattcttgaggcagtcactaaatcaactgatgatagtagaaaccgagaaatggttcagggaaggttgagagaaaaattgacaggaaagagattttttcttgttttggatgatgtttggaacagaaaacaaaaggaatggaaagatttgcaaactcctcttaatgatggggcttcagggagtaaaattgttgtcactacacgtgacaaaaaagttgcttcaatagtgggttcaaataaaatacattccttagagctgttgcaagatgatcattgctggcgattgttcactaagcatgcattccaagatgatagtcatcaaccaaatccagacttcaaggagattggtgtgaagatagtaaaaaaatgtaaaggactgcctctggccttgacaacgattggaagtctattacaccaaaaatcatctatttcagaatgggaaggcatattgaaaagcgagatatgggaattttcagaagaggatatctctattgtccctgctttagcactaagctatcaccacctcccttcccatctcaagagatgttttgcttattgcgccttattccccaaagattacaggtttcacaaggagggtttaattcagctgtggatggcggaaaactttttacaatgtcatcaacagagtaggagtccagaagaagtcggtgaacaatacttcaatgatcttttgtcaaggtccttctttcaacaatcaagcaacataaagggaacaccttttgtcatgcatgaccttctaaatgatttggcaaaatatgtttgtggggacatctgcttcaggttggaagatgatcaagtaacaaatataccaaagacaacccgtcatttttcagttgctagcaatcacgttaaatgctttgatgggtttcgaactttatacaatgctgaaaggttacgcacatttatgccatcaagtgaggaaatgagttttcataactacaattggtggcactgcatgatgtcaacagatgaattgttctccaagtttaagttcttacgtgtcttatctctgtcaggttattctaacctaacagaggctcttgactctgtaggtaatcttaaatatctccattcattagacctctcaaatactgacatcaaaaaattacctgaatcaacatgttcactctacaacttgcaaatactgaagctaaatggttgtagacatttgaaggagctgccctcaaatttgcataaactcactgatttgcatcgccttgaattaataaatactggagtgagaaaggtaccagcacatttgggaaaactgaagtatcttcaagtattaatgagttcgtttaatgttggcaaaagtagggagttcagtatccagcagctaggagaactcaatcttcatggaagtctatcaataaggcaactgcagaatgttgagaatccctcagatgcattagcggtggatttaaaaaataaaacacatcttgtcgaggtagagttagaatgggattcagacaggaaccctgatgattcaacaaaagaaagggatgaaattgtaatcgagaatctacagccttccaaacacttggagaagttgaggatgaggaactatgggggtactcaatttcctagttggttatcggataattcatcatgtaatgtggtgtccttaaccttggacaactgtcaatcttgccaacgtttgcctccccttggacttttgccatttctgaaggagctttcaattggagggcttgatgggatcgtgagtattaatgatgattttttcgggagtagctcttcttcatttacatccttggaatctttgaagttcttcgatatgaaggaatgggaagaatgggaatgtaaaggtgtgacaggtgcttttccacgtcttcaacgtctttctatattgcattgtcccaagctgaaaggtttgcctccccttggacttttgccatttctgaaggagctttcaattggagggcttgatgggattgtgagtattaatgctgattttttcgggagtagctcttcttcatttgcatccttggaaatactggagttctcccggatgaaggaatgggaagaatgggaatgtaaaggtgtgacgggtgcttttccacgtcttcaacgtctttccataaaggattgtcccaagctgaaagggcacttgccagagcaactatgtcatttaaatgatctaaagatttctgggtgcgaacaacttgtaccttctgctctcagtgccccagatattcatgaattggttggtggttctcttctttctgctttccttcaggttgcatttgagaagcttgcttctcttcaagttcggggcttctttcgtggaagaaagcttgatgaaaagctgctcaacaacttggaaatcaagctgaactccatacaggctctggctgatgatgcagaactaaagcagttcagagatccacttgtcagaaactggcttcttaaggtcaaagatgctgtgtttgacgcagaggatatcttggatgaaatacaacatgagatctccaaatgccaggtcgaagttgaagctgaagctgagtctcaaacctgcacttgcaacgtaccaaatttcttcaaatcttctcctgctagttcctttaacagggaaattaaatcaaggatagaacaggtccttgagaaccttgaaaatcttgctaggcaaagtggctatctaggtttgaaaaatgcaagtggtgttggatcaggatttggtggtgcagtatcacagcaatcacaatcaacatctttgcttgttgaaagtgttatttatggcagagatgatgacaaagaaatgatcgttaattggctcacatctgacattgacaattgtagcgaactatcaatactttctattgtgggcatgggtgggttgg

SEQ ID NO: 60985 - DNA, 366 bp, Glycine max
  Peptide Sequence Number=SeqID_177763
atgtcttcattgcacttcaaattgcttgtggttgatgcgttcaaattgcttgatgagtttttcacaagtcctaagcacctctacttgtcgctgaagaaagttgtcgatggtggtgaccaaggtgtcgacgatagcgacgaggttgagttgactgagggtgagtttggccagggcagtctcgaggcggtcctcgctagcgggagaaagttcaagttaaagctggtatggcagccatgggctctcaatgaaagcaccaaaatgttacgtgttgagtatgggaaagctggtttcgagggtccatcacctcctgaagaagaagaagaagagaagaagatagcacttggaattcgaggaccaacctcttaa

SEQ ID NO: 60986 - DNA, 273 bp, Glycine max
  Peptide Sequence Number=SeqID_177764
atgtggagtcagcaagggtgcggtgaatggttgcacgggtgtaggacatggaggcgcagtcagaatggacggcggaggtggcataggcggtggagtcgacatggacggcagagcagcgaggttgagttaactgagggtgagtttggccagggcggtctcgaggcggtcctcgctagcgggagaaagttcaagatggtttggcggatgctatggactgcggtggtttgggctggaatggcagccatggaaggcagccacgggagctctgtttag

SEQ ID NO: 60987 - DNA, 1218 bp, Glycine max
  Peptide Sequence Number=SeqID_177765
atggatctctcccttgactttatcaccggcttaccccctttccgcggcaatactgttattctagtggtggttgatcattttttcaagggggtgcatctcggaatgttgcccacagcacacacagctcacgcagtagcctctctattcctggaattggttgtgaagatccatggagtgccacggagcttggtctctgatagggatccgctcttcgtcagcaagttctggcaaaaactttttcatcttagtggcacgcaattaaagatgagtttggcctatcaccctcaaagtgatggccagacagaggttttaaaccacgtcattgaccaatatttgaggagtttcattcatcatcagccgtcaaattggggaaggtttctggcatgggcggagtattcccacaatacatcatggaatgcagcaacaggcaccacaccttatgaggtaacatttggccgcaaaccattcaactttccgacatacattgccggaacttctaatctcgatgcagttgacacctttatgaccaacagagatgaagtttttcaattcatccgcaagaaacttttgaaggcacaggctacaatgaaagaccaggctgacacccaccgtcgtgaggtgacatataatcccggagagtgggtgctgctgaagttgagaccacatcgtcaatccactgccaaaggttctcaagttttctcgggaaagttagctaaaatgttttatggaccttttcagatcattgaacgtattggcaaggtttcctatcgattgcagctgccaccagaagcgaaaattcactctgtttttcattgttctatgttgaaaccatttaaaggggatcctgaagttactgcactcactttaccaggccaaattattgatcatcagcctatcgtagcccctttggcaatcctggattatcgcaaggctgattcacccaatgagacttggcaggtcttagtccagtggcagggactatctcctgatgacacttcttgggaggattggtctcaactttgccacgattttcaccttggggataaggtgcttttccaagggccgtggagtgataaggaagcagaatcagctgaagggaaaatagaagctaatgcaaaaggtgctgaaaacagagcaacagcaacagagcaggtgcaaagagcaaaaaagcccaaaagggtagtgacgagaccatcttacctcagggactttgtctga

SEQ ID NO: 60988 - DNA, 354 bp, Glycine max
  Peptide Sequence Number=SeqID_177766
atgagttactcgatagaaatttgcagagaccaaatttctttaaagctagatgatcatctgtacaagaaagatggggttgaagatgatttaggaagtaacctgtggcaagttacatatacagataatcaagttcctcctcaagatcatggcccctatcctcaagcactaattattgagacatatactcctccagatcctggcccctatcctcaagatcagcctaaacaaaattcagttcgatttacacccacccaggttgaagcaatcatctctggcattcagcctggtctaattatggttgtggggccacctagtacaggaaagactgatcaacaaagtgtaattaagaattag

SEQ ID NO: 60989 - DNA, 240 bp, Glycine max
  Peptide Sequence Number=SeqID_177767
atgcctgctgcagcgtctagatctttgaaaattagaaagttccagaaatcttctgcttctgggatttttgaatctatgtttcctccaccgcctaaggtgttagggagaggttctctgtgctccgaagtgagtggaaaaagttccagtgaagggtggaactccaaatttgattacatcagcatgggaaatcatggtgaaactcagaacacagcacaaaaggatatgagttctatatattag

SEQ ID NO: 60990 - DNA, 180 bp, Glycine max
  Peptide Sequence Number=SeqID_177768
atggcatcaactttgctggcaagctcggaatggtgcagggataggcgggagatggcctcctcgagcctatccgtggtggtcttacgtgtgttatggtcagccatggaagggcaggtcggaccaaatgttatgaatggagcaaggccttgtttcgaggacaagcaagttggatacagctaa

SEQ ID NO: 60991 - DNA, 1249 bp, Glycine max
  Peptide Sequence Number=SeqID_177769
atgaagtttcaccacctgggccaacccgtcgagcttcatgtcgacgccgaccatgggccgcaccctatttctgctacccaaatcaagcgtatgatccagaccaatgccacttcagccctcttccacctttgcgtcctccctgctagtgacaccaccatcccccagcacccaccctcatcaacaccttcgtccatacccgccattgatgctttaatccacaaataccaatcccttttccaaacacccacagccctacccccctcacgctccattgaccatcacatccatttacgacccaacacggagcccattaatgttcgtccttatcgctacccgcattttcagaaagccgagattgagaaacaggtggccgacctcctctccgccggcctcattcaagtcagccggagtcccttttcctcccctgtcctcttggtaaagaaaaaagacgacagttggcgtatgtgcgtcgattatcgcgctcttaacgccgtgaccattcgggatcgtttcccaatgcctactgttgatgaattgttggacgatttgggccatgcatcctggtactcgaaactcgacctgcaacaaggctttcaccaaattcttatggctcctgaagatactccaaagacagcattccggactcatcagggacattacgagtaccgtgtcatgccattcggtctctgtaatgccccgtcaacgttccaagccgccatgaacaccttgctccaaccctttctccgtcgtttcactgcggttttctttgatgatatacttgtctttagtgattctttgcaggcccacctccatcatctcgaactcgtgttccaagccttgttacagggccaattctacctcaaacataccaagtgttcctttgctcagaggcgcctggagtatttgggccacatcatctcggagcgtggcgtggagcccgacccctctaaaattagagccatgatcgactggcccacccccaagacccctaaggatctccgtgcttttttgggcctcacaggcttctaccgcaaatttgtccaaggttatgccgccctggcctccccgttgacggccctcctctgcaaaaacgcctttgactggaccccagagtcccagctcgcctttgagacactgaaaaccgcaatgacccgagctccagtgctggctttgcccaatttcgaacacccctttgtcctcgaaactgatgcatcaggcactgccatgggtgccgttctccttcaacagg

SEQ ID NO: 60992 - DNA, 366 bp, Glycine max
  Peptide Sequence Number=SeqID_177770
atggagaaacttacacaaacttcatttggtggagatcacttgacattgaacgcccctgttatctctgctgagaaagcataccatgagcagctttccgttgctgagatcaccaacagtgcctttgagccatcctccataatggccaagtgtgaccctcgccacggcaagtacatggcgtgttgtttgatgtatcgcggcgatgtcgtgccgaaggatgtgaatgctgcagtggcaaggtggcacggcggcgcagtggcgtgtgaatttatttgtgcccccaggggcccctccccaattcagagcgacccggctcattgtcctgtgataggtggaaaaagcttttgctgcgaagcagcttcaagctga

SEQ ID NO: 60993 - DNA, 888 bp, Glycine max
  Peptide Sequence Number=SeqID_177771
atgggaccaagcaaacatcatatgttagcaactgtggcaaatccttggtggacgggtcagggagggttatctggggttgaccacccaggaacccattcacctggcctaggcaaacgcccctcagaccttggaatcagcgaaaacagtggtgggcacaatagagaagaagatgaagacaatagagatgaaccaaaagagggtgcagttgaggttggaacccgcagaccaagaggaagacctcctggatccaaaaacaagccaaaaccacccattttcgtgacaagggacagcccaaataccctgaggagccacgtgatggaggtaactggaggagctgatgttgcagaaagtgtagcccaattcgcaaggaggcgtcagcgtggggtttgtgtgctcagcgggagtggctcagtggccaatgttactcttagacagccttctgctcctggtgctgtggtggcacttcatggaaggttcgagattctgtccctaaccgggactttcctacctggtcctgctcctccaggatccacaggactcaccgtgtatctgacgggaggacagggccagatagtgggagggagtgtggttggatctctagttgcagcaggaccagtgatggtcattgctgcaacttttgctaatgcaacatatgagagacttccacttgatgaggatgatgaggggcccagttcagcggcgggggcgcaaggtggaggatcgtcgccacccccaccgcttggaattggaagcagtgggggtggacagttgcagggtgggatgccagatccatcatctatgcctttgtataatcttccaccaaatggaggagtggggcaggtagggcatgaagctcttgcttgggctcatggacgagcacctttctga

SEQ ID NO: 60994 - DNA, 1012 bp, Glycine max
  Peptide Sequence Number=SeqID_177772
tcttgggcttagtggagtttctccaagtccaacattgcaaaatgagtgtgggttagtgtctggccagattaatgttcctatgagttctgagaagttgaaaaacatacattgcaagagaaataggagaactgctgtggagacaagggaaactattagtaagcctatgaggagaggtgaattggcatatcttcaactcgaagattttggttttccttgcggaacaagtccggggagacttttcatggaatgtctgagtttaagcagctcggttgtgaaattagacgatgacgatgatgattatgttgttgatcgcgaggacctacacggtcacatatcaagcagtcatagtattgatgttgggaataaggccaagaaaagggatcacttgtacaattctggtggtccaaatcatgttcaaagtggtgttcctttcaccgaagatctaagttgctcaacctttggtccccaaagtagattagctgtttatgctcctccttctacacttggaggctgtgctctagcattgcactatgccaatgtcataatcgtcatggagaaactccttaggtatccacatttagttggtgaggaagctaggaataatctatatcagatgctaccaacgagcttaaggttgtctctgaaaggcaaacttaagacctatatcaagaacttggccatatatgatgcacctcttgcccatgactggaaggttactcttgatgggatactcaagtggcttgctccacttgctcataacatgatcaggtggcaaagtgagaggaattttgagcagcaccaaattgttaacaggacaaatgtgctgctatttcagacattatactttgctgacaaggacaggacagaggaagctatatgccagcttcttatgggactcaattacatatgccgttatgaacaacaacaaaacgtgttgttgggttgtgcaagtagttttgattttgaagattgcatggaatggcaactgcaatgtggagcttttcccagttga

SEQ ID NO: 60995 - DNA, 380 bp, Glycine max
  Peptide Sequence Number=SeqID_177773
tcactcttttccttcaacattttaacatccctcttgattctgaaccctatgttccaatcaagagatctttcttgatcgatgctgttgtggtttcgtcctttggttatcacaaagagcgtgatggctcttgggtaaaaaagggtgctcaaccaaatgatgatgaaggacaattaccagttgaagaagactcttctctctttcaaagtattttggacaggtttgatggactccaaacctatgttggtgagaggtttgatgctttggaacaacaagtggacatgcgattcaatacaatggactcaaggatcacaaaggttgaagaagatgccaccatcattcgcgactaccttgatttacctccaccaccaccatcaatttag

SEQ ID NO: 60996 - DNA, 195 bp, Glycine max
  Peptide Sequence Number=SeqID_177774
atggggaagcaaaattctaacgataatatagtgcatgatgcgacaatcaaagaaaatagagtagatgatcatggagatgacaaggaaggggggagtggtgctgtgggcactccagatggtccgtggtgtcgatgggcaacagcggcggaggaagtggatgagccctttcgctttttcaatgattcagccatttga

SEQ ID NO: 60997 - DNA, 426 bp, Glycine max
  Peptide Sequence Number=SeqID_177775
atgggtgaagtagaggaggtgcaaaagcagatgaaggctgacatggaggccatgaaagagcaaatggccagaatgatagaggccatgatgagcatgaagaagataatggaaaccaatgcggttgcagttgccgctaccagcgctgttgctaagagtcaacaacctcaatctgatcatgcacatgtctttcaaaccgtgggggagacacatgaaattccccaccacaatctagccgacttcaagccttgcctcggatatgccactgaagggcaagtagttggtggtatactcctgcaaaacactttggagggccctcaatttcatccccaaccacaacccttgcattccacagtagctaaaatccctcctattatggaaggaatgggaaaagttggatcatctagaggaaaggctcagggtcgttga

SEQ ID NO: 60998 - DNA, 387 bp, Glycine max
  Peptide Sequence Number=SeqID_177776
atgatccttgatgcctcaactggtggcactatgatgtccaagagtccagaggaagctattgtaatcattgactccatagcagccagtgattatcaaagtcatcatgatagagctccgactcaaagaaaagaagagaaggcccattatctgcaaaatcaagccagacctcaacaaaacttccaaggaagctaccaaggctatagaggtggctcaggttcaaatcaaccttatggtcggagaccacaaaattctagtcccactaacacttcttgcgcaggtccttctaacaactcttatggaggttcttcaagtaggggtccacaacaacatcaagctcaaccagatagaatgtcaaagatggaagatactttaacacagtttatgcag

SEQ ID NO: 60999 - DNA, 192 bp, Glycine max
  Peptide Sequence Number=SeqID_177777
atgagtcagacccttctgcgcaacaatatcatcatccaaaaacagcactatgttgagctttggaaagatctatggcaaatagaactggagggaccagtcaccaaatccatgaacaaaaggctccaagaggattgggctagagctgttgaagaaggccctagggttctcatgaacctcaggatagatttatga

SEQ ID NO: 61000 - DNA, 471 bp, Glycine max
  Peptide Sequence Number=SeqID_177778
atggcgaccaactgtgcgagcacaaccagagggggaggctatcgcgcagctactgtgcataccaatgaggatcgcgcccacaagacacccagtggacccggaggagtccaacagggccctagggtctccagctctagttatggtcctctggatcgcgcccataagacacctagtggacccggagaagtccaacagggccctggggtttccagctctagttacgggcctctgtcagtcctacagggtgcccgttccccccggcaagggatcgcgcccgcaagacacccagtggactcgaagaagtccaacagggtcctggggtttccagctctgattatgggcctctatcagttctacggagtgcctgtcgcccccagcaaggtcatcaggccccctattaactggactttcatcgagaagtactgcgccccaggaaggcgcagggcaaggcatcatagtagtgggcaataa

SEQ ID NO: 61001 - DNA, 1746 bp, Glycine max
  Peptide Sequence Number=SeqID_177779
atggaaaaccaattctttctcaatgctggtgtgccccctcagctgcattttgagccttctccacaccaccatcatcaccatctttgtccaccaccctcttggcaatcatcactgtcttctgccatggatgttcaagtcactgttttgaattgttcaactgagcagaacccggattgcttctacaacaacacccccacatgggacaagtcaacggatcatcatggtcttcagtttgattcagctctgagctcaatggtgtcctctcctgcagcctccaattccaacatgtcaagtgagaattttgtcatcagggaattgattggaaaattgggaaacattggtgctggctctgatgagattgagatctcacctcattctcagcctttggttggtgcatcttcctacatcaattgcaataacaacagcaccaacacatcatgttatagtacccctttgagttcttctccaaaggtgaacatgaacaagatccccacaatggtgaagcacttggtgaaagagggcatgcccctaagtttggggacatcaacgtccttgaattccaccgtggcggaattctcagctgatcctggctttgctgagagggctgcaaagctttcttgctttggaagtaggagtttcaatggcaggaccacccaattgtgcctcaacattgctgaattggctcagagatcttctccattggtggaaaatgggaagaagcagctccctagagtctcaagtagtccatcactcaaagtgcttggatctcaaatgggtactcaggagaacaagaattctccattgcaagacctaatggaagtggccaattctcaagaggagtccgcaatctctgaacaaacaccaaatggagacactggggagaaaccttccccttatgtgaattctaggaaaagaaaaggtccatccaaaggaaaagccaaagaaacttcaacctctaccaacccccctatggctgctgaagctagcgatgactcgaatgcaaagcgcagcaagcctaacgaaggtgaggggaatgaaaatggccaagtgaaggcagaggaagagtccaaaggaggtaataatagtaatgcaaatgatgagaaacagaacaagagtaactcaaaacctcctgagcctccaaaggattacattcatgttagagcaagaagaggtcaagccactgatagtcatagtcttgcagaaagagttcggagggagaaaatcagtgaaagaatgaagcttctccaagatcttgtcccaggttgcaacaaggtcacgggtaaagcactaatgcttgatgaaattataaactatgttcagtcattgcagcgccaagttgagtttctgtctatgaagttggcttctgttaacaccaggctggattttagtattgagagtctaatctcaaaagatatatttcaatcaaataattctttggcacagccaatattcccaatagattcctcggcgccacccttttatgggcaacaaactcagccaaacccagcaatccacaataacattcctaatggaactatgacccacaactcagtggacccattagatactggtatgtgccaaaaccttggcatgcatttaccacacctaaatggttttaatgaaggtggctttcagtatccaataacattctctgaagatgacctccacaccattgttcagatgggatttggccaaactgcaaataggaaaacaccaatacaatctcagagtttcaatggtaaataa

SEQ ID NO: 61002 - DNA, 1336 bp, Glycine max
  Peptide Sequence Number=SeqID_177780
atgaagctgctctctccaaaattgttcactctcgccattctgctcgcggcggcgctggttttagcttccgccgacgcagtcagtgacaatgagatgcagaaacatgaagccacggaatcaagggacgtggttgaagagaagttgcgagtgcagagcttgaagaattcgtcaatggcagaaaggtcagggggtgctttaaatgaacatgcagttgataatccagaggagattgcttccatggttgatgagagcatacgcaattacacagctcgaaggaacctgaacttcttctcatgcgggaccgggaacccaatcgacgactgctggcggtgcgacaagcggtggtacgcccgccgcaagcgcctagccaactgcggcatcggcttcggccgcaacgccatcggtggccgcgacgggcggtactacgtggtgtcggaccctaacgacgacgacccagtaaaccccaaacccggtaccctccgccacgccgtgatccaggaccgccccctctggatcgtgttcaagcgcgacatggtcataaccctaaagcaagaactcatcatgaacagcttcaagaccatcgacggccgtggcgtgaacgtccacatcgcttacggtgcgtgcatcaccatacagttcgtcaccaacgtgatcatccacgggttgcatattcacgactgcaaggtaactggtaacgcaatggttcggagctctccctcgcattatgggtggaggactcttgctgatggcgatgggatctccatctttggctcgagtcacatttggattgatcataactcgctgtcgagttgcgctgatgggcttgtggatgctgttatggggtccactgctattactatttccaacaactacttcactcaccacaacgaggttatgctactgggtcacagtgactcttatgtccgtgacaagcaaatgcaagtaaccattgcttacaaccattttggggagggtcttatccaaagaatgcccagacatgggtatttccacgtggttaacaatgactatacccactgggtaatgtatgcaattggaggcagtgctaatcccacaattaacagccagggtaacagatacctcgctcctctgaacccttttgctaaagaggtgacaaagagagtggatacagggtcatccgtatggaaaagttggaattggagatctgaaggagaccttttgctcaatggagccttttttacttcatcaggagcaggagctgcagcaagctatgccagagcctcaagtttgggggctaaatcatcttctttggttggtaccatcacatctggagctggtgttcttaaatgccgcaggg

SEQ ID NO: 61003 - DNA, 99 bp, Glycine max
  Peptide Sequence Number=SeqID_177781
atggctcactctgacaacagcgggaatggaaatgacgtggatgccctccatctccatggaaggacaacgagatcaaccggcgcatccttaagctggtaa

SEQ ID NO: 61004 - DNA, 192 bp, Glycine max
  Peptide Sequence Number=SeqID_177782
atggagcctttttcacttcatcaggagcaggagctgcagcaagctatgccagagcctcaagtttgggggcaaaatcgtcttctttggttggtaccatcacctctggagctggtgttcttaactgccgcaggggtgccatgcacttcttcccactttcacaatccttcacttgtgcgagagatttccccgtaa

SEQ ID NO: 61005 - DNA, 327 bp, Glycine max
  Peptide Sequence Number=SeqID_177783
atgtctccttcacaactcctgcctatagacaactatcggcaacgtcagccgcaacaacccgacgccatgtttttaccgtggatgttgatgaagatatgctgtaacagaaaaagccattggtggaacgcattagtcgtagacgttgccttgtggaagattaacgtgaaaaacggcgtccctactcttgctgacccatggtaccagtacttagcggacaatgatttaatgtccagagatgaggtggtattttactacacgttcaagaaacatggatgggacgtcctgtataggaagcagctgatatgggatgatgaccaatccgattga

SEQ ID NO: 61006 - DNA, 549 bp, Glycine max
  Peptide Sequence Number=SeqID_177784
atgacgacgaccaatgccccaaccgcgtccactccctcccctcgcagtttgtcgcgatgcacacccgtatactcctttcaggcagtattccatgttgataggaactacattgaggtccccagatcttatcataagcaatgggctccacattgccctgcttatgtgaagatacaatacaatggagcgccgcacatcattaaggttaggaaaaatggtcagcaatactacctggccgatggactgaaacaattcagaagaaacttcaacatacatgaaggtgtattgttgttgcctaccgaggctgtccattttgttcatgcttcaacaccatttatgaccgtgcaacataacagtgccgttcgtgacatatggaccatctccatgcataatggtgaacaacatgtggatgacccttggaatagattgttaacggacaatgacttgatgggtggagacgaggtcatcttctattaccggcctaacgaacatgtgtgggagatcatcttcaggaaggagcccatatgggatgaagatgacgactccacttga

SEQ ID NO: 61007 - DNA, 210 bp, Glycine max
  Peptide Sequence Number=SeqID_177785
atgacttctttccaaatcctcctccttcaactcaagacaagcaagctagtagccaaaattgagtttggggtgaatgggtttatgttgttggtgaaggagagattagcaacgtcaatggatttttcaagtgagtcgatggaatgcatttatcgagtaaaaaggaaacaacgtcggggcggggaaaacgtcgtgttcaagtacatatattaa

SEQ ID NO: 61008 - DNA, 309 bp, Glycine max
  Peptide Sequence Number=SeqID_177786
atggctaacaacaatcattattggctttgcatttattggacaggccgtggtcaattgaccacgaccattatcgggccctttggtgactaccttggttgttgtaaatccaccatggttgtgggccataccaccacgagcgcaaatttcttgggaagaggtggaggtgtgagttgtaaactagaacttttccccctcatgaaactcacggctctcgagtttggcattctcatgagcactgagcctaaactcatccagcttattcaactgctacaacctattgttacctgtaagcttagaatcaaagtttag

SEQ ID NO: 61009 - DNA, 453 bp, Glycine max
  Peptide Sequence Number=SeqID_177787
atggtgtacgaaaaagcatgccacctaccagcggagttagaaataaaagctcattgggccaagaagttccttaactcagactttaccgcatccagagagaagaggaaggtacaactacaggaacttgaagagatgtgcctcaacacatatgaatcatccaagctctacgaagaaagaaccaataggtaccatgaaagaaagatcctccatagagaattcaagcccggacaacaagtattgctctacaacttaagattaaagttgtttcccagaaaattaaaatcaagatggagtggtccctttactgtcaaaggcattaagccttatggagctatagaaatagaggaccaatccaaagactgcagcaagttggttaatggcaaaagattaaatatctaccttggtggagaagtcccacaacacatcatagtcatcaagctcaaagatccttag

SEQ ID NO: 61010 - DNA, 567 bp, Glycine max
  Peptide Sequence Number=SeqID_177788
gatgtggaccctggaagaaaggatccagcatttggcgtaagaagttcatataagttgcaaagttgttctacaccatctagtgatgctgctcaaatctcatgggttgtgcccattggaatgactgttgttgtcaatgtgttggctattgtggtggtggcagttgttgatatgtcgattgttgtgatggtggctgctctcccattagtggaaaaggagagtggagtagtagatggaataccaccaatagtggatgtagggtccttagatgtgaccaagatggtgctctccttcttcctatgcaagcaccctatgagccattcatttgtgaacaaggtggagggctgggtcatggaagaggctggctttggagatgccaggctgaaagatgggggatttagtgagttccttgaagaatgtagaaagaaaccatctgcatttgagctagcctttgtaccatatgagtcccacacttggcaagtggagatgaactccatagatatgtcacagaaggagtgctctgagataaaagctccacactaccacctaatggctattgttaacgtttaa

SEQ ID NO: 61011 - DNA, 2391 bp, Glycine max
  Peptide Sequence Number=SeqID_177789
atggagtggctccaaacgctgcctccaccctctcacctctcgccctccgcactctccttcctcgatcacaggctccacacgcagctcgccctcgccgaggctcccaccttcgtggccgagctccagactcagtgttccgagttggatcgctcgctcgacgagttgactcggcttctcggagctggtctcgccgcgtacacctccttctccggagaaatccacggcctcttcggggacgtcaccgagaggctgatcgctctctcctccaccgtcgtgccagatggaggaagaggcgaagaggatggcaagggtttcagagaggagcttgcgactttggcgaaggaagtggctaggttggagacggttcgtgtttatgcagagacagcactgaaacttgatactttggttggtgatattgaggatgctgtatcatttaccatgagcaagaacataaggaaacattctagtcaaaattcacaagaaatgcatatgcttgctattaaaacactgaaaacaacagaaggcatattaacttcaattacaaaagcacatccccagtggaagcatcttgtatcagctgttgatcacagagtagaccgagctcttgctattttgaggccccaggcaattgctgagcatcgggcacttcttgcttcgcttggatggcccccacctctttttgccttaaactccttggattcagatgcaaggactgcaaatcaagttgcgaatcctctactgaccatgcaagtggatcttaaagtccagtactctgaaaactttcttgctttgtgcaacctacaggagttgcaacgacaaaggaaagccagacaacttgagggccatgacagggaagttgctctacgacaatcactttgggtaatagaagagcttgtgaatcccttatcattggcttcccaacgacatttctcaaaatgggttgataaaccagaatttatttttactcttgtatataaaatcacaagggattatgttgattctatggatgaattgttgcagccattggttgatgaagcaaagttgcttggttacagttgtagagaagaatggatctcagcaatggtaacctctttaaccacatacttggcaaaagaaattttccctagttacattagtcaactagatgaagagagtgttataggaattcagtcatctgctagaatatcatggctacatctcattgatttgacgatagcttttgacaaaaggattaagtctttggtagagcattctgggatcttgctatcctttgatgatgatatcatgcagaaaatttcttctctatctgtattttgtgatcgtccagattggcttgatctatgggctgaaatagagctaggtgatgccctaggtaagttgaaaccagacatccaagatgagaataattggagaaagaaagttgaaggtgtggttctttcatcctatactgatgatcacaagtctcctctgatttctaatgcctttcttcgccatctagcatctgttattgatcgttgccgatcattgcctagtgtaattttgaggtcaaaatttctcagatttgcaggtgttcctattataagaaatttttttgattccatacttatccgctgccaagaagctgaaggtttgactgccttaaccgatgatgatgctgtaattaaagttacaatttctgtcaatgctgctcattactttgaatctgttctaaaggaatggtctgaggatgtctttttccttgagatgggaatggatgaggatgataaaacagaattggaaagtaattcaaatagttatggtgaactgttgccagagagttccagaagggttatttttgatgatgagataaaaaagctggaagagttcagaacagagtgggttgaaaagatttcccttgttattttgagaggttttgattctcattctcgagattatgtgaagaacaagaggcaatggcaaaagggtgaagaaggatggactgtgtcaaagactctaatagaagccctggattatcttcagagtaaaatgtcagtggtagaagtaagtttgaatgatagggattttgttggggtttggagaagtttggcagcaggaattgatcgattgatttttaatggtattctcataagcaatgtaaaatttcacaatagtggtgttgaaagatttggtagcgacttggaagttttatttggggtatttggggcttggtgcttgcgacctgaaggttttttcccaaaatcaagtgaaggtctgaagttgttaaagatggatgaaaatagagtgcaagaatgtatgggaggggggaagagatggttgaaggagaatgggatcaggcgtttgagtgtaactgaagcagaaaagattttgaagaatagggtgttcaggagttga

SEQ ID NO: 61012 - DNA, 342 bp, Glycine max
  Peptide Sequence Number=SeqID_177790
atgcgggaaccatttggtctagcactttttaccttttgttatccagaggcggcgagcccgatgacatgcagagacaaattatggtcatctgcacgcttttgctattttaagtcgagaggtgggcggagacaaattatggtcattccccacaccttttcgcgatccagaggcgatcgtgtccggtggcacgcagagacaaattatggtcattctgcgccttgccacccaggctcgattgtgtccaagggcaagcagagacaaattatggtcattctacgccttgtgtcaaccaagaggaacgaactcgacagtatcaggacgatgttggtcattcggtactga

SEQ ID NO: 61013 - DNA, 1326 bp, Glycine max
  Peptide Sequence Number=SeqID_177791
atggatggattaggttcgccatcccagtggctgagggagctgagatgggactcccagggcttaaatccaataagccttcttattgactgtgccaaatgtgttgcatctggaagcatcaagaatgcagatattggccttgagtacatatatcagatttcatctcctgatggtaatgcagtgcaaaggatggtcacttatttcagtgaagcacttggttacaggataataaaaaatttgcctggtgtatataagtctctcaatccatcaaaaacatcattatcttctgaagatatccttgttcagaaatacttctatgaactgtgtccatttttgaagttctcatacctgatcacaaaccatgccattgctgaggccatggagtgcgaaaaggtggttcacattattgatcttcactgttgtgagccaactcaatggatagatcttctactaactttcaaaaaccgtcagggaggtccaccccatctgaaaattacaggaattcacgagaagaaagaagtattagaccaaatgaactttcatttgacaactgaagctgggaaattggattttcctttgcagttctatccagttgttagcaaactggaagatgttgactttgagaagttgcctgtaaagataggagatgctcttgcaatcacttctgttcttcagctgcattctcttcttgccactgatgatgatatggcagggaggatctcaccggctgcggcagcatctatgaatgtgcagagagcactgcatatgggtcaaaggacttttgcagagtggcttgagagagatatgatcaatgcatataccttgagtcctgattctgctttgtcaccgctttccttgggtgcctcacctaagatggggatctttctcaatgctattagaaaacttcaaccaaaactagtagtgattactgaacaagaatcaaatctgaatggttccaatttgatggagagagttgatagagcattgtacttttacagtgcattgtttgactgcttggactctactgttatgaaaacatcagtagagaggcaaaaacttgagagcaagcttcttggagagcagataaagaacatcattgcttgtgagggtgttgatagaaaggagagacatgagaaactcgagaaatggattcgaagacttgaaatggctggttttgaaaagcttggagttttaggagatgaatgttcatatatgtgctggaatatgaagaatcccttgcattgccatggatttcaagaagttgaaaatgaactgaaagaggtggcattatcaatgaaaactgccaaatatttacagatgagatactag

SEQ ID NO: 61014 - DNA, 495 bp, Glycine max
  misc_feature (17)..(17): n is a, c, g, or t
  Peptide Sequence Number=SeqID_177792
atgtctcgcaggttgcntgaggcctgcacttctgagagacatgagaagtggatggcacaaaaaaggaacatagcatggagacagcaacagaaacatcatttttgtatgtcacatgacagtgtgactaagattcctgctagcatggactggaggaaaacaggtgttgttactccaatcaaggaccaaggaaaatgtttaagttattggaatatgcggaagatgcctttgaatttagtgcaaattaaagaaagtataataacttatattgttctccactacggtgcatattggcaaatggttgtcattttgcctaaggaaaatgttgtcatctggttttgttcgttgcataataggccaaacaactacctgaaaggaattattaataatactttgaaaggatttgacgatactccacaaagtaaatccaaggctactgctaggtggattgttgttaaaaaaaagaaggaagcactgagtgtgagtattacgtcatga

SEQ ID NO: 61015 - DNA, 300 bp, Glycine max
  Peptide Sequence Number=SeqID_177793
atgggtttgaggtggagaataggggatggtgaaggtattaatatgtggcagcagcctagggttagaaaaaatagttggcacagtttttttacatgtcctacaagtgttatcatttggaaacaaagtggtatgtggagtggcattgaggcaactatgacaagtgctgatggtttcaaaagaagacgagctaataaagtagcccgtagcttagctagaaatgcaaacaccttccctcatgattatactttcaatgatgtacctcaatgtatttatccttttattgaaatggaaaagatatga

SEQ ID NO: 61016 - DNA, 528 bp, Glycine max
  Peptide Sequence Number=SeqID_177794
atggtacgaaattctctaggactatgtggtctagagatcaaagcattgaggtgtgaacttgaagatgagtgtcagaagctggaagaggagttgcatcttcaaaaatccaaaactctcagtcatagcctctgccagggaataaataccttgaattcaaatgtcaaatcagacactgcattccaaggcggttattacataataaccgtctttgaatgtcgaccagacgtaacattcaaagatggttattatgtaataaccgtctttgaatgtcgaccagacgtaacattcaaaggcggttattacataataaccgtctttgaatctcgaggagatgtaacattcaaaggcggttattatgtaataaccgtctttgaatgtcgaccagacgtaacattcaaaggcgtttattatgtaataaccgtctttgaaaatttttcactttcaaagacggttgttataataaccgtcataaaaagcaattgcgtttcaacgacgttatatacaacgacggtttacaaccgtcgttaa

SEQ ID NO: 61017 - DNA, 743 bp, Glycine max
  Peptide Sequence Number=SeqID_177795
atggttcttcccattaaaaggagaagattgactgcttgtgccaaggcagagacaagccgcgccattgagaattcatcaggaggcttggaatctgaaaaagtggcattctctcagttatcgagctttccagattcccaccaaaatgtttgtgattcagttagttctcggccgaatggaagttcaattgcctctttagctgacagaagtgtggaagtgaataacgaggaaatcattctcaatgaaatttgtcaatccaggagcaagtcttgtgttgaagtcgagaaatgtgaatcacagtcggcggtcaccttcaacacaccccaggttctgttgaagtctgaagatggtgaaatggtggcgacagtggaggaagatgggcagtgcaaaaaggcaaatgatccgtgtttgtcaactgatactcagggggtagtcgaaaagccacaaagatcctcttgtgatgttggttctatggaacagcagcctactaatataaatcctaggagacagagcacaagaaatcgaccattgactgttaaagcaatggagtccttgggaaatgaattcttgcatgtgcagaggagacggaaaaagaaagacatcctgtcacacattgatgctttcagcccatgccgcaaggctcgtacaagcaaaacaaagctgcatcgtcatagttcagatcatggaactgcagttttagtaaaagaaaagcatttaagtggagatcataaaatggagattgtaga

SEQ ID NO: 61018 - DNA, 1635 bp, Glycine max
  Peptide Sequence Number=SeqID_177796
atggagtcaattcaacaaaattataatgatgattccatggagcattcatctagtagtcctccaggttcgcctgatataagtgacgtagttggagccctgcagttggatcctcgagttggtgaagaataccaggtggaggtccctggcatcataaaagaatcagaacggcttcaacttcttatgaatcctgctgattcagaagttatgcttgatagctcgctttcttttgcaattggtttgcccatctcagtcacatggatacgaaatgaagtggaggatagtggacatgaaaggaatcttgccgacgttgatggaggcaaaaattcaggtcaactgggtaaaagcaaaaattatgtattggttcctggcacattgagtaactcttggagtgaagctgatgcaaaaagttttctccttggtttgtttatttttgggaagaattttattaagataaaaaaattcttagagaacaaagggatgggggaaatactgtcattttactatggaaagtttttcaaatctgaagaatatcatagatggtcagactgcaggaagataaaagggagaaaatgtattataggacagaagcttcttaatggacagaggcaacatgaactattgtctcgcttgattccccatgtctcagaagaatctaaagatactttgttgcaggtttctcagtcatatgtggagggcagaacttctgtagaagaatacattttatctataaagtctattgttggacttggtgttcttgtagaagcagtaggtattggaaaggaaaaggaagaccttacaagccttgctgtggaacttgggaagaacaatcgggtgttttcagtaccaacttgtaaagcttgggcttctcttgggcccagtgatataataaaatatttaacaggaggattgcgacttagcaaagccaaaagtaatgatctcttctgggaagctgtttggccccgcttactggcaagaggttggcactctgagcaaccaaagaatcaaggctatgtccactccaaagatcatctggtttttcttatccctggtgttaagaagttttcgaggagaaaacttgtgaaaggtgatcattactttgattctgttagtgatgtattgagcaaagtagtagctgaacctaatcttcttgtgcttgaagaagagactaaagttggtagctgcaatgatgaagagccagaaaagggattgaataaggatgaccaatttgattatcatcgtcaatgttacctcaagccccaagcttctactacagatcatataaaattcatggttattgataccagtttggtgcatggagggaagtcatctgatttaatggaatttaaatctgcaccttttaagtcagtgagtaaagttgaggtaaatgctgctggtattacaagtaaaggggccaaacatacgaggaaagtaaaccattgcaaggatatgcctgataacattgataaaaagttgacaaaattcacagtaattgataccagtaggctttatgaaggaaaattattgaaggtgagagaactgacatgtcttccagttgaattagaaaatgcttctaagatgactgttctctcaagagaaagtaaggatagctcctctgatgaagattcatcaagcatg

SEQ ID NO: 61019 - DNA, 2532 bp, Glycine max
  Peptide Sequence Number=SeqID_177797
atgttttatgttttccttcatgcgttatccgcctctatccaccttctcttcctcgcggcgtcgtctctgtcatggctttggaacaaagtcactctcacaccaacaaccagggaagaacactctaaggaggagaaacacaatagcaataacaataacaccattttcaaaacaaccgtgttttgttctctcgctctttctgtcttcagtttcgtcctctgtttgttcaattacttctactggtacacgagtggctggtcagagcaaaatgtgtcgacccttttggatttggcgcttaaaacacttgcttggggcgttgtttctgtttccctgctcaaagggttctctttcgtcctcttcttcagtgaagaagaaaaaagattcaggttctcattcttcttccgagcttggtgcaccttctacctcgttttttcttgctattccttcgttgttgacattgttgttctctccaagagaccaattcagtacttggtttccgatgctgtatccacttgtgccgggttgttcttctgtttcgtggcgtattttgtgaaaaacaagggtcatgtcaacggtattgaggaacctcttttgaatggtgatgcaaatgttggtaatgaaaaagaggccacgggtggggacactgttacccctttttcacatgctggagttttcagcattctcactttctcttgggtgggtcctcttgtggctgttggcaacaagaaaaccttggaccttgatgatgttcctcaactggataccagagatagtgtagttggtgcttttccaagtttcagggataaacttgaagctgattctgatgcaaatgcaattaatacttggaaggacattctcttcacagcttttcttgcattgttaaacaccttggcttcttttattggtccttatcttattgatgcttttgttcagtaccttgatggacggcgtcagtatgaaaaccagggctatgtgctggtttttgtgtttttctttgcgaagattgtagagtgcctctcccaaaggcattggttctttaggttgcagcaaattggaattcgaatgcgagcgctgcttgtcaccatgatctataacaaggctctcaccctttcttgtcagtcaaagcagggccacacttccggggaaataatcaatttcatgactgttgatgctgaaagagttggcaacttcagttggtacatgcatgatttgtggatggtggcactgcaagttgtgttggccttgctgattttgtataagaaccttggccttgcttcaattgctgctcttgttgcaacctttgttgttatgttggcaaatgttcccttgggatcattgcaggagaagtttcaaaataagttgatggagtcaaaagatacaagaatgaaggccacatccgagattttgaggaacatgaggatcctcaaactacaaggatgggaaatgaagtttctatcgaaaataaccgagctcaggaaaactgagcaaggctggttaacgaaatatgtttataccacagccatgaccacgtttgtgttctggggtgcccccacatttatatctgtggttaccattggtgcttgtatgctgataggggtcccccttgaatctggaaagatcttgtctgcacttgcaacgtttcggattcttcaagagcccatttataatcttcctgatacaatttcaatgatagcacagactaaagtttctcttgataggatttcatcattccttcgtcttgatgacttgcggtctgatgttgtagagaagcttcctcggggcagttctgatacagcaattgaagtaattgatggaaacttttcttgggatttatcttcccctaacccaacattgcaaaatataaatctcaaagtttttcatgggatgagggttgctgtttgtggaactgttggatcgggaaagtctactttgctttcttgtgtattgggagaagtacctaagatatcaggcattcttaaggtttgcggaacaaaggcctatgttgctcagtctccatgggtacaaagtggtaagatagaggataacatattgtttggtgaacacatggatagggaaaggtatgagaaggtacttgaagcctgctccctaaagaaggatctggagattttttcatttggggatcagacagttataggagagcgtggaataaatttgagtggtggacaaaaacaaagaatacaaattgcacgagctctttaccaagatgctgatatatatctatttgatgatccttttagtgctgtggatgctcacacaggttctcacctctttaaggaatgcctgctgggccttttaagttcaaagacagtggtttatgtcactcatcaagtggagttcttacctgctgctgaccttatattggtgagtacttatttcatgaaagatggtaaaatttctcaatgtgggaagtatgccgatcttcttaatagtgggactgattttatggaacttgttggtgcacacaaagaagctttgtcaacactggattcattggatggactggcaaccatctaa

SEQ ID NO: 61020 - DNA, 144 bp, Glycine max
  Peptide Sequence Number=SeqID_177798
atggcttcatctctgttactggctatggtgcttgtgcttgatctggttgcttttgctctcgctgttgctgcagagcagacaaggaatacttactatggatttagttatctgagtctgaatggggaaacaagagcaactatataa

SEQ ID NO: 61021 - DNA, 1404 bp, Glycine max
  Peptide Sequence Number=SeqID_177799
atggctatgcttctcctcattccactgttcctatcatccattgcactattcaccatatcaagcgcgacaacgttttcaacccatcccggaatctgctacggccagctcggagacaaccttccaccgccgcaaaaatcagtctccctcatcacctccctccacgcgaagcgcgtgaagctctacgacgcaaacccggcgatcctccacgcgctacgtgacacgagcctgcaagtctccatcatggtccccaacgacctcatcgtgaacatctccaggaaccaatccctctccgacaaatgggtctccgacaacgtcgtaccctaccatccccgcacactgatccgctacctcctggtgggcaacgaagtcaccagcagcaccgcccccaacggcacgtggccctacctggtccccgccatgcgccgcatcaagcactctctgaaatccctcgggatccgcaaagtcaaagtcggaacctcctccgcaatagacgttctggaagcctcgttccctccctcgaacggtgcgtttcgaaaagacctaagtgcccccgtcatgaaacccatgctaaagttcctcaacagaacaaaatcctttttcttcttagacgtctaccctttcttctcttggtccgctgaccccttgaatataaacctcgattacgctttgtttcagtccaagaatttaacggtaacggatccgggtacgggtctggtttacaccaacctctttgatcaaatggtggatgcggtttattttgccatgaatagattgggttttccgggcgttcggatcttcatcgcggaaacgggttggcccaatggtggcgacttggaccagattggagccaatattttcaacgctgccacttacaaccgaaacttcataaagaaggttactagaaaaccgtggctggggacaccggctcgaccgggttcggctcttccgtcttttttattcgctttgttcaatgagaatcagaaaccgggtccgggcacggagcggcacttcggcttgctgcaccctaacggctcgagggtttacgacgtcgatttgtccggggagacgcccgaggcggggttccggccgcttccggtgccggagaataacgagaagtttaagggggagatatggtgcgtggcggcacgtccgcataacgcgacggcgctggcggcagcgcttgcgtacgcgtgctcgcagggaaatggcacgtgcgatccgatccaaccgaaggggaagtgttttaaacccgattcggttttctggcacgcgagctatgcttttagcgcttattgggcgcagtttaggaaggtgggtggtacttgttacttcaatgggcttgcaactcaaaccgcaaaggatccaagttatggatcttgcaagttcccaagtgtgacactttga

SEQ ID NO: 61022 - DNA, 192 bp, Glycine max
  Peptide Sequence Number=SeqID_177800
atggggaagaagctcatgcatgcggttcagtacgatagctacggtggaggacctgctggattaaagcatgttgaagttcccttacctactcccagcaaagatgaggttttgattaaggttgaagcagctggtctaaatccatttgattggaaaaaatatatggcaatttctgatagtaatattttcaattga

SEQ ID NO: 61023 - DNA, 1659 bp, Glycine max
  Peptide Sequence Number=SeqID_177801
atggcttgggcgacacccatctcaacagatgtggagccacctgttggaggatcgactcttatagtaatctatgttggtctggccgttggaagttctttctgtgtccttgtcagatcaatgcttcttgtcacagttggttacaagacaactaccgtgctattcaataagatgcacttatgcattttccgtgctccaatgtcatttttcgattccactccaagtgggcgagtcctgaacagagcttcaactgaccaaagtacagtggatactgacattccttatcaaattggctcatttgccttctctatgatccagcttctgggaattatagcagtgatgtctcaggttgcatggcaagttttcattgtctttatacctgtgatagcagtcagaatctggtatcagcaatattatataccttcagctcgagaactatcacgtttagttggagtctgcaaagccccaatcattcaacactttgctgaaacaatttctggtacttcaaccattagaagctttgatcatcagtcaagatttcaggaaacaaatatgaaactgactgatgggtattctcggccaaagttcaatattgttggtgccatggaatggctgtgcttccgcttagatatgttgtcttctatcacatttgccttttccttaatattcttaatttctattccaccgggaatcatagatccaggaattgctggtttagcagttacatatggacttaatttgaacatgatacaagcttggatgatatggaatctctgcaatttggagaacaaaattatatcagtagaaagaatacttcaatatactattattcctaacgggcctccccttgttgtagaagacaatcggccagatccttcttggccctcgtatggtgaggttgacatacaagatttgcaggtttgctatgatccacatcttccactggtgttgcgtggtcttacatgcaaattttatggaggaatgaaaactggcattgttgggagaacaggaagtggtaaatccactctcattcaaacacttttccgaattgttgagcctacttccggacaaattatgattgacaactttaacatctcttcaattgggcttcatgatttgaggtctagactaagcattattcctcaggatccaacaatgtttgaagggacagtgagaaataatctggaccccctggaagagtacactgatgaacaaatttgggaggcactggataagtgtcaacttggagatgaagttagaaagaaagacggaaagcttgactccacagttagtgagaatggtgagaattggagtatgggtcagaggcagttggtgtgccttggtagggtgctgcttaagaaaagcaagattttggtccttgatgaagccaccgcatcagttgacacagctacggataatttgattcagcaaactcttaggcaacatttttctgcctctaccgtcattaccattgcacatcgaataacttcggttattgacagtgatatggttctgcttcttaatcaagacattgctgcaggacttattgaggagtatgacaccccaacaactttgctagagaataagtcttcttttgctcaacttgttgcagagtataccatgaggtccaaatccagttttgagaaatctgttgatcactga

SEQ ID NO: 61024 - DNA, 513 bp, Glycine max
  Peptide Sequence Number=SeqID_177802
atgcagttcatgttgtccccgtatgggagaagggtgtcaaatttggacgatttggcgccgtgccttgataagatgattcttttagctgaggaagaggatagaattattgaggcacgtgaagaagctcctccttcggttccacaatttgaaagtcaacagtttgatatgttgggtaggagtatggagacccaaggtttagggcgacgtagggaaagtgtggatgcagaagcacatgttattcctgcgatgccaaagcgccaacatggaatgtattacacaccttatcagttcacccaagagccatctcaaatgtcgcccctgtatccgtacccatatcaaagtgaaacttcatcagatgcatatttcatgggaacgcaacctccgctacaactaggatatgttatgactgacttatttgggtctccttctcctgcgggaactcctgaggaagggcgaccatgtgggacttcctcccgccataacacacatgatgatgatgatgatgatgattga

SEQ ID NO: 61025 - DNA, 519 bp, Glycine max
  Peptide Sequence Number=SeqID_177803
atgttttgcgtccttaatgcacttgctgtaaatgagaagtgtatttcttcctccatttttggttacagacaaaaggtgaaggacattgttcaaggtgctttattccccgaagctggtctagataatagagttggtcatgcagggggagcaggtggactcgtgattgttcgagatcttgacttgttttcctattgtgagtcctgcttgcttccattcccggtcaagtgtcatgtgggttatgtcccctctggtgaaagagttgttggtttaagcaagctctctcgtgttgctgatgtatttgcgaaacgacttcaagagcctcagcgtctggcagatgaggtatgctctgctttacatcggggaataaagccggcaggtgttgctatcatacttcaatgtacacatatccactttccagacatagaaccagtctttcttgactcaaaccatcaagggtgggtgaagatacttgtttctcagttctggggttttgagacaaaatgcagatgtatgggatga

SEQ ID NO: 61026 - DNA, 177 bp, Glycine max
  Peptide Sequence Number=SeqID_177804
atgtcagtggataataaaggccaacagcagcagggaggaagaagacgtgcaaaaggtgagcacaagagagacacagaaaatgcatctagcaactgcatccatgatggacatatgaatagtttccatgaaaagcatgctcagaccagtacttggcacatcgtcatgattcatgaatga

SEQ ID NO: 61027 - DNA, 1917 bp, Glycine max
  Peptide Sequence Number=SeqID_177805
atgggtggctgtcaacttaaagacttgagtccatctattcaatatgctaattttacttcactcaaatctctctctctctctgcaaatgaatttccctcagatttgcctaaatggttattcaatcttagcagtggtatctctagtatcgagctttactcaaattctttaaaagggaaactacccaaggcattgttaaatcttaaacacttggaagtcttgaacttggaagacaataagttgagtggaccaattccatattggttaggcaaactcgaacatctaagatatcttgctcttaatttaaacaagttttctggatctattcccacaagttttggaaatctatcatccttaaccagcttgttggttggccacaatcaattatcaggagttgtttctgagagaaattttgccaaattgtcaaaattaagggaattggatatatactcatcaccaccattaatctttgattttgactcctattgggttccaccttttcaactgcaacgattagctcttgcatttgcaggtcctaaccttcctgtgtggttatatacacaaagatctattgaatggttggacatttatgaatcatcatttgaggcacagggaaaattttggagttttgtgtcaagagtggcacaactctatttaaaagataatttgatagatgtgaacatgtcaaaggtgttgttgaactctacattcatatatatgtcatcaaatgatctgaaaggtggcctgcctcaactatcatccaacgtggcctttcttgatatatcaaacaactcattatcaggaaccatttctcctcttttgtgtgatcacaagatgctgaatgggaaaaacaatttggaatacttggacatatccctgaatcatctatctggagggcttacaaattgctggaagaattggaaatcattggttcatgttaacttcggaagcaataatctaacaggcaagatacctacatcaatgagcttgttatctaatcttacctccttacatctacatgagaataagctctatggagacattcctctcgcgctgcaaaattgccactctctattgatctttaatgttcgtgagaacaacttttcaggaaatataccaaactggataccacatggtgcaaaggctctccaattaagatccaatcattttagtggtgtgatcccaacacagatatgcctaatgtcatccctcattattttggatgttgcagataacacaatctcaggacatatacccagctgcctacataatatcacagccttagttttcaacaatgcttcctacaacaagcttacttttttctttcctatagatggtttcagttactatatcttcgaagacagtcttgagctggtcacaaaaggtcaaacaatagactatggaatgaacctgcactttgtgagcttaattgatatgtcaagtaacaatttgtctggaataatacctccccaaatgttcagcctcattggattgtactccttgaacttttcccacaacaaattaacaggacaaataccaaatgagattggcaacatgaaaaacttggagtcccttgatttttcaacaaaccaacttcggggtgaaattcctcaaggcctttccaatttgtcctttcttgcttccttaaacctgtcatttaacaatttcacaggcaaaataccatcaggcacacagcttcaagggttcggtgcactcagctatataggcaatcgcaatctttgcggacctccacttacaaaattttgcttgcaggttagtgaacctaaagacacaaaggcaatagatgaagatggggatgaatctgcattttggtcatggttttacattggaataggatctggatttggcaccggctttttgggagtttcctataagtttctttatgacttgagaggctga

SEQ ID NO: 61028 - DNA, 594 bp, Glycine max
  Peptide Sequence Number=SeqID_177806
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttggccccctcctcccccccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 61029 - DNA, 237 bp, Glycine max
  Peptide Sequence Number=SeqID_177807
atggatgtgcaggaaaaacaaaaaaaatccaattattatttcccaagcggagctctaaatcaagctcctcatcatggtggtggcggccatgaccatgatgggttgaagagtcgtttgtgggtggttcttgttccactttcccagaataagaagaagagaaaccattattattcctccctacagcaggaggagcaggctgagaacatctatcatcaatttggtaacattggaagatga

SEQ ID NO: 61030 - DNA, 3000 bp, Glycine max
  Peptide Sequence Number=SeqID_177808
atggatattcaggaagagagccccgtgtttggatccttgaaagccatgactacaaggaatatgtcatcatcatcttctgctttcttttcagcaaaccagtcacccttcttctctccaagatcaccatcatcatgtcaattattagagtcagccaggcttgatgctccaagtaacagaattcatttaggtttggctccctcaagcaccacttcagagattccagaaccaaattcactagtaaatgttagatgtactttctcagatgtatctgcatctccagctggatgtaattcagctgatttgcagaaacttaatcgtatatcttcctcagttggcatctcaagtagcagcgtatctagttactccaatcgccgtgaggatggttattctggacagaaagaaaagcgaattaaagaagacagaaaccatagaacatcctccactccaggttccacatcattttcttcttataggctgaggagttgtgatgttttcataggattgcacggcagcaaacctcctttactacgatttgctaaatggctgtgtgctgagttagagactcaaggcatcagttgctttgtttcggacagggctcgaagtaggagttcttgcaaacttggcattgcagagagagctatggatgctgcttcttttgggataatagttataacaaggaagtctttcaagaaccaatacaccattgaggagctgcagtttttctgtagcaagaagaatttgatcccaatatactttgatttgagcccagctgattgccttgtaagggatataattgaaaagaggggtgagctgtgggaaaaacatggaggggaactttggctttcgtatgatgggttggaacaggagtggaaagatgcagtgcatggcctctctcgggttgatgagtgcaaattggaagctcaggatggcaactggagagattgcatactgagggctgtcacattattagcaatgagattaggaaggagaagtgtggcagaacgtttgacaaaatggagagaaaaggtagaaaaagaggagtttccttttgcaagaaatgagaattttattggcaggaagaaagagctttcacagttggaatttatactttttggtgatgtcactggagatgcagaacaagactatattgaacttaaagccagacccaggagaaagagtgtgagaattggttggggcaagagtaatgtgatagatgagagatggagggaaagacatatgggaaatggcagctggaaggaaaaagaaccagttgtatggaaggagtcagaaaaggagattgaaatgcaaggtattgagttttctaagaggcacaaccatctaaggctcaagcggggaaagtatagtaagaggaaaagaggaatgaagattttgtatgggaaaggaattgcttgtgtttctggggattcaggaattggaaaaacagaacttattcttgaatttgcttacagatttcatcagagatacaaaatggttttatggataggaggagggagcagatacataaggcaaaactatctcaatatcagatctcttttagaagttgatgtgggagttgagaatggtttggagaaaacaaagataagaggctttgaagagcaggaagtagcagcaatttctagagttcgcaaggaactgatgagaaacattccgtatcttgtggtcattgataacttggaaagtgaaaaagattggtgggatcacaaacttgttatggatcttctccctcgtttttggggagagacccatgtaattatatcaacacgccttcctcgcatcatgaacttggaacctttgaaactttcatacttatctggagttgaagcaatgtctttaatgctaggtagtggcaaggactatccagttgccgaggttgatgccctgagagttatcgaggagaaagttggaaggttaactcttggccttgccattatcagtgcaattttgtctgaactacccataacaccaagcaggctcctagataccataaatagaatgcctttgaaggagatgtcatggagtggtaaagaagctcactcgttcaggaagaacactttccttctgcaactttttgatgtttgtttctccatatttgatcatgcagatggtccaagaagcttggccaccagaatggtgctggtaagtggatggtttgcacctggtgctattcctgtttccctattgttacttgctgctcaaaagataccagagagatgtcagcgaaaatgtttttggaaaaaagtacagcaattattaacatgtggattcacatcctcgtatgccaaaaaatcagaattagaagcatcttctttgctgctgagatttaatattgcaagaagtagtactaagcaaggctatatccatatcaatgagctcatcaaactgtatgctcagagaagagacgatactggggctgcacaggccatgattcaagctatcatcaatcatgggtcaatatcacaaaatctggagcatttatgggctgcttgttttctgttatttggatttggtcatgatcctgtggttgttgaggtcaaggtgtctgagcttttatatcttgtcaaaagagtagttctgcctcttgcaattcatacattcattacatattctcgatgcactgccgctcttgagcttctgcgtctgtgcaccaatgcattggaagctgcagaccaagcatttgttaccccagttgacaagtggttggacaaatcactttgctggagatccatccagactaatgctcagttgaatccttgcctttggcaagagttagcattgtgtagagccactgttctcgagactagggccaagctaatgctaagaggtgctcaatttgacataggggatgatctgatcaggaaggctgtttttattaggacttcaatttgtggtgaagatcacccagataccatatctgctcgtgaaacactgagcaaacttaccaggcttcatgcaaatgtccaaattcacagttcaacttag

SEQ ID NO: 61031 - DNA, 714 bp, Glycine max
  Peptide Sequence Number=SeqID_177809
atgggtcaagcttttcgaaagctctttgacaccttcttcggcaacaccgagatgagggttgtgatgcttggtcttgatgctgctggcaaaacaactatactttacaagtttcacattggagaagttttatccaccgttcctacaattggtttcaatgtggagaaagttcagtataagaatgttattttcacagtctgggatgttggaggacaagagaaactaaggccactttggaggcactactttgacaacacagatggcctgatttatgttgttgatagcctggaccgtgagagaattggtaaagcaaagcaggaatttcagacaatcataaatgacccatttatgctcaatagtgtcatcttggtgtttgccaacaaacaggacctgtttgcacttaacaacttaagttttaaagatcatagacctcttgggatgatggtatcaaagcctcttaagaacaactggtcagaaatatggtccatgctgatcccgttcttcataattaaatttcagcaaatgagaggggcaatgacgccaatggaagtgtgtgaaggactaggtctctttgatctaaagaatagaaaatggcacatacaaggcacttgtgcacttaagggagatggtctttatgagggcctggactggttggcttcaacactgaaggaaagaaaagctgctggatactcttcaataggaacctcatccttctaa

SEQ ID NO: 61032 - DNA, 2733 bp, Glycine max
  Peptide Sequence Number=SeqID_177810
atggccgccgagaagctcagagatttaagccaacccattgatgtgcctttactcgatgccactgtcgctgccttctatggcaccggatccaaggaacaggttctagaaggtgtaattaaatatagatggaatgcattacctgttgaccagcgagatggaatgaaaaatttcatctctgatgttattgtacagcatgaatggccagtgagatggagaagcttcattcctgaccttgtttcagcagctaaaactagtgaaacaatttgcgagaattgtatggcaatattgaagctcttgagtgaagaggtttttgatttttcaagaggagagatgactcagcagaagataaaagagcttaaacactcattgaatagatctttcattttttctggttcaagggaggacataccattgagtgaatttcagctcatacatgagttgtgcttatatgtgctatcagcgtcccaacggactgagctcatacgggcaacactgtctacattgtatgcattcctatcatggattcctttgggatatatatttgaatcaccattgctcaagacactgctaaaatttttcccaattcctgcatatcggaacctgactttgcaatgtttaactgaggtagcagcccttcaatttgggaattactatgatgcccatattaagatgtataatatattcatgggtcagttgcagaccatacttccgcccactactaatatacccgaggcatattcacatggttcaagtgaggaacaagttcacgttcgaattctggaatccactcaagagaatatatctgctttgctattgggtcttgaatatcttattaatatctcatatgtggatgatactgaggttttcaaggtctgtttggactactggaatgtcttggtttcagaattgtttgagccaaaccgtagcttggaaaaccctgcagcagcaaacatgataggacttcaggtgcctggtatgattgatggcattggttcacagcttcttcagcaccggcagctttatgccggtcccatgtcaaagttgagaatgcttatgatctgtcgtatggccaaaccagaagaggttctcatagttgaagatgaaaatggtaatatagtccgtgaaacaatgaaggacaatgatgttcttgttcaatacaagattatgagggagactcttatttacttgtcacatcttgaccatgatgatactgaaaagcagatgctgagaaagttaagtaaacaacttagtggtgaggactggacatggaacaatttgaacacactgtgctgggcaataggatctatatctggttccatggtggaagaacaggaaaatagatttttggttatggtcattcgtgatttattaaatctatgtgaaatcacaaagggaaaagataacaaagctgttattgcaagtaatatcatgtatgttgtggggcagtatccccggtttttaagagctcattggaagtttctaaaaactgttgtgaacaagttgtttgagtttatgcatgagtcacatcctggagttcaggatatggcctgcaacacatttctgaaaatagtccagaagtgcaagcgtaaatttgtaatcacccaggttggtaacatgattcaagcagagtctgatgcccagaagagagatgaatatcttcaaaagttgatggtgctcccaaaccagagatggatggaaattatagggaaggcacatcaaaatgctgattttctgaaggatcaagatgtaatccgaaatgtgcttaatatattgcagacgaatacgagtgttgcatcttctttaggaacatatttcctgccacagatcacattgatctttttggacatgttgaatgtgtacagaatgtttagtgagcttatatcaaaaagtattgcagaagggggaccttttgcatctagaacatcctatgtgaaacttctacgttcggttaagagagaaacacttaaactagttgagacattcttggacaaggctgaagatcaaccacaaattggaaaacaatttgtgccaccaatgatggatcctgttctaggagattatgccagaaatgtgcctgatgcgagggaatcagaggttttgtcacttttttccacaattgtaaacaaatataaagctgccatggttgaagatgtcccacaaatatttgaagctgtattccagtgtacactggagcttgtgcctgatgttgtttgtaatctgtttcagcaactgaaacttgttatggattcaataatatgggcgtttcggcatacagaaaggaatattgctgaaactgggctgaacctcttgttggagatgctgaagaagtttcaggaatcagagttctgtaatcagttttatcgaacatactttttgacaattgagcaagagatatttgctgtcttgacagacacttttcataagcctgggttcaaatttcatgtcttggtgcttcaacatttgttctgtctggcagaaactggtgccctaactgagcctctttgggatgctgctacaaatccttattcatacccaagtaatgcagcttttgtacgcgagtttacgataaaccttttaagcacttcatttccaaacatgactgcttcagaggataacaaagatctttatgctgaagaggctgcagctcagagagagagggaacgacaaagaatgctttctattccaggacttgttgccccgagcgagttgcaagatgaaatggttgactcatag

SEQ ID NO: 61033 - DNA, 1572 bp, Glycine max
  Peptide Sequence Number=SeqID_177811
atggcttttcagtcactcttttccaagtataaaatcttaccttctttcttttgcactcttgtccaacacaaacccagctaccatcacttccactctttcccaacctcacaagtctcagggacattattacctgaccttgtgaatgagatatctcgtctactcagtgatcaccgataccctcaccatgatctagaactttctctcaatccattttcagcacaattatccacaaatttggttgaacaggtcttgaagaggtgcaagaatctcggcttctcagcccacagattctttctttgggctaaatcaattccaggttttcagcacagtgttatgagcttccacattttggtggaaatcttgggaagttgtaaacaatttgccatactctgggattttctcacagaaatgagagagtctcatcattatgaaatcaacagtgaaattttctggctcattttcagggcatatagccaagctaatttaccagatggtgcaattcggtctttcaatagaatggatgagtttggagttaagccaaccattcatgatttggacaagcttttgttcattttatgcaaaaggaagcatgtcaagcaggctcaacaactttttcatcaagctaagaatcgtttctcgttaactgctaaaacttacagcattttgataagtggatggggtgagattggtgattcagagaaagcctgtgacctgtttcaagcaatgcttgaacaaggatgtccagtggatttgcttgcatataataatttgttacaggctctttgcaaaggaggtcgtgtggatgaagctaaaaatatttttcatgatatgttgtcaaaaagagtcgagccagacgcttttacttattcaatatttattcactcatattgtgatgcagatgatgtgcaatcagctttcagggttcttgataaaatgagaaggtacaaccttttgcctaatgtgtttacatacaattgtattataaaacaactttgtaagaatgaacatgtggaagaagcttatcagttgttggatgaaatgatttctagaggagtaaaaccagacacttggagttataatgcaatacaagcttaccattgtgatcattgtgaggtcaatagagccctgaggttaatgtttagaatggaaaaagatatctgtcttcctgatcgccatacatataacatggtgctcaaattgctgattaggataggaaggtttgataaggtaactgaagtttgggagaacatggtggacaaaaagttttatccttctgtctcaacatattctgtcatgatccatggtttttgtaagaagaagggaaagctagaggaggcatgtaagtattttgaaatgatgattgatgaaggaataccaccatatgttactactgttgagatgctgaggaatcggcttttgggtttagggtttatagatcacattgaaatactggctgctaagatgaggcaaagcacttcctatgcaattcaagaattggcaaatattatgattggcaatagaacagctcataatactttgggacgtgatgagatggacatagaaagtgactga

SEQ ID NO: 61034 - DNA, 285 bp, Glycine max
  Peptide Sequence Number=SeqID_177812
atgattagatgtatattgtatagtattagtagtagtagtagtactgctggaaaacagcaggaatgcagatttggggagagatgtgcatatttagggtctaacagtatcttgaataggattgcctccaaaggaggatacctatggagaacaaaaaataaggggaattggggcttgttgagggttaaaaacatatcaatggagatacttgatttttatgaaagcaatagaatgttcactgatgagagaatcaatgctgctcttcagaagctgagcctgagaccctag

SEQ ID NO: 61035 - DNA, 468 bp, Glycine max
  Peptide Sequence Number=SeqID_177813
atgtccagaaattggcagccatatttctccagagatcagataaaaactctgccaaataggaagcagaaaacagtggacaaacactgcagatgcaaaaacgacgctgttatcgctggacttgcgagaaaccaagacaccgggtctcaaggttttcgaggtgtgtcgacggtgccgcggaaaattacgattctgccaccgtcggaggatgtctcggcgagggaggatcggaggtcggagacggagaggaaaagaggcgcgatggagcttatggagggcggcagaagtggcggtgaatttgaagtgtgcgcacaaaggggaaggagcaggacattcacgcatcgatcgggtgtgggcgtagggggacacgtagaactgcacccaccaattaagggagcagtcgtcgctatccatcacgcggtggaggtgtttgtgcgtgcggagggtctagatcatgccttgagtcgttga

SEQ ID NO: 61036 - DNA, 489 bp, Glycine max
  Peptide Sequence Number=SeqID_177814
atgacgactctttgcaatccagaagaaaggtatcaaaggacaataatggtcaattttgtgaaattaagacatttccaaaaggattgcctaaagtgtaagttttggttcgaaaagaatggtgagcttaatgctcatagattccttacaatccaaaccataagcctaaatgagaagttcattttcatagggaatgaagtgaaagctccagtgaaaatagttgaaacttattgtttaaaacacaacactggacatcgtttagatttactggaaactccttatggaaaacaagcaaaacatacaaagaaaggagctacaagaagcactcagcttcttgaaattgtgcatactgatatttatggaccttttgatgttagttcgttcggaaaggaaaaatactttatcaccattattgataattattcacattatggttatgtctacttactgcctgagatttctcaggaaatgaatgccttagaaatttactaa

SEQ ID NO: 61037 - DNA, 1527 bp, Glycine max
  Peptide Sequence Number=SeqID_177815
atggagattttgtcatcttctagaatttgtaaaattattctgacaatcctgtctgttgttttgctttacaacgtatcaactaaagctcaagatttacaaagacgttctcactttccaaaaccaggatcatcatttccatctgacttcttgtttggagcaggaacatctgctttacaggttgaaggagcagctagtgaaggaggaagaggaccaagtgtctgggatgatagagttaaccgtaataaaggagcgtttatagacggtgataagtttcctacaatgattcagcattataggcgatacaaggaagacgttcaacatttgaagaatcttggaataaattcttacagaatgtccatttcatggagtagacttttacctgatggaaccataaaaggaggtataaatcaagagggtgttgacttttacaaccttttgatcgatgaattacttgcaaatggcattacacccttcgtgacgatcttgcactttgactatcctcttgctattcacaaaaacactggcggcttcttgaatagctccattgtcaattattacaaggattattgcgaactcctttttaaaacatatggagatcgagtcaagcattggactacagttaatgagcctcaagttgtaggtttatttacttacatgcacgcctatgataatgatgatcctgaaccatgccaaactaccaagctatgcaaacaagcatatattgtagttcataattacatcctttgccatgctgcagcagtgaaactatacagagaaaaattctatgaaacccaaggaggagaaattggacttgttcttggatctcaaagttttgaaccttacagttcaaaatcagaagatgtggctgctgctaaaagacttatggatttctttatgggatggattttagatccagtggtctatggcgattatccaaaaatcatgagagacttagtagggaataggctacccaatttcacagaagaggagaaaaattttgttgcaggaagcacagacttcattgggatcaattattatacttctcattttgctaaacatgaaacaaacaaaacaaatatgattttatcagacaattatgatgccttaggaatatcagtagattttaatgcagaaggaaaaacccttggttacttggataaatatggaggcaattttgtctatcctaaaggattatatgacgtcttacaacacattaagaaaaagtaccaaaatccaaacatctacatcactgagaatggtattgcttcattcaacatcacgaatccattgaaagacacacaccgaatcaaatatttggccacacatttaaactccaccaaagcagcaattgacaatggcgtaagagttcgtggttactttgtgtgggctgcatttgacacctttgaatttcgagcggggttttctcaaaattggggacttattcatgttgattttaaacatgatctcatgcgtcaaccaacaactgctgctaaatggtacaagagattcttgaatcatgtaatttga

SEQ ID NO: 61038 - DNA, 1659 bp, Glycine max
  Peptide Sequence Number=SeqID_177816
atgacaacttcagagcagcaagtccctcccaaaactcctgcagctgatattgttggcaatgcttttgttgatcaatactaccatatgttgcatgaaagccctgagctggtgcataggttttaccaagatgtcagcaaacttggccgtcctgagcagaatggcataatgggtattacaaccacaatgcttgatattaacaagaaaatactatcattgggttatggggaactcagtgcagagatcgtatcagtggatgcacaagaatcttatgacgggggagtcattgtcttggtcactgggtttatgataggaaaggatgacattaagcagaaatttactcaatgttttttccttgctcctcaagagaaaggctactttgttttgaatgatgtttttagatatgttgatgaaaatggaatccaagggtctgctcatgatattggatctcctgcccctccggacactgtttccaatccttctgtgctggagacacaagtttccgagcaaatatctgtgacagctgaggatggtgatgaagaggtagtctacaatccagaaaatggtcaagctgcaattgaagaagaggaagcacctgtacctgaggttcttgatgaaattcctgatgattctcagatggtagctggattggcatctcaaattgaagaagttccaaagaagtcttatgcttatattgtcatgaaagagggtgccatgccgtcttccactgtgacacctgttccagtgaaatctgcccacaagagtcaagaacagcagggtattgctgcacctccaccatctagcatatcagagacaaatggttctgttataaatactaatgaagttggaaacattcaagaagctgaagccgagggctattctatttatgtgaaaggtctgccaccaactgctacgcctgcagtcttggagaatgagtttaagaagtttggacctattaagagtggtggcatccaagttaggagccaaaagggattttcctatggctttgtggagtttgaagtggcaagtgctgcgcaaagtgcacttgaggcttctccaatttcgatcaatggccgtctcgtcgttgtagaagagaagagatcaactaatcgaggcaatgctaagatcccagctagggagaaagcatacaaggctcctagcttcaggggtgaaggtgcaagagggcgtggaaattatggaaatggccgaacctatggccgtggtggtgactttaatggcaggggagaatatggttataggaatggcaatcggggagggttttcaagccgtggaggtgatgggtatcagagaaatgatcatatgggtaccggcggtggccgcatgaatcgagcaggtgggtcggctgttaatccagcagtcaagactgccggtaatggtgatgaggaagaggagggggatgaggaggaaaatgaagttcatcctcgtgtgactgaggaagttctagcgattttagaccaagctgggagctttggaattgtgtatggagactcatctgatggagcagtttatgtttacaagaatgatggtaatgatgcagacttggcttctgcagttcatcaatctgcaccattgactgttctcaggagattgacactggaaaagaatggcaatctgcggttgtatcaatggtcagtgctatga

SEQ ID NO: 61039 - DNA, 798 bp, Glycine max
  Peptide Sequence Number=SeqID_177817
atgagattcttttctcttccaaccactcatttcccgggaaaaataactgcctcttccatcatcgctattattcacttcactatgagcatgagcgtgctctcatgccaacgttctactatgttagcagctcagaacaattctccatttcttcgcagattccgatccttcaaacctcaccgttcccgatttcgctgtttgcttgaccaaatctctgctcccactcttctcacctccgataatgtcatcgccgccgccgccaaagccgcctccgtacatagtgccgtctcctccgccatcacacaggtcgccgtcaccgctgtcgccattgcttccggcgcctgtctttccaccaagtttgatttcctttggcccaaactgcaggaacaatcaggtactgtgatgcaggatggagtagatgttactggctatcctatatttaacgatgcaaaggtacagaaggctatagcttttgcaagaaaagcccaccgtggccaaatgcggaagacaggagacccttatttaacacattgtatccacacaggaagaattttggctgcattggttccatcaagtggtaaacgagctgttgacactgttgtggctggtatattacatgacgtggttgacgacacttgccaaagtctgcgagacattgaggcagagtttggggatgatgtggtcaagttggtagccagtgtttcaaggttaagctatattaatcagagagcaagaatgaatgagagtccgaatgattcacgtcgccttttacggataatcttctcgggtttcctgttctga

SEQ ID NO: 61040 - DNA, 996 bp, Glycine max
  Peptide Sequence Number=SeqID_177818
atggagagttctggcaccttcttttccttgtctagcctcttgtgtgatgaagtaggagaagctggcttctttgaagacccagatgagaaccctggcattttttactctcttgataacccatgtttcgttttggaggatgaagagctatatattgaatatttgttcaaacaagaaacgggatttggatcccagaatcatcacttgtttgcctctgatgatcattctaacagcagacactggttacgaagtgcccgtgttgatgccattgactggattttcgatacacaagcgaaatttgggttcaaagttgagacagcctatttatcagtgacttattttgatcggtttctatcagagcgttccatcgatgaatccaaaccttgggctattcggttattatccgtggcatgtttatctctagcagcaaagatggaagagcaaaatgtgcctcctctatctgagtatccaatagaagattatcgctttgagaataaagtaattaagaacatggaactgatgattttgagtaccttggattggaaaatgggatcagcaactccttttgcctatttgcattactttgtcggcaagttctgccctggatccagaccacaatcaataatcactaaagccattgaacatattgtggccatgatcaaagatgttaatttgatggatcaaagaccatctataattgcctcggcagccatattggcagctcttgatgctacattaacaagaaaagcaatggatcttcgtataaatgtaatctcatcgtggggaaatctagaaagtggacatgtgtttttctgttacaatctaatacaggaaaagaggaaaagcaaagttaagacaccttgctcgaatttaatgtctaccaagtcgagctccacgtgtgttcttgagaaccaatctgacactttttcgggagctaagagaaaacttagttttgaggacagtgaaaattgtgcgggacaaaagctacatcggccttag

SEQ ID NO: 61041 - DNA, 1533 bp, Glycine max
  Peptide Sequence Number=SeqID_177819
atgactgagttatctttctcaaacaagaagaatgagttatctagtaacctcttctctatcttcttccacttctgtttctccattttttctcaccctttatacttctcctacttcatcttcttctccccttacctcctcaggatcctgtctttcctctcccctttgttcatcaccacaactcttctccttgtggcccttctcactttcactcccaacaatcttgatcaggaaaagggtggttctgagctttctgagtccaaatggggcattctgctttctgttttgcaatcttttctagcatggcttcattccaaagctgatgagatagatgaggaaatggggctcctaggtgaggttgaggcatatcttgtcatgttccaggcatcaatctttgaagtggttgatcctaagtcactgcaagattgctcagaaggctttgaagcagttgatgttgagtgctcagttgaaggaagagaagattctcgtccaatggaagagccaaagcctagtgtcaacttggacgaaaacctttcctcacaacaacgtggtgaaccaatgttggaatattcgtcagaagtgtccgcattcagtgttggacagtatctcgaacaagattgtctagaaaagaggatagtcgtggatgaaatccttcactcacaaccaaagttcgaatccccgtccgaagaggtgcctatatttagtgcccggcagagcttcgaaaaagattgcccccacaggaagatactagtggagaaccaaataaactgggatgaaaacccagttgagaaggttgataaagtggaagcccctatctccattgtagaagtcaagagcctagagagcttgttccaagagaatcaagagttagaagatttgtcctgtcaaaaggaacacaaggaagtgaagccactgattgctgagttcaataaagttgaagaaagcaaagagaaatggcccttgagaagtggatccaaagtggtgatgggtaatagagacaataaagtgagtactaacagtgatggggaatttgcttttgctgcatcagggagggtcaagtccttatcacaaaggctagaagcaaatattgggagtccagaaagcaactgggtgtacagtggaaaaggcatggggaataataatcaagcacttggtagttttggttcaatgagagtggagaaagagtggaggaggacattggcttgcaagctttttgaggagaggcacaatgcagatgggagtgaaggaatggacatgctttgggagacatatgagacagagtccaacaaaattctgaagaagagcaacaccaagagagggaagaagaaaggtgaggttgagaatagtgaggatgatgaggaagaggaagaagaggacatggagggtaagttgtgctgcttgcaggccttgaaattctccacagggaagatgaatttaggaatggggaggcctaaccttctcaaattctccaaggcactcaaaggaattggatggttgcacaatgttggaaagaatggcagaaagagtaaccattga

SEQ ID NO: 61042 - DNA, 252 bp, Glycine max
  Peptide Sequence Number=SeqID_177820
atgacagccataatcgattgctcctcttctccttttcgacacttccaactcaacacaaatcccaagtcgaggttatcgcagtttgtcaacaagcaaagtgttgctcacgtgaccattttttatcaagacaaatcatatggacatatacttggagtaccaaagttaagagcaaccagaacagtttttgtgaagataaaggatattagtgggaagcgggagaggaaccaaaacagtttccatttgcatggctag

SEQ ID NO: 61043 - DNA, 261 bp, Glycine max
  Peptide Sequence Number=SeqID_177821
atggatgatgcacgccgatcgagaattgaagcacatgtgatgcatggtcgtggacttgtggagtgtgtatttgcatttgcttgtgagaggcgcttttgtgatgaagcaaccgtgattgtttttggagaggagattgttgtgaaaggatatgtgatatgtcaaagcgttgtcttgtgtcgtgaccacgaaaaccatcatgatctatgggacaatttcaatggggaatgttttagaggagtcattcctcaaagcaacaaatga

SEQ ID NO: 61044 - DNA, 270 bp, Glycine max
  Peptide Sequence Number=SeqID_177822
atggcttgttgttcatctttctatgccttttttttttgtctgttcttgcctatgtctttctggagggtccttcagtttttcctctttgttgactggtctagaggccaaagacttggtctttatctcttgttggcttttctgggtgtcttgaattttcttgtgtatgtgtgtggtcaaatgggtttgtcttctctgtcaccacccccttccaagaaaggtggtactcttcctgctaaattgatggaaaaagttggtatcataggaagttaa

SEQ ID NO: 61045 - DNA, 2684 bp, Glycine max
  Peptide Sequence Number=SeqID_177823
atgatgatgagttcatgaaaagagtgaagaagacaaaagccgagaagctgtctttagttgaccactcaaagatcgactatgaaccattcaagataaacttttatagtgaagtgaaggagatctcaaagatgactcctgaagaagctgcagtatacaggaagcagttggagttgaagatacatggaaaggatgtgccaaagccaataaaatcatggcaccagactggacttcctagcaaaattttggagaccataaagaagatgaactttgaaatgccgatgcctattcaagctcaggcgctccctgtaatcatgagtggtcgagattgcatagggattgctaaaactgggtcaggcaaaacacttgcttttgttctgccaatgctgaggcatatcaaggatcagccaccagttgttgccggagatggacctattgggctcattatggcccctacaagggaacttgtgcaacagattcacagtgatataaagaaatttgccaaggtactgggtctcaggtgtgtgcctgtgtatggaggatctggtgttgctcaacaaattagtgagttgaaacgtggtgctgagatagtggtttgtactccaggtaggatgattgacatactatgcaccagtagtggaaaaataactaacttgcgtagagtcacttatctggtaatggatgaggctgatcgaatgtttgacatgggttttgaacctcaaatcacacgaattgttcagaatattcgtccagatcgtcaaacagttctgttctctgcgactttcccccgtcaggttgaaatcctggctcgtaaggtcttgaataaacctgttgaaatacaagttggtgggaggagcgttgtgaacaaagacataacacagctagttgaggtgaggccagataatgaaaggttccttagactcttagaaatattgggggaatggtatgagaaaggaaagattttgatatttgttcactcacaggagaaatgtgatagtttgttcaaagatctgctcaggcatggttatccatgcctttctcttcacggggctaaggaccagacagaccgtgaatccacaatatctgattttaaaagcaatgtctgcaatttgttggttgcaaccagtattgctgccaggggattagatgttaaggagctcgaattggtgatcaattttgatgttcctaaccactatgaagattatgtacatcgtgttgggcgcaccggacgagctggccgaaagggttgtgccattacatttatttctgaggaagaggcaagatatgcacctgatctgctgaaagccttggaactatctgagcagattgttccgaatgatctgaaagctcttgctggtagctttatggcaaaagtgaatcaaggactggagcaagctcatgggactggttatggaggcagtggctttaaatttaatgaagaggaagatgaggtgaggaaagcagcaaagaaagcacaagccaaggagtatgggtttgaagaagaaaagtcagattctgaagatgaagatgaaggtattaggaaggcaggaggtgatatctcacagcattctgcttttgcccagattattgctgccactaaagggaatgctcctgcattgcctactccaatactcctaccatccttgcaagtcttgcctgggacagggctacctcttcctgcaaacgatggggcagctcgagcagcagcaatagctgctctaaacttgcaggacaagttagataaaatacgatcagaagcattaccagagcattatgaggctgagttggaaataaatgatttcccccagaatgctcgctggaaggttacacacaaggaaactttgggccctatttctgaatggagtggagctgccattaccactagggggcagtttttcccacctggcaaaatcccaggacctggggaacgcaaactctacttgttcattgaaggtcctactgagcactccgttaagtcagctaaagcagacttgaagcgtgttttggaagacatcacaaatcaggctttgcaacttcctggtggaactcaaccgggcaaatactctgttgtgcataatgggactctgttaaacactcttgtctcgcgccccaatctgggacaagttgcacatattgtctgcctttcacttttgccatacaggaaaggcacattggaggctttggagagaagaatagcttttgctaaagttgaagttctccaaaaagaaaagaaaaacaaaaaggctgtaaatgaagatgggaaaccacctattcctgcagattctacttctaatgatcgttccccacatttgttgcattcatcatcaatcacacccaagaaagacattgaagatggtccagcatatgcccaattttctgtgactgtaaatgaaaatctgctcacaactaatgagaagttttctgctgaaagaggacgttcaattgatggcatattgcacgagcttcttcagaagggagatgcagcacaaaagtacatgcaaggatctagaaacatgaaaattgacaattggatccttcttgataattatgtgcacggacgggtgctttcttctggttctcaaactagggctttgcaacttcattcaaaacgctctaagaaacacatgtctatgaaacggcataagaagtatggatcattagaacttcctcaagagttccagaagtaa

SEQ ID NO: 61046 - DNA, 1488 bp, Glycine max
  Peptide Sequence Number=SeqID_177824
atggtgctgggcgatgcagggtgtactaataaagacactccgatgcttaagaagatctactttcaaaatattctgtctcaagtatcaactgagaatgaaataaatatgaaacgaaaggatataagcattgataaagtatatgatgcacgtgcattaagagtagttgtgggagacaagaatggaactttacatggtcctgcagttcagtgttgttatagtcttcttgacattgtacacaggctttggactccaatagatggtgaatttgatgactacatcattaatccgaagcctagtggctatcagtccttgcacactgcagtccaaggtcctgacaactcacctttagaagtacaaataaggacacagaggatgcatgagtgtgctgaacaaggacttgctgcacattggctttacaaggaaactggcaatccttttttatccatagacagcatggatgaacctgaaactgaagcatcctcctatttctccaaagatctagaggaaggaaattcttcagatattttattaagtaaatataagtcattgaaggctggacatccagtcctcagagtagaaggaagtcacttacttgctgcaattatcatcagtgtagaaaatgatgaaagagaattgctagttgctgtgagctttgggctagcagcttctgaagcagtagctgacagaagatctttccagattaagcgatgggaagcttatgcacgactgtacaaaaaggtgtctgatgaatggtggtttgaaccggggcatggggattggtttacgtgtctagagaagtacacactgtgtcgagatggtatgtatcataagcaagaccaatttgggcgcctactcccaacatttatccaggttatcaattttactgagcaagaagaatctgaatattgggctgttgtatctgctgtgtttgagggcaggcaagtggattggataacatctcggtcaaaatttgacttggttgcatcaacttctgtagaagctggcatcaataacaaggtgaaccttttgagaacaatgctctcttgggaagagcaattgcgctctgaagtaagtttcatgcaagcaaagcatgatgcaaagctttatgatcttcatggttctcttggggaagtggtaattatatgttggcctcatggtgaaattttgaggttaaaggcgggtagcactgctactgatgctgctcaaagagttggtttggagggaaagctggttttgattaatggacagttagtactgcccaacacaaaactcagagatggcgatgtagttgaaattaaatttatagcaaaacataggcttaggattcatttccactgtacaaccctcgaagcatggttcactataaagaaaacagtcccaacattgaattttgcatgccggcaagtattatctgtattatatttcaagagaagttgctacggcaaggtttcatgcacaagcatccattgccctaaatccttccaatga

SEQ ID NO: 61047 - DNA, 165 bp, Glycine max
  Peptide Sequence Number=SeqID_177825
atgaagatacctgcgacactcgacgagacaaagaacgtgtttccaggtatattttccagctcatgtctggcagagaagaattatcagatggggaagctcttcaaccttgagtgtgggcttataaaagaatctccaccactgcttcagtctccatgtgaaccatga

SEQ ID NO: 61048 - DNA, 1944 bp, Glycine max
  Peptide Sequence Number=SeqID_177826
atggagagttcggggttaggtccagtggattgcgacgttggatcgattgtttgggttcgaagaaggaacggttcgtggtggccgggtcaaatacttggccccgatcacctttctgcttctcatcttacttctcctcgttcaggaactcccgttaagcttctcggaagggaagatgccagcgtagattggtacaatttggagaaatccaagcgcgtgaaggcattccgatgtggtgaatttgatggatgtattgaaagggcggagtccgcccagggtatgccattaaagaaaagagagaaatatgcacgcagagaagatgccattcttcatgctcttgatctcgagaggcaaatgttaaagacgcaagaaaaaatagttgatggtagtgctctgactctaacaagtgatgggtctttgcataggaagtacaattcaggattggggcaagttggtgtagcacaccaagtaaagaggaggaaatttgtttatctgccagaagagtctagtgattctatggattacaaggagattcctgtcaatgttgccatgtcagcttcccaatttggaggggagtatgcttattgcagctctttggctgaagagagtgaatctgcttttatggatgttgttgaatctgattctcttgaaactggttctgctaatgctgattctgattcctctgaaatggaacttgacaaggatgatgagatgactactctttcagaaactggttgcgatactgaagaacaagaaagcactagcagtgaggaacttgatgagttggcaatttctagagacatgcctcacctctatcctcgtccgcatatatcatgcaatgaagctgtatccaaatggaagttaaaaggaaaaaggaataatcgtaatcttgtaaaaaggtctgttggtgctgctgatgggaaaggtgttgttttatatgaaacagatgttgaaggattaagaagccgtttaaatcacaagaggttggtgcctagtatgcattattatgggaatggtattagtgatgtttttgctgacaccgatcaaatgtttgggtttgaagatgaatattctccaacttccaaagcactagcaaaaggtcaaaataaaattggtcatggtgttgattgtgatgaatgggcttgggaggatcagactgcttttaaaggatattgggaaaataaagggtttgctcgattatatagtgatagttatcattttgatggaaggatgaggtcaatgctggtagatgtggacttgaaggttcaagcaagctatcggaaagcacctgtccccattgtttctatcactagtaagttagatgggaagtcaataatagggcacccaatccaaattgaatcccttaaggatggttcatcggataaacttttttctgcaattgatgactttagtaacgatgggaatggctttgagggaagtagtgtacttccaccagcctggaggactgcaaggagaacagcaaattttcgtgttcctcgtccccgtgtattgtcatctaatggtgctgatagtgatgcggatttctgcattggtcaagaaagaaatattgagtataagaaattaaatggtggaagttccagtcataaggcaagcctttccaggaagagtggccttaacagtcctgtgcattcggtagacaagaagtcctcaaaaaagatgccaaagaaagtgagcttgtcatctagtcagaaaactagaactctatcctcattatctattgaaaataatcatggtaaaaagcaattacatgatataagtttttatcaaacaaataggttgactaaaccagaggtctctgggctcactactgttgcttgcataccagtcaaattagtatttagtagattacttgagaagattaataggccacctttaaaagcagctagtaatgcggccttgtcaaatactggtgtggagagaaaataa

SEQ ID NO: 61049 - DNA, 1132 bp, Glycine max
  Peptide Sequence Number=SeqID_177827
atggatgagggaaagcataaatcgaggaaagaaaatcatgaggtgaaagatggggattctaagaggagtcaccgtgaccgtgatagaactggagaaaggggtaaggataaaaacgatgggaggcacagagatagggagaagagggatcgtgagtcccgaagacctgagagagagaggagtactgattctgaagacaggtatgatagagacagggagaagcgcaaagataaagataaggatgtggaccgagaaagaagtcgagataagaaaagggaaagggataggacagacagagtaagggagaaagaaagagagagggaaagaaaagaagataaggagaggatcagagagagggaaagggaaagggaaaggagggatcatgagagagagaaggaaaaggaaagagaaagggggaggagagtacgagggagggagaagcgtagggaagttgatagtgattgcagtgatggtgaatctaaggagcaggacagaaagcggcataggaaagaggatggtgattacaagagagagagggaaaggagtgtcagcaagccaagcaggaaatctgaggaacatgaaggaagcccaagaaaaaagagtggcgaagatgattcagataccaaagatgaagagaaaaaacctacccgtgaagaggagatggaggatgaacaaaagaggttggatgaagaaatggaaaagcggaggaggagagttcaagagtggcaagagctaaggaggaagaaggaagaagcagaaagagaaaaacaaggtgaagcaagtgctaatgaacctgagtctggaaagacctggacacttgaaggggaatctgatgatgaagaaggactgggtactgggaagcagacaggtatggatgtagatgaagatgacaaacctgctgatgaggagcctaaggatgtgatggtggtagatactgataatgggacaattgcatctgatttacaggatggaactgctggtgctcctgaagatgaggaaatagatccattggatgctttcatgaattctatggttctacctgaagttgaaaagctaaacaatgctgtgacatcgtcactttctgataaagccattgatgtaaaacccaaggataaagggaatgggcaaaatcgtg

SEQ ID NO: 61050 - DNA, 2499 bp, Glycine max
  Peptide Sequence Number=SeqID_177828
atggacgacagagtcaaatctgaaaagagaagcagagatcgacacttggaacgtgacgacaaataccatcgcgattctgatgatcaccgccgtcatcgatcagacaggaatcacaagcgtgaccacaaatcaagggatagggataggacttatgacagagaaggaagcagggatagggattacgaaagagagggtagcaaagataggttgaaggtgaaccgtgatgaggggagggaagatttggtggagccacgactctcctcacattctcataagcggaaagagagggagcacagtgaggacagggactatgaggataagaaaattagggtttctgaggagaggaaggaagggaggagggaacggaggaaatttggggataaagtcaagaaggaggaagaagaagaagatggtaatgataatattagaggcattcatgaggccaaggtcaaggaggaagtcgctgatggtgcccatggctcagcttcttccaatgacactgcgtttatccaaaatggtgccttgggatcacctgctgtggcgcccatgagtgtgcctgagacatctttggctcctccttcttgctttcctatcaaggtatcttcgaattctaccacaaatgaaaataagggcgttagtattatcaggtctcatgaggttactggaaaatctagtacagatgggtcatcttcagctgctggaaaaactgggagcctctctattgatgccctagctaaggctaagaaagctttacaaatgcagaaagagttgtcagaaaagctaaagaaaattcctcagttgaataagagttctagccaaaattcacaaggaagctcgaacttgggttcaatgaatgaatctgcagtaccctcttctgctgctggagtggcattaaaaagttccacctcagcttctttgggccatgttgcaaatatgtcaatgttcccctcaactgcttttgctgcttctgctaatactccagtaattggcactagtgctgttggtattccaaatgcaactctgcccaacttggaagctgtcaggcgtgctcaggagcttgctgccaggatgggatttcgtcaagatccacaatttgctcctctgataaatatgtttcctggtcagatggtaacagatgttgctctcctgcagaaacccacaaaggcccctgttcttcgtcttgatgctcagggacgggaaatagatgagcagggaaatgttattaatgtgactaagcccatcaaccttagcacattaaaggtcaacattaacaaacaaaagaaagaagcatttgaaatactacagcctgtattggatgtcgatcctgaatctaatcctcattttgatgcaagcatgggtatcaacaaaacaaagctcctgcggcccaagaggatgaatttccaatttgtggaggaaggaaaatggtcaaaagatgctgaaacaataaaattgaagagtaaatttggagaagctcaagcaaaagagcacaaggccaaacaagcacagttggcaaaggcaaaggctgctcctgatataaatcctaacttaatagaaataacagagagagttgtaattaaagaaaagcccaaggaccaaattccagagattgagtggtgggatgtgcctcttctgcattctggaaattatggtgatgttgataatggaatcataggcgaagataaactgaaaatagaaaaaatcaatttttatgtggagcatcctcgtccaattgagccacctgctgagcctgctcccccacctcctcaaccactcaagctaactaagcaagagcagaagaaactccggacgcaaagacgtatagctaaggagaaagagcgacaggagatgataagacagggtgtcatagaaccaccaaaaccaaaggtcaagattagcaatttaatgaaagtacttggctctgaagcaactcaagatcctactcggctcgaaaaagaaatacgtaccgcagctgcagagcgtgagcaggctcacatagataggaacattgcacgcaagcttactcctgccgagctgcgggagaagaaggagaggaagctgtttgatgacccaaatacactggagacacttgtctctctttacaggataaatgacctctcacatccgaaggcccgattcagagttgatgttaatgctcaagagaaccgtttgactggatgtgctgtgatttgtgatggtattagtgttgttgttgttgaaggtggaagcaagtcaattaagaggtatgggaaacttatgcttagacgtattaattggagtgaagtttcaaaagagaaagaagaaaatgaagattcagatgatgacaagcctgccaataagtgtgttctggtgtggcaaggaagtgttgccaaacccagcttctataggttcagtgtccatgattgcatcaccgaagcagctgcccgaaaagtttttgtggatgctggtgttcctcattattgggaccaagccgtgaactacaaagaagatgaagctgtttaa

SEQ ID NO: 61051 - DNA, 1386 bp, Glycine max
  Peptide Sequence Number=SeqID_177829
atggactttgattatgctcactatatgcttaccgaggggaataaaggtaaggaaaacccagatgtgtgttccccctctagagaagcttacaggaagcagcttgcagaatccttaaacatgaaccgtacccgaattcttgctttcaagaacaagccacctgcaccagttgacttaatccctcacgagatgtccactcatacccacgataataaaccagccaagcccaaacgatttattcctcagacttctgagaagactttggatgctccggatcttgtggatgactattatctcaatttgctggactggggaagcgcgaatgttcttgcaatagcacttggaagcacagtgtacttgtgggatgcaacaaatggttctacttcagaacttgttacagttgatgatgaagatggccctgtgacatcccttagctgggctcctgatggacggcatattgcagttggtttgaacaactctgaagtgcaactatgggatacaacttcaaatagacagttgagaactttgagaggtgggcacaggcaacgagttggatctttggcatggaacaaccacatactcacaactggagggatggacggtagaattgtcaacaacgatgtaagaattagatcgcatgttgttgaaacctacagcgggcatgagcaagaggtttgcgggctgaaatggtcagcttcaggttcacaattagccagtggagggaatgataatctactttacatctgggatagagctacagcatcttctaattcggcaacgcagtggcttcacagacttgaagatcacacatctgctgtaaaagccctcgcttggtgccccttccaagggaatttgttggcttccggtggagggagtggtgaccgttgcatcaagttttggaatacccacacaggtgcatgcttgaactcaattgacactgggtctcaggtatgttccctgctgtggaacaagaacgagagggagttactcagctctcatggttttacccagaatcagttaacactttggaaatacccctcaatggtgaagatggctgagctcactggtcatacctccagagttcttttcatggcccagagtccggatggttgcacagtagcatcagcagcggcagatgaaacactgaggttttggaatgtgtttggagctccggaagcagcatctaaggctgcaccgaaagccagagccgagccattttcaaatgtggtagagcttgtcttggaggctaggctacaatggagattctcgacgacgacgggcgtagatccagcgtctcctggatgccacaacttatgtcgccgtgaatctactaatctagctgtgtgcgtcgagacggccgttggtggggcggcggagaatagaagatga

SEQ ID NO: 61052 - DNA, 933 bp, Glycine max
  Peptide Sequence Number=SeqID_177830
atgagcaagggaccgggtctctttaccgatatcggcaaaaaatccaaagatcttttgactaaggactacaactccgatcagaaactcaccatttcctcatacagcatctccggagtggccctcacttcaacatctgtcaagaaaggaggactctccactggggatgtggcagcactgtacaagtataagaacactattattgatgttaaactggacaccgcatcaactatctccacaaccctcacattcaatgacgttcttccatccaccaagactattgcttcatttaagctgcctgattataattctggcaagttagaggttcaatacttccatgaccatgctaccttaacaacagctgttgcactgaagcaatcccctgtcattgatgtttctgccactgttggtaccccaaccattgctttgggtgctgaggcaggctatgacacttcatctggtggttttacaaaatacactgctggaattagtgtcacgagacctgattcttctgcttcagtaatcctgttagtttcttttacccataaaatttgtgttccaaattatctagtaatctcaatcattttgaaagctaacaaattgattctgaacatgtacttcccaatcagtggtgacaagggtgacagcattaaagcatcatacctccatcatctggatctattgaagaagagtgccgctgttgcagagatcactagaaagttctcaacaaatgagaacatttttacagtaggagggtcttttgctgttgaccctctgacacaggtcaaagcaaggctcaacaatcatggaaagcttggggccctcctgcagcatgagatcataccaaagtcagtgtttactgtttctggtgagattgacaccaaggccctggataaaaagcccaggtttggattggctattgccctcaaaccttga

SEQ ID NO: 61053 - DNA, 786 bp, Glycine max
  Peptide Sequence Number=SeqID_177831
atgtatttttcacaaactccttcagagttgctagatgatggactgaaaaagcaatttagaaagagaaatccgaagatggaagacttagaagcaaagatatcagattcaaaaccagatgactcaatttttgcctttcgtggccaccatgttactattcttaccactccttccaatgctaaactcatcccaaaacatctcaatgtccacatcttgaacttcccctccgaggaagtgggtctcccttcaggccttgagaatatctccttggccaaagacaacaacactgcctacaagatatggaaggcctcaaagcttctcaaacccgaaatcgaaaacttcttaaatcataaccctcctcacgctttgatcatagacatcatgtatacatggagatccacacttaacaatagcatccccacgtttgtttacagccccatgcccgtcttcgctctttgcgttgttgaagccatcaatcgccatcctcaaactttggcttctgattcttcacttccttatgttgtccctggtggtctcccccacaatgtcacgcttaattttaacccctcatcaactagctttgataatatggctcgtactttgctacacgccaaggaaaataacaaacatggtgttattgtgaacacatttccagagctcgaagatgggtacactcagtactacgagaaactcacccgtgttaaagtctggcaccttggcatgctctcacttatggtggattatttcgacaaaagaggcaagccacaagaggatcaggtatcggagtaa

SEQ ID NO: 61054 - DNA, 303 bp, Glycine max
  Peptide Sequence Number=SeqID_177832
atggctgctctgtttcttgattttgtagtcgttgaggcagtgcccgccctcgtcacagtttcggcattgcggaggagccgtcatggcggcatagaggcgctcgacgacttcaatgacacgattgatctggaagaattcaacaacgaaacaaatcagatgatgcttgccatggcaaaaggattgggtttctatacatgtttaaaactaactacaaccctcactaaccagagttcggcaaaagtcttcgagtcgccaacttcgactcgtgaaagaagcagaaaacaagttggccgggaactttga

SEQ ID NO: 61055 - DNA, 432 bp, Glycine max
  Peptide Sequence Number=SeqID_177833
atgaaaacatctattggcgaggaattggaaacattggaatcgagagaaacacataatttgaagcctgatttttccatcattgtgaacacaattaagacaatattattattacttaggaacataccagtgaagaaattggtagagcttaaggtacttaggactaacggtcctgtgttgaatcctgagagcgagcctacccctaaacctcgtaatcacactcctcttgaatcaaaatcaccaattgacctctctttaaagcttgctccgtcaactttatgtgaagaaacacatccttcatatcaaactcttgcaagaatacagtctacgattcagtctctatcatcagtggcggtggcagcattatcggtgagcgtcatgcgagaggaagacgcgttgggaccttctgcatctagaaggttatggaagcaataa

SEQ ID NO: 61056 - DNA, 348 bp, Glycine max
  Peptide Sequence Number=SeqID_177834
atgaagacaccaaacaaccctcactgtatggcctcaagccattcaacttcaaggactgtaaacaaacagctgatgcaatgcaactccacaattaaacatcaaaataaaaccctagatctgttggttgttccttgcgtggtacctacagaagttattatagtagagggtagaaagaagagaaaggaagcgggaaaaagcgtagcacaccaaattgatgctcttaggttcggaaccgaagcggttaagagtgactttgtggctttgcttgcttcccacactctccaatctgcccgtgaatctgtattcactttctctcagcttcctgcgttaggcaagcaggagaaatga

SEQ ID NO: 61057 - DNA, 1197 bp, Glycine max
  Peptide Sequence Number=SeqID_177835
atggaagggtcagaggctctaaaaatgtatgtcctccctttcccttcgccaggacacacgatcccgctcattaacctggctcaaattttggccttaaaagggcaccacatcaccatcctcaccactccctccaacgctcaagtcctcccaaacaacctcaatgtccacacctttgatttcccctccgaccaagttggtctcccttccggcctcgaaaacgcagcctccgccggagacagcgtaaccgcccacaagattctgaaggccgcgctgcttctgaaaccacaaatagaaaccctagtgcagcaaaaccctcctcatgccatttatagccatccccaagtgttgccttcggttgttccttttgttgtccctgctgttctcccacacactatcacctttgatttcaacccatcatcagcacccgggtttgatgctttggctcagctttttctgcacaccaagcataacaacacacatggtattattgtcaactcctttgaggagctcgaagatgggtatacgcagtgttaccaaaaactcaccggcgttaaagtgtggcacgttggcatgacttcactcatgctcaattttaccaagaaaagggcatgcacatcacaaaaggatcagcaacaattggagatagcacatggggttgaagcctcagggcacgagttcctctgggtgtttcctaaaaatatgcatgttgaggttgaagaatggttgccacatggttttgaagaaaggactaaggaaaataacagaggaatggtagtgagagggtgggtccatcaagagttaatattgaagcatgttgcgattggagggttcctaacgcagtgtgggtggaattcagtgacagaagggattagtgctggggtgccactgataaccatgccaagattcgctgagcagtttttgaatgagaagttggtgactgaagtgcacaaaattggggttgaggtgggggagtgtgagtggagcatatcttcttatgatgcagggagtaaggtggttggttgggaactaattaagaatgctgtggagagggtgatgaaggatgaaggagggtcacttagaaaacgagccaaagatatgcaagaaaaagcacataaagctattcaaaagggtggctcctcttataataatctcactgcccttgttcaatccctcaaacaaaagaatatccatggttga

SEQ ID NO: 61058 - DNA, 774 bp, Glycine max
  Peptide Sequence Number=SeqID_177836
atgtgggacaaaggagctaagaccacaaactctagcatactctttcgtgccaggctagcaaacatgttaagagtatcgagggcatggattttttttatggtcgacgacgagtgcctcaaatggcttaacaccaaggagtccaactcagtggtgtacatatgctttgggagcttggcccgtctcaacaaggagcaaaattttgagatagcacgtggaatcgaggcctctgggcacaaattcctttgggtgttgcccaagaacacgaaagatgacgacgtgaaagaagaagaattgttgctgccacatggttttgaagaaaggatgagggaaaagaagagaggaatggtagtgagagggtgggtcccgcaaggtctaatattgaagcatgatgccattggagggttcttaacgcattgtggtgctaattcggtggtggaggcgatttgtgaaggggtgcctttgatcaccatgcctaggtttggtgaccattttttgtgtgagaagcaagcgactgaggtgcttgggcttggggtggagttgggtgtgtctgagtggagcatgtctccttatgatgcgaggaaggaggtggtgggttgggaacgaattgagaatgctgtgaggaaggtgatgaaggatgaaggaggcttactcaacaaacgagtcaaggaaatgaaggagaaagcacatgaagttgttcaagagggtggaaactcttacgacaatgttactacccttgttcaatcactcagacggatgatgaatgttcatggttga

SEQ ID NO: 61059 - DNA, 1191 bp, Glycine max
  Peptide Sequence Number=SeqID_177837
atgggagctgacaactccgggtttactattcaactaatccgtcacaactcccccaattattctcccttctacaaatcagatgaacttcatatgcatagacttggctcaaatggtgtcttcactagagtgacgtccaacaatggcgactatctcatgaaactcacattgggaacaccaccggttgacgtgtatggtttggttgacacaggcagtgatcttgtgtgggcacaatgcacaccttgccagggctgttacaggcagaaaagtccaatgtttgagcctctaaggtccaatacatacactcctattccatgtgattcagaggagtgtaattcactctttggtcattcttgctctcctcaaaaactgtgcgcttatagttatgcttatgctgattcttcagtaacaaaaggggtgcttgcaagggaaactgtcacatttagttccactgatggagaacctgttgttgttggagacattgtatttgggtgtgggcacagcaactcaggaactttcaatgaaaacgacatgggaatcattggactaggtgggggccctctctcacttgtttcacaatttggtaacctttatgggagcaaaaggttctctcagtgcctagttccttttcatgcagaccctcacactttaggtaccattagttttggtgatgccagtgatgtttcaggtgaaggagtagccgcaactcctttggtctctgaagaaggtcagactccttatcttgtcacattggaaggcataagtgttggagacacatttgtgtcctttaattcttctgaaatgctttccaaggggaatataatgattgattcaggtacaccagcaacatatttaccacaagaattttatgaccgactagtgaaggaattgaaggtgcagagtaacatgttgcccatagatgatgaccctgatttgggcacacaactttgttacagaagcgagacaaatttggaagggccaatcttgattgctcattttgagggggcagatgtgcaattgatgcctattcaaaccttcatcccaccaaaagatggggtattttgctttgcaatggctggcactactgatggagaatatatatttggcaattttgctcaatcaaatgttttgattggatttgatttagatagaaagactgtttcctttaaggcaactgattgcagtaatcagtag

SEQ ID NO: 61060 - DNA, 1623 bp, Glycine max
  Peptide Sequence Number=SeqID_177838
atggtgatgatgactcgagcattgaagaccattatgtcatcctatcatgactatggcaagaattcccgtttatgtcctttgcctatcagtcaatccagaagccgtcagtggcgccaatgccgcattggaaccttcgctgtagccatagcagcacttctcatatctaccactgcttggctttcccttgtcttctctgatgcaactacctgttgctttcatcacttaaaggattgggaaagtagcccccactttttcaattggaagaagtgcatctctcatcgtcttgcaaaagtaacacctccaccagctctccaatatgagaccgtgaatgctcatcttcataatggtagcaggactgttgaacaggaaggcttgtcacttaaacatattgtttttggcatagcaggatcatctcagctttggaaacggaggaaggagtatgtcaaattgtggtggcgtcctaatgacatgcgtggccatgtgtggttagaggaacaagtgcttgaagaacctggagatgatttattgccccctatcatgatttctgaagacatctcatatttccgctacactaatcccattggtcacccttctggcctccggatttctcgcattgtcagagagagcttttgccttggcctctctgatgtgcgctggtttgtcctctgtgatgatgataccatcttcaatgtgaataatctagttgatgttctcagcaagtataattcttctgaaatgatttacataggtagcccctcagagagccattcggcaaatacctattttagtcattcaatggcctttggcggtggtgggattgcaataagtcattcacttgcaaaggctctctctgagatacttgacgaatgcattgagcgatatcccaagctttatggtagtgatgatcgactgcatgcctgcatcactgaacttggcattccactgacatgggagcatggttttcatcagtgggatataagaggtgacgctcatggtcttctatcctctcacccaatagcaccatttgtatcaattcatcatgttgaagctgttaatcccttttatcctggcctgagctctttggacagcctgaaactttttacaaatgccatgaaagccgatcccaaaagctttttgcagcgttcaatatgttacgaccacgcacggcatctaacattttcagtgtcacttggttatgttgttcaagtcctgcctaacattgtttttcctcaagaactggagcgctctgaaaggacatactctgcttggaatggtattagtcaaacgaatgaatttgattttgatgccagggaaccatacaaatctgtttgtaaagggcccactcgattcttcttgaaagatactagaagagagggtaatgcttcttggggttcatatgttcggggtagagataaagatgatttcaaaaagagaattttatgctttcctcacttcccccctctgcacaatgtgggagagatccaggtagcagtgcaacatttgagcaagaattggcatctggttccacgacgtctctgttgccgacaaagccaagctggcaaagaaatactccaaatctcagttggagaatgtgggaagggaacttttagctctgtctactga

SEQ ID NO: 61061 - DNA, 339 bp, Glycine max
  Peptide Sequence Number=SeqID_177839
atggggaagaagcagcacagcaaagacagaatgttcatcaccaaaactgagtgggcaacggaatggggaggcgctaaatccaaagaaaatcgcactcccttcaaacgtcttcccttctattgctgctcgcttacatttactccgtttgaagaaccggtctgcacacctgatggcagtgttttcgataatatgaatataactccctatattgtaaaatatggcaaacatccagtcactggagctcctctcaagcatcaggatctcatttctctaactttccacaagaattcagaaggttcctctaatttaaatccttgcatgcccgcaaattattgttga

SEQ ID NO: 61062 - DNA, 1185 bp, Glycine max
  Peptide Sequence Number=SeqID_177840
gctcgtctgatatcaagaagttcatacctcaaacggtatctaacgggagtttctaacctaactctctccccgccgttaaacataacggccgagactttcgctgcggtggctgaattctgttacagccgcagagtccacttaacgccgagtaacgttgccaccgttagagtggcggcggagttattgggcatgacgggagaagagaatctccgtgaagtaaccgaatcgtattttgagagagtcgttggcattgacgcgtcgatggttctgcgctcgtgcgtggctctgctccccgaatccgaaacgacggcgtcgcttgccagcaggtgtattgaagcgctggtttgggaagacgacgtttcgtgtttaaacgacgtcgtaggtatgcaccctcaggattttcaaacggtatcgtattcactgaacagaaggttacacaaccacgacgttctatacaagatggttgatctttatctcaaggaaaacaagtacggtaaactaacagaggaacagaaatcggagatatgcaacagcatagactgttctaggctctcgtctcacactctcgttgactgtgttcaaaacccacgaatgccgctcagattcatagtgagagcgatactcatggagcatctcaacactcgccgctccgtcactgcggcggccagggccccggccaccaccggtgcacaacaacaaccagaacgaacgtccctaagagaaattctgcagcgtgacacggctgatcgcgaaacgacacagatcaaagagaccatggattccacctactctcgtattcaaagcctcgagagagaacttaggggcatgaagaagatccttcatgaacatcaccaagcggaggatgacacaaggaataataataatgtgttgaactcagagcgtttcgcaagtttccattttgttccagcagatgcagagagcagtaaaatacagaggggaggaagagggtctgtttcgtcttcgggttttgtgcttgacaacgtaaggaggaaaaataaggaagtggccggggggatgtgcaatttgtctgtgggatcatcatgtcatgacgatagcaagaccccaaagatgaccaagtttcttcgccatagtaagctcataactggtctcaagcatgcatttcggatatcaaagtctacgtcaaacactactgaagaaacttag

SEQ ID NO: 61063 - DNA, 1767 bp, Glycine max
  Peptide Sequence Number=SeqID_177841
atggatgaactatgtaggcagagttggctagagaaccaatctgatttgaagaccacaggaaatgtgttctgctatgaggctgttaaagagttaaatattaagacaaaaaactggaaggagctcctcaccgatgagccattcactaaggatgaccttataaccattcaaaatcctaatgcacttgacagcaaggttcttctggattttgatcatgttaaaaatagtttgaaagttgatgatgaagaactacagaaaatgagttcagatccaacctataacataaacatgtcgggtgatataaagcaaatgcttaaggagcttggaactgagaaaggaaaggaaactgcattgcatgggggaggcggtggcaaggcacaaaaagaaagagctgctgcacttgctgccatcttagctgcaaggtcacgtgttgaagaagattccaaatcaaatccaaataaagaggtcaaagtttctcaggcatttagtattgtagatgctgcgtctgcctcagtacatggaagaagtgcagctgctgctaaagcctcagcagatgataaaactgcagctagaatagctatgcatatggctggtgacagagcaccagtgaatgcaaagatggtaaaaagccgtttcacaactggtgctgcttcccggtctttcacttcaacatcatttgatccagttacaaaaaatgaatttgagtatgtgaaagttgagaagaatccaaaaaagaagggatatgtacaactgcatacaacacatggtgatttgaacattgagctgcattgtgatatagcacccagggcatgtgagaacttcatcactctttgtgaacgtggatattataatggagttgcttttcatagaaacattaggaattttatgatacagggcggtgatcctactggtactggtcgaggaggtgaatctatttggggaaagccttttaaagatgaacttaactccaaattagttcactctggaaggggtgtggtaagcatggcaaatagtggcccccacactaatggctcccagttcttcatcttgtacaagtctgcaaatcatctaaacttcaaacatacagtttttggaggagttgttggtggcttgactaccctatcggtgatggaaaaggttcctgttgatgatgatgatcggcctctggaggaaatcaagatattaagtgtcacgatatttgtcaatccttacacagaaccagatgagggagaagagcaggataatgccaaagagaagaatgcagaggatgaagataatggtaaggtaggctcgtggtatagcaatcctggcgctgcaacgtctgaatctggaggtacgggggttggtggtggcgttggcaagtacttgaaagctaggaatgctcaagctaaatctgctactgttgacaacacaggtacagacgttgtagtaaagaaaagaaaagtgggagttgccagcagtgaatttaaagatttttctgcatgggaatttcttttattcctgttcagtaatcagttgtctggcgtgaacgctaacttcagcctagggtgtcattcccaagggcacttcaagtcagtgagcctagctagttttttcattgacttttctggtcacaatttggcatcgtatacaggggatgtacaattcagagtacagaatatgacactacatttaaaatggaaaatgaggaatttatgcattatgcatattacggaaaacaaatgtaaagttgagaagtggaaggagaaaccagattataagatagcttag

SEQ ID NO: 61064 - DNA, 486 bp, Glycine max
  Peptide Sequence Number=SeqID_177842
atgggggagatgaacctaaccacccgcaagaaagagggaggctatgatgaactaggagcactgagtcgagagatccagcgtagagctataaagagagaacacaatttccagtttctattctcctcagaaacaccatcaattcttgtagcttttcaagcttgcccagcagtcccaaagattcaaggaataagtaatgctgatgctcaatatatttcacaaatagcagcttgcagaccttgtctttataattcagaacagtgcactttcttagctatgaagaaatgcattcaggaccatactctgtataataccaaacctcgcgagaatacctttcaacaggaaaaaattaggcacaaaagtttgaagcgtggggcaatgcttgagcatttccaacatcaaatgccagttcataaatctcccaaagatgagctccaaatgaataaaattgtgaaaccaaggaaagcgtacttggtggttgatcagtga

SEQ ID NO: 61065 - DNA, 846 bp, Glycine max
  Peptide Sequence Number=SeqID_177843
atggggaagataccgggtctccaacatcctagcatcatccaaaggcggagttttgagctctggcaagtgtacggactcaacactgttactgtccacaaacaaccgacacagcttgagaacgacgagcgttttgtagttgaagatgctgctcaaaatttggagcagcgccagactgtgatttcgcggtgcctcgatttggaggtcgttttggtttcggcacacgctggagttgaggtggaagtgcgtgatggagtgggaggggttgcgagagagaatggcgacgtaggcgaacgtcaagaaggaggagtagggtttgtcgttttggagaaacggttcatcgtcgaggtcgaaggcggggacggaatgccacaacggcttccagcgcttggagagaaggctcgtggcaatggcttcgtgagttgggagaaagagggaaatgctagaaacacttttttcgaacagcttcttcttctcttccgtgaacctgcttcttcttctcttctccgtgaacctgcttcttctctgcgaggcgcgccaaggttgtcttcttcttctccgcgaacagtagaagacgccggaaaaaatgggaaaaagggctcacggcagaggcttccggaagaacctgttccggaaactttccggaagaagtgttcttccggaagttactgccgtgagccctttttcccattttttccggcgtcttctactctcgtcttctaccctaagggtagggagactaacctgttcgcggagaagaagaagacaaccttggcgcgcctcgcagagaagaagcaggttcacggagaagagaagaagaagcaggttcacggaagagaagaagaagct

SEQ ID NO: 61066 - DNA, 300 bp, Glycine max
  Peptide Sequence Number=SeqID_177844
atgcccaagttgctgagggctaatatttatgaaaattacgggtttgagattcctttggaggcactttgtaatgtggagtatctacgattctgtctagttgcaaaaggttttaaaaagcggtctgggactgtgattgggaccgcatccaccctaattgtccccgatatcaagaaacgcgacgaaattgctacactaccgatatttaatccaactaatctccaagtaaccgaatttctcaacaagaaaaagttaataaacttgggtacaatgatttcttctcttttggactcgctctcttag

SEQ ID NO: 61067 - DNA, 201 bp, Glycine max
  Peptide Sequence Number=SeqID_177845
atggacaagtgctggattcatgatgtggcaaaattgaagcgattgttcttagatataattcagatatggtttgctgattgtggcatgtcgccaaagaaagttgcttattttgcttcttttcaggacattgttgaggccaaggaatatctgaaacaaaaaggagttgattgtttgtgtattactggaaagggatctgggtag

SEQ ID NO: 61068 - DNA, 381 bp, Glycine max
  Peptide Sequence Number=SeqID_177846
atggagaccacagacctgaccatagaggttgtacatctagccatagagattgcgaacctggagatcttgttgtttggacaagagctttaccagacgactttttgtgtcgcattctcttctttctccgggagttgctacgtgcacccagcaaacagtgaatggatgaaaatgcccttctgcaaatatcatttccggatgaacattcttcctgaatcattccggaagacactttttccgggaaatttccggaagacccttcttccggaagaacgtgattccggaagaactaaggaacactttccggaagaacgtcatccggaatgtttccggaagaaagttcttccggaagataaccttcttcttccggaaatttttttttaa

SEQ ID NO: 61069 - DNA, 897 bp, Glycine max
  Peptide Sequence Number=SeqID_177847
atgctgaagttccaagagttgagtccctggacaaccttcggccacgtggcatccaatggcgccatcttagaagccttggaaggagagcccaaactacacatagttgacatcagcaacacctattgcacccaatggccaaccctcttcgaagccttggcaactcgaaacgatgacactccgcatctccgtttaacctccgtcgtcaccgccggcgccaccgcgcagaaggtcatgaaggaaatcggagccagaatggagaaattcgccagactcatgggcgtgccctttaaattcaacgtcgttcatcatgtaggtcaactctctgacctcgatttcagtgtgctagatattaaagaagacgaggcgttggcgattaactgtgttaacaccttgcattcgatcgccgccgtggggaaccaccgtgacgcggttatatcttcgttgaggaggttgaaaccgaggatcgtgacggtggtggaggaggaggctgatttggacattggattggaagggtttgagttcgtgaaagggtttgaagagtgtttgaggtggtttagggtttactttgaggccttggacgagagttttccgcggacgagcaacgagcgtttgatgcttgagagggcggcggggagggcggtggtggacctggtggcgtgttctccggcggattccgtagagaggcgggagaaggcggcgcggtgggcgaggaggatgcatggaggtggggggttcaatacggtggcgtttagcgaagaggtatgcgatgatgtgagggcgttgttgaggaggtatagggaagggtgggcaatgacacagtgctccgacgccggaatattcctgacgtggaaggagcagccggtggtgtgggccagtgcatggagggccttgacgtag

SEQ ID NO: 61070 - DNA, 1422 bp, Glycine max
  Peptide Sequence Number=SeqID_177848
atgaagagcagaatgtgtcattatgtagaattttcatggtttttcatttcaagttctgtattagatcttacgattgtgggtttagatgacgcggatggagactcaaatgcacagggtcagtgccctcactacttgaagaccagttgtaaagccaatctagatctgggaagtgcagtttaccttttaggctacacagagaaacaggagctcactgttggtgaaggaaaggtggtcattgccactgataatctcataaaactgtcaactgatggaattcaatggggtcccggttctgcaggttttgatgtgcatggcaatctagcttttatgatatgtgatcctatgaaattagccacatcaccaaataccaaatcgccttcaacttcaacgtcatcatcatcatcctcttggaagaaagaccaccccatgcaatttggcataccaattcctgtcatatgtgattggttaaaccagcattgggaaggcaaccttgatgagcttaacaagccaaaattaccaatcatgcgattgatgtcaaccggcccaaagagcgagcactcgtgtgcttccttcaccctgcggcaagttttcaagtcaactgagggcgatgatgatgacaccccttcctcatcaaacaatgcctcaaaggcaagggatcagggaccaagctcttctgctgctaccaacgcagttgaagaagaaagcttgatcactaatcccaatgttgcacatgtacagggaatccccactcccgaaatatacgaatcacctagagtaactgctgtcccactcagaaggaaagaaaacataccattacagcttttggacatcaattttcctccaaggacttccaaacctgcagtttttccacaatcatccaaaccaaaaactgctgaaaatcttgccaaagaacctttgcccgaaaaccaagtagaaggagaacaaaacaagcacacaaggccaacaactcctattccagatgtttcctcaacaggttctgtcaatggagcagctcaaagtgaggttcagtctagttcgtctcccgtggaagtatatgagatgcaaaatggatacagcagcgaaggagagaccatgtactcggcagaaacagctgagtctcgcaactacacaagccccagagagtttaactttcaacaagtgggaaggagccagagttgtgtgagttacaataggtggggtgctgcaccaagaagccaagttgcacgcgggatgatggtggaaaatcagagaagcttcatgcatgtgaagagaatgtattcacaaggtgcaacaacttctcagcgaagcaatgactatttcagccccactgtctcctcaatcatgaaacgtaacagcggctcaagcaagccaccaccccggcaaagtgctgttcattctccttcacccagatggatgttttga

SEQ ID NO: 61071 - DNA, 537 bp, Glycine max
  Peptide Sequence Number=SeqID_177849
atggcattccataggtttctggggctcttgattttgatgactccgatcatgtttgttcaagttgtggcaaggcaattcgatgttggtggcaaagatgggtgggtgctgaagcctactgaagactacgatcactgggctcaaagaaacagatttcaagtcaatgacactctccatttcaagtacaataaagggagtgattcggttgtggtggtgaagaaggaggacttcgattcatgcaacatcaacaaccccatacaaaagatggatggtggtgattcaactttccaactttccaactctggccttttttacttcataagtggcaaccttgacaactgtaaaaatggtcaaaagctcattgttcttgtcatggctgcgaggcaaccaattcctagggctgcgctgccaccacagaagattccggcaaccagtttgacttctccggcaccgacgccgacggacaattcgggttcagggagggttggtgtgagtgtggggattgttttgatgttcactggctttgttgggttggtttag

SEQ ID NO: 61072 - DNA, 396 bp, Glycine max
  Peptide Sequence Number=SeqID_177850
atgaaggctgacatagcttctcaggttggtcctctgccacaacttatggtggagcctactagtgcacggtctaactactttattggaacctatgaatatcttgctccggagatcatcaataccaagatcatttcttatgctaaagctgattgggcagggtcaccattagataggagaatcacttttgggtattgtgttcttattggagagaatatgatctcacggagaagcaagaagcaaggcatagttgtcagatctggtattgaagttgaatacaatgcaatggcaatagcctcttgcgagaatacatgcatagacaacttctccaacaactcaaatttggtgacactcaagctactacatgaattatcaataatcaagtcactctccacatag

SEQ ID NO: 61073 - DNA, 573 bp, Glycine max
  Peptide Sequence Number=SeqID_177851
atggtgagttctaatgatggaagtagattcatgctagttgttggatgcggttatgctaagaaaggggaaggagaagaggctttggctttgtatctgaggatgcaaatggaagcttataagccgatccagtttacttattcagggattttgagttcttatttgagtatggggtgtttggagcaagggaaatggcttcttgcacatttgatgaaaccgggtcagaagttagttgtttacgtggggaacacactacttcacatgtatgcaaagttgggcaaaattcgggatgtagagaagttttttgacaaattggtgaaagttgatgttgtttcttgcaattcgatgttgacaaggtatgcccaacatgggcttgggaaggaagctatgcagcaatttgaagaaatgataagctttgggattgaacccaatgatataacagtcctctttgttctaagttcttgtagccatgctagacttttggatgagggtaaacattattttggattgatgagaaagtacagtattgaaccaaaagtgtcgcattatgcaacaattattgatcttcttggctga

SEQ ID NO: 61074 - DNA, 991 bp, Glycine max
  Peptide Sequence Number=SeqID_177852
tgtgaagatgaagaaaatgataaagttgtactggcttcaaacagtgatcttgctgcagcggttgaccacccgaagacatggtttgaaggtatgattatatggaattgggggaagggtttccttcctctctctgctttacttgaaattcttgcctatcatgtgcctaacttgttgggtggtgctgataggcctatctgggggttaacccctgatgatcgtttctcggttaagtcgatttatgatgcccttaacaattctggaacctcattgggtaaggttgctttgtttgggtggtgttgcaagatgggcttaaaacgaatgtcaaaaggcaagagtgtggtttatcatatcacaattcatgccccttatgtggagtttatatatgacggaaactcctattcatatctttcgggattgttcgatgttgatcaagccatgcagatttctgtgcataggcaacccttctctgaggttttgtttggcagccacctgttgggcgttgtttcaagtataatgttgatgcctgttattaatggtggtgaaaaggctagctatggtggggtgcttcgtgatgctaatggccattggataaatgggttcacgagacaattgggtcgttgttccattatggcgttcctggaatgtgaagattacctacatgtgttgtgtgaggctaatagtgtggctgacaacctagcttccaaatttcatcactctttgcaagggttggtgttttatgataactctcttgcaaagtgcaagatccttctatggtttgattttattgtgactgcctattttgttcctgtaattgaaaacgctttaaaagccgtcattgacacattcctcactctcatcgcagcttcttcgattcagggcccgcgtgctgtctctgtaccggcaaatactgcggggtctgaactcgccggagttgcggctgggcttcgcggcgaggctggcgaagaaggcggaggcgcgtgcaatgttctgg

SEQ ID NO: 61075 - DNA, 213 bp, Glycine max
  Peptide Sequence Number=SeqID_177853
atggagggcagcagagacataacagcaatgacagagggtgaactcacaaacacaggggtgcagaaggaaataatactcaaaagaaaggaatctagtgagaattttgcagctcacgcaatcttccacaatcctcctgctgatgctgcatatctgaggggaagcagccataacagaattagttatgtaatattcctaggattataccaattctag

SEQ ID NO: 61076 - DNA, 315 bp, Glycine max
  Peptide Sequence Number=SeqID_177854
agatccttcttgatcggtgctactgtaattgcatcttttggttaccgcaaagagcatgatgactcttgggtaaaaaagggtgcttatcccattgatgatgaaggacacttaccagttggagaggattcctctctccttcaaagaattttggataggtttgatggtcttcaaacctatgttggtgaaaggtttgatgctttggaactacaagtggacatgcgattcgacaagatggactcaaggatcaccaaggttgaaggagatgtcacttacatctgcacatgctttgatctaccaccaccaccatcatcttag

SEQ ID NO: 61077 - DNA, 333 bp, Glycine max
  Peptide Sequence Number=SeqID_177855
atgggcccagaaccagaagaaggcgtggaaaatgcgaggggagcaatagcagctgcctacagtagcagcggcgggtcagtgtatgacaagaaccctgatgatcagatccactctggggcggtcccagacgatgtgatccaggcaacacaatccggcaaatactgggccccacacccacagactggggtatttgggccccccggaggagcaggagacgaagctgcatctgctcccacttccacttccacttccacttctgatgccctggaggagaaggcctggtttcgccccaccagtctcgaggatttcgagaagcctcacacccttccttaa

SEQ ID NO: 61078 - DNA, 219 bp, Glycine max
  Peptide Sequence Number=SeqID_177856
atgtgggtgctcaccaaaacctcatgcgttgctgcaactatacatacacccacttcatgcaccacctccgattgcgtcaagattaaacccgtttcaagctcgtctgatttcaaatggcgcctccatcttcgaatgcggattgatagaatcgaagggatcaagaagctttttttttctttttggagatgcagtgcttgcgcttcttgcagttgtgattag

SEQ ID NO: 61079 - DNA, 1353 bp, Glycine max
  Peptide Sequence Number=SeqID_177857
atggtcgtttatcccacttcatttcatcttgcaacaatcatttgtctcatgcttctccctttacatatctcagccactgagggattcagcgttaacctgattcgaaaaaactcttcccatgcccatgtcctccctctacgtcgtctaatggagttatcagctatggaaaaaactcttactccacaatccccaatatatgcttaccttggtcactatctcatggagctctctattggaactccaccattcaaaatctatggcattgcggacacgggcagtgatctcacatggacctcatgtgtgccatgcaacaactgctacaagcaacgtaaccccatgttcgatcctcaaaagtccaccacgtataggaacatatcatgcgactcaaagctatgccataaacttgacacaggcgtgtgttctcctcagaagcgttgcaattacacctatgcctacgcatctgctgctataacacgaggcgttttggcgcaggaaacaatcacactcagctcaaccaaagggaaaagtgttcctcttaagggcattgtgtttggttgtggacacaacaacacgggtggtttcaatgatcatgagatgggtatcataggcctaggaggagggccagtgtcactcatttctcaaatgggttcttcctttggagggaagaggttttcacaatgcttggtcccattccacactgatgttagtgtttctagcaaaatgagttttggtaaagggagtaaagtgtcagggaaaggagtggtttctacacctttggttgctaagcaagacaagaccccttattttgttaccttacttggcattagtgtggaaaatacgtatttgcattttaacggttcttcacaaaatgttgaaaaaggtaacatgttccttgattcagggacacccccaactattttaccgacccaattgtatgatcaagtggtggctcaagtgaggagcgaggttgcgatgaaacccgttacggatgacccggatttgggtccccagctttgttatcgaacaaagaataatcttcgtgggcctgtgctcacggcccattttgaaggtgcagatgtaaaattgtcgccaactcaaaccttcatttctccaaaagatggtgttttctgcttggggttcactaatactagtagtgatgggggggtttatgtatattttcaacatttagcccttctaatagcgttatcgtgggcaaaggagatgcaatataagaaggtgattttcgaagctgattgtcagagggtggtagcggctatcaactcgaagaagatagagttgaatgaatttggtagcataataagcaagtgtagatctatgctacgtactgaataa

SEQ ID NO: 61080 - DNA, 489 bp, Glycine max
  Peptide Sequence Number=SeqID_177858
atgggcggttgctgtggttgtttcaaagacacttcagctccacaaaacccagcgagagtatcggaggtgcatgtgccacaatcatttcgccaaggttctcctcctgctgtttccgggggactcttaaatgatacttctagacggactcttgactttttcctttccgatttgcctttgggtgtcactcaagaaatctgtgctgaccagaccaatacatcgctgcaaactatagattctacttcaactaaaaaaacagttgatggtgacaattatgagactgggacctcatctaagtcagaaaaactgaaggaatcagtatgcaaaacccagacggctttgaaacttggctcggcaaagggttctgaacttgaacttgcaaagttgggaaaagctgtcatcttagatgaagaggagagtgcatgcccaatttatttaggaggtgatgcagtcacagcttctttattcaacttctttggctttcagcattaa

SEQ ID NO: 61081 - DNA, 618 bp, Glycine max
  Peptide Sequence Number=SeqID_177859
atggttgacgttgatggacgagctgggaagatatttgaggctgaggagttgatacgtgagatgccaatgaaacccgattctgtgatttggagttcattacttggatcttgccggaagcatggcgagactcgcttggccaaattagcagctgataaatttaaagagttagaaccaaacaattcattgggatatgtacaaatgtcaaacatatattcctctggcggtagttttacaaaagctggcctgattaggaatgaaatgagtgactttaaagtgagaaaagagcctgggttaagctgggttgagattgggaagcaggttcatgaatttggctctggtggtcaatatcatccaaacagaggggcaatattaagccggcttgagatagtgattggacaattgaaagagatgggttatgtgccagagcttagcttagccttgtatgacacggaagtggagcacaaagaagaccaattgtttcatcacagtgagaagatggcattggtatttgccataatgaacgaaggacaaggtacagcggtaaccttcaataacttacccactgagaggcatagcaatgatccccgcattaacaaattaggtaatgtcatggcataa

SEQ ID NO: 61082 - DNA, 546 bp, Glycine max
  Peptide Sequence Number=SeqID_177860
atgaagaaccaacacggttatgtgccacctgcttacatacctttggggcagtcagattcagaggcagtggatgtctctctgcttagtaccaatggatcaaaccaaatgcaggctcagtggtcttctggcatctgtgcttgttgcgatgatatgcagagttgttgtattggttgtctttgtccttgctttctctttgggaagaatgcagaatttctgggttctggaactttcctaggatcatgtgttacccattttatattatggagtgtggttaatacagcctgctgcttattaactgatggcttgttttggggattaccgggatgccttgtttcatgttatgcttgtggctaccgcaaggctttaaggtcaaagtataatttgccgtactcaaagatagtgaaaggaaagtttcttgattttgaggaaggcaggaagcaccctgtggggattttgttacccatttttgctgtcatccttgtgccatctgtcaagagtaccgtgagatacgtgaaagatctggggattgtgaagccacagacttga

SEQ ID NO: 61083 - DNA, 378 bp, Glycine max
  Peptide Sequence Number=SeqID_177861
atgggcgaagcgaaggcgttggttccggaatcggtggtgaagaaggagaagaggaacgaggagtgggctttggagaagaagcaggaactcgatgccgcaaagaaaaagaggttcgaaacgcggaagctgatttttaacagagccaaacagtactcaaaggaatacgacgagcagcaaaaggagttgattaggttgaagcgtgaagccaagcttaagggagggttttatgttgaacctgaagctaagctcttgttcatcatcaggatccgtggtatcaatgccatggatcctaaaacaaggaagattctgcagcttctgcgtttgagacagaggccaagtaaattacagtgcagtgatcctgaaatgctgattccttga

SEQ ID NO: 61084 - DNA, 972 bp, Glycine max
  Peptide Sequence Number=SeqID_177862
atgggaggatcaattgctgtgcatgttgctgcaaggagatcattgtccaccttggctgggttgcttgttgtggatgttgtagagggaacagcaatgacttcactaattcatatgcagaaaatcctatcaagcaggatgcaacatttttcaagcattgaaaaagctgtgcatggttgtccatggtgtaggagccatgtgcctggaggcaagaaccaagcacaccaaaagtgttcatttgtggaagttgaaaatgcttccgtgcagattgaatggagtgtcaggggtggctctttaagaaatattgattctgctcgtgtatcaatccctgccacgttaaagtatgatgattcaaagaaatggttagtaccactcttagcctttcagaatatcgctatctttaccgaactgagctggaaaagactgaacaatattggaaaggctggcctctcagataaatttttgtcatgtcccgttccaaagctgttgttattagcaggaacaagaatgcccagttggataaaatcggtaaagttgattggacatgtacataggccgttggaagcacagggggagagagtcgaagaaggacattggaggaacgaggaagtcgttaagagagatctaatggtgaataatacctctaaagatttggaaacggtgttgtgtgatcaaacggagccgaagcctccctcgctgacagggagggctcaactgaaggcgtgtgtggcggatttcaggtcggaaaaggagaagagatggagatcattggcacaacgctgcgccaagaagtggtggaagtccaccgtgtcggagaactccgttgactcggagtcgaagtgggagcgactgttgctgcgcgtgtccattaggctcagcgaacaagcccatgacacgcgtgaggtagagccgccgtgcgaactcgctgccgctcctcccccaacgaaatcctcatcttctccgtttgagaaatag

SEQ ID NO: 61085 - DNA, 2897 bp, Glycine max
  Peptide Sequence Number=SeqID_177863
atggatattcactccgttttccgctctatgcaaatttcactgtcatacaatcacggtaaccctcttctacgcatccctcgtgcaattgttacccaatgtagtaaaaaatccaactttcttaagttccccaatcgctgggttcgaaacaagggtgttaaagaagtgggttcagaatttgatagcaaaagcaaaacaatgctttttaagattcctgatattggggaaaatgaagaactctccagtaatttgtgcagccaatttatctgtgaatgttgcaaagaaggagacttggacagagctatgtctcttctatctcaaatggaagctaaggggtttcacctcagttccacagcttatgcttgtcttattgaagcccttggaaatgttggaaggacttcagaggctgatatgttgttcaaggaaatgatttgtgatggctataaacccaaactgaatttttacaccagtttgcttagagggtttttgaagaaaggtctgttaggacttgcaaatggggtcttgaaggaaatggattactcaggcatatggaggagtaaagagacatatcagatctttctggattactatgttggtgctggaaggttggaagatacttggtcaacaatcaatgtgatgaagcaaaaggggtttccacttaactcatttgtgtatagcaaggttgttgggatttatagggacaatgggatgtggaagaaagcaatagaggttttggaagagattagggagagggggatttctttagacattcatatttgtaacagtattattgatacctttggcaaatatggcgaattagacgaggcgttgaaattgtttaagaaaatgcaagaagaaggtgtgaggccaaacatagtgacatggaattcactcattaagtggcactgcaaagaaggtgatttcatgaaatcctttcatttgtttactgatatgcaagagcaaggattatatccagaccctaagatctttgtcaccatcattagctgcatgggggagcagggaaagtggggcataataaagaaatattttgaaagcatgaaaatcaggggaaacaaagaatatggggctgtttatgctgttttggttgatatatatggacaatatgggaaatttcagaatgccagggagtgtgtacaagcactaaagtccgaaggtgtgctagtttcaccgagcattttttgtgtgttagcaaatgcttatgctcagcaggtcattatggtgctgcagattatggaagcagagggaattgaaccaaacattgtcatgctcaatatgttaatcaatgcatttggtaatgctggaagatatatggaagcaatgtctgtttatcatcatataaaagaaagtggtgttagccctgatgtggtcacctacactacacttatgaaggcatttataagggccaaaaagttcgatgaggttcccattatttacaaggaaatggagaatgatagatgcactcctgatagaaaagctagacagatgttacaagttgctttaatgtttgaagaaaggaaattgaggttttctacaatgtcctccctttccaatgaaaataaggatccttgtgtctgcagttttggaagggcagcagttcatgttgatgtcatctctagaagcttaaggaggatacccccagagatattgatcgtcgtattcatcaaggaatccgtttttgctttgctatccaaggaatctgttggccctataaatgaatccaccaaaaagattagtattaagcctgagtcaacagtcaccgataaaacaacgacgtctgcaaaacaaggcatgatggtacttgggggtgcgagcaacttctctgcattgatgttatgctccagaaagcttgtgcgttatgtgtttttcaaacgttgttttttgcggaatctttgtagttcaagtgcagaaccagaaaccatagccacaaacattgatgctcagatacgtgctctttccacacaaggcaacattgaagaagctctttcacttctttacacccactcttctctgtcccttcaaacctatgcctctcttttccatgcatgtgctcagaaaaagtgcctccaacatggcatgactctgcaccattacgtgcttcacaaagaccccacaatacaaaatgacgtctttctcaccaatcacatcataaatatgtactgcaagtgcggccacttagcctatgcccgctacgtatttgatcaaatgtcacataggaatattgtttcttggactgctctcatttcggggcatgcccagtctggcctagtcagagagtgtttctccctcttctctggcttgctggctcactttcgtcccaacgaatttgcttttgcaagtttgcttagcgcgtgtgaggagcatgacattaagtgtggcatgcaggtacatgcagttgctttgaaaatttctttggatgccaatgtatatgttgcaaattctcttattacaatgtatagcaagcgctctggttttggtggaggttatgctcagacaccggatgatgcatggaccatgttcaagtcaatggagttccgtaatcttgtatcttggaattcaatgatagcaggtttcaacttcgtggacttggggacaaagccatttgcctctttgcacatatgtactgcaatggaattgggtttgatcgtgccacactacttagttggtcttatttctgaaattgaagtggtaactgcattgataaaatcctatgcaaatcttggaggacacatttccgactgttatagaatattccatgatacaagtagccaactggatattgtgtcatggactgctcttatttctgtatttgcagaacgggatcctgagcaggctttcctcctttattgccaacttcaccgtcaaagttatttgccagactg

SEQ ID NO: 61086 - DNA, 120 bp, Glycine max
  Peptide Sequence Number=SeqID_177864
atggcagttgtaaaggcatacagggcatgctattcagatacctggcccacgcaagccagccttttcaaaaccttgaatctggtgttcgatagaccaagaatgaccaccactgcgagatga

SEQ ID NO: 61087 - DNA, 159 bp, Glycine max
  Peptide Sequence Number=SeqID_177865
atgttacttcccgaaaagggtataaaggaagagattgtgatggctcttgaggatgaatctgggtttgagattattgataatcaaatttacaagatcaactttgaaacttgcagtggagataaatattatcagattcaaactggtcatcgactcaaataa

SEQ ID NO: 61088 - DNA, 201 bp, Glycine max
  Peptide Sequence Number=SeqID_177866
atggcgtcgttcgatcaggcacctcccggcgatgtcaaatccggtgacaaaatcttcaggaccaagtgcgctcagtgccacaccgtcgaaaaaggtgccggtcacaagcaagctgaaaccgtgcaaaagcaatatgcgcttgaaaccgattgctcgttggtgcgtagcactttcagttcgatgatattaaaattctactaa

SEQ ID NO: 61089 - DNA, 729 bp, Glycine max
  Peptide Sequence Number=SeqID_177867
atgttgaagctttcgtgcaatggcttggaccgggctcactcgctggcccaatgcggctttgcgggccggcccgcctgcgtcgtccctcgccggaggataagcggcgtctccggattctggtcgccgggcggcagggcgatccgggtgtcggcggcggtggtgtcggcgaaggatggcgcggtggcgacccgggtggaggcggagtccgggacgctggcggaccggctgagggtggggagcttgacggaggatgggttgtcttacaaggagaagttcattgtgaggagctacgaagttgggatcaataagactgccactgttgaaaccattgctaatctcttgcaggaggttggatgtaatcatgctcagagtgttggatattctactgatggttttgcaaccacccctacgatgagaaaattgcgtctcatatgggttactgctcgcatgcacattgaaatctacaaataccctgcttggtggtttgaaaagtctaagctaaacgattccaacaggagtgacgttgttgagatagagacatggtgccaaggtgaaggaagggttgggacaaggcgtgattttatactgaaagactatgcaagtgatgcagtcattggaagggcaacaagcaaatgggtaatgatgaatcaggacaccagacgactccagaaagtttctgatgatgttaaagaagagtatttggttttctgtcctcgagagcccaggtag

SEQ ID NO: 61090 - DNA, 117 bp, Glycine max
  Peptide Sequence Number=SeqID_177868
atgtttattcttgtaatgaggtatattccagggacaaagatggtatttcctggtcttaagaagcctcaggaacgtgctgatcttattgcatatctgaaagaatccactgcacagtga

SEQ ID NO: 61091 - DNA, 969 bp, Glycine max
  Peptide Sequence Number=SeqID_177869
atgtcttttgtttcctttctctgttttttctctgttgataactctgaacaacattctaatgttccaaagtttggcaatcaggagagtgaagacaacgttttagacacagctcattctgacaaagcccagaaaggtcagtctggttcaaagatgattaatccaaatgacaccaaggaaaattcggacatagtttcttctgctgacctaccccattcaaaacccagagttcattcagaggatccatctggaaagggatcagtgagaacaacacatgagttacaaaagagtagggaggatggtgatcctaaacaatttactgactctccagctcgccatggtggcggtgattcttcccatcgaggtcatggagtaggttctgctgacaaccgtaaaagaccttcaagacaaagtactgggcctgagcacaacattgaccgttcaccccttcatcgccaggcaaaaacccctggcagagatagtccttcttgggaaggaaaaaattcatatgatagcagccatggtaccccaggaaggtcccgattgagaccatcttaccgaggggatgaaactcctgatgaaggtgctgctgttccaaagtttggtgagtgggatgagagcaaccctgcatcagctgatggctacactcacattttcaacaaagtgcgggaagagaaacaagtgggggctggacacgtgccaggcacacctaatgggagacaatatgctgctcggaatcaacgtgccaacgacaaagctcagttgtcaattcttgttgacctttatgctcccccaccatccttctttgcacttttgttattgctagaccatatgttaattcgtttaatgaaagcaccaagttgttatgagcaaaagttctgctcactggttcctagaattcgaggactaggagacctccagaaaagggagattaaggagaggaattttttgattatattgcttgcccattag

SEQ ID NO: 61092 - DNA, 1779 bp, Glycine max
  Peptide Sequence Number=SeqID_177870
atgagagagcaaaacgttgagtcgttctacgctaagcttcgccaaaccgcgctatcttcttcctcttctccggttctcattttcccctcaacctccgatgtcgactctctctgcgctctgaaaatcatttttcacatcctcgaatccgattccatccaatacgcgtgctaccctgtgtcgtcttttcatgagatccacaaatacacaaattcctcctcaaacgacgagcctctctccgtcgttttggtcaattggggcaaccacagagacctcagcaataccctaaacctcccctccaacgcccgcgttttcgtcgtcgacagccaccgccccatccacctccgcaacctcagcgaccagaacgacgccgttgtggttctcttcactaaagaggacgagggacaatccgatcttgcttacgatttcgacctcaccacactcgccaacgccgccaccaccgtcgattctgattccgattccgaatctgagtccgaatcggattcggattccgactccggctctgaaaggactggatctagaaaaaggagaaagaagaaccctcaggatgatgatgatggtgatgatgaagatccaattaagctctaccggaagctgaagaaaggctattacaaattggggacgtttcacgggaagccctccgggtgtttgatgtatgaactcgctgacaagctcaggaagaacaccaacgaattgctctggatcgcgtgcatttccctcacggatcagtttgtgcacgagagattgagtgacgagaggtaccatgatggagtcatggagctcgagcagcacataaacagttctggtaacctggatgcggttacttcggttactctcaaggatggtaccaagattcgtgccccgaattctttgcggattacttatgaggaccagccgaggcttatgttgttgcaggagtggagcctctttgactccatgatgtgctcctcgtacattgccaccaagttgaagacgtggagtgagaacgggataaagaagctgaagcttctgttcgggacaatggggtttgctcttggtgattgccagcagaagtttcagcacatgaatttggaggttaagcgcaagatgaagaaggagtttgagaggtttttgcctgagtatgggctcactgatttttactacaggagtttcattaggactctcaagtatagttctaagatttctgctgcggatgtggtgtatggtgtgactgccttgcttgagtcttttgttagatctgatggttcttgtgcttctaagcagtttggtgtggcctatgatgcgctgtctttgaacaatattgacaacttgagaactgggatgcatcatgccattaaaattcagagagcaattttaaggcaagggagtgctgcaattactaagaatgggtgtataaggagtgggaggagtttccggtggctgaagctagaggattcaaatgatgctacgctgttggggtacccgcaggctttgactaagttctgttattttatcatggatgctttgcgagagaagggggccaaaatgaagcctttgatttgtgcttgtgtgtctcaggagccagggaaggtgctgattgtgggggtttgtgggaggccgcgtttgggtggggctcaaggcaatgcgtttgggattgcgtttaggactgcagcagaggagattggaactgagttctttcatgagttatttgaatcctcatggattgttctggatgcttcagctgtaaattcattcatggttaggttgaccaagaagctgtga

SEQ ID NO: 61093 - DNA, 333 bp, Glycine max
  Peptide Sequence Number=SeqID_177871
atgattcagttgttgttcttggtgatttttgttgagggggttctggcatttcttttgttggtgaagataggacctttgagagatcttgtgataaagagcctggatcagttgaagatggggaagggtccagctacagtgaaaaccattgctggtaccatgtctgtgattcttctttcaagtctcatgagcattatcaagatccagaacaaaggtgctaaactcggtactatgtcgcccatggatcaagttctatggagatctcacttgctcgaggcttcactcatggtacactttatgatttttcttagttttgaggcaccaagtgttgcatag

SEQ ID NO: 61094 - DNA, 204 bp, Glycine max
  Peptide Sequence Number=SeqID_177872
atggaggcacgtaaagagaggatggagcaagtaaagaaagaagagatcaaaggatcaaggaatactagtaaagaagagaatgcaacaaagggtgatacagtgagcaaaagggtgattcgtcttgttgctcattggaattcactcttgctactgccagagctagtgacttcgtctaccacacttggatccttattattagagtaa

SEQ ID NO: 61095 - DNA, 219 bp, Glycine max
  Peptide Sequence Number=SeqID_177873
atgaagtcaagtgacatgcgggggtaccgtatggttatctgcacctttcgccaaccaggggcaaacgagcccattgacgcgcagagactaacgttgtcttctgcaccttctgtgatcctgacccgtgaagtcaggtgttcctttcgtcgtccagagacattcaagtccgacgacgcgcaagattcttctctgctaggcagggacaatcgagttcgatag

SEQ ID NO: 61096 - DNA, 555 bp, Glycine max
  Peptide Sequence Number=SeqID_177874
atgccttcttctagttcaagccatgttgttggcgctgcttcctctgcataccgtggcgtccgcaagaggaaatgggggaagtgggtgtcagaaatccgcgagccaggaaccaagacaagaatctggctcggcagtttcgagactcccgagatggcggcggcagcatacgacgtcgcagcgttgcatttcaggggccgcgacgccaggctcaacttccctgagctcgccagcaccctgccacgccccgtcagtaacaatgctgaccacatacgcatggcggcgcaccaggccgctctcaggctccggacaaaccccgccgctcccgacaccgctggctccgccggttcctcctcctctgctcccctcaccgtgaggctctcccccactcagattcaggccatcaatgactcccccatggactcaccacaaacttggatgcaaatgcctgacactttcatgatgcatgatcagtccatgatgttcgcaagcaacggctattcgtttgaggacaacgagtgggagcatatgcagaatgattctctttgggatccttag

SEQ ID NO: 61097 - DNA, 402 bp, Glycine max
  Peptide Sequence Number=SeqID_177875
atggataaatattataggataagtattggaagttttacattattccttggattcctaattgatcgtacccaccattatcttcaaaaacttattaatttaaggagtaatgcgggagcttcaaaagaagaattggaaaaccttaaaaaagaaactgtccaacttaaagaaaaggatgagaaagcatccaaggagattaaacagctaaaggaagaactttcatgtctgtccaaaagtttggaaaagattaaatcggaatctgaagagaaggataagaaagtcgagaccgccgaagcacatgttgcttccctccaaaagcaagctgcagatctactacttgaatatgatagactcttagaagaaaaccaaaaccttcaggctcaaacactgggacataagagttga

SEQ ID NO: 61098 - DNA, 1677 bp, Glycine max
  Peptide Sequence Number=SeqID_177876
atgtacacactcactctcaaagacacaattctgggccacataaagagatgtttcagcccaaaatcactagaatcggtatatgcctccatgatcaagactaataccacccaagattgcttcttggtgaatcaatttataagtgcatgttcaaacctttcatgcattaatttggcagcttcagcttttgcaaacgtgcaaaatcctaatgttttggttttcaatgcattgattagaggttgtgttcattgctgctactcagagcaggctttggtgcattatatgcacatgctgaggaacaatgtcatgcccaccagctattccttttcatctttgatcaaagcttgcactttgttggtggattcagctttcggcgaagctgttcatggtcatgtttggaaacatgggtttgattctcatgtgtttgtgcagactactttgattgagttttattcaactttcggtgatgtgggtggctcaagaagggtgtttgatgatatgcctgaaagagatgtttttgcttggacgacgatgatttcggctcatgttcgggatggggatatggcttctgcaggcagattgtttgatgagatgcctgaaaagaatgtagctacatggaatgccatgattgatgggtatggaaaattagggaatgctgagtctgctgagtttttgtttaaccaaatgcctgcaagggatattatttcttggacaaccatgatgaattgctattctcggaacaaaaggtataaagaagtgatagcactttttcatgacgtgattgacaaaggaatgattcctgatgaagtgactatgaccaccgtcatttcagcatgtgctcatctgggtgcccttgccttaggaaaggaggtacacctttatttggtgctgcaaggatttgatcttgatgtgtacattggatcttcattgattgatatgtatgcaaaatgtgggagcatcgatatggcccttttggtgttctacaaattgcaaactaaaaacctgttttgttggaattgtatcattgatgggcttgcaacacacgggtatgtggaagaagcactaagaatgtttggtgaaatggagaggaaaagaatccggccaaacgcagttacattcattagtatccttactgcttgcacacatgcaggatttatagaagagggtcgtcgctggtttatgagcatggtacaggattattgtatcgcacctcaagttgaacactatggatgcatggttgacctattgagcaaggctggtttgcttgaggatgctttagagatgatcagaaacatgacagttgaacctaattcttttatatggggtgccttattaaatgggtgtaagcttcacaaaaacttggaaatagctcatattgcggttcaaaatctgatggttttggagccaagtaacagtggtcattacagtctccttgttaacatgtatgctgaagaaaataggtggaatgaggttgcaaagattcggacaaccatgaaggatctgggtgtagagaagagatgtcctggatctagctgggttgaaatcaataagacagttcatctatttgcagcttctgatacatatcacccttcttatagtcaacttcacttgttgctagctgaactggatgaccagctgaggctagcaggctatgtccctgaactggggtctattttataa

SEQ ID NO: 61099 - DNA, 249 bp, Glycine max
  Peptide Sequence Number=SeqID_177877
atgtatgctgatcgggtggagagtggaactcggagatcagtgaaggaacgccttgatgggaattttagcactgattctactcgccaacacagaattacgggaaagagaaaatgcacgattgagcaattgtggaattgccttggcctggagctctggacctgggaggatgccttcataggtgaaattgtgggtaaatacttggctcgggtggggatttatgatgatgtagtggctgatattgaggattga

SEQ ID NO: 61100 - DNA, 1932 bp, Glycine max
  Peptide Sequence Number=SeqID_177878
atggcggaaatctccaattcgccaccgacttcaaatcccgtcgaagaaaacacccaaactccgaaaaccacgcgaaacacaaaacccggcgtcaaacgcctcatcatcagcgtcactgtgctcttctcattcatcctaggttttcctcttctgtggaaatccgttaaaatctaccgcgcgccgctcccgttcgatcgagtcgactccttctcctcccaaatcgaatccaaacccttgtccttcccatgccgctttctagccatattcatcggcttcgatttcatggtttcaaacggaaatgtaggagccgcgattgagagaaaaatgtcggacctaagtcacggcggcgattgcggcggatgtggtggtaactactctgtttccgtggcggtgggcgggggaggcattgatgcggtctattttggcgggaagttgcggggtaatgacgaggatgctgatgaattggtgaagagtgtggtgagtgagtatggaggagggaatatgtatagtgttgtggtggtgaatgaagagggggaggtgaggagtgtggtggggaagcataggcatgcgtggatcgtggggcgggttgaggaggaggaggcggtgtggcgtgcggctgagatctttgtagaggtttttgttaatggtcgggacgaggagggttcggttcgcagcgagtttatgcctgttggtgctgatgggaggattgttctctctttcagtttgctcaatgcagaccctcgagattggatatatgattgttctgagggatggaattattcgcaagctgatggcttagtagaaaaaacttgttggcatgttgatacttttggagataaggcaaatattaatgatgctgatgttaaatattcaatcaacctgctatataatgtagggctgtcttttcctgtcaggaattttcgcgaaattgatgagactttgttgtggcctgtgattgaggctttacaacctatagcaaacatcactgttgaaagccaggttttgtaccatacaccaaagtcttcattttctaactgggatgataagcatggcagccacatatttagaaccgaggatcttcctttctttgtgaattcaaatgagtggcacttggatacttctgttgcagctggaggaaggtatataccatctgcaaaggagtgtcctcttcaactggagctttcaagtggggagatctctaaaactaacggctttatatctccaatgtggggaggtgtcgttgtctggaatccccgaagctgtataaaagatttggaaagtagggatccagttagacatacgatttcttctcagatatacttatgcatgtttggcaattgcttagttttagtaaataatcatttaaaaatatatgctcatgaagctggcaaaaaatgcatgcctattctgaaacaggatctccagaagctttttgaagttctcatggggcagttgcggcaactccttggtctgaagtctgataacctttatgttggtaagtcaggtgcatccattctcctaggcagtgaaagaggtttcacagaatgggagttggatgttttgtcacggaagcatatatgctttaatcttcagtcatgtgctactacgcttggatcactttctagattggtacagtcattgccaaggatgattatcatggatgagattggaaaacaggttaagttttctcttgaggctgcaaaatctgctcaaagtaatgcatctattggaatatatgatgcttcagctgccattttttctgccagttactatgcatgtcctcctagctgctttacgagaatggaaaaggtacaagcaagaaaaaaagaagtacttggcatcgaaggacaaagtaaaagtttcataaatctgttgagcagtgataacaagatgaagctagtttcctgggatttggggcctagcgtgtggtga

SEQ ID NO: 61101 - DNA, 1584 bp, Glycine max
  Peptide Sequence Number=SeqID_177879
atgtggtatcagagctcctctcatgaagagttctgctgtgcactcaaattcacatttcagtttctcttcttcttgactccattcaccatgaacgaattaacaccaaacacaaagagttatctctaccttcatccaagcgaaaacccagttgtagcccttgtctcgccagctttggattcaagcaattatcactcatggagcaggtccatggtaaaagcactgagcgccaaaaatacagtggaatttataaacgggaatgcgccggaaccactaaaaaccgataggacctatggagcatggagtcgttgcatcaacatggtggtatcgtggatagtgcactcagtatcagttgcgataagacaaagtattctgtggatgaacaaagctgaggaaatatgggatgatctgaaatctcgatacgcgcaagaagatctcttgagaatctctgaccttcaacaggaagcttcatcaatgaaacaagctcaacaagaacgtcagctatcaggtactaattccctcccaaacttcaaccttgaatcaaaagaaagcgcttcgatcaatgctgtcaagattgtttgcgaattttgcggacgaattggccataccgagagtgtttgttacaagaaacacggtgtgccttcaaactatgaaggaagaagcaaaagttacaatacaagaaacggaaaaacatgtactcactgcgggaaaataggacataccatagatgtatgccataagaagcacggatttcctccaggatacaagttcggcaatggcaaagtggtagcaaataacattgtggcagtagaaggaaaagccacgagtgaccaaatgaagcgccatgagtctcaagatttggttcgcttttcaccagagcagtaccaagcattgctcgctttaatacaacagccatcttcaggaagctcagcctctacccaatcacagattgcctccatctcttcatgctccactaacaccacaacagattcaggagcaactgaccacgtctcctcttccttgaccaactttcattcatatcaccaagtcagtcccatcatggataccaacaccaaagcgaagattggtacagttgaaggaatcatccatcaaaccacttgtgttgaaactcccaagcaaaacggcattgttgaaccatacttgattaattgcattcctactccctttttaaataaaaaatctccttacgagaagttatatgcgcatccatgtgacatctccaatcttcgagtctttggttacgtgtgttacgtgagtaccctcaaatcccacagacaaaagcttgaccctcgtgcccacccatgcatcttcattggtttcaaaccacacaccaaaggatatcttgtatatgaccttcattcccatagcatcactacatctcgtaacattgtcttctatgaagaccacttcccactttttcctgataaccaaaccttacccacccttcattcttatatatcaccaattcctttctcaagtaaccccgataaatttgactctcccatcccacctagtgtcaatccatcacccctcacaccacttacccttccctacgccgctccatga

SEQ ID NO: 61102 - DNA, 277 bp, Glycine max
  Peptide Sequence Number=SeqID_177880
ttgtgaagatcgcaaggtcactgctcaagatcttcgtctgaagcttcaaaagaaaggtcttcatcctggaggtcaaactggaaaaagttctgttcatggtgagcgggatctccgtgaaaggctatcagggacaatgactcaacaacctaaaaactatgacccaccaaagcctaaagtggctgctagagctagcagtaaaagtattgatgttgagcctgcagtacatatcaaaagatcagctactaaaaagttgtcccgaaagggatgtcaattgtag

SEQ ID NO: 61103 - DNA, 984 bp, Glycine max
  Peptide Sequence Number=SeqID_177881
atggaggtgcataactttgccaataacaataaccatagcccactaatgtgccaagctcgagagtctaaaattcaaatcctagcttgggttaacttagatatgagttctctatttttaattttccttatccttcttgttgccgatggggtccttgtccgaggaagtataaatattacagaaataagcttcgatcaaaactatgaggttacgtggggtgataatcatgttgtctccttaaaccaagggaaagaaattcagctcacaatggataactcttcagtaatacccttctcgttacaagaaggatccggttttggatccaagatgtcatatggctctggactattccatttgaggatcaaagtaccagataggaattctgctggagttgtcacagcttactacttaacttcacaaggaagaagtcatgacgagttagactttgaattcttgggcaatagagaagggaagccatatagattacaaaccaatgtgtttgtagacggccaagggaatagagagcaaagaattctcctttggtttgatcctactgcagattttcacaattatagaattctttggaatcaacaccaaattgtattttatgtggataacatccctattagggtatacaagaataaaagcgatattggagtcggatacccaacaaagccaatgcaaatacaagcatctttatgggatggagatagttgggcaacaaatggtggcaaaaccaaaactgattggagctatgcaccattcagagcaagtttccaaggctttgatgttagtggttgtcaagttccaacctcaaatattagccaaaattgttcttctgataagtactggtggaatacgcagaagttttggcggttggattctgtacgacaaagacaatatgaacgtgttaaacacaagtatatgacctatggttattgtgctgataggaatcgatacccagagattcccttggagtgcctttaa

SEQ ID NO: 61104 - DNA, 672 bp, Glycine max
  Peptide Sequence Number=SeqID_177882
atggctcatctgcacaagcaacaaaacttctgctttgtccttctatttgtggcactgaccatagcttatgctagaaaagcaattgaagttagcttccaacagaactacaaggttgtatggggaaagcatcacgtcttctttgtacagcatggtagagaagttcaactctcaattgataagacttcaggggctggcttcagatcaaaattggaatatgcttctggattcttccaaatgagaataaagatacccaacaaggacacacacacacacacattttacgtggatgaaataccaattggagtattcaagaactactccaacgtggaagtgagttttccttcaaaacaaatgcacgttacggctagcatatggaatggtgaaccttgggcatctaatgggaagagaattgactggaagcaagcacccttcactgctcagtttcaaggtttcaacattcatggctgccgaacccaaaatcgcaaaaaacatgcctgctattctccttatttatggtggaatgacaaaagacattgggaactaaaccctcaacagcagagagcgtatgaagatgtggggaagaaacatttgttgtatgactactgttctgatagagccatagaggagaattgcaccaagaatgtcaaattaattaggtcattaattaattga

SEQ ID NO: 61105 - DNA, 576 bp, Glycine max
  Peptide Sequence Number=SeqID_177883
atggtgttttttctgttccctaatgcttcgttagaacccgaaatgaagatgtctttgaacgagaatgagaatgagagtcagagtgaaggtgtccaagttgaaagtctttgcttctcgatcccctcattgaaatggttcgagctttgttccgatgaacaggagttcaatgttgttgtgaaggcagaaaatcttgtcaactttgtatgcgatcttgagggattgcacaaggttaccttagatgccctaaacctgaagtccttgacagttatgggtgatgttcttcaagttcacataactaaaagcctattctctattgaagaggcagtgatagaagcagaactttgtttctatttgacaagtcaggttgcaacatgtgaaattactcagtttgtcagagaacattatgaaggtgtatttcttttcgcctgtctggctctctatgtttcttcaatgacaataccaacttccaggaacttggtcaagctagagcttatccctgactattgccctgattttcgccgtagctgcatctcacatgtgttattgaaattgtttgaaagtgcttatcttcaatga

SEQ ID NO: 61106 - DNA, 349 bp, Glycine max
  Peptide Sequence Number=SeqID_177884
tctcagtttcaattacaaatgcaatcacagggactcgcattgcctcctgagcctgaggttggtccttcatttgctcatggttccaccactattctcagcatccctttggacaatgatcaagtcaaggttggtgttgaggaagttcgagatgcagatgctcgcattccagtacccactcaagaggttcagttagtggggcaaacacttaacatcttccttgcttggccgacacatcttgtcaagcgttactcagaacaagttatgtgggatgctaccgtgtttgggatgtttaatgacaacttccccctgtacataaagcatgaagatctgtctgaaatagcacacaatg

SEQ ID NO: 61107 - DNA, 1251 bp, Glycine max
  Peptide Sequence Number=SeqID_177885
atgcaatatctattcgatgagaatggtaggcgttatcttgatgcttttgctggaatagttactatctcctgtggacattgccatcctgaagttttgaatgctataatggagcaaagtaaactcttgcagcatacaacaaccatatatctacaccatgcaatagctgattttgcagaggccttggcatccaaagtgcctggaaaccttaaggttgtttattttgtaaattctggttcagaggcaaatgacttggcgatgctgatggcccgtttatacactggtaatatgggtatgatttccttaaggaatgcatatcatggaggaagttctagtacaattggactcaccgcgatgaacacatggaaatacccaataccagagggagaagttcatcatatcatgaatccagatccataccgtggaatctttggctcagatgccaataggtacgccagagaattgcaagatcatattgactatggcacatcaggaaaagttgctggatttatagctgaaacaattcaggcatgtataatccatccatcatgtttaatttctaaacttcagagtggtatttatagccacacacaccttagtgtgggagctggaggagcagttgaactggcacctgggtacctaaaactggtctatgacattgtacacaaagctggtggtgtctgcattgctgatgaagtgcaatgtgggtttgcgcgcacaggaagccatttttggggatttgagacacagggtgtcattcctgatatagttactatggcaaagggtattggcaatggtttgccattagcagctgtagttacaactccagaaatagcgagtgtgatggctcaaaagcttcaatttaatacttttggagggaaccctgtatgttctgccgggggacttgctgtgctcagagttcttgacaaggagaagcgtcaatctcattgtgctgatgttggttctcacttgattcagcgtttaagatccctgatgcaaatacatgacatcattggagatgtaagaggaagaggcttaatggtggggatagaatttgtcaccgatagaaaagagaagacacctgcaaaggctgaaacaacagcattgcacgaaagattcagagagctcggtattctagttggaaaaggagggctgcatggaaatgtttttaggatcaagccaccaatgtgtttcaccaaagatgatgcagattttgttgtggatgccttggactatgctatatctaagttgtga

SEQ ID NO: 61108 - DNA, 1296 bp, Glycine max
  Peptide Sequence Number=SeqID_177886
atgtatgctggaaatactactttgaaggccaaaggtggcctatctgtagcagttcctggagaacttgctggccttcatgaggcgtggaaacaacatgggaagcttccatggaaaagacttataaagccagctgagtttctagcacgtagagggtttaaagtatcaccattcctccacatgcagatggaagcatcagagtcagatatattggaagacaagggtcttcgtagcatatttgcaccaaatggaaaactcttgaatataggtgacatttgctacaataacaaactagctgagactctcagaacaatatccgagtctggtccacaagccttctatgatggattgattggtcttaatttagttaaagatgttcagaatgctggagggatattgagcatgaaagacctcaaaagttacactgttaaacagaaggaacccatatctaatgatgttcttggactaacgctccttggcatgcctcccccttcaggtgggcatccaatgatgctactgctgaacattctagatcaatataagctcccttctggcctttctggtgcccttggcttccatcgagaaattgaagctttgaagcatgtatttgccgtgagaatgaatcttggtgaccctgattttgtaaatataactgaggttctttctgatatgctttctcatagttttgctaaagtgttgaaaaatgacatcaatgataataagacttttggccccagtcattacggcggcagctatgttactacgcggtttacaacagaacaactatgtagtgaacgacacggtttacaacagaacaactatctagtatctaggcttattcagttagaaccaccaatgtcatttaaccgtcaagtgaagtggaatccgataaatgatcatggtacaagtcatttaagtataatagatcccgagagaaacgccattgccatgacatgcactgtaaattcatattttggttcaaagatcctttcaccaagtacaggaatagtactgaacaatgaaatggatgatttttccatccctagaaatgttaccaaggatgttccaccaccagctcctgccaatttcatcatgccaggaaagcggccactatcatccatgtcacccactattgtccttaaggatgggaagctaaaagctgtagtaggtgcaagtggaggtggtttcatcattggtggaactgcagaagtacttttgaatcacttcgttaaaggactgaatcctttttcttctgtaacggctccaagggtctatcatcagtgtttgtcatttaagtga

SEQ ID NO: 61109 - DNA, 1668 bp, Glycine max
  Peptide Sequence Number=SeqID_177887
atggagggaagtatccggtgctctgcgaactacgttcctgtcactccaatcagcttcttggagcgtgccgccgtggcttaccgtgacaacatttctgtggtcttcggcgacattacctacacatgggcacagacccaccaacgctgcattaaacttgcttcttccatttctcaactcggtgtctgtctttctccccgccatgtggttgctgtattggcccccaatgttccggctatgtatgagttacattttgctgttcccatgtctggggctgttctctgtacgctaaacacgcgtcacgattctgaaatggtttcaacattgctaaaacagaccgaggccaaacttgtttttgtttattatcaattacttgatattgctcaagcagcacttgaaatcctttcaaaaaccaccaccaccaccaccacaaagcttccccttttggtcttaatttcggagtgtggtcatccatcacctccccatgctaaaggaaccttgacatacgaggatcttatagctaaagggacccttgaattcgaggtgaggaggcccaaggatgaattggatcccatcacaatcagttccacttctggaactacagcaaaccccaagagtgtaatctatagccacagaggtgtctatcttaatgctttggtttcgattattcttaacgagatgaggtccatgccggtttatttatggtgcgttcccatgtttcactgcaatggttggtgcatcccttggagcattgctgctcagggtggaactaatgtgtgcctatcaagtgtaacagctgaagcgatattcgacaacatttttaggcacaaggttacacacatggggggtgcaccaacaattttaaacatgataattaattcaccactccggaagccgctttccggaaaggtggcagtgatgaccggcggcgcaccaccgcctccggatgtgatatttaagatggaaaatttagggtttaatgtgactcatgcatatggctccacagaagcctatggtccagcagcaatcaacgcatggaaaccagaatgggacaatcagccacgtgatgcaaaggcgaaactcaagacccgtcagggagtgcgccacgttggaatggaagacctagatgtgaaagatcctcacacaatgaagagtgtaccagctgatgcaaaaaccattggtgaggtgatgttcaggggaaacactgtgatgtgtggatatctgaagaacctgaaggcaacacaagaagcatttaaaggtggatggtttcggagtggtgacatgggagtgaagcatcctgatgggtacatagagctcagggaccgatcaaaggacacgataatctgtgggggagaaagcgttagctccattgaactggaagcagtgatttttagtcacccagcagtttttgaagcttctgttgttgggagacctgatgattattggggagagacaccttgtgcctttgtgaagctcaaggaggggtgcagtgctacagcagatgagataatcctattttgtcagaatcgtttgcctccctttatggctcctcggactgtgctttttgctgatctgccaaagacttcaactggcaagacacagaaatttcttctgagggagaaggcaaaggccatggggagtttctttaagaaaaacattagcagcttataa

SEQ ID NO: 61110 - DNA, 198 bp, Glycine max
  Peptide Sequence Number=SeqID_177888
atggctctatctgacaagaggatgctttatcaagtattccatagctctaacaggattgtaccacgtgtagggaccattatagatgaatttaaggagcttgaaaataaatttcaattacgtatcttttcgtggactcccagatctcttaaaaggggaagcacatgcaatgatgttgctaatggtatgttggatggataa

SEQ ID NO: 61111 - DNA, 1533 bp, Glycine max
  Peptide Sequence Number=SeqID_177889
atgataactctagctccttctcttgatactccaaaaactgatcaaaaccaagtttctgatccccaaactagccatgtcttcaaatcaaaattaccagatatcccaatctccaaccacctccctctccactcctactgcttccagaacctctcccaatttgcccaccgcccttgcctcatcgtcggacccgcctccaaaaccttcacctacgccgacacccacctcatttccagcaagatcgccgccggattgtccaacctcggaatcctcaagggcgacgtcgtcatgatcctcctccagaactccgccgatttcgtcttctccttcctcgccatctccatgattggcgccgtcgccaccaccgccaacccgttctacaccgccccggagatcttcaagcagttcaccgtctccaaggcgaagttgatcataacacaggcaatgtacgtggacaagctccgcaaccacgacggcgcgaagctcggcgaggacttcaaggtcgtaaccgtcgacgatccgccggagaattgcctccacttctctgtcctctcggaggcgaacgagagcgacgtgccagaggtggagatccacccggacgacgcggtggcgatgccgttctcctccggcacgacgggtttacctaaaggagtgattctcacgcacaagagtttaaccacgagtgtggcgcagcaaggcggggagtgcagttttgttgatgcagaagttcgagatcgggacactgctggagctgatacagcggcaccgagtgtcggtggcgatggtggtgcccccgctggtgttggcgttggcaaagaatccgatgctgctcccttggggaaggagctcgaggaggctctccggaacaggatgcctcaagctgttttgggacagggttacgggatgacagaagcagggccagtgctgtccatgtgcttgggctttgcaaagcaacctttccaaacaaaatcaggctcttgtggtaccgtagtcagaaatgcagaactcaaggttgttgaccctgaaactggtcgttctcttggctacaatcaacccggtgaaatttgcatccgagggcaacagatcatgaaaggatatctgaacgatgaggcagcgacagcatcgaccatagattcagagggttggcttcacaccggtgatgttggctacgtagatgatgatgacgaaattttcattgttgacagggtgaaggaactcatcaaatataaaggcttccaggtgccccctgcagaacttgaagggcttcttgtaagccatccctccattgcagatgcagctgttgtcccacaaaaggatgttgctgctggtgaagttcctgttgccttcgttgtgagatcaaacggctttgatctaactgaagaggctgtaaaagagtttatagctaaacaggtagtgttttacaaaagactgcacaaagtttattttgttcatgctattcccaagtctccatcaggaaagatattaaggaaagacctcagagcaaagctagaaaccgccgccactcagacgccttaa

SEQ ID NO: 61112 - DNA, 864 bp, Glycine max
  Peptide Sequence Number=SeqID_177890
atgccgatattctccaattcctcgccctgctgcaccgccgccgccgccgcagtggttaactcctccaaccggaagaccagattcgtctctccttcttggaggaattgcaaggtcacatctccaattttacggctctccgagaatgacaaattcaatgtgtctcggttagctcctagccactctaggcggtcagttaaggaccggaacatatcaatggcattagtgggcgaaactgttggagttggacaaaagggacaggtggccggctcctctagcatcttggcatatgatttgattcagggggcacttgtaagatggagttctgttatggacaggtctttacctgagccaccaacggctgtttttctgcatggaatcctaggttgcaggaaaaactggggaacttttgctaggagattggctcaagagtttcctacatggcagtttcttttagtagacctgcgatgtcatggcgattcagcatcaatccagaagaaagatccccatactgttgcatctgctgctatggatgttttaaaactggttcgagatctgagaataacgccccgtgtgttagttggtcatagttttggggggaaagttgttttgagcatggtagaccaagctgcaaagcctcttgctcggccagtgagaatgaaggtgccagaagttactcctctttctcagaaaataatattggttcatatgtgggatctattttcatacaaggttggggcatggtttaccatggcttggattctggatgcaacccctggaaaagttcgagcaggtggagatggagaagatcatccagaagaactcatatcctttctaagtacactgccaaaggaggtagatctttaa

SEQ ID NO: 61113 - DNA, 1563 bp, Glycine max
  Peptide Sequence Number=SeqID_177891
atgcacaatgttgctcgaatcttgaagtggatgagttgtggatggtgtggcgaagggtcaggttgtgatggtgggagttggctttgggtggcatcgaagatgatgggtctaggtagttcagctacaagggttggtcatttggagttggtgcaattcggaatagagatgtggctaaagagagttcattatccagttgtgtggactttagccatccacagatgcaaaggcaatgcagaggcagacaaagcaagagggtgcttcttcactttctctctccaacaactttcactcccaagctccatggccgcaaaccttttacccctttcaatttcatgctcctctaaaacccacattctctgtcttccctcccctcccaaacccctctttctctgccgccactctctgctccgttaccgttccactccgcgactcacatgtaaggcagcccaagtttcggtcgccgaagagtcgtcggcgtccggcgacaactgggttccggtggtgcctctgtctgctctgccgaagggggagcggcgcgtgatcattcaggacggcgagaccatactgctgctttggtacaaagaccaagttttcgctattgagaataggtcccctgctgaaggcgcctatactgaaggcttgctcaatgccaagctcacccaggatgggtgcatagtttgcccatcaactgatagcacatttgatctgcgaacgggagatatcaaggaatggtatccaaaaaatcctgttctgagagttctcacgcccgctttgaggaaactctttatctatcctgtgaaaacagatgaacagaatatttatatcagcataagaggaggtgtgagatctgatgcttctgctgaaattgtctttagtgggaaggctcaacctggttttacagcaactgatgtcaatgttgatgaggttaaaatgatcgttgatgaggatcaagagggatttggttttactgggaagaacgaaataataaacgggagagcagctgttattggtttcctcctgttgttggattttgagcttttaacagccaagaagttgaagggagttcggcgtcggaaatggggaaagtgggtgtcggagattcgtgttccgggcacgcaagggcgtctctggttgggaacctacgccacgcaggaggctgccgcggttgctcacgacgttgccgtttactgtctgaggaggccttcttcgttggacaaacttaacttccccgagaccttgtcttcgttcagccttcagctcagggacatgtctccgaggtctgtgcagaaggtggcttccgatattggcatggacgttgatgccagaaacattcttgctggtaaaacttcaacggtggtggcggaaactaattacgagagtgatgagaggagtagaactgtgtgtgatgttgatggaggtggtgctgatgagcattctgatgtgtttcggtgggatgctgtggggaatgaggatggagggtcttggcatggaagtggtggagattgtaaagaaagggatcaggccttgagcatttccattgaagattatcttgagctgtcttag

SEQ ID NO: 61114 - DNA, 1553 bp, Glycine max
  Peptide Sequence Number=SeqID_177892
aaattattgttaccgagacagaaatccatgcccagattcaacttctacaattattgctgctgtagatgaaattgaggataacctgtattactttagcgatgttatctctgctggaattcctgatgttgcgaggctaataacagacagcattttgatgcttctgatttttccgttacttcttccttccctgagagtagtggatgctaatgacatgcaaagtggtgttgtcacttctctctacttactttgttgcatcttaaggatagtcaagatcaaagatttggcaaataccatagtcgttgctcttttttatcccttagagacctttacaagattttctaggggtaaagtcaatggctatatctctgaatttggtcttacatccataagccaagaaccagatgatgataatattgccaagggcaatgcaggatgcttgacagtgaatgtgccaaactcttctagttcttcaggtttcgacccagaaagtgttatgtcagaagataattgtagcagttcaaatttggctttaagggaggttttgctttcatatgttactaaaggggatgatgtactagtttggggttctttgagtgttcttgccactctactgcaaactaaagaacttgatgaatcaatgctagataggcttggaattcttccacaacgcaaacagcacaagaaacagttattggaaggtattctaatctctttggttggtggaagaaacaatgatatggtggaggatttgacatgtttacctaggaagcaagctttggttggtgaggcttcaggtgaagatcaacttttttcttctgaaaatagcttgatgagggatggcagtggatgtgagcttgatgtctatcttgaaaagatcaaggagcaatatgggttatcttttctgccttctgattttcttatgagccctcgtgtgcctagatttcaggtgctcgatgcattagtgagtctcttttgccgttctaatatatctgcagagacactgtgggatggtggttggcttttacgccagttgcttccttacagcgaggcagaattcaatagtcatcacctggaattgctgcaagtttcatacaagaattctgctactgctcttgtaaaggaggttagaggtttctggcccgatcttcttattacagttctttgcaatgagtggagaaaatgcaaaaaagcaatggagtcatcataccctcctaaagaaccaaagtgcatactttttccttctcagatgctatcttcagaagaagatatacctgagggctcatcatttgctgctggagaaaaaatgcatgaactagtgaaggtctgtacttattctttgcctgttattttctttaaagtgcactatagcatacatgctaacactgttggacttttcaattctgttctgcaccagcttcaaatattcactctaggtagacctttgcctgagaaacctcttatttatcctcctggtgatctcccagcaaattctcgtgcccaaacttctggacttgatgtttcaggcccaaaaccaggaactgaagtcagccttg

SEQ ID NO: 61115 - DNA, 1365 bp, Glycine max
  Peptide Sequence Number=SeqID_177893
atgcttgaaccacacggtaccccactacttaagcaaactggtgaggacgaaaaagtacttctaaagcccaaaaaagagaaaggcagagaggaaagactttaccgagtccttacgcgttgtttgtgtttgcgtcggaaggaagagaagatgagtgagaatttgatggagaaagtgagcgcactgggagagcgcctgaaaatcggaggcgtggaagtggggagaaagatgagcgaggggatgagctccatgagtttcaagctcaaggagttcttccagcctgggcccaatcaggccgacaagcttgtggaggacgctacttccgaggccctggacgagcccgaatgggccctcaatctcgatctctgcgacctcgtcaacaccgacaagctcaactgcgtcgaactcgtccgcggaatcaagaagcggatcattctcaagagccctagggttcagtacctcgcccttgtcctcctcgaaaccctagtcaagaactgcgagaaggccttctccgaggtcgccgccgagcgtgtcctcgacgagatggtcaagctcatcgacgacccccagaccgtcgttaataaccgcaacaaggccctcatgatgatcgaagcctggggtgagtccaccggcgagttgcgctatctccctgtctatgaggaaacttacaagagtctgagatcgaggggtattcggttccctggccgtgacaatgaaagcttggctccaattttcactcctcctcgttcagtgtcttctgctccggaggctgatgtcaaccttcaacagcagtttgagcatgatattcctgagcagtttcatcatgatgttcccgtgcttagttttacgcctgaacagacaaaggaggcccttgatgttgcaaggaatagcattgagcttctttccactgtgttgtcgtcttcaccacaacaagatgctttacaggatgatttgaccaccacacttgtgcagcagtgtcgtcggtcacagactactgtccagcgaattgttgaaacggctggggataatgaagcagtgctttttgaggccttgaatgttaacgatgagattcagaaggtcctcaccaaatacgaagagttgaagcagcctgcaactactccacttcatcctgaaccagctatgatacctgttgctgttgaaccagacgagtcaccctatcatagtaaagaagatgctttgattcgaaagccagctggatcaaggactggtgtcgagggagggagcaatgatgacatgatggatgatctcgatgagatgatttttgggaagaaaggtggggaagcatcagatgggggacacgagacaaagaagcagccgtcatcgaaagatgatctcatctctttctaa

SEQ ID NO: 61116 - DNA, 357 bp, Glycine max
  Peptide Sequence Number=SeqID_177894
atgaggggccaaagggtcttttcattgagtttcctagaccctagctcgcccaggctagcctctggcttgcctgggcccccaaaagacttctgggtgaaggaactagctcgcctgggcgagccagttagtttaggagtaagcattatctcgcctgggcgagctgtcattgccccaaatgcccgtttttctataaataggcatgaaggggaggctgaggagaggttccaaggtcagaaggtgcgggaattgagagaagagagaaagaagaagaaagaagaggaaatgaagttgaggcgcgactgtgatcaatctctatgttgttctttgtttggtgttcttcatgcgactatcggttag

SEQ ID NO: 61117 - DNA, 417 bp, Glycine max
  Peptide Sequence Number=SeqID_177895
atgacaccaaaaacttgttcgcttccggcaagtgcaccggatcgcacaagtagtataaaacgcgcaattctaaaccgcttagcgcgcattggtgaatttcggcttagcgcaacttttctcgctcaacggatggccctttgctcagcgaacaagcacaactcatccttcttccagattcttcctcgtgctttgccgaggaatgttgcactcagtggatggctcgctaagccagcagattcatttagcacgaggtcgtattcatcgactaatacgagtcttctcgctcagcggatggactcaagcggtacgcttagcaggatgacccttcgcttagcgaacatggacaagtcatccttcttcctgattcttcctcgcgctcagccaagggaatggtgcgctcagcggatggctcgctaa

SEQ ID NO: 61118 - DNA, 309 bp, Glycine max
  Peptide Sequence Number=SeqID_177896
atggagcttgaaaccaaagaaattgtgggtcatgtatgttttaagttgaaattttactcttcactcttttctgcgctgctgctctctctccctcgtgacgctgctcacccaccactgccatctcctcttcgtctctttctcactcaccaccgtctcctcttgtctttctcccttattcgagatccactttgtcgcatgcagttttggagtggtggtcagggattgaagacagagaggctagagatggaggatggtgatgagatagatgcaatgctgcaccaaaccggaggtggacacaagtttctttaa

SEQ ID NO: 61119 - DNA, 894 bp, Glycine max
  Peptide Sequence Number=SeqID_177897
atggctccgaagaaaatttctgctaaaagagctaggaaggccgctacaggggaagggtccagtgcagctccacaagtggaaattgagtttgatggatgtcactttcgaagcaaggagcatcaatgctgttttgaggtgattaaggattggtcttttctcaaagaaagacgggtccagatactagatggagagtctgcggaattccatgccaaagtttccaggaggcattggacacaggtgatagagcctatggcgaagtatgatcctgaagtagtcatggagttttacgcaaacgcctggcccactaaagaaggagtcatggacaagcactccggggtgcggggccaatggatcccatatgacatagatgctatcaaccaattcttagggcatccactgatcttagaagagggacaacgatgcaaatacactgagagaagaagccaattttcaggttttgatgaagaggccatagatcagctactttgctccccgggacatgattttgcgcggagcatagtagggaggcaggtgcggatcatgcacactagcatgaccactctaactcaaatctgcatgacacttctactcagcaacatccttcctagtgaccataactctgatctcacactacccaaatgccagttggtctacagcatcatgacccagatcagtgttcatatggcgcagcttatctcagatgccatccaccagttcgtagatattacacctccgagatacccagtggacccagagaagtccaacagggcactgggattttcaacattgatcacaggtctctgccaattctatagggtaccggtcgcgccgacaaagctcattcagcctcccattaacaggtcattcattgaaaaatattgcatgctaaggtag

SEQ ID NO: 61120 - DNA, 375 bp, Glycine max
  Peptide Sequence Number=SeqID_177898
atggctgattctaaattactgatttatgagggatcagcgaccgtccacaatgcccctttgtgtagttatcaagtgaaggtcagtgttgagaaagttcaagatgttgatgctcgtgttcctatgcctactcaagagggacttgagggaccgccgaaacctatagataggtcggatcttgatgtcaatcccctatacctgatgacattgaccattccacaacttttcctcaagcctttgcaggtgtcatgggatgcaattgtgtttggggtatataatgataacttccccttgtacataaagcatgaagatctttctaaaatagcacacggttgtcatggtctcagcatctttgttatacaaatgtggattctgtaa

SEQ ID NO: 61121 - DNA, 282 bp, Glycine max
  Peptide Sequence Number=SeqID_177899
atgaggttctgcaacgtgatcgtggtgaccacgaccatgaatgtggcagtgtcgaacagcaaggtcgtcgctttgtgggggctcatgccgttgttcgatggcagaacagagaaacaaagggaagggagagaacgcaaagccaatggaaacaaagatacatccacttggttgttcgaagagaacaagggagggtacatcccttgtggatctttggcttgtaaaggattttacaaggtcgaaagaaatctcaagaaccgttggttgcttggggactggatgtag

SEQ ID NO: 61122 - DNA, 362 bp, Glycine max
  Peptide Sequence Number=SeqID_177900
atgttaaatcaagcttctccaacgtcgaccacgccaagcggggcaatggtgctgcctccacgaagcaaaacaccacctaccactgccaaaaacacacaatcaacaacaagagtaacatcatcaacaaagcaacccaatgcctggtggtactctttaattgatgacaacaacaacaacaacatcatcaacaagagtaacaagcggatttcaaaatctaaacaagaaagtttagtacttatgtgggtgttgttaacagtcgaagaaataggcgagaggtgtcatagtcggaggagttattgtcggtgtaacacacgatggtgttggagcacgagcatggcatgctgtggtacaagtcggagatg

SEQ ID NO: 61123 - DNA, 324 bp, Glycine max
  Peptide Sequence Number=SeqID_177901
tctttctgcgtcggagctgttgacgagggggaggtcaatggagagaaggatctggagggaactatcggagtccataagggcatcattgtcgacaaacctgatgaatcagaggaagaagccgagaaggtgataccttcaacaacatttgctactgctcctcttggttcgtgcaacccccacggtctctggagaccatggaggttaatggtggtggcatcgcaagtcatcaatggtgattatggatatgaagaagaaggaggaacaagagagagaaggataaatctaaaaaagaaaaaaacaaaacaaaaaagtcttaaccattga

SEQ ID NO: 61124 - DNA, 987 bp, Glycine max
  Peptide Sequence Number=SeqID_177902
atggaatggttttattgcagtaacaatgaatgtcctgcttgtcgtactcattgttcaagtcgaaggtcactaagggaagaccccaactttgataacttgattggtttgctctattccaacattgacaaatatgaggaggaggtggttttgaagaggatgcaaaaagcctatgccaagacttatgaacgacagagcattgcactgggaaagaagcctgctgctgcaacttctacaaagagatcaaaagctaaattcttaagaagttcatcaagtcgaccaacaagaagaagtcccagaaacattgctgctgcatttgccggatcgagttcgagccgggaaagggccttgcctcctattgctgaagaggaagaaatagaagaggtacccgacactgacataagtgagtcagagatagaggcacagactcctcaacatgtccctgctgcaacaaaaactgtccatggaacaaatgaagcagttaaagatatcattagctctgctgataaacttgtgtggggaaagagtgctcaaaggagtaataatcgaagcaattctaggaatgttgctgccttgagaagcaatcgcatagcgcgattcattgatcatcttaaggtgtctcaagaaaatgatgatgagttggacatatttatcaagcttgtctcttttgaggagaaaagagtgccaaatttgccaaggccataccttagctgcaggcctaccctgtcaatcaagcaactgtgccagtatgttgcccttgaaacctcactacaaactgaagaaattgagttgtacttggtgaaagagtgtcaacctgacattataagtggtgatggcaaactagatgaagacaacaataagtttgaatttctagctgaagaggaagtaacaatggctcaactcaaaactaataatctcagctttggccatctggtcatagcttataagaggaagaggtggaacttaaatgaagggttgtttttgggctga

SEQ ID NO: 61125 - DNA, 1032 bp, Glycine max
  Peptide Sequence Number=SeqID_177903
atgtcagcttccgataacagccgagcccgagagctagccggcttgacccttgacgacgtgttagggaaccagaagagaccttcttcaacacctcccagccaacaacttcccaagagccgaaccctacttgacatcatcaaagaagacgagagcaacaagaaagaccgcagatcttggaaagccttcaaggacaagcttcggctgaagcgcgcaggctcagcttggacatcgacaattcatatcccgacttcggatgttcctatccctaacccgaatagcagaatcttcacccagtttggtcaccgcaactcggtccaatccccgactcagactctgactctgactcactccgactcggacatgtcaactccctacgatgctcgccaagtcgaagacctcgaccccgccgccgccgacgactccggttatccggccaccatgcctcccgccgtccgcccccagtttagccgccgcggatccacccgcttcgacggcgacccctccggcgaaaacaccgccggcacgctccggccgcagctctcgcggcggaactccaccaacatgccgtcggagccctacaagcgtggccgcgtggtgacgttccgcgacaccttcgacgacgaggacgacggcggcgagaagccgggggaggggagggcgctgtcggcgagggaggcggtggcggcgcaagaggcggcagaggcggcggcgcaggaggcggaagaggcggaagagcaggcgccggtgatgatgtcgctgatggacttgctggaggagacggacagggagatggggctcgaaggatcgaggtatatattgagtgatgatgatgaggatgaagatgaagatgatgatggtggagagggttctatggaacacacttgctgtgtttgcatggtgaggcataaggctgctgcttttataccttgtggccacaccttctgcaggatgtgctcaagggagcttatggttagtagggggaattgccctcgctgcaacaatttcattttggagattcttgacattttctga

SEQ ID NO: 61126 - DNA, 921 bp, Glycine max
  Peptide Sequence Number=SeqID_177904
atggattacagcaatgacaacaaggagccatgggattggcatagggaggattattgtctccaaaggagtttcaattatgaaatttcaccagggatatggaatggagtttctcaaaatgaagatctttcctttgtgttcaatgatgaaacaaccccagtgaaggcttgtggggactttgcgtacaatgtcaataatagtgggttgatttcagagtcaaataatgtacaaaaggaatcagacaaatgtttgaagagttcttaccaaattaagagaaggcggatgctacaattcaattctcaagatgggggtcatttactctccaatgaacagatgtcttcagcatatttgaaagggaaggaggagccaaaggaggatgttttccctgaattttcacaatgggtgtctgggacaccaggaagtgcatcagcttccaattatgaggaccttgagtcagctgaagggtggctagcagattgctttaaggatgctgaaatgcaattgtgtcctgatgatttgaatttttctggggcagatgaggttcaagttgatgttgcagatctgggcaacttcccaccagcatgtgaacaaaatgtggttcaacatggcttcactcaaacccccaaaaatatcatcttcaaaggtggaaaatcatttatagaaacacccacaaagctagctgcttctgtggcctatccatttgccttcattaaaccctgtggtgcccatggagatgtcactctgaaggaaataaatcagcgcattctgtctccaccacctcctttgaagtcccaacaacaaagtatggaagatccatcagcttacccaaaatcagcattttctgggaagcccgttgttggaaaaacaagaattcacattgaagggggaaaaggtagcatcaccattatgagaactaaaggctaa

SEQ ID NO: 61127 - DNA, 151 bp, Glycine max
  Peptide Sequence Number=SeqID_177905
atggagatcacaaaaggagatatattgggtgttactacatctttctatgcagctcttgaaaaagatatgacagtgatcgagggatttagagagtgcgaattgattgatttgaatcacacgttagtagccgtggtagtggaatcttgtaaca

SEQ ID NO: 61128 - DNA, 1137 bp, Glycine max
  Peptide Sequence Number=SeqID_177906
atgtctccaatggtggataggattagctctttgccagacacactactgtgtcacattctctcctttttgccgaccaaagaagctattgccactacaagtcttctgtctaagaggtggagccctctgtggctctcagtctccactcttcgcttcaacgaccaatgctatctgcaaaacaaagacacctattttcgttttcttcaattggtctacacagttatgctctcgcgagatgtggcacaacccatccaaaggttttaccttgcatgcatgtcttcactttgtgacacttcaatggtcaacacatgggttacgaccgtaattcaacgcaaagttcagcgtctcgaactttctctgccttctaccatcaacttgccatgttgcattctcactagcacaacccttgtggttctcaagttgagtggtttaactgtgaaccgtgtttcttcttctcctgttgatcttccttcgcttaaagcacttcacttgagaagggttcatttccttgaacttagatggcttcttcagattctgtctgcatgtccacttcttgaggacttgctcataagatctttgcatgttactaacttttccagtgatgagcagttaaaaaggttaccaaaattggtcagagcagatatttctgattcgtttatatatattcctttgacagggttttatcatgtggagtttcttcgaactgaagtggcatggaatttatttttcgataagaatcacacttttttcaatttaagctacttggagcttaagttcatctgtcagttccatgactgggattggttaattaaattgcttcatcaatgccccaatcttcagattcttgtaattgacaaggaaaatggtttcaccaaaacaagtgtggacgaaaattgggtatatccacgatttgttcccaaaggcctttcatcaaaacttaaaagatgctgtgtcagaaattatgaaggacaggaaggtgagcttcaatttgcaagatatattatgcagaatgcaagagttttaggcgccttgaccatttgtagtaccacttcctcaaatccagaggcaaaactccaaatgattaaaaagttatcaacttgtccaaggatttcagttacctgtgaactttcctttgaatga

SEQ ID NO: 61129 - DNA, 627 bp, Glycine max
  Peptide Sequence Number=SeqID_177907
atggaaatgctctggaatcctgtggcttggggaaaggagtgtggagataataataactgtgggattataaatgttagagggttacagattgtgaatccgcaggattgcctctgtagggaaccagaaatactgaggtatctggggcttcttatttggcacccaactaatccccttccactgggtttgggggaaggacaaagactattttatccattaccatatgaagaaaaaggtagtacaagtgtctcattgaagactcaagaactctatgcactcgtttttgcttgtcgctacctagatatctttactaattatgtatctctctataataccactatgaagttgatattcttgggaagctcattttctattgtgtggtacatgaggtaccacaaggttgttcgtagatcatatgacaaagatcaagatacctttcgccattactttcttgtattgccctgcttactattggccctattaatcaatgagaaattcacattgaaggaggtcatgtggacattttccctgtatttggaagctgttgctatacttcctcaactagtacttttacagagaactagaaatattgacaatttgactggacagtatgtctttctcctcgggtaa

SEQ ID NO: 61130 - DNA, 237 bp, Glycine max
  Peptide Sequence Number=SeqID_177908
atgcgtgggttcaagaaattgagggaatcaaatgcaagatctaacgcacgcggtagccagagggatcgtgatcgcgaaagggctcaggctagaactggtgctaaaggcaagcagaaagatgatggattgacccctgaacagcgcagggaaagagatgcaaaggcgctgcaggagaaggccgcaaagaaagcggcacagggtgcaggagggaataatgcagctggaagcaaaaaatag

SEQ ID NO: 61131 - DNA, 1968 bp, Glycine max
  Peptide Sequence Number=SeqID_177909
atgtctcggcttcataagtcaacaacaggtcagcagcaacagtttcattccctacaccaaatcctgtccccatacatgtcaagtgttgttgtatccgttttattatggcatgccattgctgtgcttttgctttcaaatttggcctctgctgagggcattgaggccacaaatggaggcacaaaacacagaggtgaggtgatctatgcccacaatggcgctgttgccactgatgacggtagatgctcaaggattgggaaggatgttctgagagaaggagggcatgcagtggatgcagcagtggcttctgccctttgtttgggggttgtgagtcctgcttcaagtggccttggtggtggtgcctttatgcttctcaggttgaataatggggtggcaaaggcttttgatatgagagaaactgctcctgctctttcttgcaaggatatgtatgctggaaatactactttgaaggccaaaggtggcctatctgtagcagttcctggagaacttgctggccttcatgaggcgtggaaacaacatgggaagcttccatggaaaagacttgtaaagccagctgagtttctagcacgtagagggtttaaagtatcaccatacctccacatgcagatggaagcatcagagtcagatatattggaagacaagggtcttcgtagcatatttgcaccaaatggaaaactcttgaatataggtgacatttgctacaataacaaactagctgagactctcagaacaatatccgagtctggtccacaagccttctatgatggattgattggtcttaatttagttaaagatgttcagaatgctggagggatattgagcatgaaagacctcaaaagttacactgttaaacagaaggaacccatatctaatgatgttcttggactaacgctccttggcatgcctcccccttcaggtgggcatccaatgatgctactgctgaacattctagatcaatataagctcccttctggcctttctggtgcccttggcttccatcgagaaattgaagctttgaagcatgtatttgccgtgagaatgaatcttggtgaccctgattttgtaaatataactggggttctttctgatatgctttctcatagttttgctaaagtgttgaaaaatgacatcaatgataataagacttttggccccagtcattacggcagcagctatgttactacgcggtttacaacagaacaactatgtagtgaacgacacggtttacaacagaacaactatctagtatctaggcttattcagttagaaccaccaatgtcatttaaccgtcaagtgaagtggaatccgataaatgatcatggtacaagtcatttaagtataatagatcccgagagaaacgccatttccatgactagcactgtaaattcatattttggttcaaagatcctttcaccaagtacaggaatagtactgaacaatgaaatggatgatttttccatccctagaaatgttaccaaggatgttccaccaccagctcctgccaatttcatcaagccaggaaagcggccactatcatccatgtcacccactattgtccttaaggatgggaagctaaaagctgtagtaggtgcaagtggaggtggtttcatcattggtggaactgcagaagtacttttgaatcacttcgttaaaggactgaatcctttttcttctgtaacggctccaagggtctatcatcagctactacctaacgtggttaattatgagaattggacaactgtgttcggtgaccactttgaagttccagctgatatcaggaaagcccttaaaagtaagggtcatgtcctaaagggtcttgccggtgggactatttgccaattcattgttttagacactattgtgccctccaaacaaaataaagggattgaaaacgaaacgcttgtggcagtgagtgatccaagaaagggtggttttcctgcaggcttttga

SEQ ID NO: 61132 - DNA, 720 bp, Glycine max
  misc_feature (8)..(8): n is a, c, g, or t
  Peptide Sequence Number=SeqID_177910
atgaccancctgacccagatctggatgaccttgctgctcagcaatatccaaaccagcgatcataattccgacctccccctgccgaagtgtcagctggtgtacaccatcctgacacggatgagcattcacgtggctcagttgatcgctgatgtcatctatctatttgcaggtatggcgcctaccaggcaccctctggacccggataagtccaacagggccttgggatttcccgctttgatcacaggactctgccagtcgttcggagtccccgtcgcacctagcaaggtgattcggccgcccatcacccgagcttttattgagaagtattgcacggagagacaggcccagggtgatgctccgcaggccgcagacgcgctgccacctcatcaggctggcccagctggatcatttgatacggagcagtatttacggcatttggttcgccagcaagcggccaaccaccgagcgcatgtacagacccatgattgtctttaccagttgagcctcagcctgcagagccagggttttacttcttttccatgccctactccggatcagttatgggcaaaggtcgcatggcccagagattggcctgaggcccgggcaggagaggcaccagcagaggcacccgcagaggctcccgacgaggcaaatgaggcccgcgaggacgaggagatgaccgatttgcttgatttcttgggagggagcggagccacatga

SEQ ID NO: 61133 - DNA, 1245 bp, Glycine max
  Peptide Sequence Number=SeqID_177911
atgactaattcgctttcgatgttggtggccgatttgtacccgcaattgcaggcctggcgccgcgacttccatcgctatgccgagtccggctggtttgagttccgcaccgctaccctagtggcggaagaactcgatcggctgggttatcgcctgcagctgggccgcgaggtcatcaaggcagagtctcgcatggggctgccttcgtccgatgatctggaagcgcaggaacagcgcgcccgcaatcagggggcgttggaaaaatggttgccgcacttttccggcggcttcgccggcatcgtcgcaacgctcgataccggccgccccggcccaaccatcgcctaccgcgtggatatggacgccctcgatctcaacgaattgctggaacccgaacacctgccgttccgtgaaggcttcgcctcttgcaacagcggcatgatgcatgcatgcggtcatgacggccataccaccatcggcctggggctggcgcacgtcttcaaaagcctggagccccagcttagcggcaccgtcaaactgatcttccagccggcggaagaaggcacccgcggcgcaaaatcgatggtggaggccggcgtggtggacgacgtcgatttcttcaccgcggtgcatatcggcaccggcgtgccggccggtgagctggtgtgcggcagcgacagctttatggccaccagcaagctggacgtcaccttccgcggcgtcgcctcccacgccggcgccaggccggaagacggtcgcaacgctctgctggcagcggcccaggctgcgctggggctttacgccatcccgcgccacagcgaaggcagctcgcgcatcaatgtcggcgtgctgcaggccggcaccggccgcaacgtgatcgccgatcgggcgtttatgaaggtggaaacgcgcggcgccaccaatgagatcaacgcgttcgtctatcagcaggcgctgaacgccatcgaaggcgcagccaagatgcacggcgtcgcctgcgacatcgcgctgatgggcgctgcgcagagcagcaaaccgacccaaccgtgggtggattacatccgccgccaggcacagcaggtaaccgagctgacctcggtggtcgatcgccgcgaacaggctgcgggttcagaagacgccacctacatgatggagcgggtgaaatcccgcggcggccaggcctcatacgtcattttcggcaccgagctgagcgccgggcaccataacgaaaaattcgacttcaacgagcag

SEQ ID NO: 61134 - DNA, 463 bp, Glycine max
  Peptide Sequence Number=SeqID_177912
gtaccgatcaagctaaagggaaagttttatcggactgcagtaagaccggcgattttgtacggaacagaatgttgggcggtcaagagccaacatgagactaaagtaggtgtagcggagatgaggatgttgcggtggatgtgtgagaagaccggtagactctgtagtgaggagagtagaccagatggagaaaaggcaaacaaacccaaaaagactatcaagaaggatctcgaacttaatgatttggatagaagcgacgatgaggccgcggttctgccagcggccgacggaggacgacaggaactcgccggagccaccgttgggcttggcgatgacggtggagaggccgccgtcagtttcatcaatggagtgagactccaaaacgaggccgcactcggagcacaccgtgtcccccgcagagtggtcgaacaccacctccgtctgcctcttgcagtcgctgcagaag

SEQ ID NO: 61135 - DNA, 870 bp, Glycine max
  Peptide Sequence Number=SeqID_177913
atggattccacttatgataggaaagctgaagtgaaagcctttgatgattcaaaagctggtgttaagggtcttgtagagtctggagtcacaaagatcccacgtatgttccattctggaaagttggatttggatatcattgaaacctcaggtggtgactccaagttgattatccccatcatagacttcaaagacatacattctaatccagctctgcgttcagaagtaattggcaaaattcgaagtgcatgccatgagtggggatttttccaggtgattaatcatggaattccaatcagtgtcttggatgagatgattgatggaattcgtagatttcatgaacaagacactgaggcaaggaaggagttctatactcgggattctaagaaaaaagttgtgtacttttccaaccttggcttgcacagtggcaaccctgttaattggagagatacaattggttttgctgtttctcctgatccgcccaaacctgagcatataccatctgtatgcagggatattgtgattgagtatacaaagaaaataagggatgtgggttttacaatctttgagttattgtcagaagctttgggacttaactcttcttaccttaacgaattgagttgtggtgaaggactctttactgtgggtaactactatccagcatgccctgaacctgaattaactatgggcgctgccaagcacacagatggtaacttcatgactttacttctacaagaccaaattggtggtcttcaagttcttcatcagaatcaatgggtcaatcttcctccagtacatggagctcttgttgtaaacgtaggagaccttctacagattggcttcgatgcctctatgagtgagcataaagcctag

SEQ ID NO: 61136 - DNA, 444 bp, Glycine max
  Peptide Sequence Number=SeqID_177914
atggctagccaatgtaattatggtgaaaaaaggcaaacatcaactgtaggatacgttctgactacacataccaatacaaaatgtgtccaaaagactcctacccactaccgagcatcaacccttctagttgatgaagcttcaaaataccccgttcttagtttccttgatgcctactccagcttcaatcaaattcaaatgttcccctcaaacgaggacaaaatgacattcttgattgataatgctaattactactacacaatcatgttgtttggccttgaaaatgtagaggtcacttaccaaaggctaatggacaagatattcctcaatcaaattgaacgaaatatgagagtctacgtggatgaaatggttatcaaaagccaaaacatggactcatacgcaaaagacttggctgagatcttcaaggagatgagaaagtgggattag

SEQ ID NO: 61137 - DNA, 2289 bp, Glycine max
  Peptide Sequence Number=SeqID_177915
atgtgtttcagcagctgtgcaaacttgttctttgttctgttcatactgttttgttatgtgttggatgttgctattgccgtagacaccatcacatcatcacaacccgtcaaggaccctgaaacactaagatccaaagatggtaacttcactttggggttcttcagtcctcaaaactccaaaaaccgctatgttggaatttggtggaaatctcagtccacagtcgtatgggttgctaacagaaaccaaccactgaatgattcttctggaattattacaatctctgaagatggcaatcttgtggtgttgaatggacagaaacaagtggtttggtcatcaaatgtgtccaacacatcatccaatacaacttcccagttttcagattatggcaaacttgtacttaccgaaaccacaacgggaaacatcttatgggatagttttcagcaaccttcagatacattattgcccggcatgaaactttcaagcaacagtacaagtatgagagtaaaacttgcatcatggaaaagcccctctaatccctctgttgggagcttctcttcgggtgttgttgaacgcataaacatacttgaagtgttcgtttggaatgaaactcaaccatattggcgcagtggtccatggaacggtgggatatttacggggataccgagcatgtcaccatatcgtaatggtttcaaaggtggggatgatggggaagcaaatacggaaatctattacacagttccaagtgcattaacatttacaatctatatgttgaattcgcaaggccaatatgaagaaaagtggtggtatgatgagaagaaagaaatgcaacttgtgtggacaagtcaagaatcagattgtgatgtttatggcatgtgtggaccgttcaccagctgtaatgcacagagctcacccatatgtagctgtttgaaagggtttgagccaaggaacaaagaggaatggaatagacaaaactggactggtggatgtgttcggagaacacaattgcagtgtgaaagggtcaaagatcacaacacaagtagagatacaaaggaagatggatttttgaaactgcaaatggttaaagttccagattttccagaagggtcccctgttgagccagacatatgcagaagccaatgcttggagaattgctcttgtgttgcatatactcatgatgatgggattggttgcatgtcttggactgggaatctacttgacatacaacaattctcagaaggaggacttgatctatatattcgtgtagcccacaccgaacttgataaagggacaaacacaaaaatcatcattacgataacagtgataataggaactgtcatgattgttacttgtgcatatgtcatgtggaggacttccaatcatccaggcaggatatggaacttaattaaatcagcaaggaaagggaacaacagggcttttgtacgatttaacaatgatgaaacaccaaaccatccaagccacaaagtaattgaagaactgtcacaagttacactaccggagctgttactgttcaactttgaaagggttgcaacagctacaaacagcttcgacttgtccaacaaacttgggcagggtggttttggtccagtgtacaagggaaaactacaagatggacaggaaatagcagttaagagactttctagagcgtctggacaaggtctagaagaattcatgaatgaagttgtggtgatttccaagcttcaacaccgcaatcttgtaagactttttggctgctgtgctgaaggcgatgaaaagatgttgatatatgaatacatgccaaacaaaagtttggatgtgtttatctttgatcaatcaagaagtaaactccttgattggaggaagcgcagtagcataatagaaggaatagctcgagggttgctttatcttcacagagactccagactaagaattatacacagagatttgaaggcaagtaatatcttgctagatgaagagctgaatccaaaaatatcagactttggtatggctagaatctttggagggactgaagatcaggccaacactaataggattgttggaacctatggctatatgtcccctgaatatgcaatgcaaggattattttcagagaaatcagatgtctttagctttggtgttttggtactagagattgttagtggaagaagaaactcaagcttttacgacaacgtgcatgctcttagccttttgggatttgtatgtctcaacaattcatttctaactcatttacagggttttttgccttttgctggtacaacttccaaacattga

SEQ ID NO: 61138 - DNA, 1962 bp, Glycine max
  Peptide Sequence Number=SeqID_177916
atgggttccagcagctgtgtaaaatttttctttgtattcatactgtgttgccatgtgttggacgttggtactgccatagacaccattacatcatctcaatccataaaggacactgaaactctaacttccacggatggtaactttactttggggttcttcacccctcaaaactctacaaaccgctacgttggaatttggtggaagtctcaatccacagtaatttgggttgctaacagaaaccaacctctgaatgattcttctggaattgttacaatatctgaagatggcaatcttgtggtgcttaatggacacaaacaagtcatttggtcgacaaatgtgtccaagacatcattcaatacaagctcccagttttcagattcgggtaagcttgtcctcgcagaaacaacaactggaaacatcttatgggacagttttcagcaaccttcaaatacattattgcccggcatgaaactttcgatcaacaaaagtacaggtaagaaagtagaacttacatcatgggaaagcccttataatccctctgttgggagcttctcttccagccttgttcaacgcaaaaatatagttgaattgttcattttcaatggaactcaactctactggcgcagtggtccatggaacggtgggatctttacaggtatagcgtacatgtcgacgtatcttaatggcttcaaaggtggggacgatggggaaggaaacataaacatctattacacagtgtcaagtgaattaggtccattgggatttttaatctatatgttgaattcgcaaggccggttggaagaaaaatggtgggatgatgagaagcaagaaatgggacttatgtgggctagtagaaaatcagattgtgatatttatgctatatgtgggtcgtttgcaatctgtaatgcacagagctcaccaatatgcagctgtttgaaagggtttgagccaaggaacaaagaggaatggaatagacaacattggactagtggatgcgttaggaacacaggtttgctgtgtgaaagggtcaaagatcaaaacacaagtatagatacaaacgaagatggatttttggaactgcaaatggttaaagttccagattttccagaaagatctcctgttgatcctgacaagtgcagaagtcaatgcttggagaattgctcttgtgttgcttattctcatgaggaaatgattggttgtatgtcttggactggaaatctacttgacatacaacaattctcgagtaatggacttgatctatatgttcgtggagcctatactgaacttgaacatgatgaagggacaaacacaacaatcatcattataattacagtgacaataggaactgtcttcattgttatttgtgcgtgtgcatatgtcatgtggaggacttccaatcacccaggagttaaggtgacattatctttctcattccagctaaaatatggcactcgatcaagtcaggaaggaaaaggggcaacaaatatttggctcgttttaacaatgggggttgttgcagccacaaacaacttccacctgtccaacaaacttgggcagggtggttttggtccggtgtacaaggggaaattgccagatggacaggaaatagcagttaaaagactttctagagcctctggacaaggtctagaagaattcatgaatgaagtagtggtgatttccaagcttcaacatcgtaatcttgtaaaactttttggctgttgtgctgaaggaataggtcgaggattgctttatcttcatagagactctaggctaaaaatcatacacagagatttgaaggcaagcaatgtcttattagatgaagcgctgaatccaaaaatatcagactttggtatggctagaatctttggaggaactgaagatcaggccaatactaacaggagattgttagtggaagaaggaactcaagattttacgacgacgacaatgctcttagccttttag

SEQ ID NO: 61139 - DNA, 2532 bp, Glycine max
  Peptide Sequence Number=SeqID_177917
atgggtttcagcagccgtgcaaacttgttctttgtattgcttatgttatgttgttgtgtgttggatgttggtattgccatagacaccatcacctcatctcagtccatcaaggaccctgaagttctaacttccaaagatggtaacttcactttggggttcttcacccctcaaaactccacaaaccgctatgttggaatttggtggaaatctcaatccacaatcatatgggttgctaacagaaaccaaccactgaatgattcttctggaattgttacaatccatgaagatggcaatcttgtattgcttaagggacagaaacaagtaatttggacaacaaatctgtccaactcgtcatccaatagaacttcccagttttcagattatggtaagcttgtcctcaccgaagccacaacgggaaacatcttgtgggatagttttcagcaaccttcaaatacattattgcccggcatgaaactttcaacaaataatagtacaggtaagaaagtagagcttacatcgtggaaaagcccttctaatccgtccgttgggagcttctcttctggtgtcgttcaaggcataaacatagttgaagtgttcatttggaatgaaactcaaccatattggcgcagtggtccatggaatggcaggctctttacggggatacagagcatggcaactttgtatcgtactggttttcaaggtggaaatgatggggaaggatatgcaaatatctactatacaataccaagttcatcagagtttttaatctatatgttgaatttgcaaggccaattattactaacagagtgggatgatgagaggaaagaaatggaagttacatggactagtcaagactcagattgtgatgtttatggtatatgtggatcgttcgcaatctgtaatgcacagagttctcccatatgtagttgcttgaaagggtttgaggctaggaacaaagaggaatggaatagacaaaactggactggtggatgtgttaggagaacacaattgcagtgtgaaagggtcaaagatcacaacacaagtacagatacaaaagaagatggatttttgaaactgcagatggttaaagttccatattttgcagaagggtcacctgttgagccagacatatgcagaagccaatgcttggagaattgctcttgtgttgcgtattctcacgatgatgggattggttgcatgtcttggactgggaatctacttgacatacaacaattctcagatgcaggacttgatctatatgttcgcatagcccacactgaacttgataaagggaaaaacacaaaaatcatcattataattacagtgataataggagctgtcgtcattattacttgttcttgtgcatatgtcatgcggaggacttccaatcacccagctaaaatatggcacttaattaaattaaggaaagggaacaggaatggttttgtacaatctaaatttgatgaaacaccagaacatccaagccacagagtaattgaagaactgacacaagttcaacaacaggagatgttcgtatttgatttcaaaagggttgcaacagccacaaacaacttccaccaatccaacaaacttggccagggtggtttcggtccagtgtataagggtaaactgcaagatggacaggaaatagcagttaaaagactttctagggcctctggacaaggtctagaagaattcatgaatgaagttgtggtgatttccaagcttcaacaccgcaatcttgtaagactttttggctcttgtattgaaggcgaagaaaagatgttgttatatgaatacatgccaaataaaagtttggatgtgtttatctttgatccatcaaaaagtaaactcctagattggaggaaacgcattagcataatagaaggaatagctcgaggattgctttatcttcacagagactccagactaagaatcatacacagagatttgaaggcaagtaatatcttgttagatgaagagctgaatccaaaaatatcagactttggtatggctagaatctttggagggactgaagatcaggccaatactctcagggttgtgggaacctatggctatatgtcccctgaatatgcaatgcaaggactgttttcagagaaatcagatgtctttagctttggtgttttggtactagagattgttagtggaagaagaaactcaagcttttatgacaatgagaattttcttagtcttttaggatttgcctggatacaatggaaggaaggcaacatattatctctagtagatccgggaacatatgatcctagttatcataaagaaattttaaggtgcatacacataggatttctatgtgtacaagaacttgctgtagagagacccacaatggctacagtaatttctatgcttaacagtgatgatgtgtttcttcctcctccaagtcaacctgcatttatcctgaggcaaaatatgttgaattcggtgtcatctgaggaaattcataattttgtctccatcaatactgttagtattacagatattcatggtagatag

SEQ ID NO: 61140 - DNA, 714 bp, Glycine max
  Peptide Sequence Number=SeqID_177918
atggtggtcaaaaacataaaccagttggaggaaaacattgattctacttatgacaggaaagctgaagtgaaagcctttaatgatccaaaagctggtgtaaaagctagtgactccaaattcagtatcccaatcatagacctcaaagacatacactctggtccagctctgcattcagaaataattagcaaaactcgaagtgcatgccatgagtgggtatttttccaagttattagtcatggaattccaatcagtgttttagataagatgattgatggaattcgtagatttcatgaacaagtcactgaggcttcgggacttcatccttcttaccttaaagaattgaattgtgctgagggactctttattttgggtcactactatccagcatgccctgaacctgaattaactatgggcactaccaagcacacagatagtaacttcatgactttacttttacaagaccaacttggtggtcttcaagttcttcatcagaatcaatgggtcaatgttcctcctgtacatggagctcttgttcttatcacaaatgacgagtttgtcagtgtgtatcacctttgtgacgagtttgtcagtgtgtatcaccgtgtcttatcacaaaacacgcccaagaatattgtagcaagcttctttttaaattcacatgactcagttgagggtacatcaagagtgttgttagatgcacgcaacattctttaa

SEQ ID NO: 61141 - DNA, 495 bp, Glycine max
  Peptide Sequence Number=SeqID_177919
atggcatcactctccaccaccgcacccggcgtcccacccttccctccgcccaccgccgcccgccgcgccgcttcaagacgattccaagcctcgcctcgcctggacccggaacccgaccctgaacccccttctccttcttctttgtcggcgtcattggtggtcaccgacgagcggacgcggagaatagcgagggagctggagaagctgaaggcgcgggagcggaaggagatgaggaacagaaaggtagcgtcgcagaaagcggtgtcggtgattctgtggagagaggcgacgaaggccatgattgataagagcggtggtggtaggaagaagaaggggcccatcaactccaagaagcttcttcccagaactgttcttgaagcgctgcatgaaagagtcacggctctgcgttgggaatccgctctcaaggtttttagttgctctctttctcaagttcaatgtggtgtttcgttgggttgggatgaggtgacaggttga

SEQ ID NO: 61142 - DNA, 1158 bp, Glycine max
  Peptide Sequence Number=SeqID_177920
acaccatcacaatccatcaaggaccctgaaactctaaggtccaaagatggtaaattcactttggggttcttcacccctcaaaactccacaaaccgctatgtcggaatttggtggatgtctcagtctacaatcatctgggttgctgacagaaaccaaccactgaatgattcttctggaaaagttacaatatccgaagatggaaatcttgtgcttgtacttatggaagcctcaactggaaacatcttgtgggatagttttcagcatccttcaaatacgttattgcctggcctggaacttacaacaaatataagagcagtggtccatggaatggtaggctctttacatggataccgaacacggactctgcgtatcttaatggctttcaaggccaataagaagaaacaaggtgggatgatgagaagaaagacacggaagtttcatggactagtccagaatccgattgtgatccaaggatcaaaggggaatgggatagacaaaactggagtagtggatgcgttaggagcacaggcttgcagtgtgaaacgtacggttgaagatcaaaaacacaagactggttgtatgtcttggactggaaatctacttgacatacaacaattctcaagtgcagaacttgttctatatgttcgtgtagcgtatgctgaacttgaacatgtgataatagcagctatcctcattgttacttgtgcatgtgccatgtggaggacgtacaatcaccaagcaaggaaaaggaacaacaaagcatccctactgtttaataatgatgaaacatcagaacatccaagccaaaaagtaattgaagaactgtcacaagttacactaccggagctgttacaattagatttcgaaatggttgcaatagccacaaacaacttccacctgcccaacaaacttgggcagggtggttttggtcctgtgtacaaggggaaactgcaagatggacaggaaatagcagttaaaagactatctagagcatctggacaaggtctagaagaattcatgaatgaagtagtggtgatttcaaagcttcaacaccgtaatcttgtcaaactttttggctgttgcattgaaggtgatgaaaagatgttgatatatgaatacatgccaaataaaagcttggatgtgttaatctttggttag

SEQ ID NO: 61143 - DNA, 675 bp, Glycine max
  Peptide Sequence Number=SeqID_177921
atggatgttaagaaaggtgggtctgtagtacaagcacaagtgaagttgcagaagcataacgaaaaggagatgggcatgagaaaaggtccatgggcggttgaggaggacaccattctggtcaattacatcgccacacacggtctaaggaggagtgggaagagttgcagattaaggtggctaaactacttgcgcccagacgtgcggcgtggaaatatcacactccaagaacaaatattaattctcgaccttcactctcgctggggcaacaggtggtcaaagattgctcaacagctgccaggaagaacagacaacgaaataaagaactattggaggaccagagtgataaaacaagcgaagcagctaaagtgcgatgtgaatagcaaacagttcagagacacgttgcgttacgtttggatgccgcgcttgctggagcggcttcagcccacatcacaagcactggagccaaaccaaagtggacttgtgttacacgcttcatcatcactgcttccttcgaattccgaccatagtattgaaagggggtcggatctgtggccaggtttcaataaccaaatgttgttggaacaggggagtggcggtgacttgttggaaagtttgtgggatgacgacaatatgtgctttttgcaacagctttcttatgacctccaaatgaaataa

SEQ ID NO: 61144 - DNA, 1053 bp, Glycine max
  Peptide Sequence Number=SeqID_177922
atgcttggcaaatgtaagcaacctgagaaagctcatgaactctttcaagctatggttgatgagggctgtgttttggactgtgaatcatacactgcactgttatcggcctacagtaggagtggtctcttggacaaagctttctctcttcttgaggaaatgaagaatacacctggttgtcagccagatgtacagacttattcaatcctcctaaaatcttgcttacaggtttttgcctttgacaagattcagagtcttttatctgatatgaccaatcgtggaatcaaacctaacacagttacctacaatacccttattgatgcttatgggaaggcaagaaagttttcagaaatggaatctatacttgtggaaatgcttgctgaccggtattgccaacccgatgtatggactatgaattcaacactcagggcatttggcaacattggacaaattgaaacaatggagaagtgttatgagaagttccaaaatgctggaatccaacctaatgttcagactttcaacattctcttggattcctatggcaaggctcaggattacaagaaaatgagtgctgtgatggaatacatgcagaagtaccattactcttggacaattgtgacctttaatattgtcattgatgcttttgggaaggctggggatctcaaacagatggagtacttgtttagactaatgcggtcagagagaataaaacctagttgtgttacactgtgctcacttgtgagggcttatgcacgtgcaggtaaacctgaaaaaatcagtggtgtccttcgttttgtcgagaattcagatgtattactggacactgtattcttcaactgcttagtggatgcttatgcgaggttagggtgtttggctgagatgaagggagtgcttgagatgatgaaacagaatggttgtaaacccgatattgttacttacagaaccatgattaaaacctatacatacaagggcatggatagccatgctaaggaacttagagagctccttccaacagtgaataggcctccattgaaaagggataagcctgacttttga

SEQ ID NO: 61145 - DNA, 849 bp, Glycine max
  Peptide Sequence Number=SeqID_177923
atggatacgatcagtgttcaggcgatgagaagcttatcagatagtgactcattatcatctgcaacatatgcaagtgaagaagatatgaaaattaagaaaggtccatggactgaggaagaagattctgttctgatcaactacgtcaacttccaaggcgaaggtcaatggaactccctcgctcgctctgcaggtctaaagcgaacgggcaaaagctgcagactgagatggttgaactatttgcgaccaaatgttcgacgtgggaacatcacccttcaagaacagctcttgattctcgaactccattcccgctggggcaatcggtgggctaaaatagcagaagaattgggtgggagaacagacaatgagataaagaactattggaggactcgagtggtgaagcaggccaagcaactcaaatgtgatgtaaacagcaaacagttcagggacacggtgcgtttcgtttggatgccgcgccttatggagcagattcaggcttctttcaggattgttccttcagattcttcccatggccttgatcaaaccacattgtgcaacactcaacaaacagaatctagtactgatgccaatcccaccatgttttgtgacaactcaatggtttcatcgtactcatcagaggttgatcttcagcctctttctctttctgatacaagtacaacttcatcatcggaaagtgcagagaagaaggagtccatatcctcctccctttggcagcaatgggactactctgacctccaagcatttgaaccatgcaatggttttggtgatgcagacttgtggaccgatgaaaacatatggttcttgcagcagcatcttgctgatcacttatga

SEQ ID NO: 61146 - DNA, 840 bp, Glycine max
  Peptide Sequence Number=SeqID_177924
atgttgctgaggcgttactccgttgaatccccgtcgaattgcattcctccctcaaccctaattctgcaccgcctcttaagctccaaccaaaaccaagacgtagagaaagtcttgggcatcctcagcagcatctccacgccggaacagctgaaacagtccctaaaatcaatagtcaacattcttgatgaaatgcgtgaccgggatttgtcgccggatgtgatcacgtatacctgtatcatttgtggcttggggttgattgggcagcctgataaggctaggaatgttttgaaggagtatgggtgttaccctgatgctgcggcgtacaacatcaggaacttttgtattgccaagaggcttggtgatgctcctggtttggtggaggagatggcgagcaagggtttgagtccaaatgcaactacttacaatttgttctttagggtcttttgctggtccaatgatttacagagctcttggaacatgtaccagaggatgatgattgaagggtgtcttccgaatacgcagttttgtatgttcttaatgaggttgtttaagaggcatgagaaggtggagatggcgatgcagttatggggggacatggttgagaagggttttgggtcgtatacattggtttctgatgtgctgtttgatttgctttgtgatatgggtaagttggaggaagcagagaagtgtttcttggagatggttgagaaggggcagaagccaagtcatgtgtcgttcaggagaatcaaggttctcatggaactagcaaatagacacgaggcccttcagagcttgacgcagaaaatggccatatttcggcgaccattgcaagtacggtga

SEQ ID NO: 61147 - DNA, 255 bp, Glycine max
  Peptide Sequence Number=SeqID_177925
atggggtttgaagtgtttcacccacatctccaactagtggggttgtggccacgagacagttttgccagcggtgataggaagaggagagatccgatgaggcatgaggagaagctgagcttggaaatgtcgaggtcaacggcgaaattgaaggtgtggccaaatttgttgccgttttggtggaagttgcaaccaagtcctttgagatccaatgatgcagtgtccctcgtagagatattgggtggaggcgagggatga

SEQ ID NO: 61148 - DNA, 234 bp, Glycine max
  Peptide Sequence Number=SeqID_177926
atgaatgcaaagaggagagaagatatggttggtgtgcttccaaggaaaagaatattgatgcagcatggggagttgcagggaatccgggacacgacatcgtataccatcatacccgaccacaacattcaatcaacgctctacatgtccccctacgctcgcacccaatcgacgctccgcgagctcaaacgatgtttcttgaagaagagaatcatcggcgtgagggaacagtcgtga

SEQ ID NO: 61149 - DNA, 966 bp, Glycine max
  Peptide Sequence Number=SeqID_177927
gttaaggaagaagttgaagccgccctaaagaggcatttaaccagcatgaaacagacctgtggaaaggagtttcatactactgaattaagaaatttgcagctgcagtttgaaaacagcatttgtcttcctgtctttacaggagctcgaattgaaggagaggatggctccaacttaagaataagtttagttgatgccctaacagggaaggttgttagtacaggacctgaatcgtcagctaaggtggaaattgtagtccttgagggtgattttgaagaggaaagtgaaacttggatgcctgaagagttcaagagcaatattgtgagagagagggaaggaaaaaagcctcttcttacaggagatgtaattttatatcttaaagatgggattggtatggtgggtgaaatttcatatacagataattcaagctggacaaggagccgtaggttcagacttggagcaagagttgtggacaactttgatggtgttggaataagagaagcaaagacagaatcattcattgtcagggatcacagaggagaattgtacaagaagcaccatcctcctagtctgtctgatgaagtttggagattggaaaaaataggcaaggatggagctttccacaagcgcttgagtcgggaaaagatccttactgttagagagtttctcacacttctcaatctggatccagcaaagctgcgcagtatactgggcactggtatgtctgcaaagatgtgggaagtaactgtggagcatgctcgaacttgtgtacttgatacaacgaggcacgtgtacttcccttctaattctcaagaacctggtgtggtcttcaatgctgtgggacaagtgacaggactgctttctgaatgcgagtatgtcacagtagaaaagctgactgaaactgaaaaggcatttatccctcatcacctattactttccttactctttccttccttctcttctctttaa

SEQ ID NO: 61150 - DNA, 183 bp, Glycine max
  Peptide Sequence Number=SeqID_177928
atggcatcatttgcaggcactacccagaagtgcacagcatgtgaaaagaaagtgtattgggtggaacagctcactgctgacaacaaggtgtaccacaaatcttgcttcagatgtcaccactgcaagggcaccctcaaggtagagaatagagagactgaatatgaagaatgtgtccctgagtag

SEQ ID NO: 61151 - DNA, 1479 bp, Glycine max
  Peptide Sequence Number=SeqID_177929
atggcttccaaccaagaagcaacaatccctttgagatattgggtggataatgagcaaaagcgtgtagttatggcagaagcaagtggagactttgttgatgttctctttagtttcctgacccttccattgggaactatcatccggctagggaaccaatttcaacaaccggtagagattggttgcatcaacaatctttacgagagtgtgcaaaatttgcgccctgatgttttctggaacaacatctgccagaaaatgttgcttgctccacgcaacccgttagaagcttcttaccagagactaaaagtgaaggtggatggcacagagcccacaaaaaaattgatgcgaaagaaaatggagctgctggaagagtccaaggacgaggcttctggggtcgacggtgttttcgttaaaggggatgccatgttcttgatctttgatgatttgaaagtgctccgtagctctccaagtgactcccttcaaacacccctcctatttggacacacagacttcagcaagatgcaagaaatgtctcaagatgtcggcccgagggagaaagttcagatacattggattcaaaacatttttgtgacttgcacttatgacatgtatatatttagcatattaaagcacgcattaacctccaaatctccactaagtgatgtattcattccaaacagaaaaaaaattgagccatcgtactctttctcacccgatactggcccgagtcattggaaaggttctgtagaaatcaagctaatggtgagcaaatcaaagaacaaggttctgtttgctgaagcagatggagatttcgttgattttctagtcagcttcctcacaacacctcttggatctattctgaaccttatgaatggcaaatcatcgttgggaagcattgataacttgtacgcgagtgtgaagaagctcaatgcatcatggttcatagggtcatcaaacaaatccttactgaatccaagggtcgctcctcaatttggttgtgggagcaatccactaaatgcttcacaagaatacactcctacgtattggtatggcactgtggtagtgaaagataacaatgaggggcgtacaatgatttcaaagaaaaaagaaatgttagaatatccagcaaaactgaaactttttgagccaagatgttatgatggagcaagagaagctgctgtgggatttatgaagaggccgtgtctatttgttgtgagcgatgatctgaaagtgaggcaattgacaactacttctagcattcagtatatgcaagagctggggaatgtcaagtttgatgatttgaaggaacatatggtggaaatcaggaagtcacatgaggcactgaacctgttgagggcgtctttgacatccaaagaagttggtttgacacggagcctattgaagaagtggaaatgccaaagatgcattccattttgggattccattttggggtgtgttgggatggaagaaaatgagacatag

SEQ ID NO: 61152 - DNA, 285 bp, Glycine max
  Peptide Sequence Number=SeqID_177930
gtggctgttgatggtaaatcttaccacaagtcttgttttaggtgcacccatggaggttgtgtaataagcccatcaaattatattgcccatgaacatcgtctttattgtagacaccaccatactcagctcttcaagcagaagggcaacttcagtcaattagacaagcatgaaaatgtccaagtcatcactgagatcacaataacacaacacactgagaacacaacacaacatccggatccgagtaatggcaatactgatacaactccagctgaggaatctagttag

SEQ ID NO: 61153 - DNA, 249 bp, Glycine max
  Peptide Sequence Number=SeqID_177931
atgcgagacgaagaggcgaagagaaatcaaggctgttgtggcggcgagatacgaagaggcaaagagtggaggcgcgagaggcggagaggcgaagagaaagagagtggagacgaagagaaggagatgaggtgcgatagtgacactaatagtgatgatggtgttgcggtggttgcaatgacaatgacgatgacgatgatggagacaatggtggttgcgattgtgatggaagagggagggaacaagccatag

SEQ ID NO: 61154 - DNA, 240 bp, Glycine max
  Peptide Sequence Number=SeqID_177932
atggataagttaaggttgtcctctattgttcgaacacctattgcggcaagtaataaaatcgacgtttctgcggttccagagtgtggtgtcaggctttcttatgtggtggctcgtggttcacaggtgtacccttcgaatctccccaacaaggccatggctatattcgtggatgataaagacttccgctcgaggggagactaccatataaatgaggagaagacccataaacctgagtcttaa

SEQ ID NO: 61155 - DNA, 534 bp, Glycine max
  Peptide Sequence Number=SeqID_177933
atggagaagttgaaaattggaagctcaataagcaagatcaaggtcatcggcgcagtgctgtccatctctggagcattagttgttaccctttataagggtagttttatcatcacctttcgaattcaaccatctttgttggatgaaaccagtaactgggtcattgggggtctcgtatttgccattgcctctgtttcttttgcagcctggaatattactcaggcagtaattctgaaagaatattcatctcaatcaaccataatagcctactattgcctgtttggaaccatccaaagtgaaatactttctctctttgtagtcagagattcaaatgtatggaaaataagccccaacgataagctcatctgtatattctattcagctattgcaggaagcgcggtgacattttctgtaacggcatggtgcataaaaaggaaaggacctgtatttgttagcatgttcaagcctgcagggattgctattgctgccttttcgagtgttgtcttcctttgtgaaacactccattttggcaggtaa

SEQ ID NO: 61156 - DNA, 4287 bp, Glycine max
  Peptide Sequence Number=SeqID_177934
atgcagccaggcggtcgatctcctaagccagtgagcagtccaacatcaacatcacagttaaaatctggttcagatagtgtccaaaacagtgtttcttccttttcttctcatgttaagggtaggaaaagggagagggtagatcaagggcaagaatctgtaaagcgagaccgttcaaccaaaaatgatgatggggattctggtaattttaaggcggatagcattttgaagacagagattgccaaagtaacagaaaaggggggtcttattgatcctgaaggggttgagaaattagtgcagctgatggttcctgatggaaatgagaaaaagattgatttagctagccggtcaatgcttgcagctgtaattgcagcaaccgagaaatttgattgccttagtcggtttgtgcaactaaagggtttgcctgtatttgatgaatggctccaagaggcacataaagggaagcttggtgagggtattgggtctagggatggtgataaatctgttgatgactttctttttgtattactccgagcactagataagcttccagtaaaccttcaggctctacaagcttgtaacattggtaaatctgtgaatcatttgcgaactcataaaaacttggaaattcagaagaaagccaggggtttagttgacacatggaaaaaacgtgttgaagctgaaatgattataaatgatgctaggtcttgttcagttcagactgtcccctggccagccagacaacgactttctgaagttgctcaaggtgggaataaacattcaagtgggtcagctgatgttgccatgaagagctcagttacacagctttctgcatccaaaactgcctctccgaagattgccccaggagagaatactacaagatctacatctgcatctccagggtctacgaaatcagtgccttcacctgcacccgcaaccgcaaacttgaaagatggacagccccatgctgcagctgttagtggttcatctgatcttcctgtggcaaatgcaagggatgagaaaagtagcagttctagtccatctcataacagtcaatcttattcaagtgaccatgccaaagctgggggtttctcaggaaaggaggatgccaggagctctactgcaatgagtgtgaataaggtatcaggaggctcttcacggcaccgaagatctatgaatggatttccgggttcaactccatctagaaggcaaagggaaactggatcgagcagaaattcctcacacaagaatttaatttcagagaaaatatctcaatctggattaagggaaaaagcaaatgatggaactcttcttgaggggcatactccgaagctgattgttaagatcccaaaccgaggtcgaagtcctgcacaaagtgccacggcaggttcttctgatgatccttcaatcatgaacagtcgagcttcatctcctgctctttcagagaagcatgatcagtttgatcgctgctcaaaggaaaagagtgatttttatcgagctaatattggtgcagacattaatacagaatcgtggcagagtaacgatttcaaagatgtattgactggttctgatgagggtgatggatcaccagcagccattactgatgaacagtgtaggactggtgaggattgtaagaaagtatcagatgtatctaagacaacttcttcatcacctgggagtgagagtaaagccaggaatttgcaggatgcttcatacagctccatcaatgctcttattgaaggtgttaagtacactgaagctgatgatgttggaatgaatcttcttgctcgtgtggctgctggagagatctcaaaatctgaatcgggaatgccagctggatcccctaaaaaaaacaccactacaattgaacagtcatatgcaggtaatgctgcagtagtcaagtcctctgaagagtatcttgttcaggataagtgctactctaatgctgaacatatgaagcaggattctagatctggtgattttgggacagatgatgatattcgggcatttgaagggaaagctacaggagaacacaatccatctagtatggatttacaggttactgaaactagtttagaaagcaaaggaaaattaattgtaaaatcatctggtacatctgctggcattcctgaaagcaccttccaagaagtcagagatattgactctagcaaactggtaaaggaaaagaaggttgttgtgagagtggatgctgtcaataatgttgatgaggtcaatgttgttgcaagagaaggtgaaacagaggcaattgaaaaattgtcacacacctgtgaagaagttgatgtcaagtgtgataaccatgcttctgaaggactaagctgtgacaaagagacagctggcaagtctcctgccacttgtgtgccctctgactctgtaaaagcgacagatgagaatgcgctccaatcatctggttacattgttgataaggttcctgaatacctaaatgaaagggaatctgaaaaaaatgatgatatggctgctcaggatcatgctaagcagtctttgaagcaaaaaaatgagtctgaaaatgatgctattatggtgcccgagaacagaggtttatgttcaggtgcaactggtcttgatgctgaatatgtggaagagaattcaggtacaaaagaggtttgtgaccaagatgcaggagcaggacagatactgcacacagatttacctagctttccttcacgagaaatggatcagcattcaggtcaaagggattcaaaattggctgccatggaatcagaggaagcagaggaatgcacctctaccactggagatgcctcttctgcatctgttgctggtgtctcagaagtggacacaaaagttgaatttgatttaaatgaaaggctcaatgcagatgacgggaaatgtagtgagatacctgggtctacacctgctgcaagattggtcagtcctgttccattttctgcttcatccatgtcttttggtattctctcgatcacagtggctgctgctgctgcagcaaagggcccctttgtgccacatgaagatttattgaaaagtaaaaaggagcttggttggaagggatccgctgctactagtgcatttcggccggctgagcccaggaaagttatggaaattcctcttgatatgtctactacccctattcctaatgatgaagctagaaagcagagtcgggtaccattggattttgacttgaatgtttccgatgaaataatacttgatgatctttcttctcagaactgtgctcgtcagactgattgtgtaactcgttcagatgatgggcatgatccaaataaatcaatggcctcacatgttcgttgttcaggaggactaggtcttgacttgaacctagtggatggagcttctgacgtgggcaattgcaccttaagcagtagtcataaaatggatgtaccacttacgcagtttaaatcagccgccagtggtcctccaaatggaaagatgagtgtccttagggattttgatctgaatgatggacctatagttgatgaagtcaccactgaacatttgatgtccacacgatctgccaggaatagtgtaccatctcaacctcctatttctggacttaggatgagtaatgcagaagtaggcaacgtctcttcatggtttccttccactgggaacacctattcagccgtaacaatatcttcaattatgtctgatagaggtgataagccattttcaattgttgcccctaatgtgtcagaaagggtgttgggtcctgcaactggcagcaacccatttggacctgatatttataggggggcagttttgtcatcttctcccgcagtgccatatcaatctgcaccatttcagtatcctgtcttccctttcaattccagctttcctcttccatcagcatcattttctggtggatcaactccttatgtagatacaacttcaggagggaggctttgcttccctgtagtaaattcacagcttataggttctgttggtaatgtttcagcccattaccccaggccttacgttgttagtttcccagatggtagcaatagtagtggtgctgagaacagtaggaaaagggcaaggcagggtttagatcttaatgctggacctggttcagacttagaggggagagatgagagctcacctcttgtaccacggcaactttctgttgctagttcacaggcccaacttgaagagcaagcaaggatgtttcacttaagcagtgatgttcttaaaaggaaggaacccgatggggggtgggatggctacaagcaatcatcatggcagtaccataatttgtaa

SEQ ID NO: 61157 - DNA, 1500 bp, Glycine max
  Peptide Sequence Number=SeqID_177935
atgggagataacaaacgtaagagaggacgcaaagccaaaacccccgcctccgaaaccctagaccaccccgcccccgtcaccaccaccgctccaaattccacctccaccgccatggacgatgtcttctccgtcggcaacgtcgagctcatcgacaccacggcctctccgcaccaccgccgcctccgcgcccgtcccaaccactccgagaagccccacgctctgcccacggggcgccgccacgcccgccccctcgacaacggaggcggtgacttctcggtccccagcgacgtcgtcggggtttcccctgccgtggcgatggaggcggacccggcggcgtgggtggcaagggcgctgccggcgatggactcggtggtgaaggtgttctgcgtccacacggagcctaatttctcgctgccgtggcagaggaagaggcaatacagctcgagcagcagcgggtttgtgattggcgggagaagggttctcaccaatgcgcattcggtagaacactatacacaggtcaagctcaagaaacgtggctctgataccaagtacttggccactgtgctcgccattggaaccgaatgtgacattgccatgcttacagttgatgatgatgagttctggcaagggatgtcacctgtagagtttggggaattgcccacacttcaagacgcagttacagttgtgggctacccaattggtggagacactatctccgtcaccagtggtgttgtatcacgcattgagattctatcttatgtccatggttctacagaacttctaggtttacagatagatgctgctataaattctggcaattctggtggacctgcatttaatgacaaaggaaactgtgtggggattgcatttcagtccctcaagcatgaagatgcggagaatataggttatgtcattccaacgccagttatcatgcattttatccaggattatgagaagaatggaggatatactggattccctattcttggggttgagtggcagaaaatggaaaatcctgatctgcgaatggccatgggcatgaaacctgatcagaaaggtgtgcgcattagaagaattgatcctactgctccagaatccaaggttttgaagccatcagatgttatccttagttttgatggggttgatattgccaatgatggaacagttccatttcgccacggagagcgcattggtttcagttatctcatatcacagaaatatactggggataatgcagcaatcaaagtactgcggaattcagacattttcaaatttgacattaaacttgatagtcacagaaggcttattccagcacacagcaagggcaaacctccctcatattatattattgctggatttgtttttacaactgtttctgttccatatcttcgttccgaggtgttgctgtttgttttactattgttaatattgatatggatgcacttcagattttcagcactttcaatgtttcttcctcccaagtggcatttgaatgtctag

SEQ ID NO: 61158 - DNA, 576 bp, Glycine max
  Peptide Sequence Number=SeqID_177936
atggcaaaggttgtaatgttccatttgcttccattgtcttccttaggacaagaggattacaacagactgaggcctttgagctacaggggggcagatgtctttgtcttggctttctctttagtcagtcatgcaagctatgaaaatgtgttgaagaagtgggttcctgaactgcagcattttgctcccggcattccagtggtgctagttggcaccaaattggatctccgagaagacaagcactatttggctgatcatcctggtctggtgcctgtgacttctgagcaaggtgaggaattgcgtaaactggtgggagctacatattatatagagtgcagctcaaaaactcagcagctgagtacacctggtgagacaagcttagttgttgttgtgaatatgaatgtgaagtcagtttttgatgctgctataaaggtggtcattaagcctccacaaaaacaagagaagaaaaaaccacgtcgagggtgtctactgtcagtacacttttttcatatcataacaactcctgcacgtgaaactttcttacttgtgaaaagggatagttcaataagtgtttattga

SEQ ID NO: 61159 - DNA, 330 bp, Glycine max
  Peptide Sequence Number=SeqID_177937
atggggtatccaagtatgatactcaacccacaagatgttaaccaacctttttttcatgttaaaaacccacccaattcacaacatctgcagggggagaaggagaaggaaaaggatcaaatgggagtgaaacgcaatttggtggaatggactccattcatagcgatggcgactgtggagtgccttgacgtggagctgtccacgttgagtaaagcagccatgtcaagaggaatgaaccacttcgttcttgttggctactccaatgctctcgcaactctcatactcctcccttcccctttcttcatagacagttatactctcaccttctcttag

SEQ ID NO: 61160 - DNA, 990 bp, Glycine max
  Peptide Sequence Number=SeqID_177938
atgcgcagcatcaatggaaagttgaagtactcatcatattatcctcaatctccattctcagcattcgaagctcccaacgatggtaacattagcaataacaaagaagcaacaacgccatcatctctcagcagaatcagtccactcattttactggtcataatagttctagcagttatcttcttcgtctacggactcgtccatttgattctgtggtttttcatgaagaggccattatcaccttcatctctctatagctactccaacaggttccacgaaaattccacgcgctcccgtgttctccaaaggcagcttcagcaactcttccgcttgcatgattcgggtctcgaccaagccctcatagacgctctacccgttttctattaccaagaattgttggggtcgaaggaaccgttcgactgtgccgtgtgtttgtgcgagttctccaaggaagacaagctgaggttgcttcctatgtgcacgcacgccttccacatgaactgtcttgacatgtggctcctctcgaattccacgtgtcctctttgcagggcatctctgtccgagtatatggagaatcagaatcagaatcagaattcaatgcttaatgttggaaattccaactctttggttttgcccagaggtgaagaagagaataatgggtgttcagatagtcaaagatcagtggggaaaagggtgttttctgttagacttggaaaatttagaaacagtggagtggagggtggagaggtgggaggggatggtggttgtagtttgaatgagaggagatgctactctatgggttcgtatcggtatgtggttcgtgatttgaatttgcaagtagtgttatctcatggtgatgatgttttggaaaatgggaatgtggaggggaagaggataggggactcaaccaaaggtgagagcttctctgtttccaagatatggctttggtccaagaacaccacatttcatgactctaatgcacctttcccttga

SEQ ID NO: 61161 - DNA, 228 bp, Glycine max
  Peptide Sequence Number=SeqID_177939
atggctgaagattatctccaagaagagaagaagcgagttcggaacccttttgtccccattgagaatcggattgagaaagagttcagatggtttataattagggaaaactctttgcaatatagcattgctgaattacaccaggacaaaataacagaaagccataacagaaaaggagaggcagacagcatattccacttatccaattccatccagcttagcacccgctaa

SEQ ID NO: 61162 - DNA, 735 bp, Glycine max
  Peptide Sequence Number=SeqID_177940
atgaaaagtgccttgcaatctttcttttctttttctctatcagcagccttttattcctctgttgctctctctcccacagtgctgtccatcgctggagcattactagtgaccctttacaaaggaagtcccatcatcagctttcgaactcaaccctcgccaacacaaccattgccacctttgttggctgaaaccagtaactgggttattggaggtctcttctttgccactgcctctatttctcttgcagcctggaatattacacaggcagcaattctgaaaggatattcatctcagttaaccatattagcctactattgcctgtttggaaccatccaaagtgcaatactttctctcattgtagtcagagatccaaatgactggaaaataagccctgacattgatctcatcgctgtattctattcagctgttgtgggaagtgtggtgacattttctgtaaacacttggtgcattaaaaagaaaggacctgtatttgttagcttgttcaagcctgtggggattgccattgctgccttttcgactgttgtcttccttggtgaaacactccatgttggcagtgttgttggtgcagtgataattgccatcggattttacacagtattgtgggcacaatcaaaaggggaaaacgcaaaaggcttccaagttgatggactgtcatccccgtctgcccaagcgagtcctctactcgagttccatgaaagcaatgttttagcataa

SEQ ID NO: 61163 - DNA, 492 bp, Glycine max
  Peptide Sequence Number=SeqID_177941
atgaggcacaaaaggaagatccagccacccaagatacccgaaggatttcatctaacggaattggttagcggcctgaataccttggaaaccagccaccattccccttcttcatccactgctattccatcttctggaaagcttctgcgtgaaggaaaagcgcagcaagtgagcagtccacctcacctccctccattgcagttgcagccactcagaccagcatgccgactccgccttccatggctgcttcccacctccctccttaaaccttttcatccctctgcaactgatactgctgtggagttacctcgacagcagttagcacataatagagctggagaacaagtagcagtggactcaagaaatcgtcaccctgctgattttgcactgtgcaaggctgctaaaccaggtgagcctagctgggacagcccttgggatcctggaggacctgggtggcacattgaatgctcacttgaaggactcatatcacgttga

SEQ ID NO: 61164 - DNA, 204 bp, Glycine max
  Peptide Sequence Number=SeqID_177942
atggcgatatcgccatgcatagggaaccgccagtcaaactggcgagttccacaccacaagagtaggctcgggctttcaggctttgcagtgatggctcaggcttttctggctttgcagggatggcaggcacatgcaactaaagggaaattgccactcctatgggcgagtttaaatttgttagattcgaaatttgcaatcaaataa

SEQ ID NO: 61165 - DNA, 180 bp, Glycine max
  Peptide Sequence Number=SeqID_177943
atggactgtcctgcggggctcgcggtccgtgcgggtctgcggattggcctgtttgacccgtggggtctgcgggacgaactgacccggtccgctgtcaatgcgggtttatgcaggcggggcgggctgacccgcttacctacccctacttccatgggcaatttatgtggtgcatgcatgtaa

SEQ ID NO: 61166 - DNA, 1158 bp, Glycine max
  Peptide Sequence Number=SeqID_177944
atgacttggaaaagcaggggagacctgcttcctaaaagtgttatgtctcagaaatggatgatttttctctgtgttggaagcttctgtgctggtatgtttttcaccaacaggatgtggactattcctgaacctaaaggacttgcacggacaacagctatggaagctgaaaaattgaatgtagtttcagagggttgcaattcaagaattttgcaagagaaggaagtgaagcgtgaaaccaaaggcatctatagtgaggttttcaagacacaaaatgccatacaaaccctggacaaaactatttcaaacttggagatggaattagctgctgcaaaagcagctcaggagtctatacgaagtggtgctccggtagcagaagatatcaagatgagtgaatcatctggtaggagaagatacctaatggtcgtaggaattaacactgctttcagcagcagaaaaagaagagactcagttcgtgagacatggatgccacaaggtgagaaaagaaagaagctagaggaagaaaagggaattatcatccgatttgtaattggtcatagtgccacatcagggggtatcttagacagagctattgaagcagaagataggaagcatggagatttcctgagactggatcatgttgaaggataccttgaattgtcagcaaagacaaagacatactttgccactgctgttaacttatgggatgctgacttctatatcaaagttgatgacgatgttcatcttcttagtttgccactttcttgcagaggggtaaggtaccatgaaccagaatactggaaatttggagaggccggaaacaagtacttccgccacgccacaggacagttgtatgccatttcaaaagatctggctacatatatttcaaataacaagcacgttctccacaagtatgccaatgaggatgtctcactaggttcttggtttattggactagatgtggaccacatagatgatcgaagactctgctgtggtacaccaccaggtgaagattgtgaatggaaagcacaggcaggcaatgtttgtgttgcttcatttgattggacgtgcagcggaatttgcaggtctgctgaaaggatcaaagaggttcacaagagatgtggtgaaggtgagaaagccttgtggaatgcctctttctaa

SEQ ID NO: 61167 - DNA, 123 bp, Glycine max
  Peptide Sequence Number=SeqID_177945
atggctcggtgcatctctacaagagttgagaaaggtcatcaacgacaatgttcgagctttggaagaaggagattctctgctacgttgaaagagtacagaggcaggttgtctcttaatatataa

SEQ ID NO: 61168 - DNA, 666 bp, Glycine max
  Peptide Sequence Number=SeqID_177946
atgggaagcgtggtagaaagcagagaatggtacttagctgcatattcccctcacggtgtaccaaattccgataatctgaaactccgcaccgtcgctctctcattatcctctgattcaatccccgacggccacgtgtccctccagatcctctttctctccgtagacccctaccttcgcaccagactcaccggcaccctcgacggtctttacattcagcaatatccactcaacgaggtgattacagcatatggagttggcagggtaataggatctaaagacagcaagtacacggagggtgatcttatattaactccttctgcgccagtggctgagtactgtatcttaccctcctctcgtgtaattcgaaaaattgacgctgctagtggaatttcgctgccggattatctaagtgccttaggggtgccagggtttgcggcgtgggtgggtatagtggttctgggagacccaaagcctggttcgaatgtgttcatatctgctgcgtccggtgcggttggtatgagtgctggccagttagctaagattcgaggttgtagggtcatcggaagcactggctccgacgaaaaggctcttcgtcatctttcaaatttgaggaaacgaagccccacttacctgcccaggcctatttgctggccccgtactatatag

SEQ ID NO: 61169 - DNA, 385 bp, Glycine max
  Peptide Sequence Number=SeqID_177947
atactttcccgatggcattgatgtctaccttgataatgttggcggtaaaatgctcgaatctgtacttaaccatgtcaacaagtatgcaaggataccactttgcgggatgatatctcaatataataaggtttggactgaaagagaaggcgtgaggaatcttttgaatatggtgggcaaggaggtgaggatggagggttttatgctggaatcgtattggcatcgttttgaagattttgctaaagaaatggaaggatacataaaagagggcaaggttacgtccaagaataaaataaacattggaatcgagagctttttggatagcttggcctccttgttctctagctctaatattggaaaagttgttgttcaagttaataaggcctag

SEQ ID NO: 61170 - DNA, 282 bp, Glycine max
  Peptide Sequence Number=SeqID_177948
atgcggacaaggagaaagaagaaagcgccaaggacggcaaggactcacagtggtgcagatctgaatatagatagaaacaataaaagggaagatcgagcaactcaacaaaggtgcgaggaggttggacgctgtggtggtgggatttgtagaaagagttgcaccattgctgtgaagcagattgggaaaagcagtgaagggatcacaaagatgacatggacgctgatactaggaagaagaaggtgcatgcagaaagggttttgtcatccgcaaatagggggatag

SEQ ID NO: 61171 - DNA, 708 bp, Glycine max
  Peptide Sequence Number=SeqID_177949
atgggtgaagaggtgaaaagcttggttgttgaagaggaaatgggggtggtggaaagcaaagaatggtacttggtatcttatgctccacacggtgttccaaccaccgatcatcttaaactccgcaaggttcgtctatcaattgcacctgaatcaatccctgacgcccatgttgccattgagatgctgcttttctctgtagatccatatcttcgaggcagattcactggaaccttagatggcctttattttccgcagtttgaactcaaccaggtgatcacaatatttgggattggaagagtgaaacgatcaaatgacagtaaatatgaagagggagatattgttttgagtgcaagttttcctgttgctgagtattgtgtgatgccctccagtgagatcgatgcaaaaattgatgctgcaagtgggatttcattgccggattatctgagcactctaggagtgcctggatttgcagcatggctggggatagaggtggtggcagaccccaaacctggttcaaatgtgttcatatctgcagcttcaggtggtgtgggaatgattgctggtcaattggctaagatcagaggttgtagggtcatcggaagcacgggatctgatgaaaaagtgaggctaatcaaagaggaatttgggtatgatgatggattcaactacaaaaaggaagaggaccttgatgcagttctaagcaagtaa

SEQ ID NO: 61172 - DNA, 138 bp, Glycine max
  Peptide Sequence Number=SeqID_177950
atggcgccaaaaacttgttcggcttccggcaagtgcaccggatcgcacaagtgtataaactatctgtgcaaaaagaaagaaaatcactcgagagaaatgatgtgtaaaaacaagtatagaacacgttggtcttcctaa

SEQ ID NO: 61173 - DNA, 390 bp, Glycine max
  Peptide Sequence Number=SeqID_177951
atgaatttcttgacgacacacaataaaggatgggaacaggagttaagtccttacaatcaatatgaagaagaaagaacttctaatcttgaaagtgtgtttgaagaattcagggcataccatgatagctcaaaagctaatcaaaattcaatgcaaaatcatgaaattcattttggtatgagctactcaatagaaaactttcaagggagaccagagttacaaccttactatcaaaatgaagcagaaagaggttccaatctggataaactgttgatgcaattcatggaaacaactaaatcaactcaacaagcacttcaaagtgtagaaatccaggttggtgagctggcaaaagcagtaactcaatttatgtccagacgagaaaatcctttgtag

SEQ ID NO: 61174 - DNA, 381 bp, Glycine max
  Peptide Sequence Number=SeqID_177952
atgcaatcacagggacttgcactgcctccgaagcatgaggttgctccctcagcttctcgtgttagcacaaaggggagttgtgttgatccctcaccgaccgatccagagacgagtgactcagacaaatgcgggctgtacatcgaagaaaatccatcccgcctggttaccctaggaagactttatgagggatccacagttgttcacaacattcctttgttgcatggccaagtgaaggttggtgttgaggaggttaaaggtgcacaggctcctgttcctgtaccactacgaggtttaactagtggggcaggcactgaacaccttccttgcttggccgacacatcttatgaagcgtgtatcagaacaactgtgtctccagcataa

SEQ ID NO: 61175 - DNA, 228 bp, Glycine max
  Peptide Sequence Number=SeqID_177953
atggattgtttggaggaacagacgtcacaaggttcgtttgtcccccatggacgtcaggatgtcctgactacttccattggacgaccaaaacaccctggccatgtgcgtgctgctggagccagtgtcacgatcaagcaatacttcagattggctccacaaagctcccgcaattcctcctccatccctcccgaagaactcgagaagctgactcaacaaattagggactag

SEQ ID NO: 61176 - DNA, 771 bp, Glycine max
  Peptide Sequence Number=SeqID_177954
atgttaacaacttctgttatttgtgctatgactagtattggtctttcttcatattgtggagccacgttgcctacttttcctagcatttgtgccgtgaatgattacatagaagcagttaaagaactaacatgtgaggttctcgatatggtggaggagggtttgtgggtccaagacaagttctcactcagcaagctcatcagagacgtccatagtgactcactcctaaggatcaatcaataccctcccgtgagcctaaagggcaccaagaattgggacacgtccaaacttgaggcacatcaactccagagccaaaataataataacaacaacaacaatattggctttggagagcattctgaccctcagatcttgaccatcatgcggtccaacaacgttgatggccttcagatttccacccacgatggcttgtggatccctgtcccccctgaccccaatgaattcttcgttatggttggtgatgccttgcaggttttgacaaatggaaggtttgtaagcgtgagacacagggtgttgacgaacacaacaaaggccagaatgtcaatgatgtactttgcagcaccaccgctgaattggtggatcactccactgccgaagatggtgacaccccacaatccaagtctctataagcccttcacctgggcccaatacaagcaggcagcatattctctaagattgggagacgctcgccttgacctcttcaagatccaacgacaacaagatacccatctcatcgcacctgcttcaacctga

SEQ ID NO: 61177 - DNA, 336 bp, Glycine max
  Peptide Sequence Number=SeqID_177955
atgtttgggtttggctatgatccgtcaagtgacaaatacaaggttgtagcaattgcattgactatgctttcacttgacgtatctcaaaagactgagatgaaagtttatagcgcgggtgacagtagttggagaaaccttaaaggttttcctgttctttggactttacctaaagttggtggagtgtatctgagtggaacccttaattgggttgttattaagggaaaagaaaccattcattctgaaatcgtaattatttctgttgacctggagaaggaggcttgcagatcattgtttcttcccgacgatttttgctttgttgataccaatcaattctga

SEQ ID NO: 61178 - DNA, 216 bp, Glycine max
  Peptide Sequence Number=SeqID_177956
atgcccggggaaaaagacagcgttggcgattctctggatatcacccttgtcgccttgttccaaaaacaaacacggtatccttctggtatttcgctaaccccacagtgcaacccattacatgaaccgaccagatgggaatggaattacgaacttacatcacacgattccatgtggatttcagggatggatccgaggcagacatttttcatcagttga

SEQ ID NO: 61179 - DNA, 414 bp, Glycine max
  Peptide Sequence Number=SeqID_177957
atggttgcgccttgtccaacatccatgatggtaagaaccaagaaaacaaaggccatgggagttccgacaatagacctttcaatggaaaggtccaagttgtcggaactggtggtgaaagcatgtgaggaatatggtttcttcaaggtggtgaaccacagtgtgcaaaaagaggtcattgcaagattggaagaggagggaaaggagtttttctccaaaacctcctcggagaagcgccaagctggccctgccaatccttttggctatggttgcagaaatattggccccaatggcgatatgggtcacctcgagtatctcctccttcataccaaccctctttccatatctgagagatccaaaaccatagcaaatgaccctactaagttcagtttaagcggcatgcgtgaaatgttgtaa

SEQ ID NO: 61180 - DNA, 1079 bp, Glycine max
  Peptide Sequence Number=SeqID_177958
gggctgcagcgcaacggagtattaacgcaccctaaattatcttaccggatcgacagcaacgagggtgttcccggtggagaaggcgacacgcatacgctatttcgatgcgagcaggcattcgggcgcatcagccgttacgaagagcggtggctgccgaaagaacgcgtctactacagccatgacgaagtggctgcgctgaccgggcgaaagctggaagctgccgccgatgccacccacagccgcctgaacggctttcaccagtccatccgttttccgaaaatggtttttcaccatctgctgaatgaccggccgcatctgggttattgccacgtcacggcggcgacgaccagcttcgatgcagagcgtcatgtgctatggtccttctatttcgcgaatttcttcgcggaactgagcggggccgaaaacttcttcgaaaatatcgatgcgcgttattcgcggatgtatttcgctgtcgccatcaacgcccttcccgatcaggaaatcgccgtcgatacatccgatcatcaaggcgatatagcagcgacaaagcccccagggacttcatctttctttcttaggcatgtcgttgtcccgaaaccgacgaccagtttcggacaatgtgcattagcgctttccattctgcccggaaatacgctattgaccgccctgaaaggcagcatcatggcgcgtcatatccatattgaaaacgagcgggaaaccgcccttcaagcagccgtcacggagcttgccgccggccagccgatcgccctgccgacggaaaccgtttacggccttgccgccgatgccaccaaccctgcagccattgcccgtatctacgagaccaaaggccggccgcaattcaacccgttgatctgccacatggcagatatcgccatggcggaacgttacgccattttcgatcccatgtcgcttgatcttgcacaggccttctggcccggcccgctgacactggtgctgccgctgaagccggcaagcgatattcatgcgctggcgacggccgggctcgatacggtcggcattcgcgtaccgcaaggttttgccggcgatcttatccgccg

SEQ ID NO: 61181 - DNA, 210 bp, Glycine max
  Peptide Sequence Number=SeqID_177959
atgaggaagtttggagatgacaagtcttggattcaattaataaattttagttatttacatcttaatattcgtccttatgaagaaaaatcaatgattttaccattgtgcatgtctaacaatggagacttcttcatgctgaaattcactagaaatgctgatgatgaataccaaacaattctgtatgaccagagggatgatgtgagttcttga

SEQ ID NO: 61182 - DNA, 318 bp, Glycine max
  Peptide Sequence Number=SeqID_177960
atgactccggcgataaaagagccactttggcaaagaattcagaatttagaggcagtggtaactgagatggctaataaacctaatacaattcctcctgaaaaagaggatattcttcaagagtcattgagtcgcataaaatgtatagaatatgacttgcaaaaaacaaagaaggccctgctagccactgcttcaaagcaagttgagcttgccgagtcattggaaagcttaaaggagagtaaatttgacgaaactcttccaagtggattacgattgcttgaggaatgtgggctatggggagtgcatagccccaatgtatag

SEQ ID NO: 61183 - DNA, 1305 bp, Glycine max
  Peptide Sequence Number=SeqID_177961
ctggtgagtattcttgatcctgggttggatttgttgttattaaaggtggttcttgtttttcccttggtgcagaggcaatctaggtgcaaattgcttgtcttgaatagaatgccaggagaagaagtattagctcaagaagatgagaggggtagatgttttgagcctgaaacctctgaggatgagtggcggaagtctcgagctagatctcttaggagaaaagcaatgactgcttcaaccagactcgcttatagtctcaggaagcgtaatacacgtgtagcaaatagtgactttgcttcaattttcatagaagatgtccgcgatgctaacgaggaaaaagctgtgaattcatttcgtcaggtgctacttacaagagatctgcttccagattcccatgatgattatcatgaaatgctgaggtttctgaaagccagaaagttcgacattgataaaacagtccagatgtgggcagatatgttgcattggaggaaggagtatggagtagattctattttacaggaatttgtatataaggagtatgaagaggtacagtgttattatcctcatggctaccatggtgtggacaaagagggccaaccggtttatattgaaagacttggcaaagttgaacccagcaagttgatgagtgtcacgacagttgatcgatttttaaaatatcatgttcagggatttgagaaaatgtttaaagagaaattcccagcatgttctattgcagcaaagaggcatatagataaaacaacaacaatacttgatgtgcatggagtgaattgggtcagctttagcaaagttgcacatgatcttgttatgcgtatgcaaaaaattgatggtgataactaccctgagacattaaaccaaatgttcattgttaatgctggtagtgggttcaagctactatggaatactgcaaaaggttttcttgatccaatgaccacagccaaaatacatgttttaggcaacaagtttcagagcagactgttacagattatagactcaagccaacttccagatttcctcggcggcagttgttcgtgcccaaatgatggagggtgtcttagatctgataagggaccttggaatgatcctgacattttgaaactattgcattctagagaagcaatgaagctaacaaagtttggaagttcttctgttgctgatggggttgatgtgaagtcatatgccagcaaggttaaaagcactggaatatctgaacctctatcagcgtcagaagtaagattgaatccttcagccttcgtacaatctgttccttcaagtgaaaaagtgagctga

SEQ ID NO: 61184 - DNA, 450 bp, Glycine max
  Peptide Sequence Number=SeqID_177962
atgtgtgcagatcttttggctaagcttggtacttctactgaagctgagtttctaccctcctcctgtcctgacatagaatctctagtacagctgaaggatgttctaggctgccgcgctttggttggcacttggcaaggggagttgataaatagattatgcctaaggttgatgctcaagtaccagactgggtgcaacaacatacgtggattcatgggattcaaattcccatcacgctgtgggttgtttggagggctaggaataaaacaaagcagatggatttgctgggtgagacctcctttaagggcggtgacattgaaggtagatggtagcatgatgggtagccctcctagggcagggtttggaggactttgtagggttcaccatggaagctttcttgtgggcttatatggtcatgttggagggcaagagatcttatatgctgagatttaa

SEQ ID NO: 61185 - DNA, 228 bp, Glycine max
  Peptide Sequence Number=SeqID_177963
atgacaccgacacgtggtggcgttgtttgggaagcaaaaattgtagactttagtctcaccgattttaagcaagaagatgcaattaatgagtgtgaatttaagcattggaaggtgttgcttcaaagttgcttagtttttaatccttcttcttcaccgagtttgttcatatcatcttccattccaaacattgaagattgcagggaagtgggaggaacttctgaattatag

SEQ ID NO: 61186 - DNA, 1182 bp, Glycine max
  Peptide Sequence Number=SeqID_177964
atggccaaagaaaccttccccatagaactaatagtagaaattctgtcatggcttcccgtgaagcctttgatccgattcaggtgtgtttccaagacttggaaatccctaatctcccatccaatcatggttaaattgcacctccaaaggtcgtccaaaaacccccacgtcctattaacatttgaggacaacaacaggaacaacgataactgttattccttcgctgcaacctgctctatacgtcgtttacttgagaatccatcatccactgttgacgatggttgctaccaattcaacgacaagaatcactttgtcgttggtgtctgtaatggcgtggtttgcttgcttaattctcttgatagggatgactatgaggaatactgggtccgattttggaacccggccacaaggactatgttcgaagattcgccacgcttaagtctccattggcgcaaatataaaactgggcggaatgattgggtctgtgggtatcctaggtgtgggtttggctacgacggtttaagtgacacttacaaggtggtgataatcctttcgaatgttaaactacagagaacagaagtgagagttcactgcgtgggtgatactcgttggagaaagactttaacttgtcctgttttcccgtttatggaacaacttgatggaaagtttgtgggtggcactgttaactggttagcactccatatgtcgagttcttattatcgatgggaagatgttaatgttaatgagatagtgattttttcgtatgatctaaacacccagacatacaaatatttgttgttgcctgatggtctttctgaagtccctcatgttgagcctattctcggggttttgaagggctgcatgtgtctttctcatgagcacaggagaacccattttgttgtttggcaaatgatggactttggagttgaaaaatcttggactcaattgctgaatgtaagttatcagcatcttcaagttcatgactttccatcttgtccaatgataccattgtgcatgactgaaaataatgatctctttttgctggcaaacaatgaaggtgaggaatttgttgtctacaatcggaaagataatagagtacagtgtactgaaggtttcaagaacggcaaattttcatttttttcttatgattatgttcaaagcttggtttttccgtatccaaattaa

SEQ ID NO: 61187 - DNA, 513 bp, Glycine max
  Peptide Sequence Number=SeqID_177965
atggagagaaagttcatttcagtagttgttttgggagtatgtttggtgctgggaatgtcccaatatgttgatgcaaggaacttggagaaaaaatcaaaggaagaggtgaagaagccagaatcgtgcttagatggagggtccattggtggtgttggtggcattggcggcattggcggtgctggtggaggtggtggtggtttaggaggtggctatggaggaggagctggtggtgatagtggtttaggtggtggatatggaggaggagcaggaggtggtggagttggaggacttggaggtggtagtggtcttggtggtggttatggaggaggaagtggtctaggtggtggaattggtggaggcatttacaaaggaataggaattggaggaggcatttacaaaggaattggaattggaggaggcatttacaaaggcattggtggtggtgtaggtgctataggtggtgttggtggtgtcattggtggtttcaagcatgttgaagccaaaaagccttga

SEQ ID NO: 61188 - DNA, 3792 bp, Glycine max
  Peptide Sequence Number=SeqID_177966
atggagtcaggaaacttcttttataatgcaggaattttgattaaaacaactcgccagtgcaattggcgagtcctttctgcccacaaaccgctagccaggctggcgattccctcactgaaagcaaaccgccaatacggatggcgattccctcctgcatggcctgaccctgaagaacctgcttgcactctcctacacctagcccggctgagcctacttgttggaactttttataaaagcaccccaaatgcgaaaatttgccaggttttgtttgtgtttggaagaaaactgaacacatcacgagacccttttccaccaacagtcgctgtgcctgtgttacttacgctctcagtcactctagtagggagcatcatcatggggacgacaacgacgacaaccctttccaacacggttcgcgtgtccaacatcccccaatccgcgaccgcgaaggacctcctcgacttcctcgaatcgacggtgggtccctcgacggtgttcgccctcgaaatcttctccgacaaccccaactggaagtcccgcggcttcggccgcgtccagttcgagaccctcgacgccaggtcccgcgccctctcgctctcccaactcaaccacctcctcttccaccgccacttcctccgcctctccgaaaccgacgccgacatcatcttccgcccccaacaccgccttcataacggcgtcctctacgccggcttcgtgctctccgaccaccgcatgagcgtcctcgaatcctgggagggcgtcgcgggctgggtcctgcccctaaggaagaggctggacttctgggtgtggcataatggcgactgttacagactcgagtttttgtttgaggatattttggagtctcatggctattgtttgggagaagatgccaaactcaatgccctcctcttgaagatgaaatttgggccaaggatttataagaaaaagacgggggcagatgtggcagccaagtttaggggagatagataccgtttttgtaaggaggattttgaatttctttgggtgcggactaccgacttctcacctctcaagtcaattgggcactctacttcgttttgttgggaaattgtggaagaacatttagctttggatgtttttaaaagtttcccactctacaaggaaaatttgagagatctggctctggaagacggagaagaattctgttcttcgacagaagcagttccgcttgtaaagcgtgcttcacaatccaagttaccttatgaggctcttttccagctgaattctcttgttcatacccagaaaattagtcttgcttcggtggatgatgaattgattgacttgttagcaggcttagatgaagaaactagagctgtgatttttctgaaattgcacaagatgagcttcacctgttatgagcctctcaaatttgtcaagactcaattgcatgtgctgagtaacaagaaaaaaggtctgccacaatcgtcgcagaaaaggttgacagatagtaacattatgagctgtcatagagccttgattacccccacaaagatttattgccttggtcctgagcttgaaacctcaaatcatgtggtaaagcactttgcttcgcatgcatcggacttcatgaggattacctttgtcgaagagaattggaataagcttccaactaatgcagtatcaactggtgtgcaaaagggactcttttcaaagcctttgaaaactgaaatatataagcggatattgactattctccgagatgggattgtaattggctcaaagagatttgagttcctggccttctctgctagtcagctgcgatcaaattctgtttggttgtttgcttctaatgacaatctgaaagcagcagatatcagagaatggatgggatgcttcaacaatattcgcagtgtttctaaatgtgcagcgaggatgggtcagttgttcagttcttccatgcaaacttttgaagtggtctctcaagatgtggagataattccggatgttgaagttatttctgatggtgtaagctattgtttctcagatggtattggaaaaatttcccaatcttttgctaggcaagttgctcaaaagctaaaattggatcatactccatcagcatttcaaattcggtatggaggatttaaaggtgtcattgctgttgatcgccgttcctttaggaagttatcattgcgtagcagcatgcttaagtttgaatccaaaaacagcatgctttgtgtcactaaatggagtgagtcaatgccttgctttctcaatcgagagattatatccctgttgtctacattaggagtaaaagatgaggtgcttttggcaatgcaacatgaccaattggatttgttaggaaggatgctgactgatagtaaagcagctttggaagttttggaaagtttaaatggagctgattcaaagagcattctagtgaagatgttgcatgaatttaatgagccaaacagtgagccttacctatcaatgatgctcaaggcttattatgcataccaattatctgacttgaaaagtagatgccgaatatttgttcccaagggtcgggtcttggtaggttgcttggatgaaactggtcttttgaattatggccaagtatttgtccgcataaccgtgacaaaaactagggaaaaatttggagatgaaaacctaaggaaagtggatggggatgataacacatgtataatagtgggaaaggtggtggtcaccaaaaatccttgccttcacccaggagacatcagagtccttgatgctatctacagtgaagaattagaggagaagggtttgagggattgccttgtatttccacaaaaaggacataggcctcatccaaatgaatgctctggaggtgatctcgatggagatttgtttttcataagttgggacaaagatctaatcccatgtcaaactgaggctccaatggactacacaggaaggaggccccgtataatggaccataaagtgaccctagaggaaatccaacaattctttgttgattacatgatcaatgatactttgggtgctatctctactgctcatctagttcacgctgaccgtgaacaagataaggccaagagtagaaaatgtctggaattggcagagcttcattccatggctgtcgactttgcaaagactggagcacctgctgcaatgcctagagttctgaaaccaagagagtttccagatttcatggagagggttgacaagcctatgtacatctccaagggggtactgggaaaactttatcgcgccataattgagtcacaaatgcaaataagatatagctttgtgtggtcagagaagcatgctgaagaagcatatgaccgtagccttgaagtgaatggttttgaggccttccttgagacagcatcaactcacaaagaaatgtatgcagagaagatgagcagtttaatggacttctatggtgcagagaccgaggatgaaatgctacttggtaacttgcaaaaccgtgcttcatatttgcagcgtgataacaggagatatggtgatatgaaggatcggattctgctctcagtgaagaaccttcagcgtgaagctaaagaatggtttgaaactagttgcgaaccgcatgaatataagcctatggcatctgcatggtatcatgtgacctatcaccccagctattattgccgggaaagcccatgctttctaagctttccatggatagttggtgagattttgctgcaaataagtggcttcatctataaccaggttcagcgaatcaagtgggttgggttactccaaaaccgtttcaccaaaattccgggtttgtag

SEQ ID NO: 61189 - DNA, 2586 bp, Glycine max
  Peptide Sequence Number=SeqID_177967
atggtggtaagatcatgctcgaatttgtctgacttggtgtccaaggacagtttgaattcccctcaaactcctggagctcttccccgacacctgtctgttccaggaattatgtctgatgtggatagcaaactaacgggcaatgatgattcaaatgctttctcatcagaactacatcagaagaagatcattatagcagcaaatttccttcctcttaatgctcaaaaggatgaaatatctggcaaatggtgcttcacttatgatgaagattcaatcttggtgccattgaaggatggtccctcttctgacactgaggtcctttatgtgggatctctgaaggttgatgttgatgctagtgaacaagagaaagtttctcttcagctactggaggaattcaattgcttgcctacctttattccttcagacatccagaaactgttttataatggcttctgcaagcaacatttgtggcctctgttccattacatgttgccgttgtatccagactactgcaatcgttttgacaagtcactgtggcaggcttatgtttctgctaacaaaatatttgctgataaagtcatggaggttatgaatccagagcatgattatgtatgggttcatgattatcatcttatggttattccaacatttctacggaagcgatacagttggatcaagataggatttttcctccactctccatttccttcatcagaaatttatcgggctttacctgtcagggatgaaattttgaaagcactgcttaatgcagatttaattggttttcatacatttgattatgctcgccactttctttcctgctgcagtcgaattcttggcttagaatatgaatccaaaaggggttacatcaggctcaaatactttggccgtacaatattcattaaaatcttgcctgtagggattcatatggatcgacttcaatctgcctttaatcactcttctttttcagtcaatgtcagagaaatgtcagagaagttcaaggagaaaaaacttattcttggagtagatgatatggacatttttaaaggtatcagcctaaagctattggccatagaacaactccttcagcaatatcctgaattgttgggagaattaatacttgtccagattgtaaatccaccaagaagtactggtaaggatgtagaggaagcaaggaacgagatgcacattattgccaacaggataaatgaaaggtttggtttgctagattatgaacctgtcatcatcatcaatcgtcatgttccgttatatgagaaggcatcctactatgctttagcagaatgttgcattgtggatgcggtgcgggatggtatgaatttggttccttacgagtacattgtctgcaggcaggggagtcctacaatggatgaagctttagacattggttctgaatcacctcgtacaagtgcacttgttgtctctgagtttataggttgctcaccttctcttagtggggcaatcagggtaaacccatgggacattaatgctgtagccgatgcactgaatttggccatcacaatgcccagtggagagaaacagttgcggcatgagaagcactatcgatatgttagctctcatgacgtagcttactgggccaaaagttttgtgcaagatcttgagtattcatgcaaggatcactatagtaaaaatcgctgggggattggctttggccttaatttcagagttttgtccctttctcctactttcaggaagcttaacaaagaccatgctgtttctgcatatgaaaggacaaattgcagggcattctttttggattatgatggaacagttgtgccttccgttgttaaaactccaagttctgaaatcatagatgttctaaatatcctctgcagtgaccctaagaacactgtgtttatagtaagtgggaggggggaaaccacgctgagtgaatggtttgatcagtgtgagaatcttggtatagctgctgagcatggttattatctaaatcaacagtcagcttgggaaatgaaccatacaagtaccagtttttcttggaaagagattgttgaacctgtgatgagattgtatactgaggcaacagatggctcctatatagagaccaaagagagtgccttggtatggcactactatgatgctgatcctgattttggatcttggcaagccaagcagctgttggatcaccttgaaggcttatttgcaaacgaaccggtaactgtaaagaaaggaaagcatattattgaagtcaagtcactggggattactaaagggttagtcgtggagggcattctgtccaagatgaccaagaatgggaaaatacctgattttgtactctgcataggggatgatagatctgacgaggacatgtttgagagcttgctgaataaagtttacagtggaacctcttctcctgcaccagaaatctttgcatgcactgttggtcaaaaaccaagtaaagctaggtactatttagaggatactgaggatgtgatgaggttacttcaagctcttggtaccgtttcagtgcctaaatcaacatctcctgaggaagactcttttggaaaaacagaagcctgtttcgacgtttga

SEQ ID NO: 61190 - DNA, 108 bp, Glycine max
  Peptide Sequence Number=SeqID_177968
atggctgaggagcaaatgaaagtgtctgagacaatggctaaggggcgcgttgcggacattctaaggcggttatttataaccgccttagaatgtacgagtaaaaactaa

SEQ ID NO: 61191 - DNA, 339 bp, Glycine max
  Peptide Sequence Number=SeqID_177969
atggagtgcattggtgtcacatgggttagtgctgagacgctcttcgagaagcctcttggcttcctcctcggtgaaggcggtgttggactcgacggcggaggagtggaagcacatgaagaaaaaggtagtggcagcaatgacgatgcaagtggtttcaacaacaagagaagaatgaggttagggtttggaggagaagggagatggagggggagaaggaagaggataagggagtggaaaatgggtaaggccctcgaaggagaagtaagtgtgaacattggtactacaccagggaagactgagtgccataatgaggaaaaggctaggtcttcatcttgtgag

SEQ ID NO: 61192 - DNA, 243 bp, Glycine max
  Peptide Sequence Number=SeqID_177970
atggaagaaccatttagggttttagaccatttgattgagcttgaaccggaggaactggagtggttgctcctgaaggcaaacatgcacatctacaacaacaaccacaccaacatgcgcaaacttttcgaggaaatcctcaagaaagacctacttcgtgaggaagtgttccacggccttgtcatggcgactttgcgatccaacgagctcttgaaagggctattgaagagagtggaagagcaataa

SEQ ID NO: 61193 - DNA, 1425 bp, Glycine max
  Peptide Sequence Number=SeqID_177971
atggccagaacagtctccaacagcaatgaaacagcagctaaagaggagggtgaggtgagaaatggcgtaaggaaggggccatggaccccagaagaagacgcgatcctgatggactacgtgaagaagcacggcgaagggaattggaactctgtgcagaagaattctggcttgttaaggtgtggcaaaagttgcagactcagatgggccaaccatctcagacctaatctcaagaaaggtgcattctctcaagaagaagaacaagtcatcatcgaccttcattccaagcttggaaacaaatgggcacgaatggcagcacagttacctggtaggaccgacaatgaaataaagaacttttggaacaccagaatgaaaaggcgtcagagagcagggttacccctttatcctcctgaagtccatgcagaagccacttcataccttctacaacaccaccgttacttggaacaacaacaacaacaacaacctcattcatcttcatcattttctcttctcctatcttcatgttaccccaataaactcaatgatccaaaccaaacccatcatcattccaatgcaaatcttctgcaaagccaacctgatcattctgccaaccgttacatcaatccaagccagcaattcaagttttccaatgaaaacagtggaagcaatggaaattttgcttttccattgtcccctctttctccatatggatcctcctcctccacccttcttaaccacagttttggtggtggtgatcatggcttcatagcaggatctccctatgaacccttttctttggtgcaaggctccaccactgacatctcttccaaccagacaccaacccctgcttcatcctatgctagtggtgtcgatggcttgatgggagcttcaagcatggttaataacaacaataacaataatgattactatgaagttgcaccattgtctcctcctcaaggaaacagtggcctgttggatgctctagtgatggaggctcagggactttctcacaatgagaagtcaaagagtgaggaggacccaaacttagctgggaagttatcttgtaagagaaagaaaatggaatatgctgaggagggaggcactgtgccagccatgaagaagaacagtggcaacagtactactaatgaaagccagagggatgatgatattagctcctctcaattggcaaaagggaaggaacaaattggcgaggacccgttggaagagatgaatgggatggacgatgacctggttagcctgctcaaccattttcccttagaaatgccaatgcctgagtggtaccgtagagggggaaatcagtcattgggacttgaaaatcagcccaaagcttcactaccagatcctgctgatcaagaacatgcttggactctcggaacttgctggaacaacatgcctcgcatatgctaa

SEQ ID NO: 61194 - DNA, 111 bp, Glycine max
  Peptide Sequence Number=SeqID_177972
atgaggaatgaacgggggaggtttgccatagactatttgataaggatgataggccgtgctcatgcgaagttaggtgccactgagtttgaaaagtttgcgccaaaagcttga

SEQ ID NO: 61195 - DNA, 456 bp, Glycine max
  Peptide Sequence Number=SeqID_177973
atgaaagagttctaccacactgttaggcaagtggaggtggaggatgctctccgacaaggagagtcggagagcttgtggtgtaaaattctaagatcaaaatatggggaagggtactctagtggagaagtatcaaaaagagagcaagatacaggcgtgtggtgggtggagggatggggtatggtcatggcagaattggttggagtgggaaaaactgatgggtcggtctggattcttggcattgaaatacctgcacctcaggttctcgacaaatatttggaacaagtgctacaattggcagggagtggagatggtacagcacagcgatcctcggaagcgctttgttcaacaccatatgggaagcttcttgaagaaaccagcaaacttggcttcggcagtatggtgcgaaacaacatgggtcctatggcagcaccaaaatgggattatctttcacaatga

SEQ ID NO: 61196 - DNA, 249 bp, Glycine max
  Peptide Sequence Number=SeqID_177974
atggggctccgaaaaaaaggcgaggttggagaattgcacgaagcaatctctacgcatggctccaaactcgtaggtggaggacacatgaacagcgctaggcaatggcattcatggggctccgaaaaaaagtggagaatggagaattggcgaatagcgctacacaataacttcgcggggctccagactccaatcactacgcatagctccaaactcgtaggtggaggacacatgaacagcgctaggcaatga

SEQ ID NO: 61197 - DNA, 267 bp, Glycine max
  Peptide Sequence Number=SeqID_177975
atgcagcatgtgactggccagcaggcggctaatcacaggggtcaggtgcagtggaatgagagcttctaccgatacaccctgcaccagcagagccaggaccccagtcccttcccatggcctacccccgagcagttcagggccacagtggcatggcctggagatgagcccgattttcaaacagaggcaggacccatagaggcctccgaagatgaggatggagctcaggaggatgatgatatgactaatgtgcttaagtacttcatgtga

SEQ ID NO: 61198 - DNA, 225 bp, Glycine max
  misc_feature (220)..(220): n is a, c, g, or t
  Peptide Sequence Number=SeqID_177976
atgttacaagcaccaggtggtctagtggacaatgatcgtagacgtgaggctttgtgtgtccgcttcacggcagacggcgaagccaatgtgtccgaagtaggaggaagagaaggaagaggaggaggaggaggaggaggaggaagagtggaggcagaaaacaaagaggggaacaagcaaccatttgaaggttgtacaatcaggaacttaaggattccaaatnactag

SEQ ID NO: 61199 - DNA, 460 bp, Glycine max
  misc_feature (432)..(432): n is a, c, g, or t
  Peptide Sequence Number=SeqID_177977
atggctggcattttgcatcccatgaaaggagtttctatcaaggaagttgaacaaggtttcttcctcttccgattttttcacaagttggatgttcaaagaatcctcaagagaggtccttggtcttttgatgggcaccttcttgtactaggagttataaaggaaggagaatcgccatcacaggttcctttgtacaccgtccctttctgggtgcaagaacacaacatacctgcagcttttatgacttttgcaccagggcaaaatattggcaactacttgggagaatttcttgaatataacaacaagaacaatttgagtttttggagaaagtacatgagactgagggttcttatcaatgtccggaaacctttgaagcgtactaagaagatcagaaaacctggaggagaggcaaaggaagtggcttttaagtatganagattagggaatttttgttacttttgtg

SEQ ID NO: 61200 - DNA, 312 bp, Glycine max
  Peptide Sequence Number=SeqID_177978
atggtggaatggtgtggtggagttttggccaactgccataggcaatttgtaggcggtgccataaggtatgtgaaaagagaacatcttattgatgttactgaagtgtttagggtttgtcacacccttacaatagagcatgcttatctactgtgcattagcttggatgtgttgttaaatgacggccatggcggcgccatgacggttttccatggcggattttcgaaaaaacgccaccgaatagcggtggcgtggcgggtttgggatggcggcgtcatggcggccgccgtagccatggcggtcgtggcggggtag

SEQ ID NO: 61201 - DNA, 408 bp, Glycine max
  Peptide Sequence Number=SeqID_177979
atgaaacttctaagtacacgaaagttgcccctttttcatgcagatttacccatcacagagatgcacagaggaacagaacgaacttcatatatcccttttctactcaatccagaaacaagatcggacgttattccggttcgtctccattttcgtgaaactattcctcaagcaaggcagccgataagtcgtcgaagggatctgtcttcaatcctttcacctgagcgccttgatggtacaagttgtcctgaacgacaccaaaaaggaaaaaaggtggagtctcctaaggacaactccatcgttgctactggatttgttgctaagttaggtagtggtacaatatctatttctaatgtactttttattccttctcttaattgcaaacttttctctgttagtcaattaacctag

SEQ ID NO: 61202 - DNA, 432 bp, Glycine max
  Peptide Sequence Number=SeqID_177980
atgacatgtgttaaaaccttaccccctctctcttcaatccatgacgccaaccccctctctctctatgttgctcttttctccactgacactcttcccttgaaccaccacacctcaagcccttgtcgtcctctctgtcatcgtcatcacatgccttcatcgtcaatcgccccatcacaacggagcacagttgctagagagcaacaccgcgttgcttctggattccttcaaaaggtgaggcttctcatctttcatcgttttgatttggtcggaggaaggacattgcagcttcaggtggttagctttggtcaaaaacttgatatgggttgttttgatttgagaggaattcaatccgatttgggtttgggagaaaagggttgtttggttggtgcagtgttgtgtttccggcataatagacaggtgaacctaatctaa

SEQ ID NO: 61203 - DNA, 382 bp, Glycine max
  Peptide Sequence Number=SeqID_177981
tgctcttcctgaaggctacgccaccaaagtaggtgagagaggagttcaactctctggtggccagaaacaaagggtagctattgccagagctgttttgaaaaaccccgaaattttgctgctagatgaagccaccagtgcacttgatttggagtctgagcgtgttgtgcaacaagctctagacaaattgatgaagaacagaacaacagttatagttgcacacaggctatccacaataacaaatgcagaccaaatagcagtattagaggatggaaagataattcagagagggactcatgcaagacttgtagagaacacagatggagcatactacaaattagtcagccttcaacaacagcagcatatacaagaacataatgattaa

SEQ ID NO: 61204 - DNA, 2886 bp, Glycine max
  Peptide Sequence Number=SeqID_177982
atgtatatacaggttgggaatttcatgcactacataagccgttttatcgcaggctttaccattggttttgtcagagtgtggcagatcagtttagtgacacttgccattgtacccttaattgcccttgctggaggcctttatgcatacgtgacaattggtcttattggaaaagttcgaaaatcatatgtgagagctggtgagatcgctgaagaggcaagagtaaaggtgataggcaatgtgagaacggtacaagcatttgcaggagaagaaagagcagtgagatcatacaaagtagctctgatgaacacatatagaaatggtcgaaaagcaggtttagcaaagggtctgggattaggctctatgcattgtgtccttttcctttcatgggctcttcttgtttggttcactagcgtagttgttcacaagaatatcgccaatggtggcaacgctttcactaccatgctcaatgtagtcatttctggcctgtcacttgggcaggcagccccagatatttctgcatttataagagcaaaggcagcagcttatcccatttttgagatgatagagagggacacaatgagcaaagccagctcagaaaatggtaaaaagttaagcaaattggaaggtcacatccagttcaaggatgtctgtttcagttatccatctcgtcctgatgtggttatcttcaacaatttttgtattgagattccttcagggaaaattttagctcttgtgggaggaagtggttctggaaagagcacagttatatcgctgattgagcgcttttatgaaccactttctggtcaaatactattagatgggaacaatatcagggaacttgatcttaaatggcttagacaacaaattggattggttaaccaagaacctgcactttttgccacaagcatcagggagaacatactgtacggaaaagatgatgccactcttgaagaagtaaatcaagctgtgattctttctgatgctcagtctttcattaacaatcttcctgatgggttagatactcagaatcaaccttttgaaatgcaacgtgagggtgtaggatacaataaccaactttcagcaagggcggacccaactgtaaatgagagagtgcatatgcaccctctggttggtgagagagggatacagttatcagggggacagaaacaaaggatagcaatatctcgtgctatagttaagaatccatcaatccttttattagatgaagcaaccagtgctctggattcagagtcggagaaaagtgtacaagaagctcttgatcgtgtaatggttggtagaacaaccgtaatagttgcacacagactttctaccattaggaatgcagatatgatcgttgttattgaggagggaggaaaggtggtggaaattggaaatcatgaggaactcatttccaacccaaataataatgtatacgcatctcttgttcaaatccaagaaaaggccttttctcaaagccacatttctggggatccttacttgggagggtcatcaaggtacttgggagggtcatcaaggcacctaggagagtcatcatcccgcgcaacaagctttcgtggtagtttccgatcagataaagaatcaactagcaaggcttttggagatgaagccgaaggtagtgttggaagttcttcaaggcatgtctcagcaagaagactgtattcaatgattggtcctgattggttttatggtgtttttggaaccttgggtgcatttattgctggagcacagatgccactttttgctcttggaatctctcacgctcttgtatcttattacatggactggcatacaacacgtcatgaagtgaaaaaggttgctctactcttctgtggggcagcagttttaaccatcactgcgcatgccattgaacatctttcctttggaatcatgggggaacggcttactcttcgggcaagagaaaaaatgttttctgctattttgaagagtgaaattggctggtttgatgacataaacaacacaagttctatgctttcatcacgtttagagactgatgcaacatttttaagaactgtagttgttgatcgatcaacgattcttctgcagaatgttggtctggttgttgcttcatttattattgccttcatgttgaactggaggataacgcttgttgtattggccacataccctttaatcattagtggtcacattagtgagaaactatttatgcaaggatttgggggcaacctgagcaaagcatatctaaaagccaacatgttggctggggaggctgtgagtaatatccgcactgtggctgcattttgtgctgaacaaaaggtccttgacctttatgctcatgagcttgtggagccttccaagcgttcattcaatcggggccaaattgctggcatattctatggcatttcccagttctttattttctcttcttatggccttgccttgtggtatggatccgtgttgatggaaaaggagctttctagcttcaaatcaattatgaagtcatttatggttttaatcgtaacagcgctggctatgggggagactttggcactggcacctgaccttttgaagggaaatcaaatggttgcatcgatttttgaagtgatggatagaaagacaggaatattgggagatgttggagaagaactgaagacagtggaaggaacgattgagctaaaaagaatccatttctgctacccttcaaggccagacgtggttattttcaatgatttcaatcttaaagtgcttgcaggaaagaatattgccttggtggggcatagtggttgtggtaaaagctcagtcatctcccttatactcagattttatgatccaacatctgggaaggtgatgatagatggtaagatgtttgaacaacttatgctttaa

SEQ ID NO: 61205 - DNA, 456 bp, Glycine max
  Peptide Sequence Number=SeqID_177983
atggatataaacgagggaagaaagaaggaaaagggcacacaacaggaacgaagaaaggttccttttctcaagctgttctcctttgctgatttctacgattgtgttttgatggctattggaactgttggggcatgtgttcatggtgcttctgtgcctgttttctttgtcttctttggaaagattatcaatgtcataggcttagcttacctttttcccaaagaagcttcccacgaagtttccaaggtggcttgttggatgcatactggggaacgtcaagctgcaaagatgaggatggcatacttaaggtcaatgttgaatcaagatataagtctttttgatactgaggcatctactggagaggttatttcttctattacaagtgacatcatcgttgttcaagatgcactgtctgagaagcttcaaaacggtggatatggtcatgtgtacattatttaa

SEQ ID NO: 61206 - DNA, 327 bp, Glycine max
  Peptide Sequence Number=SeqID_177984
atgacgatggagtgtcaattgttaggtttgccactagagggttattggtacacatgggttcgaagtcagggaacaaccaatgcagtcgaagggaggctcaacagagcgagccttataaatttgatcacccctatatcttaccgcatttcaatccatcttcaagtttacacaaagaaaaaggagttcgtgagaatgaggtttaggtttgagaatgtttggttggacaagaaggagttggaggaagtggtgcagttcagttggcagcaagctgctcaagaaagtataccccataaaataaaagcatgtacgggggagttggagaattaa

SEQ ID NO: 61207 - DNA, 342 bp, Glycine max
  Peptide Sequence Number=SeqID_177985
atgcctacttacataagggcctcagatcccaaccaacacccttgtgcttctagttataccacccactacgcatgtctcattaccctaaggcacgatctagccaaactaacattttggtgcctaccgtggggcacagtgaaacactttcgtcaccctttgtttttgccttgttttcttctgctttcaatggcgaggcccactagaaccaggacatctacatcaaggaatggtggaagagtgatgcaatcctcccaaggaggggacccatcaccagatccatggctaggagactccaagaagattgggctagagatgcaggagaaggccctaggattctcatga

SEQ ID NO: 61208 - DNA, 225 bp, Glycine max
  Peptide Sequence Number=SeqID_177986
atggctgcaaaagcttctagcgctcaggtcaaggatgtgatcattgcggaagtaattcgtacatcttggtatctatggataactgggattataggagctatttacgcattggaaataacgctatctaaaggtcggtctaagctatggcttgagttcgattcttcacttgttgtgttggcatttaaggatccttccattgtgccgtggaacttgaggaattgctag

SEQ ID NO: 61209 - DNA, 219 bp, Glycine max
  Peptide Sequence Number=SeqID_177987
atggcgcagataaaggacatggggagggaaaatgaaaaggctaggagggagggtgaaaaagtgaggatggcggcagataaagctcttaaggttttggaagtcaacctcagacattttgtaattcatagccaacaaggagaggccgcccataacgatcgacctatttggtgtgtgccaatagccagggaaatcaaaggagtttttgacaagattcaatag

SEQ ID NO: 61210 - DNA, 555 bp, Glycine max
  Peptide Sequence Number=SeqID_177988
atgatctatcctccatctcccatcagatggcacgtcaaatgcaagatgacccgcacgaagaaaattgaccagatgacgattcgttggaggagcaggtgccacagggttgttgtccatggacgtcaggatgtactgactgctaccattgggcgaccagaacaccccagtcgtgtgggtgctgctagagccggtgtgacgatcaagcaatactttggaccgactagaggatcccagtttcagtcgcagataaaatcacagggacttgcactgcctcctgagcctgaggttggtccttcagctgctcgtgtcagcacaaaggagagttgtattgatcactcagggaacgatccagacatgtgtgactcagacaaatgcgggttgtacatcgatgaaaatcctccttgcctggttgccctaggaagagtttatgagggatccataatcattcacaacatccctttgttgcatgatcaagtgaaggtcggtgttgaggaggttagagatgcagatgctcttattcctgtacccattgaagaggttaagttagtggggtag

SEQ ID NO: 61211 - DNA, 189 bp, Glycine max
  Peptide Sequence Number=SeqID_177989
atggagaattggcgaacagtgctaggcgatgacattcgcgtggctccagactcgaagcgcttggcaatgacattcatggggctccgaataaaagtggagaatggagaattggcgtatagagctaggcaatcacattcgcggggctccagactcgaaggtggaggacacatgaacagcgctaggcaatga

SEQ ID NO: 61212 - DNA, 270 bp, Glycine max
  Peptide Sequence Number=SeqID_177990
atggattacgggactcaatcagacatccgagcaaaaagttattgtcgtttgaatttgctgagagcatcaacattcaatttcgagcgtctcgatctcagagcttcagaattcaatttcgagcgtctcgatgtattacgggactcaatcagacatccgagtaaaaagttattgtcgtttaaaattgccgagagcttcaacattcaatttcgagcgtctcgatgtattacgggactcaatcagacatgcgagcaaaacattattgtcgtttga

SEQ ID NO: 61213 - DNA, 1224 bp, Glycine max
  Peptide Sequence Number=SeqID_177991
atgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacgggtaaaacagcagtagccacagatactattctcaatcaacagggacaaaatgtaatatgtgtttatgtagctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttatgtaccgtgaacgtcacactttaatcatttatgacgatctctccaaacaagcacaggcttatcgccaaatgtctcttctattacgaagaccacctggtcgcgaagcttatccaggggatgttttttatttacattcacgtcttttggaaagagccgctaaattaagttctcagttaggcgaaggaaatggccaaatattcttatctgccgatctattcaatgctggaatcagacccgctattaatgtaggtatttccgtttccagagttggatcggcggctcaaattaaagccatgaaacaagtagctggtaaattaaaattggaattagcacaattcgcagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacaggtaaggaaatttcttgttgagttacgtgcttacttaaacacgaataaacctcaattcaaagaaatcatatcttctaccaagacattcactggggaagcagaagtccttttgaaggaagctattcaagaacagatggaactctttttactacaggaacaggtagaaaaaaattga

SEQ ID NO: 61214 - DNA, 324 bp, Glycine max
  Peptide Sequence Number=SeqID_177992
atgctgaagataggagattcggctaaagttgtgataaaacaagacatgaagggaagaaggcataaatatgggtttaacaacaacaaacgtgagaaggcagagaagaaaagggtggtggatgatgaaactggcgacaaacatcagctggatgaaaggggaacgagcaacaatttgaaggttgtacattcaggaactaaagaattcaaaatagctagtaataagagggatttgtttttgggattttctgagcaccaagagcggctacgcaagaagcttgcacttgaggagggaaggatatttgcagctaatgaacaactttcttaa

SEQ ID NO: 61215 - DNA, 891 bp, Glycine max
  Peptide Sequence Number=SeqID_177993
atgactagagctgggcattctcttggaatctatttggcttcacttttgatctttaggcttggttatgctaggaagcactctttggccatgaagattttcaacttattacctgataaccataagtgcagtgctacctatactgctttaattagtgtttacttctctgttagaagagttaacgaggcacttgagatacacaaaatcatgtgcagcaaagaattttgtcctgtgttaggtacttatgatggactattaaccggtttggaaagaaatggtaaatatgctgaagcagaacattataggaaagcaaagaagatcaagagcttacttgccaatagtggttctcaagaaagattagttgctatcaccggagatgcagtgcagtggcttagagacagtcttggcatcatttctagtgcttcaaagatagaggagatggcattacaggttgaatccactggtggggtttactttgttcctgcttttaatggattgtttgctccatggtggcgtgaggatgctcgtagcgtttgtattggaataacaaggtttacaagcaaagctcacattgctcgagctacgctcgagagcatgtgtttccaagtgaaagatgtcttggattcaatgcataaagattcaggagaaacatatttggtgggatgtccagcaattagacctactgacatagagacaacaacacttggagcagcctatactgtaggattagctattgggatttggaaagaagattatcttttcaatactaaggacaagttgaagaatgctaatgttttccgccccttaatgactgaggaattaaggaaaaagaaagtggcctcttggtgcaaagctgttagtaaaactttcgacttagcggatctttttctttga

SEQ ID NO: 61216 - DNA, 270 bp, Glycine max
  Peptide Sequence Number=SeqID_177994
atgaccatcctccttcagcttccttatgagtacatagacaacaatccagttcccaccatagtcttcaagggtcgcccgagaacattccacaccttcataatattcataatcttcgccttctcgggtgccaccaatgcacttgtggcattcaataagtcaagattttctaggctttgtggtattatgcaatgggttctatggcttctgctttggcaattctcttgtgggcattgtgttgcacatgtttcaattagaaaggctggactttga

SEQ ID NO: 61217 - DNA, 824 bp, Glycine max
  Peptide Sequence Number=SeqID_177995
tcgatattgaacaggctgataaacagcccgcacaggccaaacgtcaccagccagatggcgttcagcggcgtgatcgcaacggtgtgacggatgagcggcatgagcgtgtccacggtgtgtccgtcgagcagaaccatcccgcctgccgccagcgtcatcaggctgccgaccgccccgccaatcccggcgacccagccgctcaggtacgctaccgcgctggtcatcatcatcgccgcgtcgccaacattgctgttgatggtcagctcgcgtttacgcttgcgggtacgggcgatgtcgcgaatgttaaccagaatcaacgcgttggttgggcaggtgcgcacgcaggccgggccttgttcatcaaagctgcacagatcgcacttcaccgcaacggcgcggatgccgggcacccagtccagcagcgtgctgacgcgtgccggagcaggcggcgcgggcggggcttttggcgagttggcattcgccggaatatgcagcgggcggctgccggaaaattcaatggcgccgaacgggcaggcaatgccgcacagcttgcagcttacgcacaggctttcgttcaactggacagcgccgtccacgcgggtgatggcatttacgggacagacacccgcacaaggggcatcttcacagtgatggcagagctgcggggcagactctttttcattacgcatgacgtgcaggcgcggcatggactgcagcccatgcaggcgatgcgtttccgaacacgccgcctcacaggttcgacagccaatgcagaccgtcgagtcagcaattacaaaacggttcaccgggttatcctctggtga

SEQ ID NO: 61218 - DNA, 606 bp, Glycine max
  Peptide Sequence Number=SeqID_177996
ggcgctggtctcgacgcaggaaaacgccccgaccttcagccagactccggtgacgctttttgcgtggttttgcacagcctgttgttcgataagttccagagcccgcttggcagagggcatgtcgatgtcaacgctgtcgaaatgacacgtcgacaccgcaaagttgacagccaattacatcgcgcagcgtcatcagcagttacaggaccagtggcatctttactgcaactctctggttcagggcatcaccctgtcgaaagcgcgtcttcaccatgcgatgagttgcgcggcgcagggggatatgcgcttgtcctcttcggccatttcaccatcaacgtgaccctggcggataacttcaacagccacaccattgagtactacctcgagacaaaagacggcgaaaaacagtgtattgcgaaggcgcagctgatggccgacggcatggtggacggccacgtcagcaaccgcgatcgccagcaggtgctggagcattatctggaaaaaatcgcgccggtttataacggcctgtacgccgccgttgagcacgatcttccggtcaacctgaagcagctgatggatggaaatgcctcagcgaacgtggcctga

SEQ ID NO: 61219 - DNA, 309 bp, Glycine max
  Peptide Sequence Number=SeqID_177997
atgagtgaaatagaaaaggtgcaagaacagatgaaggctgacatggaggccatgaaagaccaaatggccaccatgatagaggccatgttgaacatgaagaaaataatggaaagcaatgcggctatagttgccactacgagtgccaccactgaggtagacccgactcacctgtctggcatcaatcaaccaagtcgtctagtcccaaatatgttaggtcagggaggcaaagcattgggaagtacaggttgtaacgacccacctcgtcactacgatatcaccactctaaaccgcgataatttcaatttttaa

SEQ ID NO: 61220 - DNA, 340 bp, Glycine max
  Peptide Sequence Number=SeqID_177998
cacaaaattccgtgctcttctctccctctcccttcattcatctccttcttcctccaagctcttatccatggcctcctatggtgcaaaggaatccattgatgaagaagatcctaggcctacaagctccaatggagcttgcatcaatgttgcactgcatttaggcattagagttgatggtcgtgttgtggccacacctcatggtgacttggttggatatagatctcgtatagatcatatggaaagccatgagtttggactacaacaagatatccctgttgatcccatgaatcttgatcgacttcaccaaattgacatgcgaggcaatcattacattgactag

SEQ ID NO: 61221 - DNA, 894 bp, Glycine max
  Peptide Sequence Number=SeqID_177999
gaacgtgggcgtagccggctggaagcgaccgctcagcatctcggccagcagttcccgcgccagcgtttcattgccgcgcgccagcgtcagcgccaccatgcaggcgcgctgctcaaaggtttccagatagcgtttgccgtcgaaggttttcagcgtgtagctggtataaaacttccacgcaccgaggaaggtgtgaaaacggaagccccaggcgtcagcctcttcgtgcagctggcacaggaaggcgaaatcgtactggttcagcaccccagcttcataatagccttcggccaccagatagcgcaggcgttcgccgtgcgagtcgaatggcacgctgttgggctggacgtgctgcaggaaaaactggcgtgtggcttcatgatctttgctgaactggatgcggccatcggcgtcatacaggttcagcatcgcgttgagcgcgtgttcaaagcggtagagatagggaacctgacatttctgcgcaatgatgtcgcccgccaggcagaagcccgcgccaaagttgcgattgcccgcagcaatcacaccgcgaataccgcgccggcgctgcgtggcgtcgagcggaatacgccgcgcaggcaggccgagacgggtgataaaccggccggcgattttgtcgggacggaagccgctccagtggtcgttgtgcgtcattacgacaggcacctggcgatagccgagcgatttgagctgatcgatggcttccggttggctatcgaggttaatcagctggtagtcgatgccactgcgatccatggcatttttggtggcgtcacactggacacactggctcttagtgttgcgagatacgaagcaaaaacccttttgctgcgaacgtcgtccctgctgacatctggtagcgagttgatgtgttga

SEQ ID NO: 61222 - DNA, 339 bp, Glycine max
  Peptide Sequence Number=SeqID_178000
atgtatttacgtccggatgaggtagcgcgcgtactggaaaaagcaggattcgaaatggacgtcctgacacccaaaacttatggttatcgccgtggcgaaaactacgtctatgtgaatcgcgaagcccgcatggggcgcacagcgttgatcattcatcccaccctgaaagaaaaaagtcagcacttcgctgaacccgcatcagagatgaaaacctgcgaccactacacgcagttccctctctacctgatgggggattcgcaggagcattacggtattccccacggttttagctcgcgcatggcgcttgagcgttatctgcagggcgtcttcggcgcctga

SEQ ID NO: 61223 - DNA, 318 bp, Glycine max
  Peptide Sequence Number=SeqID_178001
atgtttaatcgaaccagcaaaaacgatgacattgatatcaatcaggatgtaaacgaactggccgattcgctggaagccttactgaaatcttacggcagcgaagccaaagatgaagtggatagcgcacgcagccaggcgcaggccctgctgaaacagacgcgcgctaaactcaacggcagtggcaaccgcgtgactcaggccgcgcgcgatgcgggttatcaggtggatgcttacgtgcatgacaaaccgtggtacggcgtgggtgtcggtgccgccgtcggtctggtgctgggcgcgctgctgatgtcacgccgctaa

SEQ ID NO: 61224 - DNA, 1162 bp, Glycine max
  Peptide Sequence Number=SeqID_178002
atgtctgtgcaggccgagatcctgaatctgcttaacgatctcaaacagaatgatggcctgacgatggtgctgcgcaatgcggcgcggtttatcccgaaggtagagtgcgccgctgcccaacagccattcagtcatctaaaggaacaccgtatgacggtaaaattacgtccgctggagcgggaagatctgcactttgtccatcagctggataacaatgccagcgtaatgcgctactggtttgaagagccgtacgaagcgtttgtggagctttctgacctgtatgataagcacatccacgatcagaccgagcggcgctttgtggtggaacacgacgggcaaaaagccgggctggtcgagctggtggagatcaaccacgtgcatcgccgggcggagtttcagatcatcatcgacccggcgcatcagggcaagggcttagccagcagagcggcaaagctggcgatggattacggcttttcggtactcaatctctacaagctgtatctgattgtcgatcaggagaacgagaaggcgattcatatctacactaagctcggttttgaggtggaaggcgtgctgaagcacgagtttttcatcaacggcgagtaccgcaacaccatccgtatgtgcattttccagcagcagtacctggcgcagcataaatccggtaatgcgatggtcatacataccaccataaaacggatcgaccaccagccagcctgggaaaccgagcagcggaatattgcccagcacgtaccacaggttggcgctggcctcgatgggcagcgtcagcggtacatagcccggactctccagcatcacctgataatgtttcttaccgaaataggcgccattggatttcgccagatccaccgtctgcggcgtatagccctgcgccaccgcgcggccggtttcatcctgcacggtgaaacgcgcgccttgcggcacagagtcaatttttaccggttgcgtttcggtgccgacaatggtggcacagccgctcagcagcagcgcacaggcgggaagaagatgtcgcaggttcatagcaggcggcaatcgccgcgatatcctgcggcgtggtgcgacagcagccgccaatcagccgtgcgcccgcctgttgccactcggggaacttatcgtgcagcgtgcagccagacggcgccga

SEQ ID NO: 61225 - DNA, 1068 bp, Glycine max
  misc_feature (401)..(401): n is a, c, g, or t
  Peptide Sequence Number=SeqID_178003
atggcggaagcccgcgttgatgcgatcgtcgatgttatcgcgtcgcagcagcttaagcggttccgccagcgtgcggcgcagccggtggcgcggatgcagcgaagcgtagggatcctgaaacaccatctgcacatcgcgccgcagctggccggtaaagggtttgcccggctgcacggcggtattcgccagcgtcatctggccgcgccagtgcgggttcagtccggccatcacccacagcagcgacgatttaccgcagccggaaggccccaccagaccgaaacactcgccggccgccacctgcaggttcacatcgtgcaccacgcgccgcgcgatccagcaccggcaggcgttcgccatgcgtcgctttacccggacggcaggcccacagcgtgcgggcggcnctttgtacatcaccatcacccgctgacagtgctcggagacctgttgcagatcgtgactgatcagcagcaggcccatattgcgctgctccaccaggcgacgaatcagcgccagcacctgatcgcgcatggcgtgatcgagcgccgaggttggctcatcggcaatcagcagagcgggatcggtaatcagcgcgatcgccagcatcacgcgctggcccatgccgccggagagctgatgcggatagcgcttcatcagctggcgcggctcgggcaggcccaccgcgtccagcatctcgcacactttctctttgcgctcggcgcggctcagcttgcggtgcagcaccagcggctcttcaacctgccagccaatggtgcgcgtcgggttgagcgcgtatttcggatcctgcatgaccatcgccactttgccgccgcgcaggccgatccagtcgcgctcgcgcaggtgcagggcgtctgcgcccgccacctgcagccggtcagcctgcagctgcagcgcgggcgacagcaggcccatcagcgcacgcgcggtcagggatttgcccgagccggattcaccgaccagcgccacgcgttcgcggccaagggtaaagctgatgttatccaccagcagcgcgtcgtggctgcgaatcgtcagcccctgcgcattaattaa

SEQ ID NO: 61226 - DNA, 2387 bp, Glycine max
  Peptide Sequence Number=SeqID_178004
atgactgacatgaaactcaaccaggaaaaaaaagcctggaacaccgtgcgtccggcacgtcagaaaaccgcacgctatctgattgaagacgaagccgcttttaccgccgacgaaacgctgctgcgcctgcgcagcgatgcgctggggctggtcgaacgcgaagcggaagcgcggctgcagatttatggtcgcaatcaggtggagcatgataaagcgccaccggcgctggtgcagctgattcaggctttcaataatccgttcatttatgtgctgctggcgctggcgctggtgagctttttcaccgactactggatgccgctgcgccatggcgaggagaccgacctgaccggtgtcatcatcattgtgacgatggtaacgctcagcggtttgctgcgcttctggcaggagtttcgcaccaacaaagcggcacaggcgctgaaatcgatggtgcgcaccaccgccaccgtgctgcgccgggaatcggtacagcaggcgccgcagaaacaggaagtggatatcaccagcctggtgcctggcgatatcatctatctctcggcgggcgatctggtacccgccgatgtgcggctgctcgactcacgcgatctgtttatcagccaggcgattctgaccggcgaatcgctgccggtggagaaatatgatgtcaccggccacgtagccagcaagcaggccagcgccagcgacaaagatgcatcgctgctggaactgggcagcgtatgcctgatgggcactaatgtctccagtggcagcgccaaagcggtggtggtggcgaccggcggggaaacttacttcggcagcctggcgaaatcgattgttggtaaccgcacacaaaccgctttcgatcgcggcgtcaacagcgtcagctggctgctgattcgcttcatgctggtgatggtgccggtggtgctgctgattaacggcctgaccaaaggcgactggctggatgcttcgctgttcgcgctggcggtggcggtgggactgacgccggaaatgctgccgatgattgtcagctcgaatctggccaaaggggcgattgccatgtcgcgccgaaaagtgatcgtcaaacgcctgaacgcgatccagaacctcggcgccatggacattctgtgtaccgacaaaaccggcacgctgacgcaggacaacattatcctcgagcaccatctcgattgtgccggggtagagaactcgcgcgtcctgatgctgagctggctcaacagccattaccagagcggcacgcctaacctgatggatcgcgccatcctgcgctacggcaaaggacgcatcagcgcggacatgagcgactactacagcaaagtggatgagctgccgtttgattttgtgcgtcggcgcgtttcagtggtggtgcgtgaccgccgcctcaaccagcagatgctgatctgtaagggcgcggtcgaagagatgctgagcattgccagcgccgaacgcgaaggcaaactgattcagccgctcaatgaaacccgtcgcgcggagctgctggcgctggcgcatcagtacaatcagcagggcttccgcgtactgctggtggccagccgcgcgctggcggagccaggcctgcaacaggcgctgagcgtcgcgaatgaacaggggctgaccatcgaagggttgctgaccttcctcgatccgccgaaggagagtgcggcgaaggcgattaccgcgctgaacgagaacggcgtaacggtcaaagtgctgaccggcgataatccggtagtgacggcgcgcatctgtcagcaggtgggcatcgactgtggcgagatcctcaccggcgaggcgattgcggcgatgagcgatgagcagctggcgcaggccgcggcgcgcagttcggtgtttgccaaactgacgccgctgcagaagtcacgcattctgcgtgcgctgcagcagcagggccacacggtgggttttctcggtgacggcattaatgatgcgccggcgctgcgtgacgccgatgtggggatctcggtcgacagcgcggcggacatcgccaaagagtcttcagacatcatcctgctggaaaaggatttaatggtgctggaagagggcgtgatgaaggggcgcgagacgttcggcaacatcatcaagtacctgaacatgaccgccagttccaacttcggcaatgtgttctcggtgctggtggcgagcgcgttcattccgttcctgccgatgctggcgattcacctgctgattcagaacctgatgtacgatctgtcacagctggcgctgccgtgggacaaaatggatcgcgagttcctgcgcaaaccacgcaaatgggacgcgcgcaacatcaaacgctttatgctgtggattgggccaacgtcgtcaatttttgacatcaccacttttgcgctgatgtg

SEQ ID NO: 61227 - DNA, 1338 bp, Glycine max
  Peptide Sequence Number=SeqID_178005
atgagcgccagcgagaaggccgaattgctggccgagcactacggcaacaccctggcggtgccgccggtgggggaagggctgtgccgctatacgcgtggcgcctggcagatgctgccacaccggcaactgagccgggagattgccgcgctgttccagaaggtgcgcgcaccgttctccgccgccggtatcaacagcattttggacaccctcaagttgatggtgccgcagatgggcgacccggcccgccggttgataggttttcgtaacggggtgtttgataccgtcagcggccagtttagtgcccaccggcaagagcactggctgcgcaccgtcaacagcgtggactacacgccatcgcgtgccggggagaacctggccgactatgcaccgcatttctggcagtggctgacgcgggtcgccgggggtaatcacgacaagcaggagcgtatcctcgcggcactctttatggtgctggccaaccgctacgactggcagctgttcctcgaagtgaccggccccggcggtagcggcaagagcgtgatggcggccatcgcccggctgctggccggtgccgataacaccacttccgccactattgataatctggagtcggcgcgcgagcgtgccagtgttgtcggctactcgctaattattctgcctgaccaggaaaagtggagcggtgacggcgcgggcatcaaggccatcaccggcggtgatgcggtcgctatcgaccccaaataccgcgacgcgtacgccgcctacatcccggcggtgatactggcggtgaacaataaccccatgcagttcagcgaccgcagcggcggtgtctctcggcggcgggtgattatcaccttcccggacgcgataccgctggccgagcgagacccgcagctgttggacaaaattactaatgagctgtcagtcattgtgcgccatctgatgcagcgcttcgccaacccgaacgaggcccgcacattgctccaggcgcagcaaagctcggatgaggcgctgaccatcaaacgacaggccgatccgctggttgatttttgcggttacctgacggtgctgggcaccccggaaggcatgatgataggtaatgccaatatcatcccccctaatccgcgccgctacctgtaccacgcctatctgtcgtttatggcggcacggggctatcaacacgtgatgaatctgacggcgtttgggctggcggtgccgcagacgctgaaagagtatgagcatacgctgctgaaacgccgtaccaagcagggaatgcaaaccaatgtggtgttgagtgaagagtgtgaagcggactggctgccgaagtgcggtacggtgtga

SEQ ID NO: 61228 - DNA, 915 bp, Glycine max
  Peptide Sequence Number=SeqID_178006
atggcggctttgctgcaggcggcaaggcattatgctgatgaacaccacaacggagcgggcgttgctgcaacgccagttgatggggtgttcattctgcgcgagaccgcgcctaccgcgttgcaattcgcgatcactaagccattgatcgcaatggtgctgcaaggcagcaaacgcgtgaccatgggcactgatcgttttgattttggcgcgggggaatccctgctgatcaccatggacgtgccaaccgtgagtcaggttatcagcgccagtgccgacaccccttattattctctggtcgtggaactggatgcggcggtgatttgtgaactgatggcaaacatggtcgggctggaggctgccacggatttgcccgtcagcattgatcagatcgaagaagatgtggcagaagccgctttgcgcctgctgaacatgctcagcagaccgcacgcgctcgccgtgctgggcagccagttggtgcgagagttacattactggctactgtcaggacggcacggcagcgcgctgcgcgccctcggcagcactgacagccatgcccggcggattgcgcgggcagtcgcgatcattcgggccaattatgcgcaaccgctgcgcatgaaaaccctcgctgacgccgccggtatgagcctctcggtatttcatacgcatttccgccatatcaccacgctcaccccgctgcaattccagaaacagctgcgcctgcttgaagcgcggagactgatgctgacagaagggacagcgatcggtattgctgctaatgcggtaggatatgagagcgtgacgcagtttacccgggaatattcacggctgtttggttcaccgccagcccggaatattcgggaaacccgcgcactcgagcgttcagtcctgtccggtgagcctgcgtggcgcagttaa

SEQ ID NO: 61229 - DNA, 756 bp, Glycine max
  Peptide Sequence Number=SeqID_178007
atgacaaccctttctcttgtaactggcgccagccggggtcttggccgtaataccgcactgagcattgcccgccatggtggtgaggtcatcgtgacttatcgtactggtaaagaagcggcggatgccgtggtgaatgaaattcaggcgcttggccgtaaggccgttgcgctgcaactggacaccagcaacgtatcgtccttcccgggtttcgtcgccgccgtgcgcaatatcctgaaaggtgactggggacgcgaaacgttcgaccatctgatcaacaacgccgggcatggggaaatggccgactttagcgcaaccacggaagagcagtttgacgcgttatttaacgtacacgtcaaaggggtgttttttctgacgcagtcgctgctgccgctgctggtcgatggcggacgcatcatcaacttctcttcggggctgacccgcgtgtcgttcccggggttctcggcctactcggctgccaagggcgccgttgaaatactctccgtgtatatggcgaaagaactgggcagccgcggcatcaccgtgaataccgttgccccgggagcgattgagaccgacttcctgggtggcgcggtgcgtgacatccccgattacaaccaggcgtttgctggcatgaccgcgctgggtcgcgtgggcctgcctgatgacatcggtccgatgattgccagcctgctgggccctgacaaccgctgggtcaccggtcagcgcattgaagtctccggtgggcagtcaatttaa

SEQ ID NO: 61230 - DNA, 954 bp, Glycine max
  Peptide Sequence Number=SeqID_178008
atggcgagattcgagctgtcttttacgtcttacttccacattgcgcatggctggcccctacggcacaccgttgcgcatttatgccagaaacgcccacagaaacgggaatatattatgaaaaagacgattattgcgttatccgccattcttctgacttctacggcgtttgccgccacacacgcaaccgatgaaaccgtcgctgacgccaaagcgggcgccaatacggcgaaagagaaactgcatcaggcgcagcatcagggtgaagagcagcagctcaaagccaaacatgctgccgaaggcaaaagcgatagcctgaccagcaaagcgagcgaaaactcacagaaagcctggaacagcaccaaagaaggtactgaaaaaggttgggacgccactaaagaaggcgcgcagaaaggctggaacaaaaccaaagaaggtgccagcgatctgaagaagaaagtctctgagagctgctctcgcggcatggcaaatgggatggatttggcactgatgcaaatagttaatgatgtatctttggttgaggtgcaacacgcaacggaccgcgaacaggcgaaatcagaggtattactcagcggtagttctaccggcataatcatccccggaaaaatccttgaggcagcagtcaaaattactgataaccgctatatcctgtttgtcacggatgacgtgctctacgaggaatcactgactattgtgctgattgattcctctcagggcattcaggaaattgtcactattggcaatgagtataactccggcacatttgagcaattgcatatcagtgaccattcacttcagtttcgttttatcggtgattatatctggagcctgaaactggaagagtcaccgaaattccagctgccttttttcagcgatccgaaaggtgtctcccgcagtaaagcatttacccgattcatgaacatcacggctttaccc

SEQ ID NO: 61231 - DNA, 503 bp, Glycine max
  Peptide Sequence Number=SeqID_178009
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgc

SEQ ID NO: 61232 - DNA, 1110 bp, Glycine max
  Peptide Sequence Number=SeqID_178010
atgaatcatcgcagtcaacgacggatagtcacactgattaataaaatctgggaaacagaacttgaaggcaggacgcaaccaacaaagggttcagcacaacatccccgaacggaaaaagctggtggaacggttcggctcttcttgggggatacatcacgaagtccagaggataaagtgcttagtgaacgctggtgcgcagagcgaatgtttcaaattagtggtatagcagattggaatcaagggcaatatcagttgcttgcgcttgagcataagcttgtcgccactcgtggctcgtttcttgatgtttatgaggcaatggttttgttagatcccaacgcggcagcaccatctggcagtggggacaacaaggggccttcaacagtacaaattttgcttaatgagctggcgcatttagaagcctgtgtcagtaatgaaggaatcgttaatgagtttaaggcaaccgaggtttttcgacgttatggcggtttagataatatgcctgaggactcagaagcaagagtttaccgtactgatgaaatgcttgaggcgatagcggtatttgcaatggcttgcgccaaccctggttcaacggtcgctgaagtattagcaccagttttaaatgcaaaattatttgaagtagatcatcgccttcaggaggcttatgccgacaagtcaccagccccgccagcacctggacgaggtgaggatgagtcaaagcaaacaagaatccgccgtggatggtgtgcactgtttgctgcgccatggaaacaacttaagtgctatcggaattaccttgctgggatttctgagctcgcaacacatcaggtagttaaaggctctgagttcaagcacgtcatggttgtaatggatgatgctcttgctggtggaaatctcattaagtacgacaaattttttggtggtgcggagttaagtccaacagataaaaagaatgcagagtctggtaaggagacaacaatagatcggactttacgcttgctgtacgtgacttgcagccgtgcgcaagaatcgctcgccttagtgctttggtcgtccgatccagcggcagcaatggcaagaattaaagagagtcaatggttttatgaagaagag

SEQ ID NO: 61233 - DNA, 144 bp, Glycine max
  Peptide Sequence Number=SeqID_178011
atgaagtcaggtttcacactcttcgttcggaaacattcaagcctgacgacgcacgagattcttctctactgggcagggacgatcgagtgcaatggcgtagggaagtgtcgtggttgtccaactttgtcgcatccaagacactga

SEQ ID NO: 61234 - DNA, 570 bp, Glycine max
  Peptide Sequence Number=SeqID_178012
atggttaagatcatggttagaacacgaggtttaggtcgtgctttagctagggttatagggcgagcccgtaggcaacaggtacatattgcggttgatgagggtgttcctcaagtgactgaggatgttcctcatatggcggaggatgttcctcagatgactgaggatgtccctcatatggctgacgatgttctgcagatgagtgaagatacgcctcagatgactgcggacgtagatgcgactgttgcagaggacttagatcgtgatggtgctgaggggtcacatgctgatgagggattccctggtgggcctcgtgacccatcagttctgacttcatttgcggagcatgtcgcacatgccatttggactggacaggagtgtcctgagctgaagttggtgtcgcacgggaggaaggtggcattaattgggaggccaatgcctaagattgaagggctggttgtcgccacaggattaagtccattgatcgggtgttcagttgtaaccggcgatcctggacttatattcgcatttgtggagaggtggcacagggagaccagcaccatccaccttcca

SEQ ID NO: 61235 - DNA, 227 bp, Glycine max
  Peptide Sequence Number=SeqID_178013
ttagtagtgctacaaaggagaacacattaaagcttagtgacatccgtgacttgatcttaagcgaagatgttcgcaagagagatttaagagaatcttccaatcatgtttccaattcagcattgaatactaaaggcaggggaaggactacccagaagggtcagaatggtcgaggcagatcaagtggcctcagaataattaagaaccggggggggggggggttgaattaa

SEQ ID NO: 61236 - DNA, 204 bp, Glycine max
  Peptide Sequence Number=SeqID_178014
atgcagacaaatgatgtccaagctccactttttccattcattgcaagttgtaagcagaatgtagaatttgaaggaagttcccagaatggtagaaagcaagggacagatgaaacggccacagctaagaatagtgcatcttatatcgggaagagattgttagaaagtttggttgcagttgcagggcttctaatttggctttcatga

SEQ ID NO: 61237 - DNA, 465 bp, Glycine max
  Peptide Sequence Number=SeqID_178015
atggtcatagaccagtcctttctctttgaactcactcaattatccagtgatggtgtaccatttgaaggtacacttgatgatgagtggaagttcgatttctctatttctgatacccgtcggatggtttgcaccaaccaatcggatatgactggaaggcttcttgccggttcattggcattcgaatgtcgcatcatgcactacttgattgtgcgcatcctacttcctagatcatcctaccttgcacatgacgcaccagcacaagccgcagaagaccattctccatcaccacctcctcagagagatgattcttcatctcttatgcacaacattcttgacagattggatggactccacaccttcttcggtgagcgctttgactcattggacaactgcattgatgccattgatgcacggtttgcaggaatggatacacgcatcactcagcttgaggaggatatgagttat

SEQ ID NO: 61238 - DNA, 1747 bp, Glycine max
  Peptide Sequence Number=SeqID_178016
atctcggtgatttcaaaacagcagattgaagataaagcctaccgtgatgtcaccgatgccctgaaagacgtcccgggcgtcgtcgttactggcggcgggagcagcagtgatatcagtattcgcggcacggcgtcacagtacacgctgttcaaggtgaacggcaaacgcgtgagtacgcgcagtacccgcccaaacagcgacaactcgggcattgaacaaggctggctgcagccgctggagtccattgagcgtatcgaggttatcagtggcccgatgtcctcactttacggctctgatgctatgggtggagtcatcaacgtcattaccaaaaaagtgtcgaacaccaaggcctggacaggttcgttgcatggcgatgcaaccttccaggaaaacaatgattccggtgatatctttcagaccaacgcctacgcttcaggtcccctgattgacgggctgcttggcgcaaaagtgacggggcttttgtcacgccgcgcagaagataagattgtgaacgggtataacgagcagaaaatgcgtaacggcggtattacgttgaatttcacgccggacgagcaaaatgatttcgacctcgactttgcccgtgaacttcaggacagaaacagcacgccggggatgtcgaaagcgacggaaacctgccgtggaacgacctgtacgccaaataccaaaagcgaaacccgctatgaacataccacctactcattaacccacagcggttattacgacgacttcaataccaccagctatatccaacaggaagagacgaataatccggatcgtgaaatgcgctcgtacaacaccaccttcaacaaccagaaccagatcttcctcgccgatcataccctgactctcggcgggcaatatcgctatgagaaactgcgcgacaacggcaatcagctggaggctgccgatggcctgaacaaactgacacgctggagttgggcactgtttgccgaagatgaatgggcaatgacggaaagctttacgttaaccggcggcctgcgcatggacaaagaccaaaactatggtactaactggacgccacgtggttacggtgtatggcacctcgccgatcagtggacattgaaaggcggggtttctgcgggctaccgtgcaccggacctgcgtcagtcgtctgccagctgggggcaggtaacgggtggtggccgtcttgacggtatcatcgttggcaacccggacctgaaaccagagaagagtctgagtgaagagatcgccctgctctgggataataacgacaatcttaatgccggtgtgacgctgttcaataccgacttcaaagacaaaattactgaagttcgccgctgtaacagcagttccgatcccgcctgtacgattggcgatcatagctatgatttcgtgagcgaccgcgtcaacgtggacaaagccaacatgcgcggcgtggagtctaccttcggctggaaaatcacgcgcgatgtgaactggactgccaactacacttatacggaatccgagcagaagagcggccagttctccggtaagccgttgaacaaaatgccaaaacatatgttcaataccaccctggactggcaggcgacaccagacgtcggcttctggagtcgtctgaacctacgcggtaaaacgtctgagtatctgagccgtacatcgatgtcccagggtacaccgtcctatacccaggtggatgtgggtctgcgctacaacgcgaacaaaaacctgcttgtgactgccg

SEQ ID NO: 61239 - DNA, 459 bp, Glycine max
  Peptide Sequence Number=SeqID_178017
atggcaccttttcaattggaagttgcaatgttaggtctgacccaaaagaattggaagcaggtagatggggagagtcaaccattgctgcaacagcagcagcagcagcagcaagaggtagttcccttgcaagacagttacatgcaaagcagagctgaagctcttcagaatgttgagtccaccattcatgagctcagcaacatctttaatcaactagcaactcttgtttcccaacaaggagagattgccatcagtctattgttattagttcagcatgtcaatgggcatgtgggagtgctgagtgctgtagggcagattgaccctaagtccacacctgccctatctcatagcagagcatgttttaaattcaccattcctgccccatgcaggctggggcaaattgggttctctcgggatagggtttgttggctattaactaaagtgggggggtgtaggagttga

SEQ ID NO: 61240 - DNA, 597 bp, Glycine max
  Peptide Sequence Number=SeqID_178018
atgaaagtgcatgagaatagaagacagttgttttcgtcttctgcttctaaggattctgcgaatccttttattcggcaacggccgttggctgcaagggcggctgctagtacttctagtgcccctgctcttccctgggctaatgggtcaccatcttcatctcaggcgtttcccaagattttagtagcatgtgtttgttgttttcttgctatttgttgtgtaatgcagacattgtgttgttggcctagcctggcccaacgaaactctaggactattgaaactttgcctggccaggagtatttggtgggtcaaacaggctggtccaaaatgcatgtagagaagcaggctggcccactcaagacattttcctttgttgggaagcaagtggatggggagagtcaaccattgttgcaacagcaacagcagcagcaggaggtagttccattgcaagatagttacatgcaaagcagagctgaagcacttcagaatgttgagtccactattcatgagcttagcaacattttcaatcagctagcaacacttgtttcccaacaaggagagattgccatcaggcaatataaaacttttcaatacatctaa

SEQ ID NO: 61241 - DNA, 1128 bp, Glycine max
  Peptide Sequence Number=SeqID_178019
atgaagtccatcgccgccgtcgccctcgccgaccccaccttctccataccggagatcatggcctccggtattctcactggagcaaccctgttggtcctaggtgtcactgggctcatgcagctagtttacaagctcattcccttatgtgttgtgaggggaattcagctagcacagggtttgtcctttgctttgaccgcggtcaaatatgtgagaaaagtacaagatttgcctcggtccaaatcattggaccaaagatattggttcggattcgatgggttggttctcgccatcgtatgtgtttgctttattgtcatagtcaatggtgctggcgaggaccatgaccatgaccatggccatggccatggggaagaatcaacccaccaaacccaagctagaataagtaaagtgagaaaaataagaagggttattttcgcgcttccttcggctttcttggtgtttgtgttgggagtggtgctgactttcataagaaggcctagggtgatgcatgagattaaatttggaccctcttctatagaggtggtgaaaatgtctagacatgcatggaagcaaggtttcataaagggcacaatccctcaactcccgttgtcaatcttgaactccgtgatagccgtttgcaagctctcatcagacttgtttccaggtaaagatttttcagtgacatcactctcagtaactgtagggttgatgaaccttgttggagggtggtttggggccatgccatgttgccatggagctggtgggcttgcggggcagtataagtttggagggaggagtggaggctgtgtggcacttcttggtgcggctaagttgattttggggtttgtgttgggaagttctttggctcatttcttcaaccagtttcctgtggggatcttaggggtgttgctgttgtttgctggggttgaactagccatggcttctagggacataaatactaaggaagattcgtttgttatgcttctttgtactgcggtttcgttggtggggtccagtgctgctcttggattcttgtgtgggatgattgtttttgtgcttcttaagctcagggattggaccaatggtaagccgattaatgctatttggaagcatgaaggccctgaagagcaa

SEQ ID NO: 61242 - DNA, 1140 bp, Glycine max
  Peptide Sequence Number=SeqID_178020
atgatatttgctgtcattccttttgccagagttgatgattttgtcaaaggggaatcttccaaccccgaatgccctgcgagtttccgcatagaatcaagaaggaaaagacctgtaggaagcattgccaaaccaagggttgatggctatcttgaatatacattatactggtgttcttatggtcctgaagactaccgagagagtgactcaggtgtaggggatggcacaagcaccaaacctgcttcagggaaggggagcagaccggggaggcgtcacatgatgagagggtgcctttgccatttcactgttaaaaggctttacacccgacccctccttgcgctaatcatatataaccaaagaaggcatgtagataaatcaggggcaccgtgtcatggattacttgacagggatgcggtagggacaagagctatgtatgctccgcgaatttcggatgagttacgccagaaagtgatgtctatgctttatgttggaatatcgttggacaagataatccagcaccatgcagaggggatgcagaagcaaggtggcccccaaaaccgtgatgattttctcactcgaaatgatgtgcgtaacatggaaaggacagttcgtaattcttcacatgagctacacgaaaatgatgaatgcagtgtaaagatatgggttcagcggcatcagaagcatgttttctattttcaagataactcaggttcagaaccatttgtgttgggtatacagacagattggcagttgcaacaaatgcttcgttatggaaataatagtttcatttcttttcattcaagttttggcttgaagaagcttaagtatccaatatgttctttacttgttttcaattcatctcaaaatgcaattccggttgcctggatcatcacctcatcttctgttggtaaagctattcataaatggattgtattgctatgtgaaagattacgaaccaaggatcctagatggaggcctaatgctattttgttggatgatccatctttggactattctatcataagagacccccaccttaatagcaaatggagtgagatcttgctcattgcagagaggctttccagtgtcgcatcctattatgtgcctggcatgttcgccgtacttggattaaaaaacttttaa

SEQ ID NO: 61243 - DNA, 171 bp, Glycine max
  Peptide Sequence Number=SeqID_178021
ctacctacaaggcatactgatacaaagacaaaggatcaaattctcaatcacagcagccagaagatcaagaacattcagataacagcctcgaatatgctacagagaagcagcctcaaccttccaataaacatgggtcaaactccacctataatgtatttggaaggtcaataa

SEQ ID NO: 61244 - DNA, 243 bp, Glycine max
  Peptide Sequence Number=SeqID_178022
atggcgattataagcccaacaaagatttctcaacctccgtttcctagaggatacaaccccaacatgacatgtacttatcatgggggagtttcaaagcattccattgagcattgtatgaccctgaaacataaggattttcatgtttatgccattactgtaaacaacagtcacaatgctaataatatggataaatttaatgtccttgtctctcattctctcgcaattacatctttgcttatttaa

SEQ ID NO: 61245 - DNA, 408 bp, Glycine max
  Peptide Sequence Number=SeqID_178023
atgatattgcacgtgattagaaggcctaactctctaaaagcaatccccagtggagtcgccaactatcgcaacctacccttcgacgggagggcgacgcgagggctcacgggtgcgtcttccaagaaaggaaaatgcacgaagtcgccaccaacgtttattcaaggaaaatgtcggaaaaaccaaaacgtgtggtctacgaactttaatcgtgaaaggtttaggagttgtttttacgcacggggaaggagagaaacattaaggcgttggaccattaacgatctcttggtttttgaaaggagagaaacgttaaggcgttggaccattaacgatctcttggggtggtcgacaaaagcggggcttttgctcctacgtatcctcaattgtgatgagaaaatcagacctacatag

SEQ ID NO: 61246 - DNA, 489 bp, Glycine max
  Peptide Sequence Number=SeqID_178024
atgaaattttcaaacttgttatctaaagggaatgcagaaaaagattccaagaatcatggtgagtcacatcctcaacctcagtacaatcagcaccttcttcaatctaagactaaaaacatgcctcagtctttgcaagtgaagaatgtgacagaatggaaagtgcgacaagctgacctggaacttggatatctaaagtcggcatttcctgattatgctaaacagtcccttagagatgcatacttggcaaacagttctgatctggattattcaattgacttgctccaccactttgatgatgatgaggcaaagttttttatttcaagatttaatttaggctttgtcaactataagtttttaatcgtttttaccttacagattaatggtgataagtcttctgtgagacactggatattgggaatgctccagaatctgtaccagcagctaaagctagtgctccgtcaaatctggcataagtttaaaagtgaataa

SEQ ID NO: 61247 - DNA, 1314 bp, Glycine max
  Peptide Sequence Number=SeqID_178025
atggggtgttttgagataataatgctgaggaagaggaacaggtcagtgcagaaggatcaacaccacatgtgtgaagccaattcggagcactattctcaatctcatcatgctttggtggggcgcaacaacatcaagggacactcaattttcaatgtcccttgtctgtttgtgggtcttggtccaaaagggttgttggattctgattcagttaggagccccacttctccacttgatgctagagttctttcaaatctaggcaatcctgttaggaagccaagatcttcacctcatgaaaagaggtgggattgttgcaaagtaggtctaggcattgtggagtctttggaagactgttctaggttttctgggaaaattctccagtcaccagagagcaagagagttagtctcagcccccaaattatgatcaaagccccaaattgccaaatccatagggattcttttgagggatctaagtctttgcccaaggatttctgtaaggctccttattatgccccccaaaatggatctgttatccacaagggtgaatgtgaatctgagtccactgttctttttgagattggggaaagtggccttgagcttgagctgtttgggaaaaccaggtcttgttcattggactcatgcagtccactgaaagctctctctggtgttgccacttcctattctgattcagacactgataattttgctatgaaagatgtgagctcccctcctcattttattggaggaagccagaactcaaataacttcacacctacaaagccgaattcaaccacactttccattagctcttccaatgaattcatcaagtctctatcagctagtgagatcgaactctctgaggactacacttgtgtgatttcccatggccccaatcccaaaacaactcacatttttggggattgcattttggagactcattctaatgtatttaaaacccatttcaagagtgaagagaaggagaagcgagtgaatccattgggtaacaacaagttagggagtccaaacccatatccctcaagtgacttcttaagtttctgccaccattgcaacaagaaactagaagaggggaaagacatttatatttatgggggtgaaaaggcattttgcagtttcacgtgccgtgccatggagatcatgattgatgaggaactagagaaatccacttccaaccctccttgtgaaaactctccaaatccgaaacttgatagaactttaatgcttcaaaaggacaagggtgcgtttgccgaagtgagactctggctcgacatcaaactctgctcctcagaaacagattaa

SEQ ID NO: 61248 - DNA, 1797 bp, Glycine max
  Peptide Sequence Number=SeqID_178026
atgcaggacgtcgtgacgctggggctgatcggactcaatctgcgtttcatccgcgcagctatgcgcgcgcctttgccacatggtcacataacacgaaaaatcacgcctgccgcgttgctttgggttaacaatgcattaactatctggagccagaaagcccgtcagctgcaatgtggtcctaccaattgtggtgcggaaccgggcaacaatctgcggcgcacgcctgcttttgccgatgcgccgcatccctctggtgacctctggagaaacggcatgcaggtgtggcaacaaaactacgatccgctcaacaatttgtggctatccagcctggtggcggtgatcccgattgtttttttcttcttcgcgctgattaagctcaagctgaagggctatcaggccggtacgatcaccgtggtgctggcgctgctggtggcgctgctgctgtacggcatgccggtgccccaggcgctggcgtcggtggcgtatggttttttatacggcctgtggccgattgcctggatcatcgtggcggcggtgtttgtctacaagatctcggtgaaaaccggccagttcgatatcattcgcgcctcgattctctccatcacgccagaccagcgtttgcagatgctgatcgtcggcttttcgtttggcgcgtttttagagggcgcggcaggctttggggcaccggtggcgatcaccgccgcactgctggtcgggctgggctttaatccgctctatgccgccggactgtgcctgatcgtcaacaccgcgccggtggcgttcggcgcgatggggattccgatcatcgtcgccggtcaggtcaccgggctggacagcttccagattggccagatggcgggacgccagctgccgtttctcaccctcatcgtgctgttctggatcatggcgatcatggatggctggcgcggcatcaaagagacctggccggcggtgatggtggccggcggctcgtttgccatcgcccagtacctcagctctaacttccttggcccggagctgccggacattatttcgtcgctggcttcgctgatctgcctgacgctgtttctgcgccgctggcagccggtgcgcatcttccgctttaaagagcccgcgccagagactgcgccctcagggacacaacgctacacgctggcgcagattgtgcgtgcctggatgccgttcctgttccttaccgcgaccgttacgctgtggagtattccgccgtttaaagcgctgttcgctaaaggcggcgcgctgtatgactgggtgtttagcgtgccggtgccgctgctgcacgagctggtggcacgcatgccgccggtggtgagcgcagcaacgccgtatgcggcgctgttcaaatttgacgtggtctctgccaccggcactgcgattctgctggcggcggtgatctcggtgatttttctgcgcatgaagccggcggcggcgctgcgcacctttggcgaaaccctgaaggagctggcgctgccgatctactccatcggcatggtgctggcctttgcgttcatctcaaactactccgggctatcggccacgctggccctggcgctggcgcacaccggtcaggccttcaccttcttctcgccgttcctcggctggctgggcgtctttctgaccggctccgatacctcttccaacgcgctgttcgccgcgctgcaggcgaccaccgcgcagcagattggggtgtcggatgtgctgctggtggccgccaatactaccggtggcgtcaccggtaccatgatttcgccgcagtcgatcgccatcgcctgcgccgcc

SEQ ID NO: 61249 - DNA, 1209 bp, Glycine max
  Peptide Sequence Number=SeqID_178027
atgcaggccgtggaagaaggtggtggcggcgaggagcgaaacgcgcgtttcgaggaaaacgatttggacttggaaatttcgaagttgcgcgggcgatgggaactcgcttctgttctcaattttttggacgtgtttggtccgatacttggtaaagatttgaatctttctgctgaagatattgagatcgggcttgttaagcctgacgcttcgcttgctcggcttcacattcaacttttgaagggaataccacctgtgagtaaaacattggaggattctgataaatgggttactgcactctgtaagaatctgactacgtggtggccatgggttgccaagggggagattccacttgtaccatctaaaggagtggagatatccaagtacaaggaacttgatccgttagatcgtttactgctgctaaaagctctttgtgaagttagagctcagcaacatgatgcagtgtcatacatcaatgatgctttaaaagaaggaacccaaatttcaacttttcgcaaagatgccgtaggaagagatggaactggcacatcttactggtacgatgcaacttcaaaaggtcagagtcacagattgtacagggaaattatcacatcagactcaattccaaatgataaggatgaagaatgtttatcactccccaccattcaatgggaaacacttgcttccaatcttgaagatttttcaaaagtagctgaaaaatttgcaatcagcaagtctgctgtggaagttgctgttagcatgaagcttcaagatgatgctattcctgctcttgaaaagcttcggaagaagaaagaaagagcaataaagcaaaaacaaaggcaggatatgctgttaaaaaaagattttcagaactctcattattctggaaatacacgctcttgtcgcacacgaaggcctattagttatacatttgttgagaatcatggtagcagcgaggaggatggtgttgatggcgagttgggcaacttggaagcaccctcaagccatgcagtttcttatccaaaaggggttcgctgcagcaagcggttagctggagttcctagccacactattttagaaagcagaggcttaactgcaaagcaaagattgaggcaaagacccacccgcaattctgctatggaatctatcaatgtatccgattcagaggacgaagcacgtgaagggaagagagatttgtccgagtctacttag

SEQ ID NO: 61250 - DNA, 357 bp, Glycine max
  Peptide Sequence Number=SeqID_178028
atggagctcgtgcggcaccaagaggaagaccgagagctagattggcggcgaaggaattggagtgccaggagccgttgtcccgttagtgacaccaaaactatttataccaataccggagccaacgaaataagagaaaatgaagttgttgtggacatgaatatgcgtgacgaaagtaatgggttgagtggtaataagcctgatgaggatgccatcactccaccttttcctcacagggcaaagttgcgacaacggcaaagccacgatgaagacaaatatgtgacagtgacagagatgaatctgctacagcattcaaagctatgtcattcgtcagagacactattgctgaagacatcatga

SEQ ID NO: 61251 - DNA, 1017 bp, Glycine max
  Peptide Sequence Number=SeqID_178029
atggcaggggcagccaaaaccctaacgaatctttgcccctcttttccattcacaaccaaaccccaaaacccactcaccacacaccactctttcccttccactcgcctccgccaccgcgccatttccgcggttgccaacccggtccaacctccactcaccaccaccgagggtcagtaccgagtcgacgtgctctcggaatcgctccccttcatccagaaattccgcggcaaaaccatcgtcgtcaagtacggcggcgccgccatgaagtccccggagctccaggcctccgtcatcaacgacctcgtcctcctctcctgcgtcggtctacgccccgttctcgtccacggcggtggccccgagatcaactcctggctcggccgcctcaacatccccgccgtcttccgcgacggcctccgcgtcacggacgccgacaccatggagattgtctccatggtcctcgtcggaaaagtcaacaaaaccctagtttctctaattaacaaggccggcgccaccgctgtcggcctctccggcatggacggccgcctcctcaccgcccgccccgcccccaaggctgccgccctcggcttcgtcggcgaggtcgcacgcgtcgaccccactgtcctccgctccctcatcgacaccaaccacatccccgtcgtcacctccatcgccgccgacgagtccggacagccctacaacatcaacgccgacaccgtcgccggcgaattggccgcggcgctcggcgctgaaaagctgattctgctgaccgatgtagcgggaatattggaagatcgtaacgaccctgacagcttggttaagaagattgacataaaaggagttaagaaaatgatggaagatgaaaaagttggcggtggaatgatacctaaggttaattgttgcgtgagatcgctggcgcaaggggttactacagcgagtattattgatggtagggttccgcactctttgttgctagagattttgactgatgaaggtgctggaactatgataactggatga

SEQ ID NO: 61252 - DNA, 804 bp, Glycine max
  Peptide Sequence Number=SeqID_178030
atggtggctctacgaatgtcgatgtcatctctagttagaagacgctcaagcgacgaaataacgaactcggcctcggtttccagtagcctctttccagcatttggcaccaccatctttgatattgaaggttactcgaagtcgaacctaagaaaatatgtcattgctccctatgaccgtagatatcaattgtggcaaacgttcctagtagcattggtagtgtactctgcatgggcatctccattcgagctagctttcagagaactgctagttgggtcgctgttgcccgttgatctccttgtcgatgccttctttgccgttgatataatccttactttttttgtggcttacttggatacatcaacctatctcctcgttgacgaccataagaagattgctctcaggtacgtcaaaaagttacacttcaccatggatgtagcctccactgttccatttgagcagatacaccaaattttgacgggcaaaccaaccaaaagcgaggtctccggtttcctaattatgcttagactatggcgattgaggcgtgttagcgaactcttcgcaagcgtcgggttgggttacacttattccatgtactggtctgttgcaacccttaccactgttggctatggagatttctatgcagtgaatttaacggagaagcttttcagtactatatacatgctgtttaacatcggcctcacttcatatataatcggaaacatgacaaatctgttggttcatagctctgtccgaaactttgtcatggtaaattttatgacaatctccatggtcgtttacatttga

SEQ ID NO: 61253 - DNA, 282 bp, Glycine max
  Peptide Sequence Number=SeqID_178031
atggttgatacctatagatttgctgcaatgatcgatagtttgaacaagcgagaaggaagaggacgctttgaatctggggtgttatttttgcacctacccaacatgcaagttgcaggtgggagtggcgacttcgtgcatgagcgacacatggcaagcgctgggggacgtgccaagctcgttggcgatttcaagctgccacactggaatcgctggtcctgctggcgccaccagcctagggtcagcttttcaggcaggtttcagctttttcagatagcagtgtag

SEQ ID NO: 61254 - DNA, 366 bp, Glycine max
  Peptide Sequence Number=SeqID_178032
atgccaaggtatgtccataatttgattttaaaaaggaagggtagcatgatgcactttgatgaaggattgtttgcaaggcacaaaggtggggaatctactaaggttgtcacaaaaggtcttagagggaaaagtgcctctaaaaagcttacagaggaagaggttcttgttgagaagaattttgatttggcattcctattgatctatgaattcaatcttcctgctgttgatatatatgccagtgttgctgcatctcttgctgagagaaaaagaggcagccaattgacagaattctttagaaacatcaagggcacaatagatgacgatgactgggatcagggggaagtctacaagagaactcatctttaa

SEQ ID NO: 61255 - DNA, 267 bp, Glycine max
  Peptide Sequence Number=SeqID_178033
atggcgtcctcagagccaatagctccagaagcagaacccgaaagtcgcctttcttctctcatctacgagaaatcaaatgaagtccaagggttcatggagaatatgtttaggacgatcactgaaattaatcaaaattctgcagtggtagaggaggagatagagaaatgtaaaggttctggtctggaaaggaaaagagccttagatgaagagaaggataactttcaaaaagctgcttatgctgttcttgacatgctgaacagagagtaa

SEQ ID NO: 61256 - DNA, 372 bp, Glycine max
  Peptide Sequence Number=SeqID_178034
atgatgataacaattttttccgacaaaggctacgatcaacaagcttctcaagtggctcattgtgaagaagcggtaacgacattgccattctgccgaggatgcggaagaggacctcctcggtggcttcttgcggcacgaaggagaaccgatgacggctacagtcgtgtcatcggtgaagagattttcaacggcttcgttgccactgggtataggtattttatgaaagagatggtgatcaacaacgaggggttgttggggaaaagaagaaacaatggtgaaagaaaaaaaaaatgtcgctgtgagaaattgcctccgacgacgacggcaaacggtgatcgaaaggttgctgggagggaggaggaatacatctag

SEQ ID NO: 61257 - DNA, 885 bp, Glycine max
  Peptide Sequence Number=SeqID_178035
atgttggcacacatgcaattgaaatttcagactgcagagttacagcaagaagtgttgcaagacctacctaaaacaataagatccagcattgctcggcatcttttccaaaacatagttgaaacaacatatttatttaaaggagtctctgatgattttatcacccagctggtgtcagaaacgaaagcagaatactacccatctaaggttgacattatcttgcaaaatgagatgccaacatatttctacattttggtatctgggtcactggatgtgttgatatacaagaatgggtccgaacagtttttgttcaaacttgaatctggaggcatggcaggagaaataggcgtgatgtttaatattccacaaccttttacagtgagaagtagaggactctcccaggtcatacgaatcaatcatcaccatttcaagcagatggtgcaaccatttagtgatgatgggaagacaatcatctacaactttattaagtattttaagggcctcaaaggcaaggtgctagaagaaatatatgtaacagaattgctgggtgactttcatgacgagcatttaacgcgaaatgagggtacagacgaagaagtttcaagatatcaagaagctccatatgcagaaggaagaacaggaaattccaaagcactgtcaaacccagtccccgtaagagttaaaatccacggacaccatcccaatgaacacaaaatgggaaacgaaacaacaccaaagctcatacttctcccaaattcggtagaagatcttttcagcgttgcagagaaaaaatttggaaacagaggaagcaaaattcttatggctgacggctcagaagtagaagaactaagcacgataagggagaatgacgagttatatatcctctaa

SEQ ID NO: 61258 - DNA, 477 bp, Glycine max
  Peptide Sequence Number=SeqID_178036
atggagaaagatgctctatggcatggtttgctcactcagaggtatgggtgcttggatcaacttggggagtgtcaagcccaatctaggtcgactaagtggcaggatctcatgaggattgatgtgggggacaattggttttctagtagggtggttcgtcagattagtaatggacaagacaccttcttctgggaagactgtttggtttggaaattcatgtttgaaggatctctttccatgtcttttttatctggtgatggtacaacagatggagactttactttctacagtccaattggatttgatgatagaggacaaatggctgatcttggacaggctgcctactgtgtggctttagtgaggaggggagttatggtggaggatggtgggggatgtgtagagttcactatctcatctgacatgcaatttgctggagtctttggtttcacaagaatcatactatttttcatggagaggtag

SEQ ID NO: 61259 - DNA, 1440 bp, Glycine max
  Peptide Sequence Number=SeqID_178037
atgcaacatcctaaccccggtgcgtttccgcacggctttctgtggggcgcttcaacctcggcgtatcaggttgagggcgcctggaacgaagacggcaaagggccgtcggtgatcgataaaggccattttcctgaggggatgacggatttcaccgtcaccagcgatcactatcatcgcttccgggaagatatcgcgctgctggcggagcttggcctgaaaacctatcgattctccatcgcctggagccgcatctatccgcagggtgacggcgagctgaatccggcgggcattcagttttatcagcagctgattgatgaaatttgccgccacggcattgagccgctggtcacgctctatcacttcgacctgccgtgggcgctgcagcaggatggcggctggtcaaaccggcgcaccgtgaccgcttttgagcgcttcgccatcacctgtttcgagcactatggcgaccgggtgaaatactggctgaccatcaatgaacagaacatgatgatcctcaaaggcgaggtgattggcacgctgccggccggcacggtggatgcgcagaagacgctgtatcagcagaaccaccatatgatgctggcgcaggccaaagcgatgattgcctgtcaccagcgcttgccgcaggccaaaattggcccggcaccgaacatctcctgtatctatgccgccagcgccagaccggaagatgtgctggccgccgataacttttcagcgatccgcaactggctctacctcgacctggcggtgcacggccattacaacaacgtggtgtgggcgtttctgcagcagcgcggctggctgccgcacattgagacagaggatatggcgaccatcgccgccggccagccggactttatcgccttcaactattatgcatcggccaccgtcagtgctgacatgcctgaggtcgcgcgcggtgagctgaacagtaagcagcaggccgaccagcagatggccggcatcgacaaatcagtgtacgtcggctgcaacaatccgcatctgcagcagaatcagtttggctggtatatcgatccggtcggtttccgcattaccgcgcgcgagatctacgcgcgctatcgcctgccgctgattgtgacagaaaacggtctcggtgcgttcgacacgctggaggcgggcaacaaagtgtatgacgactatcgcatcgcctatctacgtgagcatatcgcccagctgcggctggcaattgccgatggcgtcgagctgtttggctactgtccgtggtcggccatcgatctggtcagcacccatcagggcatcagcaaacgttacggctttatctacgttaaccgcgatgaacacgatctgcgcgatctggcgcgctatcgcaagaagagctttttctggtatcagcagttgatccgcaataacggcgcacagcctgatgcggaggtggaatactaa

SEQ ID NO: 61260 - DNA, 588 bp, Glycine max
  Peptide Sequence Number=SeqID_178038
atggccgtcaccgtgaaactaatggctctcactgtttccttcttcggccttttgtctttcattttgggagtcatagccgaaaacaaaaagcctcctgctggaacgcctgtgtttggcaaggatggtgtcacatgcaagttcccagctgatccaacagttgcattggggtatctttctgtaatttttcttattgcttccaccgtggttggatatctctctctgttttacccttacaaagggaagactgttccacaaggagttctctttaaaagcatgacttttgccgtattcttcaatgttgcattgttttcaactggactagctgcaactatgctgttatggccaacaatcactgaacaccttcaccttaaacgcaatgtgcatcttgatctcacatatacatgccccactgctaaaactggtctctttggaggtggtgcctttttatcccttgattcatccctcttttggttagttgcacttctggtggctgacaatgcccgggaggattttttggatgaagacaaggatgataagcttgatgttgaacttccctcacttgctaatcatgctgatatggtcatatag

SEQ ID NO: 61261 - DNA, 423 bp, Glycine max
  Peptide Sequence Number=SeqID_178039
atggcggaatctttttgcttgtcggcttcgaacatcgccgtgcagcgggctcagtttaccggcgcgcaccagttcgatgaccagttgcagggcggcctgttttgggctgctggccggatgggcaatttcatgagacatcagatatcactccttattgttgtcagtgccgcacagtttagcccagattgtgctgctaatgggcgcggcgctggaacacacagccacgcattccgtaccacgggaatggtgcagaaggagtcggttatgttgattggttttgtcttgttagtgagcgcctgcggccacgatgcctgtgatgccctgccggtgtcggagcggatttatcccaccaaagtggcgtgtgaacagatggccgatcgcatccacaaagtccggccgaacgtggtgctgctttgtggtgag

SEQ ID NO: 61262 - DNA, 1224 bp, Glycine max
  Peptide Sequence Number=SeqID_178040
atgggcgcctgcctgcttcctgccccgaagggaacttcttgtgctaattatgctagatgtgtgaatcagatcttacagggttcaaataatatgcagttgtggcttagggttccattggtgaagcctgatgatgactctatggatgcaaagtctgttgctttggttgactcttgggaaacttggaattcatttcgtctgctgtgtgagcatcatagtcaactgtcagttgcacttgatattctgagtactcttccttccccaaattcactaggacgctggtttggggagcctgttagagcagctatattacatactgattgctttctaactaattctcatggctgtccatgcctctccaagcgccaccagagtttaattactggtttttttaaccattctattcagttcatccaaaagcaagtgtggatgcaaatgataattctggtacaaattcacaaaggcatcccttgcggccatatctggactacattggatatctttaccaaagaatggatcctcttcctgagcaagaacgttttgaggcatagcattatatgctattatatttcgcttgaccctctcagcatcttatgccagcttggttacagggattttttacagtcacccttgcaacctttgatggataatttagaggctcagacttacgagacttttgagagagatgcagtgaaatacattcagtaccaacgagcagtcagtaaagcattgctggacagggttcctgatgaagaggcatctgttaaaaccattgtattgatggttgtgggggcaggacgtgggcctcttgtgcgggcatcattacaggctgctgaagaaactgggcggaagctcaaagtttatgctgttgaaaagaatccaaatgctgttgttaccctacatgcattagtcaagttagaaggatgggaggatactgtgaccatagtctcaagtgacatgcgtcattggagtgcccctgaaaaagctgacatattggttagtgaattgctaggttcttttggcgacaatgagctgtctcctgagtgccttgatggagcccagagatttctaaagcaagatggaatttcaataccatcttcgtatgtacacaagtttcctccaaccagtgacagcttcaaagttaaggcacataaagatcttgtacactttgaaactgcttatgttgtcaaaatgcacaatgtagccaaacttgcaccaacccaacct

SEQ ID NO: 61263 - DNA, 1257 bp, Glycine max
  Peptide Sequence Number=SeqID_178041
atggttttacatcatttcatgttgaggaacatgcttttttgtccacatggtcaattgatgccagagcaagctcctggtgctaagcgggtgcttattcctgagatcttttggctcttcttatatgaagatgctgtttctgtaaagcctgatgatcctttgggtggcccaactttttcttcagattctgatgagtgttcccaatgcagtaatgaattatctgaagtagcatgcttggaggactccttgagattagttaaacaaaaacaacgtcagaatcatgagaaattattccaggctaaaagtttgcaactttctctgcacagcaagtatttcttggtgcctttgtcatggatttcaaaatggagaaattacattagtccaaccctgaagaattcagataaacctgaaaccttagatggggtaattgactcactgttgtgtgaaaagcactcacggctaattgaaagacctcctgaattggttttcagacgtggtgctataatccagagggaatcttctgcaggtggcttaaccattgtatctgagaatgattggaaatgcttctgtgaagaatggggcggtattgagaccaaaggaatatcagcaacaattgatcatgttaatgattcagagaatgtattgactggatccagtgaagagatgcaagtatgcaaggatcagttgagcacagcagataaaatgaattttgaaaatgggactggacaaaatttaattaagacttgtcctgaggtttgtgaaagttgcatcggagaaagggagagctgtgagctaatgcagaagcttaactattgcaatgaggacatatgtgtaattcttgttcgtggtaaggaggtacccagatcaatattggaggcttcaaagggattcgttgaaacagatcggcgagtttcaaaacgttcccgcaagtctaaaaatgggaattcaattagtctaaaagtttctgcttcaacatctttatatcagctgaaaatgatgatatgggaatcctttggggttgtcaaggaaaaccagatactacataaaggtgataggataattgttggcgatgatgaatgtgctaccctcgcagatgtgaacatatttgctggagatcagattatagtgagggactctgagatccatgaaaatcgagatattgctgatgagctttgtgatgataaaatggatctgcagcataccgaggaagggttccggggaacacttctcacagcaaatgtttcatcccaggttgtttaa

SEQ ID NO: 61264 - DNA, 1056 bp, Glycine max
  Peptide Sequence Number=SeqID_178042
atgcggcatagaatgtctgagttgtctcagttcaacttggtatatgacttgtcagctgtactgattcacaagggaactggtgctaatagtggccattacattgctcacatcaaggatgtaaacactgggcaatggtgggaatttgatgatgagcatgttactaatttgggttttcatccatttggtgaagagtcttcaagttctactactaaatccatcaagactgatgcaattcattctgataattctgaagcaatggtagctgacagtaatggaaatggtttaaatgctactcattcactatcttcacaagtggagacatttttgtctagtgatgcgtacatgttgatgtaccatcttaaacaaacaaaaaatgttggtgaaagtgggggtgtaatttgtggtgctaaccataaagaaagcgagggtgttgtagttgctgtgcaaaatggtgttcctcttccatctcatatttatgatgagattcaaagtttcaatgcctcatatgatgatgcttgtcggcggtacaataataggaaagagttagaattgagtcttattagtgagagaagacaggaagttcgatctgttttagctgaagctcctgttcaaccattggagcagccattttattggatttctagtgaatggcttcgtcaatgggcagacaacattattccaatggtgcttacgttgcaatgtatatgcagtcctcttgacaacacgccggtccaatgctcacatgggaaagtcccagtttcaaaggttacctcaatgaagcggttgtctgctaaagcatgggatacattgttctccaagtatggtggaggaccagcattgtctcatgataaccactgtcgggattgcctgattcatggggctatgacagtggtgtcagctgacacctatcgggatagaagagaatcaatgaagtcacttgcacgggatattctagatggaaactgcctagatggaaagtattacatatccagaccatggtatggtaacattttgtttcatctcatgccattcatgctgccacagaaaggggattga

SEQ ID NO: 61265 - DNA, 990 bp, Glycine max
  Peptide Sequence Number=SeqID_178043
acagaaacaaggggatgatggcaatggcactagtgaaatatggaggaaaattcataatacaggggtggtatccaaggatgacatgaatcaattgtatatgatttggaagccagtttgttcaggctgccgtgtcaataccaaagataacccaaattgcttctgtgcattggttccacctccaaatggagcccggaagtctggcttatggcaaaagatgtcagatgttgttgagagtcttggccatgacccaaccaaggatcttcgagcttctgctgattctcctgcaggtctcacaaatctgggagcaacatgctatgccaactgtatactccagtgcttgtacatgaataaatctttccgagaaggcatgttttctgtagaacgagatgttttacaacaacaccctgtgctggatcagctggctcgactttttgtgcagttgcatattagtaaaatggctttcatagattcttctccatttgtaaaaacactggaattagataatggagttcagcaggatagccatgagttcctgacattgcttctctctttgcttgagcgttgtctgagccattccaaagtgcccaaggcaacaacaatagttcaagatcttttccgaggaagtgtttctcatgtgacgacgtgctcacaatgtggaagagactctgaagcttcttccaaaatggaagatttctatgaattggagttgaatgtcaaaggattgaaaagtttagatgagagcctagatgaatatctcactgctgaagagcttaatggggacaatcaatatttttgtgagtcgtgtaaaacaagagttgatgctactcgcagcatcaagctgtgtacattacccaaagtacttaattttcagcttaaacgttatgtcttccttcctaagagagcaagccctggcacaaaggtaacgttgtgccttggtgaccaattggtcatgggtttgaattcgaaaacagcctctttgcatatgcaagg

SEQ ID NO: 61266 - DNA, 1182 bp, Glycine max
  Peptide Sequence Number=SeqID_178044
atgagaggtcttaaacaagttgtgacatcacctgaggagtccagtggtatcacagtttcaaacaacatccctaagctgcaactagtttggggcaccaccatgtaccaccttgatgaccttccttttgatgctactagtttgccagatgtgtatactcaatttctgctgcttatgcttgctaatgggattcaaaacttgcagcttgttgaaaccaaatgtactatacgctcatgcatcaaactaccagcatctcttggaccacctcccacagttcaggattggggatgccttccttcattagagcagctgggacttagctcacagagtgttaacaaagggatgaagtttgtggggggtgaaactgcagcattgagcagagtatatgaatacttttggaagaaggacttgctgagggtatataaagagaccaggaatgggatgttggggcctgattattctaccaaattctcaccatggcttgcctcaggaagtttgtctcctcgtttcatatatgaagaggtgaagagatatgagaatgatagactagcaaatagttctacctactgggttttgttcgagttgatatggagggattactttaggtttttgtcagtgaaatatgggaattcgcttttccatttaggtggtcctaggaaagttcagcgcaactggagccaagacaagaatttgtttgaatcctggagagatggttgtactggattgtgtgttcatttcttgttcgtgatatgggcattgattggcgcatgggagcagaatggtttgagacatgtcttttggattatgatccatgttctaattatggaaactggacttatggatcaggagttgggaatgatcccagagaagatcgttatttcagcatcccaaaacaaagagatcctcaccttcactaacaaatgctataactgtaaaaatagtgtgcactgggtggtattgattcttggagggcatatggcacaaacgtatgaccctgaaggtgagtatgttgcatactggttgccgcagttgcgaaaaatcccaaaggagaaaagaaactttcctggaaatttaatatacattcctcaaattgtgcctctcaagtttggaacaactagtggacacaataaggacaagttctttggtgcaagaagaaccaacgatagaggaagtaaaagaagatag

SEQ ID NO: 61267 - DNA, 837 bp, Glycine max
  Peptide Sequence Number=SeqID_178045
atggtttttccttcttcctccctctccctccccctctcgttcttccccattcccactctgctacctaataacctcatcttcagaaacaataactggacaatccttaaccaacgcaaatgcccattgtccgaggaaagaccacgcttttcatgttgtgctctaaaacccacttcacaaaacaggatttttagaagggatttgatgctgttggggcttacttcgctctctctaccaatgccactttcagtgactcttgctgaagaagaaccgaaaatggcttcatttcttgatgaaataaatgcctattcttatatgtaccctgttgagttgccttccgataatttttccttcaaatggattgaatccagaaagcctgaacgatattcatcagcagcaccactttctcctgatgcacgcctgcgcattgtgtctgagcgtgttgactttattgataatgttatcatttctgtcacgataggtccaccaaattcaagctatataaaatcaaaggataagagtgaatggactgcaaaagatgttgctgattcagttttagctgacagatcttcactgcgagttacttcaagtcagcgcttagaagagagttcagtccttaatactcattctagtgaaactgatgaatcaagcacttacaggcattatcttgcttcaacagctgaaagagatggttatttgtactctatcagtgcttcaaccgtcagccctcggtgggaaaaactcggtcctttccttgataaagcggtgagttcgtttcgtcttcttagtccaacagaaaattatgttcctccgtacaaagatccctggagattttggtga

SEQ ID NO: 61268 - DNA, 699 bp, Glycine max
  Peptide Sequence Number=SeqID_178046
atgggttacacaagatcttctcttctgttcctggcctttgtcttggcattattttgttccaccattcacggtttggacatcacgaaattgttgggccaataccccgaatatgcccagttcaacaaatacctcaccgaaaccaagctggcggatcaaatcaacagccttaacgccgttacagtccttgccctagatgacgccgcgatggcgtctctctccgccaagccgcaagacgccgttaaagccatcctcagcacccacgtcctcgtcaacttctacgatgagaagaagctcatggaagccgaaggaagccgcgccaaggtggaaaccctattccaatcctccggcgtcgccaagcccaaccagggttacatctacgtggcgctcatcaacgagggagagatcgcgttcggttccgccgccgctgcacctaatgcacccttcgaggtcgtgttggtgaggtccgtgacgagccaacccgacgccgcttcgattcttcaggtgagcaagcccatcgttgcacctggcgttgagtctgcagcttctgctacggtgccacttgcaaccgccgccgttgccgataacattgcacagtcacctgctgctttggcacccgctcccagcagcgcttctcgcgtctgcatggaactcgctggtgtggcttctgccatcgcttccctcgtcatgctcgctctctaa

SEQ ID NO: 61269 - DNA, 686 bp, Glycine max
  Peptide Sequence Number=SeqID_178047
atgggatgccacgtgtcacactttcaactgcttgactactcccaccctcagcaaaacccaacaccaacgttatacatggccattctccactgcacgtcactgccatttctttctctgagaaccaccatcagttcctccaagtccacgttaacctcaacgagaattccgttgttcctagcgatgaactcgttcgccaaatcagaacccgtgtcatcctcagcctcttcatcatcatcaacgtaccagcaggtgccggagcaagatgctaataacgacttggaccgcgtagcagacaacacgtttcgcaggtacacgtccaacgttaccaaggggagtggcaaaggaacagccattgtctggttcaggaacgatctcagagttttggataacgaggctctctataaggcatggctttcctccgaaaccgtgttacctgtctattgtgttgatcctcgactctttgccactacttatcatttcggctttccgaaaaccggtgcattgagagcgcaatttctccttgaatgcttggctgacttgaggaagaatttgatgaaaagaggactaaatttgcttgtacaacatgggaagcctgaggaaatccttccttctcttgcaaaatcttttcaagctcatacagtgtatgcacagaaagaaacttgcagtgaggagctgaatgttgaaag

SEQ ID NO: 61270 - DNA, 1266 bp, Glycine max
  Peptide Sequence Number=SeqID_178048
atggttgaatttgccagcggtgtgaaaggaatagcgttgaatcttgagaatgagaatgtcggaattgttgtctttggtagtgataccgctataaaagaaggagatcttgtcaaacgaactggatctattgtggatgttcctgcgggaaaggctatgctagggcgtgtggtcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacttagatatgggttacaatttcttctctttttcgcggtcttctatttaattagtactaatattaatatggcttcggtggacacattcgagagtctggtcaggagacttgctttctacctcggcaatcaagccttatctaggctattgcttcagaggggatgctccgtaggtctgaccgtggccattgctgtgctttttggggacacgccatcagtagggaataacatgatggacccctcggggtcttccggttcgtcaggagggggtgggtctgaatcctcgtggacgggtgcccttctatcttcggaaacgctttcaggaacgggatccgttaatcagcccgcggagggaatgcctgttcctcccgcaaatccggtcgtggagcaagccggtccggcaaatccggaagataccactgaaatcataggtggagactctattgactcgataaggaaccgcctcttacagtcatacgggaatccttcggcggagcaaatctctcgcgcctcgtatgacgccgatgatctctttcaggttaaagtggagatcataagggggatgactccacttgatcctgaaggggattggccggggcggggggctcgggcactcgataaccctcgaacgagcacgggcgaggattccctcgagaacctctatcgactaaaggacgacctgaatgagaatgggcgggactccgagacctttaaaagattgaaagacaaagtttttcgaagacctcgacctttagaagatgcaaattctactacttaa

SEQ ID NO: 61271 - DNA, 231 bp, Glycine max
  Peptide Sequence Number=SeqID_178049
atgagggatgttacaaatggtatcagagcaaacctctcccactacggtgtggttcaaggacgaattaggcagaagttggtgggcatgaaatgtgtgaatggggacaaaatatacttcaaaaatttgtattggtttgtgtggtcaatcattgatcctaaagcaagtaaagttgattttcaaggtttcaaaaaaggattacctagaaaggattctgaccaacaaggatgttga

SEQ ID NO: 61272 - DNA, 486 bp, Glycine max
  Peptide Sequence Number=SeqID_178050
atgcaggttgccagaagacttgatagtcagttagcagaatccattttggaaaacaatggtcaacttgcatttgaaaagcttgcaactgctactcttgaaaagctaatgccacgaatagaagggaagggacagtttggtctggctaagtggaagttggtttacgctcctcagattcctagtttggtttcttctggtgctacagtagatcctttcacgttacttgctgctaatttatcatttggtacagatgttgaagtccagcttgggaaacgtattcagaagcattcattagttgccaaatcctttcaatgttggaacagcaggctttattgttactcattggccagaatcgttaggcaaatgaaggagtcacagatggcaatggaatggaccttgacctataaacttacaagtcgtttgcatctgtgcctaaaaaatggctcgtccaaatgcgtactttttgaatattctgcatcccaggattaa

SEQ ID NO: 61273 - DNA, 1656 bp, Glycine max
  Peptide Sequence Number=SeqID_178051
atgaatatcaagagtcatgtgagtgaaatttcctcacacttaaattcaagtacttttaagaaggaagcattatgggtagctgctcaatcacatgagtctcttctaaggcagaaggtgaggtcaagatggattaaagaaggcgattgcaactcatggtacttccacttgatgatgaatgctaatcgcagaaacaactctctaaaaggagtgatgattgatggaacctggattaacaaaccggcaagagtgaaagaggaagaggatgaagtaaaacgggctatatgggactgtgagagtgagaaaagtccaggcctagatggacgaaacttcaagttcatcaagaaattctggcaaataatcaaacctgatgtccttcggtttctagatgaattctatgtcaatggaacttttccaagggattgtaatgcatcttttatagtcctaattcctaaggtggctgatccacaaatcctgaatgactatagacctatttcattaataggctatatgtacaagatagtgtccaagatgttggctaaaagactgaagaaggtgatgccactcataatagatgaaacacaatttgcatttataagggaccgacatctgttgcacagtgtgataatagcaaatgaggtgatcgaagaagctaaaaggagtaaaaaatcataccttgtgtttaaagtagactatgagaaggcatataattcagtctcatgggaattcttgttatacatgctgagaaggacaggttttagctccaaatggatcaaatggattgagggatgtttaagatctgcgtctctttcgatactagtgaatggaagcccctcgactgagttcattccacaaagaggacttaggcaaggggatccattagcaccccttctctttaatgttgttgttgaagctctaaatggattgatgagagaagctgtggaaaaaaatttgttcagaggattcccagtggactcaaataatgtgggaataagcatcctacaatttgcgaatgacacaatattctttggcgagacatcaatggagaatgtcaaggctatcaaagctatcctgaggaccttcgaactcacatcaagcctaaaaattaactttgtaaaaaactgttttgaagcaattggagtgtcggaccaatggaagcaagatgcggccaactacttgaattgtaacttgctggtcattcctttcgtttacctgggcatacccattggggcaaacctgaggcgatgtcagttgtgggattctatcattaacaaggtccctagtagagtggtggacaagctggtgtttacaacgcagattcctatgggcatcaaggagaattatgagctaggatattggagtcaaaatatggtggctggaggagcttggatgcaacatctcgggacaccaacgaatccatatggtggagggactttaaaatggcttttcatcattcgcaacagggtcggactcttcaaaatggaacgttgtggagggttgggtgtggtcatccgacagatgggagctcacaaggacacaaggtgggagtgggaattcatatggaggaggccacttttcgacagtgagattgccatggctgttagtttcctaagagatgttgaaggcaagataatacagccacatagaagagatctatga

SEQ ID NO: 61274 - DNA, 450 bp, Glycine max
  Peptide Sequence Number=SeqID_178052
atggcagtcaatgagtcaattcaggtggaaaaggatatggaggaagtgcagataaaaccaaatataggaatctgccttagtaatctgaagcttgtgcttggaccagagttgaagatagtttatcctttcatccttaattttgctgttagtggagagcttgagttgaatggtcttgcccatcccaaatgtataaaacctaggggcacactgacatttgagaatggtgaagttgatctagtcgcaatgcaggtgaggttaaaacgggagcatctcaatgttgcaaggtttgagcctgataatggactagatcctatgctagatttaaccttggttggatctgagaggcaatatagaattcatcgtcgagctagcaattggcaggactttgtagaacaggatgcactgtcaccaattgaggtaaatgacactgctctccattatcttgcttga

SEQ ID NO: 61275 - DNA, 433 bp, Glycine max
  Peptide Sequence Number=SeqID_178053
atggcgctgctgcagcggcgaccagctccagtccagcaccgcgcgcgcatagttgaccagcgcgtcgcgcggcatgctgtgctgctgctcctggcggcgcagatacatctcaaagaactgatcgaggctctgtgtctcttcgctgctacagtccagcgtggggcggaacgccacatcgagaaagccgcacacgccgtctgcgcgctgctgccagtcacaggccagcgtcataaacaggccatcctgcagattaacctcttccagcagacgacgcaaattttcagaatgtttaccggcggcgatctcatcaatgcgatcggtttccagcgtcaggtcaaaaccgcacgggttgaccgagccatccgcgtctcgggtggccggaaaggggaaatcgatataaccgttattgtccagactcttttccataatgcag

SEQ ID NO: 61276 - DNA, 876 bp, Glycine max
  Peptide Sequence Number=SeqID_178054
atgcgccgattgttaccaactgcaaagcccatgcgaaaaacttctcaacgaattcaccagcataagcgccctgctgccccggcgcgccagcctgcgcggcgtgacacgcggccaaaaggtccgcgtcgcgtcatactctttaacaaacctttcgatgttctgccgcagttcagcgatgaggctggccgccgcacgctgaaagattttgtgccggtgagcgaggtgtatgccgcaggccgtctcgaccgcgacagcgaagggttgatgattctgaccaacgatggcgcactgcaggcgcagctgacgcagccgggcaagcgcaccggcaaaatctattacgttcaggtggaaggcgtgccgcaggaatcagatttatcccgcctgcgcagtggcatcaccctcaacgatggcccaacgttgccggcgggcgcagaagtggtgcctgaacccgcgtggctgtggccgcgcaccccgccgattcgcgagcgcaaagctatccccacctgctggctgaaaatcacgctgtatgaagggcgcaatcgccaggtccgaaggatgacggcgcacattggctttccaacgttacgcatgatccgttttgccatgggtgattaccagctgcaggatttggcaccgggcgaatggcgcgacatcagcgaccggacggcaaattactggttgtggaagagcgcgttgacggccgcgttacctggaatcagccggccggccatcttgaggccgatgaaacgctgctggaagccgcgcaaccgcagagacgctgcgttcgccgctggtggccgaaagcgtgcggctgtggcagcagggggcccgctatccgctgcagctgatagcgccgtatcagtggccatttcatga

SEQ ID NO: 61277 - DNA, 438 bp, Glycine max
  Peptide Sequence Number=SeqID_178055
atggttgaatcagaaaggctttcttacatcagaaacaaccaaaaaaaacttcgagttgacaagttttgcagcttacagcagtcattggatgatggaagcacaaaaggcctaaataaagcgacagacagaccagacataatctccagagtcttcaaactaaagtatgaacaaatgcttatggacttgacaaagaatcacatgctaggaaaagttattgcatatatgtatacaatagaatttcaaaaacgagggctgcctcatgtccatttgttgctttttttacatcctgataacaaatactcatcctcggatgaaattgatcaaattatatcagcagagataccttcacagcaagatgatccagaactgcattcattagtaaaaaaccatatggttcatggcccatgtggaactttgatcctggatctctatgcatga

SEQ ID NO: 61278 - DNA, 189 bp, Glycine max
  Peptide Sequence Number=SeqID_178056
atgcctctgaaaaacaacgatctcggactcattcaccgttggatcgtcatgaaatttaagcaccagaaaaaggaatctcatgaagacagtacaagtggaggcttcaatcccttctccgtctctttgacgtttgggaattccatcaaagcagtcggagggaaaactgaaggaatctcaggaaatcgctag

SEQ ID NO: 61279 - DNA, 327 bp, Glycine max
  Peptide Sequence Number=SeqID_178057
atgaagacacttagatttgaacaccgatctctggttaaacatctcaaatacaaatccgttgtcgctcttgtcatgggttatgatgagggtggatggtggaggttgggtcgtcagcagttgcacgggcagttatggatgacaagtggtgtggtgggcgctaaggtggtgaggcggcatgcggcaatgctggtaggggttgcaccaactttgttgaaggtgcaagggtgcatgtgttcggaggcggaatcagatctggaggtggaggcagcgtgcaacatcggaggagggtggtggggttggtgcgtgatgttgatggagtgtggcaag

SEQ ID NO: 61280 - DNA, 219 bp, Glycine max
  Peptide Sequence Number=SeqID_178058
atggaaacaatttcaccggctgatgggggagatgtgattatagttcgagtatcaaataatttaaaccaaggtttaagtttcacaattcactgcaaaacccataaccaagacttgggaactcaagtggtgaatccgggttactttgaacgatttgaactccatcatgacaatgccgctggcacaaaattcttgtttaacatggagagatgcatcaattga

SEQ ID NO: 61281 - DNA, 222 bp, Glycine max
  Peptide Sequence Number=SeqID_178059
atggaagtttcccgagagaagccgaatgtagtagttcaaatagctaaaggcacaggacctccgcaaccccaaggccgtcaaccaagctctccgctccggcgcggaggtgctgacgctgaagaagttcgacgccggttccaacaagtaacccggcccggcgctggacgctcggaagctggaggaggggacggagccggcggcgctgagcgcgtggcggcggag

SEQ ID NO: 61282 - DNA, 327 bp, Glycine max
  Peptide Sequence Number=SeqID_178060
atggagctggagaagatgaggctggattttaacagggagctggagctgcagaagaagcagatcctcgagagggcgcaggccgagattgccaaaattcaggaagtggatgaggaggataccgacacttccgagactaatgcatcatcagggacaaacttgaggcttcgtaagaaaaatgatatggaacagtcttttcaatggcatctgattctcttgtatttgaaaatgaggagatatgatcttcgaaagggtggtgatatctggatagagtgcaccagttttggaggaaagattgtctacaggctggaaaagagctgcacccagtaa

SEQ ID NO: 61283 - DNA, 141 bp, Glycine max
  Peptide Sequence Number=SeqID_178061
atgaaggctaaagaagagaaggttcaagtagctgttgactcgctcaacgagacagatccactaagtgaggcatacaactcgtttagcaggttgagaaaccctagaagaaaatcagtcatagatgtgatcgcccaacgctaa

SEQ ID NO: 61284 - DNA, 1572 bp, Glycine max
  Peptide Sequence Number=SeqID_178062
atgaagcccttttttagtgcaattgttacgccagaattgctggagcaccaggatagtgatgtcaagcttctagttgcaacatgtgtttgtgagataactcggatcactgcacctgaggctccttacagtgatgatgttctaaagaacatctttcagttgattgtgggcacttttagtggtctgagtgatacaagtggttcatcgtttgaccagagagttgctatactggatactcttgcgaaatatagatcatgtgttgtaatgttggatcttgaatgtgatgatctggtgaatgaaatgttcactactttctttgcagttgccagagatgatcatccagaaattgttctgtcatccatgcaaactataatggctgttcttttagaagagagtgaggatgttcatcaggatcttttatctattctattgtctatgttaggtcgtggcaaaaccgatgttactggggccgcaaggaagctttccatgaatgtcatacagcaatccatggaaaaacttgaaccaagcattaaacaatttttgctatcattaatgtctggaggcagcaagacaatgaacagtcaagttcaataccatgaagttatatttgatctctattgctgtgctcctcagaccctatccggagttcttccttatgtcacagaagagctaatggctgatcagctggaaactcgtttgaaagcagtgaacttggttggcgatataattgctctacctggattctccactgctgaagcatttcagcctacattttcagagtttttaaagagattgactgatagagattttggggttcgcatgtctgtccttgagcattctcagctttttatacttttaccatatctgctaaatttatttggctacaactttttagctgctctttgtgatcggctactggattttgatgaaaactttcaaaagcaagttgtggatgttatctgtgatgtggcatgtcataccctaaatgcagtccctcttgaaactgtgcaactcgttgctgagcggcttagtgataaatctctacttgttagaaaacataccttggagagattggctgagatttatcgagttttttgtgagaataattccattgcagttaatcccggtgaatatgactggattccaaggaagataattagatgtttctatgacaaagatttcagatcagatataattgaatctattctatgtgggtccctgtttccatcagagttttcaatcaatgatatagttaaacgttgggttgagattttctctggatttgataaagtggaggtcaaggctcttgaaaagatacttgagcaaaaacaaaggttacaggaagagatgcaaaagtatctagttctgaggcagactagtcaggaaaaagacattcctgaggcccaaaaaaagatagtgtttggtttccgtgcaatgtcccgttcatttgctgatccaataaaggctgaagagagtttccagattcttgatcaattacaagatgctaatatctggaaaattttgacagatcttgttgatccaaatactagcttccatcaaacttgtgtatacagg

SEQ ID NO: 61285 - DNA, 165 bp, Glycine max
  Peptide Sequence Number=SeqID_178063
atggcgcagaagcctcaccttcagctcgaggagctgggatccaagctcgaatctcttccctccgacgacaacgctctcaccgagcttcttaagttatgtccgttattttctgtttggggtgcgaaggcgaagaacacggtggcgattttgatttttcgcaattga

SEQ ID NO: 61286 - DNA, 429 bp, Glycine max
  Peptide Sequence Number=SeqID_178064
atggatgaggagcgcaaggtatacactttggcccaagtatctgagcacaacacctccaaagattgctggctcataattgatggcaaggtttacaatgtcacaaagttcttagatgatcatcctggtggggatgatgtcttggtgtcttccacagggaaagatgccactgatgactttgaggatgttggtcacagtaaaggtgctagagccatgttggatgatttatatattggagacattgatccatcaaccatccctaccaaggttcagaacactcctccaacacaacctcaaaataatcaggacaagacatcatcatcgtcatcatcatcatcagacttcatgaccaagatgctccagtttctacttcccctgcttatcttgggtgttgcggttggtattcgtttctacaacaccaaatcaacatag

SEQ ID NO: 61287 - DNA, 513 bp, Glycine max
  Peptide Sequence Number=SeqID_178065
atggtcgtggtttcatcgcaatctttgataaaaaacttcgtaccccattgtccagaggctcttcgctgcgaagctattggtagatggaatccacaagctccaaagtcaatgttccaaactctagacaattatctaagcagcttttgtttgaccgccgctatggatggaattgatgagtggaaagacccagcagaggaagcacttgatggaggccgaggaatgttttgcatattgccacttgccaaagctttggtgcataaggcctcacaatcgcttttagaagtagagagtataaaacttcatataaattgtgcagtaatctcagtcaaaaaagcttcagagaagcccgagttgttttcccatcagatgctgcagagtgctttagatgacggtgttaaaagttttatgacatctttaaaaaacgttgggagtaaaggtttcatcctcaacaagaattctcaatcacaagctttcaataacccttcccactcacttacaggaagcaatgaatga

SEQ ID NO: 61288 - DNA, 330 bp, Glycine max
  Peptide Sequence Number=SeqID_178066
atgtgtgctaatcaactactaggaatcaacggaaatcaattagaagaaattcttaccatagaagctgatgatctcatttggaacgaaaaacataaagattaccagaaggcaccagcagataattttcatcatccaacctccatggtgcatactatcccggggatccctctggggaagggattccatgaggggagcggcgacctcacggaggatccaggcgacgacgagagagaaggcgaagaggccgcagtaggcgatcctggcggaacggcggctgattcccgatacgacggtcctgcaggcgtcgcatgcgcaggccgcgcagcatga

SEQ ID NO: 61289 - DNA, 309 bp, Glycine max
  Peptide Sequence Number=SeqID_178067
atggatgagaaatacggaagaaccagtcaatgtagtctggtgcacactaacctggcacaacacatggatcacctgattgtgttaatatctaggatttttgcatacgagcaaacaagcagtggaaagacacacaccacgtctggcattactgaatatgctcataaagatagagaatttgttaattttgttgatctagcaggaagtgagcgtgcttctcaagcaatgacagcaggcacaacattgagagaatgtagccacataaatcgcagtttactgagccttggaactgtaattcggaaactaaggtag

SEQ ID NO: 61290 - DNA, 168 bp, Glycine max
  Peptide Sequence Number=SeqID_178068
atggaattttacaagtatttggagatgggtctccaaaatttcgaggactaccaggtttttgctatcagagtgggtgtggttggtgatgcacagatgtattcagtgcagagccttggaggagaaaatagtgtgctactgtcttattgtttaatgagtgagaaccagtga

SEQ ID NO: 61291 - DNA, 423 bp, Glycine max
  Peptide Sequence Number=SeqID_178069
atgattctttcgatgaagcaagttttctcactagtaatattcattgcattttgggaattttcttctggtgtagctgatgggggagatgtgattatagttcgagtatcaaataatttaaaccaaggtttaagtttcacaattcactgcaaaaccaataaccaagacttgggaactcaagtggtgaatccgggttactttgaacgacttgaactccatcatgacaatgcagctgacacaaaattcttgttttgcaaaataacatggagagatgcatcaattgattatgtcatttaccaagatgccagggattttcgtcgtagatgtataactgattgtaattgggaagtcaacaatgaaaaccttcttggcactaatcaatatactctaaaaccagatattattgtcccatggcctaaaaattga

SEQ ID NO: 61292 - DNA, 1746 bp, Glycine max
  Peptide Sequence Number=SeqID_178070
atggaacttgcttctttctgctcattaagggccatatttcttttctcatgtgctctgtggataatgccagagttaacactagcaaagcatgcaaaaatcaccaggcactacaactttaatgtccaattacaaaatgtcacaagactatgtcaaacaaagagcattgtgacaattaatggtcgatttccagggcctagagtcatagcaagagaaggtgacaggctagtgattaaagtgaccaacaatgttccctacaacgttaccatccattggcacggtgttcgccaattacggagtgcttgggcagatggacctgcctatgtgacacagtgtccaattcaaacaggccaaacttttgtgtacaacttcacagtcactggccaaagaggaacattgtggtggcatgcccacatctcatggctaagaacaactctttatggtcctattgtcattcttcccaaaaaacatgtgccttacccattcccccaaacctttaaggaagtccctatcatatttggtgaatggtggaaagcagacacagaaactgttattaaccaagcaatgcaaacaggattggcacctaatctctcaaatgcttacaccatcaatggttttccaggttttctctacaatggcaccacaaaagataccttcaaactcaaggtcaaggctgggaaaacttatctcctgcgtctgataaacgctgcactcaacaacgagctcttcttcggcattgcaaaccacacactcactgtggttgaagctgatgcagtatatgtaaagcccttcagaacaaactatgtactaataacaccaggacaaactattaatgttcttctcaagacaaagtctaaggctccaaatgcagcctttgtcatagctgctaggccttatgctacaggtcctgcagcttttgacaacaccacagccactggcttgctggagtacaaaaaatcttcagtttcaaacacaaaaactaagaacaagaagcttcgtcttcttagacctgtgcttcctaaattcaatgacaccatcttcgcaatgaaattcaacaagaaggtccgaagcttggccaatgcaagattcccggcaaaagttccaaaaactgtagacaaacacttcttcttcactgttggattaggcattagctcctgccccaaaaaccaagcatgccaaggacccaataacaccagggtgactgcagccgttaataatgtgtcctttgttatgccaaacattgccttactccaagcccattttttcaacaaatccaaaggtgtgtacaccactgatttccctgctaatccacccttcagattcaactatactgggactccaccaaacaatatcatgataagcagtggaactaaggcagtggtgttgccatttaatgcaagtgtggagttgatcctgcaggacaccagcattattggtgctgagagccatccacttcaccttcatggctttaacttctttgttgttggtcaaggcaatggaaactttgaccccaagaaggacccatctaagtttaatctggttgacccggctgagaggaacaccattggtgtgccatcaggaggatgggttgccgtgcgcttctttgcagacaatccaggtgtttggttcatgcactgccatcttgaagtgcatacgagttggggattgaaaatggcatggatcgtccaagatggaaagctgcaccatcagaagcttccacctccaccctctgaccttcccaaatgttaa

SEQ ID NO: 61293 - DNA, 207 bp, Glycine max
  Peptide Sequence Number=SeqID_178071
atggctcgctctttctctaatggcaaggttctctctgctcttgtcgccgacgaattctcaaacactctcacctattttgagaccaaggcatgtatgcatgattgggtgtgtgagaccaaggctggtgatacagaaagggcggtgaaagaaaagtctataggttgtcaagtattatggattaaagattgcccagaggcagtcacttaa

SEQ ID NO: 61294 - DNA, 2811 bp, Glycine max
  Peptide Sequence Number=SeqID_178072
atggggtggcaggaattgtgcttgctttttgttaaaggaggaaccgataccatgtctgaagcatattcgtctcttatatttaagctgttaggagaaggccaagttatgataattgctcgtttctgtccagatctttttagtggcactgaggtggagttggtgaatttactgaaggataataatgatatgattaaagagggtgttttaaatgttttggcaaaggctggtggtactattcgtgaacagctggcagttacatcaagttctgtagaccttatgttggagagactatgtttagaaggcagtcggagacaggctaagtatgctgtgcatgctctggctgcaataacaaaggatgatggcctcaagtccctttctgttctgtacaagagacttgtagatatgctggaggaaaaaacacatctacctgctgtattgcagtctctggggtgtatagcacagactgcaatgcctgtatttgaaactagagagagtgaaattgaagaatttataataaacaagattctgaaaagtgatagtaaagaagaccactcaataatatcttgggatgataaaagcgatctttgtgttttgaagatatatggcatcaaaaccatagtgaaaagctacttgccaatcaaagatgctcatgttcgtcctggtatagatggtcttttggatatcctgagaaacatgctgtcttatggtgaaatatcaaaggacttacagtcaagctcagttgataaggcccatttgaggcttgcttctgcaaaggcagttcttcgtttgtcaaggctttgggatcacaagatacctgttgatattttccacttaactttaagagcaacggagattagcttccctcaagctaggaaggttttcttaagcaaagttcataaatatataaaagacaacctgttagatgccaaatatgcatgtgcccttatatttaacatatctggaaccaaggattccaagccagaggagtttgcagaggacaagcaaaacctggatgacattattcatatgcattaccaagcaagggcttggctgctttctggacaatcagatgcaaatttgttgaccacttaccctgaaaacatccttccatacctagttcatgcccttgctaacatatcctgccccaatattgacgagtgcaaggatgttgaagcatatgaaaatatatacaggcaattacacttgatactgtcaatgctaatgcaaagagttgaagatggcaagtcaaaagtagctcttaacaaagagaacgaaattatatctaccatcacttctatcttttggagtattaagcaatctgaagatgtggttgattcatcaaaatcgaagaattcgcatgccatatgtgaccttgggttagcaatcactaagcgactagtgcagaaggatgttgatttgcaaggattgtctcctttagtttctctacctccaatgctatacaaagcatgtgagaaggaaagtgaccccatggtaagtggagtgaaatcctggttggctgatggaagtgtcttggctcactttatatcacttgagttagaaatggttccatcccaattagctaaggatgactctttaaaggacagtgaaaaagacaaaaatgaaatgcccctggggaaaataataaaggacataaaatctcagggaaccaagggcaaaaaggtgaaaaagaaaaaggctgtgccagctgaaacaaaaaaggccgaaaatgatatcgatatcttgaatatggtcagagaaattaatttagataacttgggatcatccactaattttgaagcaagtaatggtcatgaaaattccttgagtaagaagttgcagaaggatccagagtgtgcaacaattaaaaaacgaaaagcagaagtgaccctggttccagtgcctaaacggaagcggtcttcctttgcccatggaaaatcaaggtcaaatagtactccaccaaagggtcctccaagagtttcaggggaagactcttctgaagtgaagtttccgttgggtgcaaaattcaaccctgatacacatagcaaacaaaggaaaaaggttaaagacaatgaggcctcaatagaagcaaaagttaaggcctccaagagctatcatgacaatgactctgacaaatctgaagagcatggcatgaagagtcctgataatacaaagccaactgacaagtccaaaaataacaatctcaagtcatccataggatctgctaaaaagctgaaaagaaaaagtattggaggattggctaagtgtacaacaaaggaagaagaaagtgatgctgaagatctaattggctgcagaattaaagtttggtggcctttggataagaaattttatgaaggcactgttaagtcttatgactctttaaagaggaaacatgtgatattatataaggatggggatgtagaagttctcaatttggaaaaggagcaatggaagcttattgccagcaaacctactaagaagctaaagctctcaaaaactgtctcttcccctgaagtgtctactgggaagaagcagagaagttctagtggttcagcaagtagaaagacaaaaaaaatagataatggtaagaaatctcctagcaagcatgtaaaacatggacgaaaaggtgcctcaaaaattaattcccatcatgaggatgccaaagagagttctgagttatcaaaccctgaagatatatctaaagctgagattaactcaggtaatgagagtaatttctgtgcatcaatctttggtacatctatcgcagacatgcttgctgttgaccaataccagtctgttagtataatttcataa

SEQ ID NO: 61295 - DNA, 386 bp, Glycine max
  Peptide Sequence Number=SeqID_178073
ggtacatcctttgtggtacaagtagagggtacatctacttgggttattgtaactgagaacaagagagggtacatctcttgtggatcagttcaagtggagggtacatccacttggttgttcaaagagaacaagggaggagctgtgagtgagagcgagaatgaaagcgcgagagtgatagtaagagtgagagcgagaaagacagtcacagagagagaatgtggtggtggcacggtgggcacgtcgcaatacaaggagttgagtcaaagtgagaaagtgagaacacggtggtggcacagtgggcatgtcgcgccaggaggagttgagttaggtgagagtcgcgaggaggaggaggaggagaatatgagcactgaaatgatacaaaaagg

SEQ ID NO: 61296 - DNA, 1227 bp, Glycine max
  Peptide Sequence Number=SeqID_178074
atgcctgacgtcgaaccgaggacggtagtggatgtattttacaaatttaaggaccaaactggaaacttcaatgaaaggctagccaatgatatacaaggaatgatgagcttgtatgaagcatctcaactaagatttcatggagaagagatacttgaagaggcacataatttcactcacattcaattatctaagtctttaaccacccaattaagcccttatctcgaggcacaagtgcaacacatcctagtacaatcatttcacaagggaatgcctaggttggaggcaacatataatatctctttctaccaagaagatccttcccatgataaatatttgctatcttttgcaaaagtagacttcgatattctgcaaaaactacataaaaaagaagtcagcagtgtgaccaagtggtggattaaggatttaaatgtgtcaacaaagttgccttttgtacgggataggattgttgaaggtagcttttggattttgggagtctattttgagccgcaacattctcttgctagaaggataatgctaaaaatagttggcatattgaccatcattgatgacatgtatgatgcttatggaacaatcgatgaacttgagctttttacaaatgcaattgagaggtgggatatttgttgtttggatgatctccctgaatacatgaaaatatgttatacaacacttttggattgttttgaagagatagaggaagagatgatgaaaagactagttcaagctcagatgactcaagcaagatggtttcattgcaactacacgccaatagtagatgagtacatgcaagttacaactatatcaagttgttaccctatgctgataatcatatcttacattggcatgagagacacaacagaggagatcctcatatgggcaacaagtgacccaatcattgttatagctgcttcaacaatttgtaggatcatggatgacattgttggaaatgaggttgagcaagaaagaggacatgttgcctcaagccttgaatgctatataaagcaacacaatacctcaaggaaagatgccattgatcaactacgcaagatggttgacaatgcttggaaggacatcaatgaggcatgccttaatcctactcaagtaccaatgacttttcttaagcctattgtcaaccttgcacgcgtgatagacgtgctttacaaagacgaagataactatacaaatgcaggagggaaggttccaagttaa

SEQ ID NO: 61297 - DNA, 204 bp, Glycine max
  Peptide Sequence Number=SeqID_178075
atgccgatctccccctgtggaagtaccagttgggatcgtgcccacaagacacccagtggactcagaggagcccaacagggccctgggatttccagctctagttacgggtctctgtcagtcctacagggtgcccgccccccagcaaggtcatgccattgtgatttgatcaccttcgtttctcaagtcatagtaggacacacctag

SEQ ID NO: 61298 - DNA, 309 bp, Glycine max
  Peptide Sequence Number=SeqID_178076
atggctacaccatccacacccagctcccatcctcctccttctgagttagcaacaccttcgtcatctacatcgaacaagacaagaaaaacaacacggctaagatcattggctaacaaactagttggggcgaagaaaccagtgattcatgtggatcctgtcactgggaaagtcgatggtccccacagaaagaaattaagaacgtatttagggatcgtcgctcgagacaaggatgttcaaaagaaggcacaggccatccagaaacaaaacattgcccctcacgtgttgtttcgtggaggttatgatttttag

SEQ ID NO: 61299 - DNA, 768 bp, Glycine max
  Peptide Sequence Number=SeqID_178077
atgaatgtgttgaagctgaaggcggtgtcggaggagaaccctaacgagactgtgaaaagggaaacggtggatctcggaaacggaagcgacgtcgtttacattcagaggttaataccctccgatcaatcatggaaatggttccattatctcgacaaacacatcccatggaccagacccaccattcgcgtcttcggaaaatctttccttcagattgctctcttgtatatggctatgatagataaacggaaaggtccttatgatatcaatgtgatgttacgtagttctctgcagcctcgagacacatgttatgttgcaactccaggattgactgagttgacttacagcggatatcagccgcatgcatattcttgggatgattatccaccacttaaagacatgctggatgctgtccataaagctctccctgggagtagttttaatagcttactcttaaataggtacaatggtggtaatgactatgttggttggcattctgatgatgagaagctttatggaccaacgcctgaaattgcgtctctaacttttggatgtgaccgcgactttgttttgaagaagaagccatatggaagtgatgaacctgccagcaagagattgaagaagggtagccatgatgctgatcagcatacatttagacttaggcatggatcccttttggtgatgagaggctatacccaaagagattggattcactctgtgcctaagcgtgcaaaagctgaagctacacgcattaaccttacctttaggagg

SEQ ID NO: 61300 - DNA, 236 bp, Glycine max
  Peptide Sequence Number=SeqID_178078
atggctcgcacgaaaaaatcttgtcaaatgacgtttgaggcaacaaaggaaattgcagatggatctgatgtcacgatcaaacaatactttggaccgacttcaaggagctcttgcacgtctacatccatggctcccgaagacatgcaatcacaaggactcactcttcctcctgagcttgaggctagtccttctactcctcatgtcagcacaaagggaagttgtatcgatccctcggg

SEQ ID NO: 61301 - DNA, 120 bp, Glycine max
  Peptide Sequence Number=SeqID_178079
atggaatccgaagaaaaagaggaatggcgcgaaaagagcatcgatgtggttttggtgtactcagcattcagcaatgacctaattcgcacatctcttcaatatctctgccctcgggactag

SEQ ID NO: 61302 - DNA, 228 bp, Glycine max
  Peptide Sequence Number=SeqID_178080
atgcaggattcacaaagagatgtctacctaagagcctacttgaatgatgctttgaagggattcaacgatagtcaaggaagtaaatttaaggctactgttagatggattgtagttaaagtaacacaaagcaaaggtgacattgcggaattcttgacaaccattgaagttccatgcagtagaaaaccttttgcagacttgaacttccagaaccttaacaaaggtctctag

SEQ ID NO: 61303 - DNA, 318 bp, Glycine max
  Peptide Sequence Number=SeqID_178081
atgattgggagtattgtggctcgtggacaatctgtcaaagcgtcacttggtgcatggggttatttggagttcactgtttggtattatgatcagctgaatgttggggtagtgctcagagataatacaggaatgtttatatggagtagctcgtgcaaaacacgggctgaaagagagaaaacaaattgtccagtggacaaagcaaaaaaaaaaaatggtggattcatactgtacagaatgctgatacattaccattctcctgcaagatccgagcacccgcttaatctttcattcaatgcagagacagaagataagtcatga

SEQ ID NO: 61304 - DNA, 734 bp, Glycine max
  Peptide Sequence Number=SeqID_178082
gaataaatcaaggagttacaagtcttccattgaagggttggcctctagcatctggaattgatcaactaaaacctaatttcggtgtacaagcttctaagcccaatttgacaacccagaaccaatttgttttggcatcacaacagcaacaagccttggcacaggctcaggcacaaaataaccttgggaattctaattatggtgacatggatcctcgtagactttctggtcttcctcgaggtagcttaagtgcaaaggatggtcagtctaccagaaatgaaggatctatttgctctcaaatgcagtcagattcacctaagatgaagatggctcagtcacaacaatcattatctcattctcaacagcaggagcaattacagcagcagagtaacagaaaaagaaaatctggagctgccaatagcactggtactggtaacactgctgctccgtcccctacttcatcaccatcaacacatacacctggtgatggattaaatacagcaagcagcttacagcatgttaacagtgtccaaaagagcatgatgatgtatggtacagagacaacaggaggccttgcatcatcgtcgaatttgctggacgacatggatcgatttggagatgttgatgctttagatgataatgtcgaatcctttctatcaaatgatggcgtagatggtggaaatctctatggaacagtgaaacaaagtccggctgagcaactgaaagatcttcaaaag

SEQ ID NO: 61305 - DNA, 882 bp, Glycine max
  Peptide Sequence Number=SeqID_178083
atggattggtctcaggcaatgtttacagccatgggagttggattctccaattcccttccatcagctgctgcccttaattgggtcttaaaagatggtcttggacgactaagcagatgcatatacactgctagcctagcatctgcttttgatacaaatttaaagtcagctgttcatcaaagttttgcaataggagacaaccttggtgaaatttctgctaaggcacagattcaaacagtgtgctttgacatccttggtcttatgcttgctgcacttgttaatctgtggatagagaaccatcgaagacaacaagcaggtctccattactttatttatcccttttttgctgctatggacctttttgggatttatcaaggactaaagactgtccatctgcaaaccttgactaaggataggcttgaaattattctgagcacttggattgagtgtggatatgtgccatcccctgcagaggtgagcgagaaagaaggaattaactttctgggagtgaaaggtaaaagcttgtggccaattagaatagggtgcctaaatcccaaggaccaagtacccaagtggtcaatgaagacaatacaatgtataacagatgaggattattactttgtgtgcgctgagatcttcgatggattaagaagaaccggaaaggctctactcttgaacagtactaggtgggagattattatagaggaaagccatgcatcagactcaacaatggaggattggtctgtaattgttgaggatgccaagagatctacagaaagggatatgtctaatttgattgaacaaatggtgggaaagggttggatggtgaagaacattctattgtcaacacaagagcagactcgatacagttttgtatgtgattaa

SEQ ID NO: 61306 - DNA, 405 bp, Glycine max
  Peptide Sequence Number=SeqID_178084
atgaagaagcttccatttgacatactccacatagttcccagtgactcctctcggaatgaagaagtcccacacaacagagccaaacgccctcagccacctatcatcaaaactcacgtcagaagccgcactgccgccgccgtcgacgctcacgacctgcaagcagtttccggtccagaagaatctcgagacactggcggggctcctcaccacgaatgggagccgaattggcttcgaagaagagcccttctcgacgcctccatcggagacgcagtcgagggaggttctgagcgaggaaaagaccgggaatcgccgaaaaatgaggttttgcttagtgggtgttggttgcttggggtttggaaggtatcctacgcctccaccgaaggcaatctgttcaagccggtatga

SEQ ID NO: 61307 - DNA, 363 bp, Glycine max
  Peptide Sequence Number=SeqID_178085
atgttggactcaatttatcagcccaaggtaacaggttttggcttgtccaagctacataatagaaatatcctcaacaattcaagcttttcaatgatcagaggaaccagaggttatatggcatctgagtgggtttacaatttaccaatcacctcaaatgttgatgtttacagctatggaattgttctattggagatgacaacaggaaagagccaaacaatggatgttgaaacagttgatggacagaaccgcacaatggaagataaagatgttaggcccaccatgaagcaagtgattgagatgtttcagagccatgaaagcgatgcacactcatggatatgctttatgttcgtccaagaaaggtga

SEQ ID NO: 61308 - DNA, 2259 bp, Glycine max
  Peptide Sequence Number=SeqID_178086
atggctttgtcaatcacactctttcttctagcatcgttattgtctttccaaatttcatcttcatcatcatcattgagaaagggatcttccctctcagtggaaaatccacaacacgttcttgtgtcaccaaatggcatgttcagtgctggcttccttgccattggtgagaacgcatattcatttgcaatatggttcactgagcctcatttccacagccccaacaccgtcacttggatggcaaaccgtgaccaacccgtgaatgggaagggctcgaaactttccctcacacacgccggcaacatagttttggttgatgctggttttaacactgcttggtcttcaaacaccgcttcattagccccagctgagttgcatctcaaagatgatggcaatcttgtgttacgtgagttgcaaggaaccattctgtggcaaagttttgatttcccaactgatactctcgttcctggccaacctcttaccagacacacgctacttgtgtctgcaagaagcgagagtaaccattcatctggtttctataagtttttcttcagcgatgataacattcttcgtcttgtctacgatggccctgatgtttccagcaattactggccgaatccctggcaaagaaggttgaaattggattctgatggtaatctccgagtttatggtcgaaaaagtgcagtagagaaatggtatgtttcatggaaagcaattcgaaatgattgtataattcatggggtttgtggacccaacagcacttgtggttatgatccaaagagtggaagaacatgcaagtgtcttccagggtacagattgaggaatcacagtgattggtcatatgggtgtgaacccatgtttgatctcacttgcaattggaacgagaccactttcttggagatgcgcggtgttgagttttatggctatgataattattatgtagaagttagtaactatagtgcttgtgagaatttgtgcctgcaaaattgcacttgtcagggatttcagcactcctatagcctaagagatggcctctattacaggtgctataccaaaacaaaattcctcaacggacagcgtttaccaagattcccaggaacaacatacttgagaattcctaaaagttatagtttatctgtcaaagaatctgctattgacagtgtagatgatcatcatgtttgttcagttcaacttcaaagagcttatatcaaaacacttgaaagccgtgttgtgagggttttgctgtggtttgctgccgcactcggagcttttgaaatggtttgcatttttgtggtttggtgcttcctcattaggacaggccaaaagtctaatgcagatcaacaaggctaccatcttgcagcaacaggattcagaaagtttagttactcagagctgaaaaaggctacaaaggggttcagtcaagagattggaagaggtgcaggaggggttgtgtacaaaggcattttatcagatcaaagacacgcagcaattaagagactcaatgaagctaaacaaggagaaggagaattccttgctgaagtgagcatcattggaaggctcaaccacatgaacttgattgaaatgtggggatattgtgctgagggaaagcataggttgttggtgtatgagtacatggagaatggctctttggcacaaaatctctcatccaacacacttgattggagtaagagatacaacattgttctgggaacggcaagggttctagcatatctgcatgaagaatgcttggagtggattttgcattgtgacataaagccacaaaacatactcctagattccaattatcagcccaggttggcagactttggtttgtctaagctcctcaacagaaataaccccaacaatccaagcatctcaatgatcagaggcacaagaggatatatggcacctgagtgggtttttaacctgcctatcacatccaaggtagatgtttatagctatggaattgttgttttggaaatggtaactgggaaaagcccaacaactagtatcgatgacattaatggtgaagagacatatgatggaaggttggtgacatgggtgagagaaaaaaggagcaacagcaacacatcttgggtggagcaaataatagatcctgttattggactaaattatgataaaagtaagattgaaattttgatcacagtggctttaaaatgtgtactggaagacagagattcaaggcccaacatgagccaagtagttgagatgcttcaatgtcacggaagtgattctcattga

SEQ ID NO: 61309 - DNA, 1034 bp, Glycine max
  Peptide Sequence Number=SeqID_178087
gagaggccatccttctcaaagataatgatgctgggaatgaagctagtgaatccttggttcttgaagaggttgatgttattcaagaaaggaacaatggttctgaattgcttccagcagataaggtggtaggggtatcggctgatcaagttaatgtgattgaaaatatcagtaatcaccttgatgagaaagggcggtggagtcggtgcagagtggccaaagttagtcttttgatctgcccattttggtttttagctcaactcacttttaacctgtcattgaagtatactacagtcacatcaaacacaatcttaagcagtgcatccagtctttttaccttcctggtatccctagcattcttgggcgagaggtttacttggttaaagcttttcagtgttcttctttgtatggcaggaacaataattgtaagtctaggtgattcgcaatctggtttagcaacagttgcatcgaatcctcttcttggagacatttttgcacttgcttccgcaggattatatgcagtttatataactcttattcgcaagaaattacctgatgatgatggaaaaagtggtgaagccagtacagctcagtttcttggatttcttgggcttttcaatgttttgatttttcttccagttgccctcatactgcattttaccaagaaggaatcttttagtacactaacctggaagcagcttggtctgataattggtaaaggattgctggataatgtgctgagtgattacttgtgggccaaggctgttcttctcacatctaccacagtagccacagctggtcttacaattcaggtcccattggctgccattgtggataccttgactggcaatgctccgcgctttatggattaccttggagcgatagctgtcatgattggcttcactggaatcaacattccttctgatacttttagcaaatccacagaaactactgtggcattggaaaatgagaacttgaatacaaggactgaagagcttactttgtctataagccaagattcagttgccatatcatag

SEQ ID NO: 61310 - DNA, 282 bp, Glycine max
  Peptide Sequence Number=SeqID_178088
atggatgatccaaatgatccgttaatctccatcaaagatgctttgaaggatgagaaaagaattaaataccacaatgactatttaattaacttacaagcttccattactgaagatggatgcaatgtacaaggctactttgtgtggtcactactggataattgggagtggcaatctggattcacttctagatttggtctatatttcattgattacaaagacaacttgaagagatatccaaaacattctgttgaatggtttaagaatttcttgaaatcaacttaa

SEQ ID NO: 61311 - DNA, 2247 bp, Glycine max
  Peptide Sequence Number=SeqID_178089
atggatttcccaacgtcactcttttttctactcttgcttctttctttccaatgttcatcttccctatcgtcactgaacaaggggtcttccctctcagtggagaaacacacacaagactctattgtctccccaaatcaaatgttctgtgctggcttctttcaagttggtgaaaacgccttctcctttgccatatggttcaacgaccctcacactcacaacaacaaccacaacaacagaaacgttgtttggattgcaaaccgcgaacaacccgttaatggaaagctctcaaagctttctctcttaaacagtggtagcatcgtcttgcttgacgcagatcaaatcaccacttggtcatcaaacacagcatcgaatgccccactagagttgaatctccaagatgatggtaatcttgtgttacgtgagctccaaggaaccattttgtggcaaagttttgattccccaaccgatactctccttccgggtcaacctcttactagatacacacaacttgtgtcttcaagaagcaagactaaccattcctctggtttctataagctgctctttgataatgacaaccttcttcgtcttatttacgatggccctgatgtttcgagctcgtattggcctcctcaatggctactcagttgggatgctggaaggtttagtttcaacagcagcagagttgcagttttcaattctcttggaattttcaattcatcggacaattatggtttttccacaaatgatcatggcaaggtgatgccaagaagattaacactagattctgacggaaatgttcgcgtgtacagcagaaatgaggcttcaaagaaatgcacttgcaattttgatcctaaaagaggaaggatatgctcgtgtctaccaggacacacagtaaagaaccatagtgattggtcttatgggtgtgaacccatgttcaatctttcttgcaacggaaatgattctacctttttggagttgcaaggttttgagttttacggctatgacagtaattatatacctaacagtacctacatgaattgtgtgaatttgtgtttgcaagattgtaactgcaaagggttccagtacagatatgatggggaatattctacttgctttacaaagagacagttgctgaatgggaggcgttccaccagatttgaaggaacgatttacttgagacttccaaagaacaataacttctctaaggaagaatctcttcacaaagagtatgttagaaagccagaaaatcgttttgtgagattttttctgtggcttgctactgcagttggagctttagaagtgacgcgccaaaagtctggtgcagatcaacaaggctaccatcaagcagaaatggggttcagaaaatatagttattctgaattgaaggaggcgacaaaagggttcaaccaagagatttcaaggggtgcagaagggattgtgtacaaaggcattttatcagatcaaagacatgtagcaattaagagactctatgaagccaaacaaggagaagaggaattccttgctgaagtgagcatcattggaaggctcaatcacatgaacttgattgaaatgtggggatattgtgctgagggaaagcatagattgttggtgtatgagtatatggagaatggttctttggcacaaaatctctcatccaacacacttgattggagtaagagatatagcattgctcttggaacggcacgagttttagcatatctgcatgaagaatgcttggagtggatactgcactgtgatataaagcctcaaaacatacttctcgatgctaattatcagcccaaggtagcagattttgggttgtccaagctactaaacagaaataacctcaacaacaatttaaggttttcagtgatcagaggaactcgaggatatatggcaccggagtgggtatacaactcaccaatcacctccaaagtagatgtttacagctatggaattgttctattggagatgataactgggaaaaacccaacaactggtgtccatagcaatgctggagaagaatcatataatggaaggctggtaacatgggttagagagaaaaggggtgatgcatcttggctagagcacatcattgatcctgcaattaaaacaaatttcgatgaatgtaagatggaccttttggctagagtggctttggattgtgttgaggtaaataaagatcggagacccaccatgagccaagtagtagaaatgcttcaaagccatgattgtttaaggtgttga

SEQ ID NO: 61312 - DNA, 2286 bp, Glycine max
  Peptide Sequence Number=SeqID_178090
gggtcctccctctcagtggagaaacacgcagaagacgttattgtctccccaaatcaaatgttctgtgctggcttctttcaagttggtgaaaatgccttctcctttgccatatggttcaacgaccctcacactcacaacaacaaccacaccgtggtttggatggcaaaccgtgaacaacccgttaatggaaggctgtcaaagctttccctcttaaacagtggtaacatggtcttggttgatgcaggtcaaatcaccaaatggtcatcaaacacagcatcacatgctccagtaaagttgcatctccaagatgatggcaatcttgtgttacttgatctccaaggaaccattttgtggcaaagttttgataccccaactgatactctccttcccggtcaattacttaccagacacacacaactagtgtcttcaagaagccagactaaccattctcctggtttctataagatgctatttgatgatgacaacgttcttcgtcttatttatgatggtcctgatgtctcaagcacatattggccaccaccatggctactcagttggcaagctggaaggtttaattacaacagcagcagagttgcagtgttaaattctattggaaatttcacttcatcggataattatgatttttccacggatgatcatggcacggtgatgccaagaagattaaaactggattcagatggaaacgctcgtgtgtacagtagaaatgaggctttaaagaaatggcatgtttcatggcaattcatatttgatacatgcaccattcatgggatttgtggtgctaacagcacttgcagttatgatcctaaaaggggacggagatgctcgtgtttaccaggatatagagtgaagaaccatagtgattggtcttacgggtgtgaacccatgtttgatcttgcttgcagcggaaatgagtctatctttttggagatacagggcgttgagttatatggttatgatcacaaatttgtccaaaacagtacatacataaactgtgtgaatttgtgtttgcaagattgtaactgcaaagggtttcagtacagatatgatggtaaccaaatatttagctgctatacaaagttacagttgtggaatggaaggcgttcaccaagttttaatggaacaattaacttgagacttcccaacagcaataacttctccaaggaagaatctgagagtgcagatgatcatgtttgttctgtgcagcttcacaaagactatgtcagaaaagcagcaaatcgttttgagagattttctctgtggcttgctactgcagttggagctttagaaatgatttgccttttgatgatttggggtttcttgattaggtcccagcaaaagtctagtgcaaataaactaggctaccatcttgcagcagtgggaatcagaaaatatagttattctgagttgaagaaggcaacagaggggttcagccaagaaattggaaggggtgcgggaggggttgtgtacaaaggcattttatcagatcaaagacatgctgcaattaagagactctatgatgctaaacaaggagaaggggaattccttgctgaggtgagcatcattggaaggcttaaccacatgaacttgattgaaatgtggggatattgtgctgagggaaatcataggttgctggtgtgtgagtacatgggaaatggttctttggaagaaaatctctcatctaacacacttgattggagtaagagatataacattgctctgggagtggcaagagttctagcatatctgcatgaagaatgcttggagtggattttgcactgtgatataaagccccaaaacatacttcttgatgctagttatcagcccaaggtagcagattttggcttgtccaagctactaaacagagataacctccacagcaattcaactgtttcaatgatcagaggaactcgaggatatatggcacctgagtgggtttacaatttaccaatcacctctaaagtggatgtttacagctacggaattgttctcttgcagatgataactggaaaaagcccaacaaccggtgtccaaagcattgatggagaagaatcacataatggaaggctggtaacttgggtgagagagaaaaggagtgccacatcttggctagagcaaataatggatccagcaatcaaaacaaattatgatgaacgcaagatggaccttttggccagagtggctctggattgtgttgaggaaaagaaagattcgagacccaccatgagccaagtagtcgaaatgcttcaaagccatgaaactaattaa

SEQ ID NO: 61313 - DNA, 342 bp, Glycine max
  Peptide Sequence Number=SeqID_178091
atgcagagaccaaggacgcgcgacaatgtactatgctaccttccttcgaccgaggtcacggtggtgcgacagagatgcaggcaaatgacagaggtcacgacgaggtcacaacagaaatttcagacaaacggggagggagttcgagcgcgagacggtgtttacaaatacaccgtcttagattacctgctccgtaacctactaagacggtcttcccaatcaacgtcgttgaatcagtcacgcgctgtgcacatggcacttaaaaatgtaacatatttacgaaaataccaccggttaccctactacgatgggtttggtacgaccgatgtaaaatgcgcgtcataa

SEQ ID NO: 61314 - DNA, 222 bp, Glycine max
  Peptide Sequence Number=SeqID_178092
atggatggaacattgctgaacagcaaaaatcaaatttcttctacaactgtcaatgctttgagagaggcgacatccaggggtgtgaaaattgtgatagctacaggaaaagctcatccagctgtgatagatatttttaaaatggtagatttaactagaaaagatggaattgtttcagaattttctcctggggttttcttacagccaggctgtccttatatgtaa

SEQ ID NO: 61315 - DNA, 711 bp, Glycine max
  Peptide Sequence Number=SeqID_178093
atgtgtatgagtatcaaccaccacttcgccgcaacctatgccttctccctccgccgtaattccccattttcggactccaccaccgctctcatcgatgccaccactagtcaccgcctctcttacagcgagctcatccaccgcaacgaaaatgagtccactcgtttcccctgtgactcaattcgatgtggcaacaattctatactcatcgagctccatggggatggtgaagggttcacgttcttctttagagcgatggtgccgtccgagaagttagcagccaaatccacaactttggaagccagatctgcaacgttgatctatggcttctctgggactgtgaatgttatggtggagttggtttggagtgaggttgggtgtgccttgttgattgtatgggacccgtacataaaaattgagctttacgtcgatattgaccaagttagcagctcgtcaacctcggttggtacaatgagttggataggttgttccacaacacctactaataacaatgtttttcttccacatgttggcattgatatataccaacaatgttccaatgttgagtttgtaaaaattttagtgatgattatgattgtaaagatgatgtttattctagccatgatgactccgatgatgacaatgaaggtcaaacataacaacagtttggggtttgtcatcacatttctccaacgtgaactgggcccattctaa

SEQ ID NO: 61316 - DNA, 261 bp, Glycine max
  Peptide Sequence Number=SeqID_178094
atggatcgagtttacatagcttctttggctactgccaacacatgtgttgcaacctacctacgatgggagggcaaggcgaaaagcaaaggtgtgtcttctaaaaaggagaatggatgggagtcgccaccaatgtttattcgaggaaaacattacaaaaaccaaaaagaaggtctgcaaattttgaagataagggtttgggagttgtttacgcatggggaagagagaatcgttaaggcgttggaccttgaaacgatcttttaa

SEQ ID NO: 61317 - DNA, 732 bp, Glycine max
  Peptide Sequence Number=SeqID_178095
atggcggtgctggacggcgcgattgccaacgtggcgctgccgaccattgcgcgtgagctgaacgccagcccggcggaatcgatctggatcgtcaacgcctatcaaatcgctatcgtgatttcgctgctgtcgctgtcgtttcttggcgatatgttcggctaccggcgcgtctatcaggtcgggctggtgctgtttgtattcacctcgctgttctgcgccctttcctcttcgctgaatatgctcaccgtggcgcgcgtgctgcagggcttcggcgcgctttctgggacgcggcatggccatcaactcgctgatcggggccggtctccagcgccgccggtcccacgggtggcggccgcgattctctctatcgccagctggaaatggctgttcctgatcaacgtgccgctcggtgtggtggcgctgtggctggcgctgcgcttcctgccggataacacgcagaaagcgaagcagcagaaaattttgatcgctgaccggcttcgcgcagggagaaaatggctggctgattgcgggtatgctgctggcgctgctgctgatcggcgtggtgtttgtgcggcgtcagctggcgatgccggtgccgctgctgccagtagatttgctgcgcattccggtgttttcgttgtcgatcggcacctcgatctgttcattctgtgcacaaatgctggcgatggtgtcgctgccgtttttcctgcaaaacgtactgggccgggatga

SEQ ID NO: 61318 - DNA, 571 bp, Glycine max
  Peptide Sequence Number=SeqID_178096
gccttctcctgagattgaaggcttagtggttgtcacaggattaagtcctttgatcacatgttcgttggacattggtgaacggggacttgtgtctacttttgcagagaggtggcataaggaaactagtagtttccagctgtcggtaggagaggatactatcaccctagatgatgtgacattgttgctacatttgaccattacaggtgcctttcataactttgaggctcttcatgtggacgatgtcgtcttcctgttagttgaattgcttggagttccgaagaggcaagagatgagacgatataataccacaacccaaaacccacattttttattgagtattgttttgttgtttttaaaatatgtacaatgttggatctacgagcattttcctttagttgcttatgctattgctgctggagattatgatgagaggaaaccacatgcttgtcattggaagtctaggaaagcatttccagtgtcgatgtatcttaagcgtctagatagattgatgtctgatgccatgtgttggattccctatggtgaccaccatgcattagagagtttcaactaa

SEQ ID NO: 61319 - DNA, 276 bp, Glycine max
  Peptide Sequence Number=SeqID_178097
atggtggttcttgaatttgcattaggaacaatccgagccaagcgtccatggcttggattgcatcacatgacacttttttcttttcttcgatggcatcaattttgtctttctttctatctcaacccttctttcgatgacttcagttcctatcttttgatgcaatcctaccctgcaagggcattggatagaagactccaagtagattgggctagagatgcaagagaaggccctagggttctcatgagccttagggtagatttcgggcccatgggctaa

SEQ ID NO: 61320 - DNA, 297 bp, Glycine max
  Peptide Sequence Number=SeqID_178098
atgggttgcaccaatctaaaggaattcgcgccacgtggcacaattagattcgacatcattgtgtggatttggtttgccgctgatcaattcttggccatgctccacgacagtgacttgcatttagtgcatggcggcgacgagggaggagagcgccttctaggcgcggtggacctggcaatcaccgaggggcgtttgtttgagggccacgacggtgatctcagcgaggcgttgaagattcttgatggcgtcgtggccaagggtaacgacattacaaacatcgagggacttgatgaggcg

SEQ ID NO: 61321 - DNA, 429 bp, Glycine max
  Peptide Sequence Number=SeqID_178099
atggcgaggacgtgtagtcctctaaaggtgaggacgtgtagtcctctgaaggtgagggcatgtagccctacaaaggtgaaggcacatgaccctttgacggcgagggcgtgtagtcctctgaagttgaaggtacatgaccctttgaaggcgaggacgtgtagtcctctgaaggtgaaggtgaggacgtgtagccctctcaaggcgaggacttatagtcctctggaggtgagggcgtgcagccctctgatggtgaggacgtgtagtcctctcaaggcgaggacgtgtagtcctctcaaggtgaggacgtgcagtcctctgaaggtgaggatgtgtagtcctctaaaggtgagggcatgtagccctacgaaggtgaggacatgtagtcctctgaaggtgagggtacctagtacccaaggcgagggcgggtag

SEQ ID NO: 61322 - DNA, 276 bp, Glycine max
  Peptide Sequence Number=SeqID_178100
atgctgaaggatggcgatcatgaggtgcggactagcagaaatgtggtcgtggatttccatttggatgtggtggcagattcattgactaaatgtcagctatcagaagatagtgatcaaccaaaacagaagttggaggcttcaaagaatcaggatgaagataaggaagggacagcagaagaggagggcaagaagaataatacagctgatccaaaagggggagagttgtccatgggagcaaaaccaaaggttatatcctcaccagacctgctaggatag

SEQ ID NO: 61323 - DNA, 1314 bp, Glycine max
  Peptide Sequence Number=SeqID_178101
atgagttgcttttcatgttttacgtccaatgaaaagaaagtagcaaagaagcctaacaatgggcagaggatacaacagcctgctattaattctcccaaggaatcagcccaaccagttcagccacggccagataataattttaacaaggcaaaggccaccccacaaacagaacctaaaataaacaaggaggccaacaaagataatgggaacaacaacaacaacattgctgcccaaacattcaccttcagggaattggcttctatcacaaagaacttcagacaggaatgcctaattggtgaaggtggttttgggagggtttataaaggaagacttgaaaaaaccaaccaggaagtagctgtgaagcaacttgacaggaatggattacaagggaatagagagtttcttgttgaagttttaatgttgagtctcttgcaccatcaaaatctagtgaatctaattggatattgtgctgatggagatcagagattattggtgtatgagtacatgccattgggatctcttgaggaccatctgcttgatgttcatccacaacaaaagcatctagattggttcatcagaatgaaaatagctttggatgctgcaaaaggtctagagtatttgcatgacaaggcgaatcctccggtcatctaccgcgacttaaaatcctccaacatcttgctagacaaagagttcaatgcaaaactctctgattttggactagcaaagttgggaccaacaggggacaagtctcatgtctcttcaagagtaatgggtacttatggatactgtgcacctgagtatcaaagaactggtcagctaactgtaaaatcagatgtgtacagctttggtgttgttttgcttgaattgatcactggaaggagagccattgataacacaagaccaacaagggagcaaaatctagttacttgggcatatccagtattcaaggaccctcacagatactcagagttagcagacccccttctgcaagcaaacttcccaatgagatcactgcatcaagcagtggcagtagcagccatgtgcctcaatgaggagccatcagtgaggcccttgatcagtgatgttgtcactgctcttactttccttggaacagctccagggagccaagacctcacaggaattgcacctgttgacctgccctcaccaccacaagaagccattagtagtgcccctttcaatcttctcgacgacgatgtcgtcatggatcgccaaagggctgttgctgaagccattgaatggggtacaaacagtaggaacaaagcaccactacgtgacagttctacctctttgtaa

SEQ ID NO: 61324 - DNA, 702 bp, Glycine max
  Peptide Sequence Number=SeqID_178102
atggaagaccatcgatatttgggtccaaatccatggaatgtagattttttggttcgtcttttggaattgagaaggcaaacatgtcacgtcaacaacgtggatcctaataagtatggcttttatgatggcatctacaattttgcagttgaattgggtttgcttccttgtaatcctttcattatgtggtttcgatgtgctaatggtaattatcgtcctctagctaatgattctaatgttatgttaatgtatgttaagaatccaaatagtagttatattcatttgtatgcgactaaaaataaagatgagttttggcatgaacctcttttcattgaagttgtacctactgttattgaaccttttattgaacttgttaaccaacctgttaatgcttgtatgtatgaagctatgaatgacgttgtcaatgaagctgcaaatgctagtatgaatgaagctatgaatgaacatgggttgagtggaggttcttcacctgacattgatagtgaatatgttggtctggatgaagaattgagttatgcgaatgacatgagtgactttgaagaaaaacttgattgtattggagttgtgcattcagattctgacatggaggaaatttataaagagaaaggattaaggggaaacaatttgaattggataagaatgggaagacccaattttctattgggcagttgtttgttagtatag

SEQ ID NO: 61325 - DNA, 411 bp, Glycine max
  Peptide Sequence Number=SeqID_178103
atgaacaacactgataaagcaatcattcttgaaatagtagtgttcatagccaatgatgttaaagctggtgacatgaaggtccttgttgagaagacattggtcatgcaaacaacagtcatgtggaaagggtctttgatgaaaggaggagcattggattgggcatgtgcaataggtgcggtgttccatcatggagtggatgagccaagagaactagtgttgggtgacatcagagagcaagttaaagttgtgtacgaaggggcagtaaaagaaggtggaaggggcctatctgtgtgggatactttttcacattcatttggaaagatacaagatgggagtaatgctgacgttgcagtgaatcaatatcatcgttatgatgtaagatggatttcgatggtggctaaattaccatga

SEQ ID NO: 61326 - DNA, 147 bp, Glycine max
  Peptide Sequence Number=SeqID_178104
atggaagcaaagaagcagaaaatgcgaggaaatgtgagcacagtgcagatgaatgccaatgatgagaggagcgcgcttagcgagttctgcagctctaattggtctgcaactttcgctaagcgggacatgactggcttagcaaattaa

SEQ ID NO: 61327 - DNA, 246 bp, Glycine max
  Peptide Sequence Number=SeqID_178105
atggtgttgagaagaggcattgttgcaacagtagtggttgtgaatgtgatttttcagattcaaatatgcctatcagagatcaacaggcaaagctttcccaaaggttttgttttcggcactgctgcttcagcttttcagaatgacgatgtcgattttgctgttggtgttggcaaaggtgtggatgatggtgaccgagtggtaattcttgactcatcggttaaggagatgatgagaaaaagtcgttga

SEQ ID NO: 61328 - DNA, 148 bp, Glycine max
  Peptide Sequence Number=SeqID_178106
aaaactcaagcaaaagcgaggggcaagcgctgaaaaggagagtgtgggcacaaggaagtttatagttttgcttttggaaattagaattgggaaaggaacacggaaatggaagaggccaaagaggcagagacatatatgtctcccatga

SEQ ID NO: 61329 - DNA, 438 bp, Glycine max
  Peptide Sequence Number=SeqID_178107
atgggtgccaagacattgcccctcattggtgagcccaattcctcaaacacaagttccacttcgagcctcatggacaagggtatttccgaatcggacagtattgttacgggccaagttccacttccaatggctttctccttgactaacctaaatgctacatgtcaaggcaatctaatgctaaagccaccatctaatgccatcaagattatagaagacatgtgctcgaatccttacaacaattatggggataagaagatcatgaaaaggtatggatgtgtccatggtctaggagaattcacaatgggcgatgagtttgcccaaaccatggatgagattaactttgtaggaggaatagacaatggttatgagcggccaaaagaagagaaggttcaagtagttggtgtctcgctaagcgaggcatatgcgcttagcgagtga

SEQ ID NO: 61330 - DNA, 1278 bp, Glycine max
  Peptide Sequence Number=SeqID_178108
tgtatttgggaccacacatttgaaattcactcctcgtcttcaggaacttccattaaagtgcattggtttaggggctttggttgactttaatggtgcaaaagcctctgatttggttccagttgttggccagatgcttttgatgggcagtatatttctcacttatatggctggagtaattcctgttgagaaatcttatgctagttatcaaaagactatttctgataaaaatgtgtttcctgaaagctcagacatttctggtagttcagcgaagcaaaattctggttttgagtcaaagtatgtattgaatgtggtgagagaaaaacttttaaattctctaaatgctttagctaacaaggattattctggagacatcatcgttcaatctgcaaagagacccttgagtttaagtgctgttgccaggggtccaaagttaaggttgctttgggctgcttttcagcaagttgaggaagaggcaggagccctggccttgagtttaagtgctgttaccagaggtccaaagttaaggctgctttgggttgcttttcagcaagttaatagtttcagcatttccacagctgttggtatggatgatctgtttgaaacgttttatgaaattattcagagatcttgtcactctacctgtactgcatggctggaaaaagaatttttccttctaaagggcagtgctgacaaggaacttgcttctatgatacttgaaaaagtgaaaggagatatcactattgtacagagcattacaaggtctggcaagaaagatctgtatgcagaattactttcatatcttacttttggttctctcagggaggattgctattatgattcgcgtatatttgctgtgcatgggatttccattttagaagatttagtgattgctctagcagatggggttgcaagcgtatatctggagtttatttcagttgatagtgatgtgtcaagtaaaaccaatagtttggatatgtcattatgtgctttatccaccagagagctccaaaagttacgtaatgaggtggctttgaaccagtggttgtaccacaacatggacacagttgtgtcaatgtatgaggatcgctttgacctgtgtattcttgagagccaacctgttgatgtaacagacagtattcagaccgaagagcaaaattggtggaagaggcttacccagcaaaattcaaaagcaatgtcacctgaattacattgtattgacattagccatttctcaatgcctgtaaagcggaccaaggaattaagagctgtgacagggtg

SEQ ID NO: 61331 - DNA, 225 bp, Glycine max
  Peptide Sequence Number=SeqID_178109
atgaagcttcgtcaccacagtcgccacccctctgaagaaaacgggcctgctcttcccagctctcgtgcctgggtttacgtagatgaagagttggcgggcctgggccacgagggagaggtggcccgcgtggaggaagcccatggtggggaccagcccgatgagcttgccctgggcccgcatcgagcgatctctgccttgtgtgcattggatttagaaggcggctga

SEQ ID NO: 61332 - DNA, 261 bp, Glycine max
  Peptide Sequence Number=SeqID_178110
atggtggtagtgagggtgaacgagaggtgtttaggtcgcggtcgaggcggtggtcgtatatcggctaatttctcttcctgcaaacgtgctagccccgctgcttgcactaaagtgaggggttgtaaggcctggacttcacgtcgtatctccggcgacagccccgagataaagcagctgagaatgaagggaggagggagcccgataatacgattcgctaaatcctcaaattccgacaggtattggcctactgaacccttctga

SEQ ID NO: 61333 - DNA, 312 bp, Glycine max
  Peptide Sequence Number=SeqID_178111
atgcctgatcgtcatatgtataggaggaagttggattgtgtgccacatcagaatcctctctatacagtggttgtagtgcagattcagttaccggctgcacttatgtctcactctcaatggagaaagaatgtagtgggaagtttgcaaggcaatggcgtttatgtgaaggggaaacaggaacatgaaaggacacaaggaaagggttctggtggtagacagaggaaaaagtccaagtctagaaaatgcaagaaagagaagagtgttacaaacgcaaccaaaaggggcatttcaataggtattgcccagagttga

SEQ ID NO: 61334 - DNA, 510 bp, Glycine max
  Peptide Sequence Number=SeqID_178112
atgggtctacaatgccttcaaaaatcccggccaagaggtgaactgagcattgttggtcatccattggaaccacgcaagtgctcgtccctccatataaaacaaggcgattgtgagacgatcgcgttccggggtgccgtgatattcaaagttggggttggattggggttggctgagggtttggggaagaagagcttggggataggtggtggagcggaggagaatgtcctcaagggaacgtgggaaagtatcgtgagaatgagagtctggcatggtgaaaaggacaacaagagcaccaaaaatgttaggtgcaaagtatcaagagctagaattcgaggtctagcacctccagaaatgaggaaggagcagagcacgaaagaagaaggaagaagcttgatcacaattccaagcaaggcgatctgggaaggatttgcagaagcttctgttttggcagttttcttcaaacgaagtcgtgaagcaattcttctacagtgtaggattgagacactgtga

SEQ ID NO: 61335 - DNA, 252 bp, Glycine max
  Peptide Sequence Number=SeqID_178113
atggttttccagtcaaaggtgttcctcggtacagatgtggttagttatgtcatgaggatagccataggagttactaggagtggtatttctaatttgcaggtagagaatcctgctagtatgcgtgttagatggctcaatcggaaagctccccctgtgggttgggtaaaagccaacattgatggttcggtgagggataatggttgtcaagcttcttgtgctgaagtgttaaggaactcttataggctaaagtag

SEQ ID NO: 61336 - DNA, 593 bp, Glycine max
  Peptide Sequence Number=SeqID_178114
gactacacgtcctcgccatcagaggggctgcacgccctcaccttcagaggactacatgtcctcgccttgagagggctacacgccctcaccttggaggactacacgtcctcgccatcagagggctgcacgccctcccctttagaggacttcacgtcctcgccatcagagggctgcactccctcgccttgaggctgcatgccctcgccttgagagggctacatgtcctcaccttcagagggctgcacgccgtcaccttcagaggactacacgtcctcgccttgagagggctgcacgccctcaccttgggtactagttactcctcaccgttgagaggactgcacgccctcgccttgagaggactacatgtcctcaccatcagagggctgcaagccctcaccttcagaggactacatgtcctcgccttgagagggctacacgccctcaccttgggtactagttaccctcactgtcagagggctacacgccctcaccttgaaaggactacacgtcctcgccagcagagggctgcacgccctcacctccagaggactacacctcctcgccttgagagggctgcatgccctcacctttag

SEQ ID NO: 61337 - DNA, 366 bp, Glycine max
  Peptide Sequence Number=SeqID_178115
atgtggcaaggaatgctagtgaggatgcacgttctatgtgttatcgtgaatatggcagtgccccagatgttcgcatttacggggatcctgattttacttttccctcacttgcatcttatggtatttgagttggttaagaactcgctgcgtgctgtccaagagcgttttatggactctgacgaagttgctcctcccattagaataataatagcagatggaatagaggatgttaccataaaggtctcagatgagggaggtggaataccaaggagtggtcttccaagaatttttacatatctctacagtacagctggaatctcattgtcagtcgaacatgaactttctgatattggaacaatggaaaat

SEQ ID NO: 61338 - DNA, 210 bp, Glycine max
  Peptide Sequence Number=SeqID_178116
atggctggaggtacgcttttgggggaacaactatggttgattcaagataatatgtggtcgaaaaccgcgattccgagggcgcgccattcgttatcgtgcccctccacgacgttcgttagcaccgcgctgagcgcaatcgtggtttcctccaaaacggcgtcgtcgttggggacaccgcgctgctttgcgatcatttttgccatggcgccg

SEQ ID NO: 61339 - DNA, 165 bp, Glycine max
  Peptide Sequence Number=SeqID_178117
atggcggaagctttaagagcctgggcaattgcccagggtagccgggccttgaaaccgcctatgtctggggcaattatggttgaagctcaagtttatgtcattagtgggactattgctaattggtatttctccaaggaacatcaaactcttagagtgttagagtga

SEQ ID NO: 61340 - DNA, 231 bp, Glycine max
  Peptide Sequence Number=SeqID_178118
aggaggccgacgagacgagaggaggaggaggaggtgggagaggaggaggcggagggcggtacggaggtcggaggagtgagcggaggtggtgctcggcggacgagcggtggagaggtgaaagtgcggcggagcatggaggggagcaatagaagagtgaattgggattgggaatgggaagggaagagaagcaagcagagcagtgagtgtggagagaaaaagagagaggagtga

SEQ ID NO: 61341 - DNA, 237 bp, Glycine max
  Peptide Sequence Number=SeqID_178119
atgaacattgcaatcacaaccaccatgatcattatcgtcatcgttgttgttaccattgtcgccttcatcgcacaaccatcgctaccaccgtcattgttttcgccaccaccaccacccaacgacaagggtggcaacaatgacaatcatggtggtgatgattgcagtgttcgtggcattgatggcaaagatgattatggtggcaacgagttcatggtggtgggtaaacaacaattttaa

SEQ ID NO: 61342 - DNA, 123 bp, Glycine max
  Peptide Sequence Number=SeqID_178120
atgtcatcagctgcaactatgcacaagagttgtgccgaaataggtttggacttcaaatcccatactgttactattgcgttccaactgttgtcattttctccagttgatgttgacgtagaatga

SEQ ID NO: 61343 - DNA, 1074 bp, Glycine max
  Peptide Sequence Number=SeqID_178121
atggctggtgttaagagaagattatgtagtgattcagatatccatgctcttcacaaagaattggatgaagtttcatgtcctatctgcatggaccatccacataatgctgttctcctcctttgcagctctcatgagaagggctgcagatcttacatttgtgatacaataaacacaaacaattctggtaatagttttgatattaaccttactgtgcaatctgacatgcatgatgttaatgaactccatcaaaatgaaattaatgctctattgtctgttggacttgcacaaggatcaagacagggtgatgcccaagatccaaataggcttttagaccaacatgatgaaggaattttagaaactgctgattctgagaacttgcaggacagggctgtgattgaggatttaaatgcagataattcgtctgagtcaaaattgaacttgaaatgccctttatgtagaggtgcagtattgaactggaaggtggttgaagaggctagaaattatctgaacatgaagaagagaagttgctcaagggactcgtgctcattcgttggtgattatctggaattgcgtaggcacgcaaggagagttcatcccacttctcgtccctctaacattgatcctacaagagaaagagcttggcgacattttgaggaccaaagagaatatggtgatattgtgagtgctattcagtctgccgtgcctggagctgtgctagttggggactatgttcttgagaatggagacggtattggtaggttaccagacgaacgtgctgaaggcaacattggcaacgccaatggaccatggttaaccaccactatcttgtttcagatgatggatagcaccgttgaaattgttagggaaccaagagcacattcgagtgcctggacaaggcaccgtcgttcagatgaacgtcggcgctatctgtggggtgagaatttattgggtcttcatgataatgacattgaggatgatctgcgtatatttagggatgcgggtgaagatgcatctcctgtgccaaggaggcgtcggcgtttgacccggacaaggtccaatgaagatcaaccttga

SEQ ID NO: 61344 - DNA, 432 bp, Glycine max
  Peptide Sequence Number=SeqID_178122
atggataggtaccagaaagtggagaagcctaagcccgagtctcccatcaatgagaacgagatccgaatcacgacgcagggcgctattcgcaactacatcacctacgccagttcgcttcttcaggtcctctttttgttccgttaccgatggttctggagaatgagaatcccttgcgttttctgcggattgggggttttcttatggtggcattttcgggaattgggatttgggttttgtttaatttgtttgtttgctgaatgctggtttaaggggctttcgattgacgggcaagctgctggtcatctcatccattctcaagagctcaagcctgtcgattccctgcattttctgggttttgcaacctacggattactaacagcccctgctattgctactgaaagtcaaccaataactctctacacagtccactga

SEQ ID NO: 61345 - DNA, 366 bp, Glycine max
  Peptide Sequence Number=SeqID_178123
atgaggcaccttccgatgaccaccaagaatgccaccacaagcggtcctaacgcaacgagatgcaatcgccacccacgacggagcatcaccttcttcgtcgccatctccgccgcgaatacggataaccatgagattccacctatgaccccaaaagtcttgaagggatgtggaaagtgttgtttggggttgatggggagggaagctatgggaatgaaatggagaatgtttgggggtgatagggtaagagggccatggttgaaggagaaaagaatgagtttgaaagtgtcaagccaaacgaggaagaaggtggtggggccacctaggtggaaggaagagaggttgaagggaagggtgaggaagaggtag

SEQ ID NO: 61346 - DNA, 1167 bp, Glycine max
  Peptide Sequence Number=SeqID_178124
atgatgacagatatcacaaacctaagcacagacctcatagagctgatcctgtccctcctcccaatcccaaccttaatcagagcctcaacagtttgcaagctatggcactccataatctcctcctcttccttctcaaccctctccaaccacctcaagcagccatggttcttcctccatggcatccacaacatctcctcaaagaacaaccaatcctttgcctttgacccttcctccaacacctggttcctcctcccaaccccccaacaccaccaccaatcccaataccaatccaacacctccttcattggcaccagctccttcttcttcatcactgcccccaacttcctctacaccccaattctccacccttcatggcaccccacccctcccctccacttccctagaatcaaccctctattgggtgtcttccatgatgctaaagatcaaaactttggccaccacccaaaattcattgttgttggtggggtcaagttcattgggaaccttgttgacatagaggatcgtttggatgttgaaatctatgaccctcttgtggggtcttgggagcttggccctcctctccctcctgatttcagatcaggaaactcctcctcttccctctccagtgctctcttcagagggaaattctatgtctttgggatatactcttgctttgtttcctcctttgacctgcataaaagggtctggagtgacgttcacacccttaggcctcgtcatgaggttgtgttctccttcttggtggcttgtagggagatgcttgtgcttgctggggtgtgcaatttccctcatgggtcttcctcctttgtgctgtggaaggttgatgagaggaccatgtggttcacccagattgatgtgatgccacatgacttgctctgtagcctttttgacggggatgaggatgataaatttgcaagcttgaagtgtgtggggttgggggatttgatttatgttttcaatgaggattaccacaggatgtaccctgcttgtgtgtgtgagattgatggggagagtgggaggtgtgtgtggaggagagtgccccaattgccatcactgatgagcaggtttcacaaagttgttagcttctgttcaactgtttcactgtatagtattctcggtgaacgtcaactccctggtcttcagtactag

SEQ ID NO: 61347 - DNA, 663 bp, Glycine max
  Peptide Sequence Number=SeqID_178125
atgagggaaattgcacaccccagcaagcacaagcatctccctacaagccaccaagaaggagaacacaacctcatgacgaggcctaagggtgtgaacgtcactccagacccttttatgcagagagcactggagagggaagaggaggagtttcctgatctgaaatcaggagggagaggagggccaagctcccaagaccccacaagaggggtggagaattggggtgtagaggaagttgggggcagtgatgaagaagaaggagctggtgccaatgaaggaggtgttggattggtgttggaggaagggtcaaaggcaaaggattggttgttctttgaggagatgttgtggatgccatggaggaagaaccatggctgcttgaggtggttggagagggttgagaaggaagaggaggagattatggagtgccatagcttgcaaactgttgaggctctgattaaggttgggattgggaggagggacaggatcagctctatgagtatgtttgttgctgacaagaatccgaagagaaagctcttgggcgttgcggcctttgagctcttctccagcagaagattcgaaaccaccaacataatcaacactcctctgggttggggtaatgagaaggttttcgggtctaagaaggaagtttacgggtctgatgggtga

SEQ ID NO: 61348 - DNA, 156 bp, Glycine max
  Peptide Sequence Number=SeqID_178126
atggagagaaacggcatgcgtacctttcgcgatgatgaacgcagtgttgtgggagcgggagaaaagaagagaagaaaagagggagggaagagaaggggtgcctacggtaaaatgctgcactttcccgaagattctgacacggagttgaagggttaa

SEQ ID NO: 61349 - DNA, 2094 bp, Glycine max
  Peptide Sequence Number=SeqID_178127
atggcatcttcagatgatgagggagaggctcaaccactatctgtgtcgaattaccattttgaagacaacaaagatgcgcctgtgtgtttttccgtgttgccaattcagtggagtgagtctcagagtccagttggcaagaaaatgcaggtgttcttgcacggttttgtggataatgggctgcagaaatttttcgtgcaagttgttgcatggaggtttgatctttcctatgtgaggccagagatattggtgctatcaaaggatggaagatggattaaactcgagaagcctcgtaagagctacgaggataccataataaggactattttgatcaccattcacttcctgagttatgtgaagaagaatcctgactcgtctgccaagtctgtgtgggataacttgagtaagaataaggagtttagatcttatgaggttatgccttcgcaaaatgatttattaaatcatatgactttaatgggtgaagctgccaaaagagacactgccttagcaaagtccaagcgctatttcatagcgaaatttctcagatccgcgattgtgattctgtccactattccggctgctatcaatgttgtggttgtgcttttgctcatggttctggaagataaggataagctgaagattaaaaaaccttctgacaaggaagttaaagatttagcacgacctggatttataattgatgatattgacaatgatatgattgatgaatttggtgaagattctgatggagaggatgagttgtttgattctgtttgtgcaatttgtgacaatggtggtcaacttttgtggtcatttcatgctaatgaggaggatggtgaagaatctacttgtgcctctcttggttttagccggaaggaagttgatgagatccagaacttttactgtaagaattgtgaatataatcaacatcagtgctttgcatgtggcacactaggctgttctgataaattttctggtgctgaggtcttcaaatgcgcttccgcaacctgtggtttcttttatcatccacattgtgttgcaaagttacttcatgggatagttgaggatgctccaaaggagcttgaggaaaaaattgctgaggggggaccctttacttgtcctactcattattgctgtgaatgtaaagaaatggaagacaagaagaaacatgattttcaatttgctgtttgtaggcgttgccccaggtcgtatcatcgcaaatgtttgccaagagagattgcttttgatgacatagaggatgaagatattataacaagggcttgggaagatcttttaccaaacaatcgcattcttatatattgtttagaacatgagatcgatgatgaacttgggactcctataagagatcatataaagttccccaatgttaaagctactgttcgagaaattgatgcagaggagaatgcaaagtctgcgaccaaagagagagttatattgaacaagaacaatattgactcaaaaaatttatttggcaaaaaagctactgctaaagtttctaaacttcctggtaaaatgtcttctgggaaagttggagacaagaagtctgaaaagatttctagatcaaatatttcaaggaagaaaataaacgaagcatcaagatgttttaatgaaaataagaggtcaacaatctcaaaggaaaccaaaaagtctgacggtgcagaaaacaggccatcattgggtgcaaaattatttgctttaaagcagaacagttctgagcatattaattctggtaatgaggctgatgatgtagccaaaaataccctggttgttaagcctactaaaaagctgagtagcacattgcccgcattagatgcagattcaaagaggagattgttggctttgtttaaagaagctacttcatcggttactttggagaatgttataaaagagcacaaatttgctgctactcatactcactcgttgaaaagtgttgtggagaagaccattacattggggaaattggaaggctcagttgaggctgttcgaacagctctaaggatgctagaggacgggcacaatattcgggatgcagaagctgtttgtggccctgatgttctaaaccagatatttaagtggaag

SEQ ID NO: 61350 - DNA, 621 bp, Glycine max
  Peptide Sequence Number=SeqID_178128
atggaagatgacgtaaaggtagccaaagttggagaaagccaaagagaagattcatcaagagtttttccatgtctattctgttcaaggaagttttacagttctcaagctttaggaggacaccaaaatgctcacaagaaagaaagaacagctgcaaggaaggccaagaaggcttctgagcactcatgtgtttccttcccttccccactgccaacccctatggtttttgctccaacccatctaggcattttaaatcctgcaatgttcatcactgcccatgcagcaagactccctcatctgccaagtcatcaaatttcagaacaatttggatcaaatggtgcacctagatttggcaatgcactattttacaggggaagttcaaaaaacaggcttcatgatgatgggaagagctctaccttctgctggggggacacatctcaacatatgcaattgttaagtaacaatcaaaatcttggaatttggaataatggtacatccatatatctaacaaatattcaggttgctttgagactaaaacagcaaactcacttcaatgacctgaaagcctcgcaaccaaaacatacctcttattctgtaacacaccttcagccgcccacaacataa

SEQ ID NO: 61351 - DNA, 3129 bp, Glycine max
  Peptide Sequence Number=SeqID_178129
atggaactcggaaggagacccacgttcaaaagaacagaacgagcgaaggcgaagtgtgaagagcgtcgaggcggcgcgagtcagtcaacgcaaccatgcatttatcatttcttttcatcttctttgcaacacaagatatcacatgaccctgacaacaagaacaacaagaacaacaacgttgtcgtcgatttcaaccttgtattccgttcttgcaccaacatcaatgtcgccaagcagcttcacgctcttcttctggtgttgggtaaagctcaagatgttgttttgcttacccagcttgttactctgtatgccactctcggggacctctccttgtctagcaccacatttaagcacattcagagaaagaacattttttcatggaactcgatggtgtctgcatatgttaggcgtgggagataccgtgattccatggattgtgtcactgagttgttgtccctgtctggtgtgagacctgacttttacactttccctcctgtgttgaaagcctgcctgagtctggctgatggggagaagatgcattgctgggttttgaagatgggttttgagcatgatgtgtacgtcgctgcttctttgatccatttgtattcgcggtttggtgctgttgaggttgcccacaaggtgtttgttgatatgccggttcgcgatgtggggtcttggaatgccatgatttccgggttttgtcagaacgggaatgtggcggaggcgttgcgtgttttggataggatgaagactgaggaggtgaagatggacactgttacggtgtctagcatgcttccgatttgcgcgcaatcaaatgatgttgttggtggggtgttggttcatttgtatgtgataaagcacgggttggaaagtgatgtgtttgttagcaatgctttgatcaatatgtattccaagtttggtaggctgcaggatgcacagagggtttttgatggcatggaagtgagggatttggtgtcttggaattctataattgctgcgtatgagcagaatgatgatccggttactgctcttggattctttaaagagatgctgtttgttggaatgcgacctgacctgttgacagttgtgagtttggcctcaatttttggtcagttaagtgatcggaggattggcagggctgttcatggatttgttgtgagatgtagatggcttgaggtagacattgtgattggtaatgcacttgttaacatgtatgccaaattgggttctatagattgtgcacgtgcagtttttgaacagcttcctagcagagatgttatttcatggaacactttgatcacaggttatgctcaaaatggtcttgcaagtgaagcaattgatgcttacaacatgatggaagagggtagaacgatagtccccaaccaagggacatgggtgagcattctcccagcatattcccatgttggagcattgcagcaaggaatgaaaattcatgggaggctaatcaagaattgtctcttcttggatgtctttgtggctacctgcctgattgacatgtatggaaaatgtggaaggttagaggatgcgatgtccttattctatgaaattccacaggaaacatcagttccttggaatgccataatatcttctctcgggattcatgggcatggagaaaaagctttgcaacttttcaaggatatgcgagctgatggggtgaaggcagatcatattacctttgtatcattgttgtcggcttgtagccattctggtttagttgatgaggctcaatggtgctttgatacaatgcagaaagagtacaggatcaagcctaatttgaagcattatggctgcatggtggatttgtttggcagagctgggtatttggagaaggcatataatttagtaagcaatatgcctatacaggcagatgcatcaatttggggcactcttcttgctgcttgtagaatacatggaaatgcagaattgggtacttttgcttctgatcgcttactggaagttgattcagagaatgttggctattatgttttgctgtcaaatatctatgctaatgttggaaaatgggaaggagcagttaaagtacgatcattggccagagataggggattgaggaagactcctggatggagctctgttgtagtaggtagtgtagttgaagtcttttatgctgggaaccaatcccatccacaatgtgcagagatatacgaggaattaagggttttgaatgccaaaatgaagagccttggttatgttccagactatagttttgtcctacaagatgttgaggaggatgagaaagaggagattttgacaagtcatagtgagagactggccattgtatttggaattatcagtaccccaccaaaaagtcccatcaggatatttaaaaacttgcgggtttgtggtgattgccataatgcaactaagtacatatccaaaattactgagagggagattattgtgagggattcaaaccgttttcatcactttaaagatgggatttgttcatgtgcacaactgccaattgtcgaggtcatgtgttttatggactaccaaaaagtatatggtgttttgcctgaacttcaggtcattgttggccagccagcattgtcaaggactgcgtatgggcaattgccctcaatctgggttcaactcttgggaaatattgttgtgatgtctcaagctgcatggaagaggttcatatctgggatttacaggtacacttcaaaggttatacatttgttccattctgagctgaaggctacaattatattttcttggttacaagtctatcctggtttttatatggtatattcccctaatgaggaagtgtgtgatgcagcaaaaactggtattgtgggaagaacaggaagtggaaaatcaaccccagtgcaaacactttcccgactcattgaacctgttgctggacaaatattgatagatagtgttaacatttctttgatgggaattcatgatttgtggtccagactaaacattattcctcaagatccaacaatgtttgaagggactgtaagaaccaacctggacccactggaagagtacacagatgaacagatttgtgaggttctagatgtgtgccaacttggagatgtaggaaaaaaagggaagcttgacttctcaaaactttga

SEQ ID NO: 61352 - DNA, 618 bp, Glycine max
  Peptide Sequence Number=SeqID_178130
atggtggcacattcgagttcttggggcagggcactcgtggccatctcgccctataccttctctgccatcggcatcgccgtcgctatcggcgtctccgttctcggcgccgcctgggggatctacatcaccggtagtagcttgatcggcgctgcaatcagggctcctcgaatcacttccaaaaatctcattagtgtaatcttctgtgaagctgttgctatatatggtgttattgtggctattattcttcaaacaaaattagaaagtgttccagcatcaaatatctatgcacctgagtctcttagggctggatatgcaatctttgcatcgggattaatcgtgggctttgcaaatcttgtttgtgggttgtgtgtaggaataattggaagcagctgtgcattgtctgatgcccagaactcttctctctttgtgaaaattcttgtgattgagatctttggtagtgcgctggggctattcggagttattgtcggaattattatgtcagctcaagcaacatggccgacaaaaagaggtgttgcttccgtcgaggtgaaagtgttatggaggttcattgatggtgattgttgcaatggttggttcggtatcggatgtcggtcgcag

SEQ ID NO: 61353 - DNA, 267 bp, Glycine max
  Peptide Sequence Number=SeqID_178131
atggggtcttttatcgtgggagcccgatcttcatatcttgggcaaaacaaattcgtgtgtcaaggtgttggtctcgggccaaacttccatattattccacaaggcacgcgcaacaatgatggtttggaaacaacgtgcaaaattggtcatggccacagccagcgtttcgtttctaaacgaccatttagaggaaacactgggcccaacagaatagaagaaaatcactcgaagtgtatcaatctcacacatttaagtgttttatcctaa

SEQ ID NO: 61354 - DNA, 192 bp, Glycine max
  Peptide Sequence Number=SeqID_178132
atgctccaaccatatgagatcagcataggcttaaaggagcactcaaacccggtgacccccaaggcctacactctgaagagtccgtcagggcctctccctcctgattcagaagacactgctcatgaattatacaatacccacgacctacactcgtgttttaaacacgttcaacacaattgcgctacgatttaa

SEQ ID NO: 61355 - DNA, 1318 bp, Glycine max
  Peptide Sequence Number=SeqID_178133
atgaaagtgtatgccggccatctgccgggcatccgccacagcgaggtggcgtggcacagcctgcactttggccagcaaggcagcacgctggaagtgtgcgtgccggtgctgtccgaggcgcagattgccacgctggcggccagcgtacgcgataacgcgcgccgctacctgcacaccctgagcgtagcgcgcatcaccgcgttgattgatgaagccatcgcgcgcctgcttaaccgttcgcacccgttgcgccagcaggcggagcggttgctgccgctggttaccggctatgacgccgggatgctgcggctcggtttaactggctatctcaaaacctttcgtgaaccgcagctgcggcgttttctggcggaggatttcggcaacgtgcagatgctggacgattttcagccgcggccaaaaggcggctttgcccgcgcgtttggtccgcagctgttgctgcaggtctgggccggcaatgtgccgggtttgccactgtggagcctgattgccggcctgctggtgaaggcgggaagcgtgggcaaagtggcgagcgctgagccgctgatggcgggctggttcgcccagctgctggcggagatcgatccgcagctgggcgactgtctggccgttgtatggtggcagggcggtgatgaacgcactgagcagcagtggttccgcgaggcagacgttgtgatggcttatggcggagaagccgcgctgacggcgatgcagcggcgtctgccgccagccacgcgctttctgccgcacggccacaaaatcagttttggcatggtggcgcggtcggcgctggacgtgcggcgcggtacggcgctggcgcgtcaggtggcttacgatgtgatgcgctatgaccaggccggctgttactcgccgcaggcgctgtttattgagcgcggtggccggatgtcgccgcaggagtttgctgcttatctcgcccatgaacttgccgcgctggcacagcgctatccgcgcgcgacgctgacgctgggtgaaagtcaggctgtggccgcgtggcgcaacgcggaggaaatgcgtgcgctgagcggtgaccgcacgctgtacggcgatgagaacgatgcctgggcggtggtgtacgtcgacaagccggagccgttacaaccgggcgcgctcggacgtacgctgaaggtgattgccgtggatacgctggaggagacggtaaactgggtggccgcgcagcgcgcgtatctgcaaagcgttggcctcgcggccgcgcccgaggtgctgtttcggctggcggcgcagctcggtgcggcgggcgtcacgcgcatcacggcgctgg

SEQ ID NO: 61356 - DNA, 350 bp, Glycine max
  Peptide Sequence Number=SeqID_178134
atggcgaactacccagaggcaaatttacttaagggggcttattttaaaaactatttacggaatggggtatgttttaaaagaaataacggagggggtctgttattgggtgtaacccgccattgccactggcggcaaaggtggagagaggagagtatcgccactggtagtggcgagataggccacgtaggagggagagaggagagtgtcgccaatgcgaatggcgacacacccccagctggagtcgccagtcctgctggcgagataggccacgtgggactcgcccacagtgctggcgagacaggccaggcttcacgtgaagcttcaggggcttgcagggcttcagcttttca

SEQ ID NO: 61357 - DNA, 780 bp, Glycine max
  Peptide Sequence Number=SeqID_178135
atgtgtttcttcaaggaaatgaaatggctccgaaaaagctttccacaaagaggtctagaaaagacaccactggagaaggctccagtgctacccaaccagctgacacagactttgacaggcactgattctggagtgtcaagcatcagaagtgcttcgacgccatcaagggatggtcattcctcagagataaggcaagatttcgcccgaactgctgcaaagagacgggtgcggatcatgcgcaccagcatgaccactctaacccagatatggatgacgttgttgctcagcaacatcctacccagcgaccacaactctgacttgcccctactgaagtgtcagctagtggatggctccctcgaggtattccctggacccggagaagtccaacagggccctggggcttccagctctgattacaggtctcttccaattctacaaagtgcttgttaccctcagccatgtcatcccgcctcccatcaccagagccttcatcgagaagtactgcacacgcagacagccacaggacggagtgccccagcagcaggcgacagatgtacgaccaccccctcagtagtccacctcggccagcttacagagtatggaacattacttgcggcatgtagtttgccagcaggcagccaaccaccagggacaagtacaattgcaggagtacttctattagtacacgctcagccagcagggtcaaggctccactcctttcatatgccctactccagagcagtttggagcaatgatcgcatggcctcgagactagcctga

SEQ ID NO: 61358 - DNA, 123 bp, Glycine max
  Peptide Sequence Number=SeqID_178136
atgaaggatgcacgaggaagagctttggctgcgcaacaagactggtttcgtaggagtaataagccttctggtaatcgattacaggctacctgttcttgtgtaatcgattacactgagtggtaa

SEQ ID NO: 61359 - DNA, 243 bp, Glycine max
  Peptide Sequence Number=SeqID_178137
atggtatcagagttatggtcgggagcacacaaagatgataaactctttgatgaggagcaagcgctgttgttgttgacctcactatcaaagtccttcaaagctttggttcaaacgttgcttatgggaagatcaactttgaatttggatgagaagattgccgctcttagagaaaatgaaagaatgatgagaattgaaaattttgataatgaacaccatgcaatagctgtggtggagtttgactga

SEQ ID NO: 61360 - DNA, 1431 bp, Glycine max
  Peptide Sequence Number=SeqID_178138
atggaattaggaaaacacgataaaaatgcaagtgcctctagaacaaacgactcatctcagaattgtatgcccctaaagagcatccttgaaaatataattgatttcctacaaaggaaagacacgagtgggctgtttgctgcaccaactaatcttgatgtggtggaaaattaccataaaattgtcaagcaaccaatggattttggtaccatgagagccaaacttcacgaggacatgtatacaaacttcaatcaattcaagcgtgatatctttctgatatgcagcaatgcaatgcatgctagtcctaagacatcaaaatatcatgaagtggctaaacatattaataggtatgcaaaggggatatttgaggctctgaatgcggaccttggactttttcattcagaactttccctcaacaagagaggtccaagtacaaagcaacaaaaggagaaattgatcagaaccccacgaagggttgctactaaatgtgctggtatggatacatgctcctcatttaacctgcattcattaatacaaaaagtttctcgaccatacataaaggtagtgagatggagaaacaatgctactcactctacggtacctgaaacagaaaagagggataagtattggcctccaagtaagccactggttgcagaagtcctaaatgctaagaagcccatcattcaattgaacgaaaatgtaagtaagtacaaagagagcctcctacggtttgtgaaggatttaggaccaacagctcaaaaagtagcagcaaaaagactagaagttgtttccctttccccagttgagaatgtgtcttcctttcatggacctattcaagagcctaccaatcaactgcacttaggaagtagcagaacaagcaacacaagactgtggaacacctctgctggtatacaaaacatgttagccgccggaatctccagcaatgcgtttgcctgcgtctgtccgacaagcatgatctcagggccgcctcaaccaaggttatcaggcaacagaaataaccttccagggtcatcacgcaatccaaatccatgtcttttgtctcagtcaatggcagattattcagtttcttgcatgccaagcaacaacctcactgagctactacctcttatgcatcagccaaggccaagagaatcaatgtatgccatgcctagcaataaccttacagggctatctccttttccacaccgagcaaattccgcgtccaggctgaaccccttgaggctctctcctcatggaccagtttctcaacaggaacaaaattcatcatttctacaaatgctcttaggaggtgaaaccaataattatggaggaggaggtgctcaaataggccagccagaagaggctcctccacagcttcctttggacaatgataatgatcatgatgaggtgcctgacttagaacttcacctctga

SEQ ID NO: 61361 - DNA, 231 bp, Glycine max
  Peptide Sequence Number=SeqID_178139
atgatttttcactatacttctctccaaacgcccacccaaaccctaacaccttcttctccaccacccatgaccatcggtggccaccaaaagccgtcgttggttgccgccagaccaccacatggaggggaagcttttaatcagagcggaatcctcagaatccacctcaaggattcggtagagaaacaaaactctgcgtttggaccgatgaacgtgtacgtgagaggcctctga

SEQ ID NO: 61362 - DNA, 462 bp, Glycine max
  Peptide Sequence Number=SeqID_178140
atggtcttgatggatggaaggagggataaaatccatgccattgttaagaaagaggatctggaaagttgggaagcggaacttaaggaagggaaaacgtattatatgtacaagtttaaggttgttttgaatgatgatggtcagtacaaaatttgtgcacatccattcaagctttatttcactggtggtacaactctaaggcaagtcgatcttgctgaaattcctcttcaatcatatgagtttaagatttttgaagacatcgcttatggcaattatgatcctactaagctgattgatgtaattgcggttgtagaggaggtcaaattccagcttcctaataggaatcttgccaaggttaaaccactacaaggtgctcatggactaaccatctctgactcactatatggatcaaagttgttcatcaattatgaagttcctaatttttgccatctacagagaggttga

SEQ ID NO: 61363 - DNA, 810 bp, Glycine max
  Peptide Sequence Number=SeqID_178141
atggagctgccagcaattaaagcagcagaaggggagcgcgaattccgcgtagaggttgacatattgagcagacttgaccacccaaatcttgtttctttgataggatactgtgctgatgggaagcatagattcttagtttatgattatatgcataatgggaacctgcaagatcatctgaatggaattggagaaagaaaaatggattggccactgagactcaaagtggcatttggagctgcaaaagggcttgcttatcttcattcaagttcttgtcttggaattcctattgttcatagagatttcaaatccaccaatgttctcttagatgccaattttgaagcaaagatatctgattttgggcttgccaaactaatgccagaaggacaggaaacacatgttactgccagagtacttggcacctttggctattttgaccccgagtatacttcgaccggaaaacttactctacaaagtgatgtttatgcttttggagttgttcttctggagcttttgacaggacgtcgagctgtagatctaaaccagggcccaaatgatcaaaaccttgtactacaggtgagacatttactgaatgatcggaagaagctccttaaggtgatagatccagagatggctcgaaattcttacaccatggaatctatattcacatttgccaatctagcatcacgatgtgtccgtagtgagagcaatgagagaccttcgatggtggattgtgtcaaagaaatccaaatgattatgtacacaaattcaaagggcttgggaatggttatgcataggttgagattggtctaa

SEQ ID NO: 61364 - DNA, 1296 bp, Glycine max
  Peptide Sequence Number=SeqID_178142
atggcagcaacttcaacaaaccaaatcaaagaccaatctctttcactcaccaagagactctttccatggaccctctatgctctaatccccatagctcttctacacttctaccttaatcctctttcatttcctccttcaccagaatctgaactccctcattcgctcacttctcacttttctcccccctcagaagatgaaaaggctcatgatacaccttgtgactacttcaatggcaaatgggtcagtgacaagagaggccctttgtacaatggaacaacctgcggcacgatcaaggagaaccagaactgcatcaaacatggaaaacttgacatgggttatctctattggaggtggaagcctaatagtgagtgccaacttccaaggtttgaccctcatgcttttctcaatgttgtgagcaacaagcacttggcttttgtaggggactctatggctaggaaccagttagagtcacttctttgcatgttagccactgcttcaagttcaacccttttgttcagcaatgacagcaacaagttccgcaggtggcacttttcttctcataatgcaactgtttctgtgtattggtccccctttcttgtaaagggtgttgagaaatctagcagtggacctgatcataatgagttgtatttggatcatgttgatgagaaatggggtggggacatgggtcaaatggacttgattgtattgtcaattgggcattggtttttgcatcctgctatttattatgaggatggttctgttttggggtgtcattattgtcctggtttgaaccatagtgcaattgggttttatggtgtgttgagaaaggctttgaggactacccttaatgggataattgataggaggggaggtaaaggaaatgatggggttggtgtgattttgacaacattttcacctgctcattttgaaggtgagtgggataaggctggtgcttgtcctaagactaggccttatagaaatgaggagaagaagcttgaagggatggatgctgaaatgagagagattgagatggaggaagtggaaacagcaaaggtgaaagccaagggaattggagggtttaggttggaggcattggatgtgaccagattggcattgttgagaccagatggccaccctggcccttacatgtatccttttccctttgccaatggggttcaagagcgcatgcagaacgattgtgttcattggtgcttgccagggcctatagacacatggaatgagatttttctggagattttgaagaagtgggaggaacaacataagagtgaagaatga

SEQ ID NO: 61365 - DNA, 441 bp, Glycine max
  Peptide Sequence Number=SeqID_178143
atgtcattgtatcaactatcaacacttccatctattacaacagtcagccaaatcactatttgggttatccaagcggtcatatatccacatctacaactctatcataatttaggacttacaacttacaagtcattgattgacataacgaaaataactctcaagcaaaagagaaacttatgtagtagcattggagcttatgatgcaagctccattggagcttgtaggcctaggatcttcttcatcaatggattcctttgcttcttgaaagatgaatggcagcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 61366 - DNA, 261 bp, Glycine max
  Peptide Sequence Number=SeqID_178144
atggtgctttatgttgttgcctatgagcaacaacataagcaaaccaattcaggttgtgttcaacaacatgttagttcacatgtacaaacaactgcatctgttgaaatatctaggagggatgcctttaaggtgtgcattgatgcaatcctccctaggaagggaccaatcactagaaccatgagcaagaggctccaagaagattgggctagagctgctgaagaaggccctagggttctcatgaaccttagggtagatttctga

SEQ ID NO: 61367 - DNA, 276 bp, Glycine max
  Peptide Sequence Number=SeqID_178145
atggatgtgatcacattgagcataattgtttgcaatgcttgccttccatatgcagtgataacctgcaacaagtactctattgatgaggacatgaccaagagcaagggcaaggatccacttgaaggacttggaagacctatgacaagggctagagcaaggaaaactaaggaagttcttcgacaagtgttgtccatactatttgaatacaagcccaagtttcaaggaaaaaagtccaaggttgcgagttgtatcatgacccaaatggaggaggactaa

SEQ ID NO: 61368 - DNA, 303 bp, Glycine max
  Peptide Sequence Number=SeqID_178146
atgggggagatgcttgccacccaactcgcccaggcgagcaaggtggcttccttcagaagcaaccgccttctggaggaatcttttggagggcccaagtgggcctggttgctatttgcacccccacttttactaaatacaccccctgccttttttttgaacctcacgattggtgcaacgatgcttccttttgagttccgacatgtcacagaacttcacgaattgcctaacgatgggtgccaagtacctcaaaatggtcaaatgaaagttgcatgccaccaagcaaaggtccccggacgaaattag

SEQ ID NO: 61369 - DNA, 621 bp, Glycine max
  Peptide Sequence Number=SeqID_178147
atgacgtcaaaatcggcaattgcagctgacaaggacaatgtcagggacactgatcgaaaaaaggcacaggccatacagaaacaaaacactacccctcacgtgttgccttgtgggggttatgaatatctagaaaacaagttgatggaggagaagaaaaagaaacaactggaggaagctgctcaatctggaagcactgacaccatgattgatcctccatctcttatcaaccgacacgtgaagtggaagatggcccgcaccaagaaatctgggcaaatgatgtctgaggcagcaaaggaaattgctcacaagattgattcattggaggagcaagcctcacaggaacaccttggtcgtgtgcatgttgttggagcccatgtcacgatcaagcaatactttggaccggctccaaggacctcccgcacgtcttcgtccatggctcctgaagacctggagcagctgaagcaaaaaatcagggaccaactagaggagtcgatcacagaaaaagtgactcgacaactaatgttttccttcagccaaatacaatcccaatttcaatcacagatgcaatcacagggaatcgcattgcctcctgagcataagattggtccttcagctgctcat

SEQ ID NO: 61370 - DNA, 1188 bp, Glycine max
  Peptide Sequence Number=SeqID_178148
atggcaggaggaggagctgcaccacaaccaaagcaagacgagcatcaaccacatccagtgaaagatcaattaccaaatgtttctttctgcattacaagtcctcctccttggccggaggcgatcctacttggtttccaacattacctggtgatgcttggcacaactgtcctaattcccagctctcttgttcctcagatgggaggaggaaatgaagagaaagcaaaagtgattcagactctactgtttgtggctggcataaacacatttttccaaacattcttcgggactcgtttgcctgcagttattgggggatcctacacctttgtgccaacaaccatttcaatcattttggctggtcgctacagtgatgttgtgaatcctcaggagaaatttgagaggataatgcgcggaacacagggtgcccttattgttgcctcaaccctccaaattgttcttggcttcagtggcctttggcgcaatgtagtgaggttcttaagtcctctatctgctgttcccttggttgctctgtccggctttgggctttatgaacttggttttcctgtgcttgcaaaatgtgtggagattggactgccagaaatcatcatcctagtagtattttcacagtacattcctcatatgatgaaaggagaaaagcctatctttgatcgctttgcagttatattctcagtagcaattgtgtggatttatgctcatcttcttacagttggtggagcttacagaaactcagcacctaaaactcaaattacttgcagaaccgatcgtgctggaattatagggggtgctccttggataagaatcccttatccttttcaatggggagctcctacatttgaagctggagaagcttttgctatgatggcagcttcatttgttgctctagtagagtctactggtgctttcattgctgtgtcaaggtacgcaagtgcaacaccaattccaccttcagttcttagccgtggtgttggttggcagggagtgggaattttgttgtctggaatctttggcacagggaatggatcatcagtttctgtagagaatgcaggactcttagccttgacacgtgtgggaagtagaagagttgttcaaatatcagctggattcatgatctttttttcaattcttgggaaatttggagctgtttttgccttccaattccagctccaatag

SEQ ID NO: 61371 - DNA, 600 bp, Glycine max
  Peptide Sequence Number=SeqID_178149
atggatgtggtgtgggctatttggaagcatagaaacactattgtatttgaggaggctaactatgatggggatattgttgtagatggcttcaaatatttttttgtggagctagtgcaattcaaatatacgggtttcaattactctctacatgagggagtggatccaacacaatatttgcgctacacgtgcttcgttctcatccacgaacaaaacaatatcgtttgttggcgttgccacgatgacttcgttgaacatgtcacctcccccaacgcctcaacgtcggacgaggagaacaactttgagttaaactacgacgatttcaacagcaagggtctttgcccgctgccatccaccatgtcgaagttcttgctaggattagtatttgactggttactagagcaggttttgcagattgagatcaacggcctcgggagggcagagaatccatcgacgtcaaaggcggtgatagagtcaatgccaacggtagaaataaccgagtctcatgttgtgctgcatccaccgcgccttgacctaaactccaccacacctttagcccaacagagggcaacccaaatcaacaacaacctagatttgaaatag

SEQ ID NO: 61372 - DNA, 363 bp, Glycine max
  Peptide Sequence Number=SeqID_178150
atgcggataaccataaggtgtctctatatgtcatcggacttaccgtctctggatgataaaggtgcagatgacgatgtcaatctctgcatgtcaacgggctcgcttgcctctagctggcaaaaggtgcagataactgtaaggcatctccgcatgtcattggacttgtcgtctctggatgacaaaggtgaagatgacgatgttagtttctgtgtgtcaactggctcgcttgcctctagcagacaaaaggtgcgaataatcgtaaggcatctctgcatgtcatcagacttgccatctctggatgacaaaggtgtagatgacgatgttagtctctacctttcaacgggctcgcttgcctctagctaa

SEQ ID NO: 61373 - DNA, 483 bp, Glycine max
  Peptide Sequence Number=SeqID_178151
atgaccaagagcaaaggcaaggatccacttgaaggacttggaggacctatgacaagggttagagcaaggaaagcaaaggaagctattcaacaagttttgtccatactatttgaatacaagcccaagtttcaacgagaaaagtccaaggttacgatcctaagtcagcccttgtgcaatgagggttcatatcatttggttatcagagcttcggttctaggatcaacacttcctttgttggaaatattgggtaataatcctaatgatggagtggggctttcgcaagtccaaatgcaagctttgacacaacatttggagaggttaatgaagcaacgatatcaaatgaagaatagagatcataatgaagaagaaaggaggagaagagggaatgatggtgttcctagacaaaaccgaattgatggtattaatctcaacattcctccctttaaaggaaagaatgatccggaggcctacttggagtggtag

SEQ ID NO: 61374 - DNA, 135 bp, Glycine max
  Peptide Sequence Number=SeqID_178152
atgaatgatggttactatggcatcaatcatagactgggcgctaggaaggcaaaaacaagcaacgatgtcagcaaatgtgatggtagccttggtgatgcctgcgaatttgatgccaggcttgacaaattttcttaa

SEQ ID NO: 61375 - DNA, 1077 bp, Glycine max
  Peptide Sequence Number=SeqID_178153
gccctcaccttcatagggctacacgccctcaccttcagaggactacacgtcctcgccttcataaggctacacgcccacaccttcagaggactacacgtcctcgccttcaaaggactacacgtcctcaccttcagagggctacacgccctcgcattcagatggatacacaccttcgccttcagaggactacacgccctcgccttcaaagggatacactccctcgcctttagagggctacacgccttcgccttcaaaggactacaagtcctcaccatcagaagactacacgtcgtcgccttcagagggctacatgtcctcacattcagaggactacacgtcctcacctttagagggctacacgttctcacctttggaggactacacgtcctcgccttgagaggaccacacatcctcacctttagaggactacacgtcttcacctttagagggctacacaccctcacctttagagggctgcactcccttgccttcatagggctacacgccctcaccttcaaaggactacacgtccttgccttcagagggctgcaagccctcgccttaagagggcttcgcgccctcgccttcagagggctgcatgccctcgccttccaagggcgacctgtcctcaacttcagagggctacatgccctcgcctttagtgggctatgcatcctcactttcagtgggctccacatccgcaccttaagggaatttaaggtcctctgccccctgatcttggaggagggccaactatgcgagcacaaccagaggaagaggctattgtgcagctactatgcataccggggcaatatttcacccgtgccactgcaaagagacgagtgcggatcatgcgcaccaacggatcgcacccacaagacacccagtggacccggagaagtccaacagggccctggggtttccagttttggttacgggcctctgtcagtcctacagggtgcccgtcccccccagcaaggttacaccatcgtgactaacgtcgtcatctgcaccttccctggagatgtcagtgtcttccggccaagactgcgaaaaagtctcatttgctatatgtaa

SEQ ID NO: 61376 - DNA, 771 bp, Glycine max
  Peptide Sequence Number=SeqID_178154
atgcgcctcgttcagcggcacacgccgttcgtcgtccgttatcggcgtggccgcggcggccgcgcagcgcgccaggcacggggcgtcgtccaggcacaatacctgcggcagatccggcatgttggcccgcgtgtcactgtgggtcagcaacatcaccggccgcgcgtcgtcgcacatcagcgccaaacgttcacgcggatagtccagatcgagcggcatataggccgcgccgctggccagcacgccgaacagcgcgaccagcgtgtccaccgagcgcggaatgccgatggcgaccacgtcttcggcgccgatgccgctttcgatcagcactcgccccagctgcatcacccgttcggagagctgccggtagctgaggcgcacgtcgccgcaggacaccgccaacgcctcgggctgacgctcaacctggcgctggaacgcatccatgatcgaaatcatgcccgccggcggcgtcagctcagcgccgcgcccccaggccgcgagttgtctgagttccccctcgccgatcaacgccagttgaccgttcggctggtgcggctgccgcgccaactgctgcagccaatggccgatgcgctccgcgtggtgctgcaaggtgcgcggcgagtatttggccgggttggcgaccaaagacagcgtcaatacgccgcttcgaaaaccgatctcgaactccaggtcgtcgaccggccccatcgccagcgtatgggtggtggccgcctgaccgtcgaacgacaaggcgctgtggtagaccgttga

SEQ ID NO: 61377 - DNA, 321 bp, Glycine max
  Peptide Sequence Number=SeqID_178155
atggaggggagtttgttaaccatcatttcaaagcatacttctagcatcatggtctccttcacaagacctcgtgctcataaactccacaagagaatggtgtcgccgaacgaaaaaaattgtcatatcttggagacaacacatgttcttcttcttggcacccatgttccaactcaccattgggataatgctataactacaactgtatacctcctcaactgcattccctgcaaggtcttgcattttaaaacacctctgtgcttgtttttgggctatggactacacaataagggctacaaatgcttggaccctaccaccaattaa

SEQ ID NO: 61378 - DNA, 564 bp, Glycine max
  Peptide Sequence Number=SeqID_178156
atggaagaagccttagttgatcctaagtgggcacaagccatacaagaggaaatggaagctttacaaaagaataatacatggaggttgataccacttcctaagggaaagaagacagtggggtgcaaatgggtgttctcaatcaaatacaaaaccgaaagatccattgatcgacacaaagcaaggctagtggcaaaagggttcacaaaaatttatgctatagattatacaaagaccttttcaccgatggctaaactaaatattgttagagtcctattatctcttgtagcaaatttagattggccattattccagctcaacgtgaagaacgtttttctccatggagatcttgaagaatatgtttatatggatatcccaccagaatatatgccctcttccggaaccaaggtggcaaggtcacaaggaggcattttcttgtctcaaagaaagtacatgttggacttattgactgaggtggggctactagactgcaaaccagcagatactctgtcataccctaatttcgtctggggaccatctgtttattgggatgcgaccttcgcatga

SEQ ID NO: 61379 - DNA, 768 bp, Glycine max
  Peptide Sequence Number=SeqID_178157
atgatagaggttttatcaaaagcccagtcaacatcacaatcatcgatctttgattcctcgatgatactgatcaacatcaagttggatggttccaattatgccctatggtcccaagtggctgagatgtacatctcaggcaaagacaaactgggatatattgacggatcattccctccgttgtcaaaaactgattcgacattccataaatggcaatttgagaacaccatagtgaaaggatggttgatcaactcaatggatccctcgttggtggggaatttcatctgcttcccaacaaccaaaggggtttggaactccattgctatgacatattttgatggatctgatacttcgcaaatttatgaccttcgacgtaaggaaagagtttatatctttctcgatggattggatgatcgactcgataacattcagagtgacatactccaactgaagtcattccccacaatcaagcaggcttatacacatgttcgaagggaggacacttgtcaaattgtaatgacatatggagcaaagaatacaacaagtggtgctgttatggccactaaaggctcaaaatttggccaattgctaatactggtggctaggaaacacaactcagtcttaaagtcaaagggtccatctaatggaggaaagtacacacattatggaaatgttagacacactaatgatacctatttcaagctacatgggtatccaaagtggtggcatgagttgcaagctaagaagaaaaaaagacaccatgacacttga

SEQ ID NO: 61380 - DNA, 118 bp, Glycine max
  Peptide Sequence Number=SeqID_178158
atgaggcttcactgttatcaagcgagtcagagacccagcatgaccacaaatcgacttccactccttatggctcatatagacccgggtatagggcctaatatctcaacgtgtgtgcgag

SEQ ID NO: 61381 - DNA, 2037 bp, Glycine max
  Peptide Sequence Number=SeqID_178159
atggctttcttcacctatgcttcaaactctaaccaatgcccaaaacaaaccttgttgttcatattcaccatcttcaccttgttccatacactctttaccactgtagagtgcctttccttcaacttttcaaccttccaaccaaactcaaataatctaatagactttaaaggtgatgctttttcctcacgcggtgttcttcagctcacaaagaaccaaattgatgacaaaatcacattcagcgttggtcgagcctcgtataaccaacaagtgaggctttgggatagaagaactaagaaactcactgatttcacaacccatttctcttttgtcatgaaagctgttgaccctaaacggtttggggatgggctagccttcttcattgcaccctttgattctgttattcccaacaattcagctggtgggtaccttggcctattcagcaatgaatccgcattcaacatgaagaaaaatcagttagttgcggttgagttcgacagcttcgaaaacgaatgggatccgagctctgatcatgttgggatcgatgtcaactccattcaatccgttacaaatgtctcttggaagagcagcattaagaacggatcggtcgctaatgcttggatatggtacaactctacaaccaaaaatctctctgtgttccttacttatgctgataatccaacttttaatggcaattctagtctttcttatgtcattgatttgagggacgtgttgccagagcttgttagaataggcttttctgctgccacgggttcgtggattgaagtgcacaacattttgtcttggtcattcagttcaaacttggatggggataataggaaaaaggttaaggttggtttagtggttggtttaagtgttggtttgggttgttgtttagtttgtgttgtaggcctattatggtttaccttttggagaagaaaaaataaaggaaaggaggaaaacttaggtgttgatgcttctatagatgatgagtttgagagaggaactggtccaaagaggttcacctatcgcgaactaagcaatgcaaccaacaactttgcagaagaaggaaagctaggagaaggaggatttggaggtgtttacaaaggcttagttgtgaactcaaaccttgaagtggcagtgaagagggtttcaaaagggtcaaaacaagggaaaaaggaatatgtatcagaagtgagagtaatcagcaggctaaggcatagaaacttggttcaactcatagggtggtgccatgaacaaggtgagctccttcttgtttatgaatacatgcctaatggaagccttgattctcatatatttggaaatagagtcatgctttcatgggtggtgagacacaaggtggctttaggtttggcatctgctcttctttatcttcatgaagagtgggaacaatgtgtggtgcatagagacattaagtcaagtaatgtcatgttggatgcaaatttcaatgctaaacttggtgacttcggtcttgcaaggctagtagaccatgaacttggttctcaaaccactgttttggcaggcacaatgggatacctagccccggaatgtgtcaccacagggaaatctagcaaagagagtgatgtgtacagctttggtgttgttgcacttgaaatcacatgtggtagaaaaccagtggaagttagagaagagcctagtaaagtaaggcttgtggagtgggtgtggagcctctatggaaaagggaaactacttgaagcagctgataagaaactgaattgggaatttgaagaacagcaaatggaatgtttgatgattgtggggttgtggtgttgccatcctgatcataccatgaggccatccattaggcaagtgattagtgtccttaaccttgaagcccctttgccaagtcttccatccaagttgcctgtgccaatgtattatgcacctccaatggatatgtgcaaattctcctacacttcatctggtgttacaagcacaaccaaagaatcttctccatactcttcaatgtcagctgggtccggaaaatctctattgtag

SEQ ID NO: 61382 - DNA, 246 bp, Glycine max
  Peptide Sequence Number=SeqID_178160
atggcaggagtaacaggagtagtcaagatctcgaagcgagagttagatggaataaaacaaagaaggcatgaagtggatagacaggtcgatatagagaccatgaaggagcaaatgacaatgatgatggaagcaatgataagcatcaggaagatgatggaggtcaatgctgaacagttgctacgaccaatactactactaagagggacccaactcacccgcccggtttcaataaagagagttgtctag

SEQ ID NO: 61383 - DNA, 1247 bp, Glycine max
  Peptide Sequence Number=SeqID_178161
tggaaacgacgccgttggaaggtgggaagaagatgagttcgcagcaaatgcaaatgcaaattcaaatccaaaacagtggtggtggcagtggcaacaacaacagcagcaacatcccagtgagcgaggttttctggactctcgtcgacaaagccgacaaaaaattctccaaaatcagagaccttcccttttaccaacgcagcaggcatgatacttacttttataaggtgttcaaggtctacacacaattatggaagtttcagcaggagaatcggcagaagctgattgaagctgggcttaagagatgggagattggtgagattgcatctcgcattgggcaactgtattttgggcagtacatgcgcacaagtgatgcaaattatctctcagagtcatatatattctatgaggccatattgactcgggagtattttaaggagggggaaatggtgcagcaattggttaatcagcttaaagtattagttgatgaatgcaagagaacattccaggaaagtgactttaaagaatggaagctggtggttcaggaaattctcagatttttaaaagctgaaactgcttttatgaatatcaggcccttgagatacagtctagttttggactctcatcctgatactttaccccatgtggctgcagccatcacgaagcgacatttgaaactacgagatgctgtattaagtagcttccatccaaatgaggtaaagtattcagagctcaccattgacacttttaggatgcttcaatgtctggagtgggaacctagtggtttgttttaccagtcaagtggttcaaaacttagtcaaaatggggctactggaactagtcgtatcagttatatccaagatattgctgatcctaccttaccagcaaacccacgaaaagctgtgttataccgtccttcgctgacccattttatagctgttcttgccacaatatgtgaggagcttccttctgatggtattctccttgtgtatttgtcagcttcaggatattgtggttctgcacagaatgaatctggctgcatacactttggtccacgtggagatagagacaagtctctgggactatcatggggccagctaataattctggtaaagccatggaccaggcttgctgaattctctaggaatgccacaggccaaactcatatttttggccagaatagtacgactgaggtcatggcagtagaacaacccaaagaaggagatggccaaaatatagagcatgactaa

SEQ ID NO: 61384 - DNA, 147 bp, Glycine max
  Peptide Sequence Number=SeqID_178162
atggtggtatctgtcgcagacatggacgaagatgagtggatgtatgaaataatgtctgaacgagcggatatggattatgaaaatgtagaatcatgtggtgcgaatgaaccacatgttgattgttcgaatgcgttcaagacttcttag

SEQ ID NO: 61385 - DNA, 1818 bp, Glycine max
  Peptide Sequence Number=SeqID_178163
atggacctttatgttttgccgatatcaggagccaacgtggtgttgggcgtccaatggtttaaaatcttaggccccgaggatgcctcctatttccacattgcggtgctcaccgaggaccctgcttccacaccggctccggacctacccctggaaattcaagatttacttgctaagttcgccaccttatttcagaatcctcagggccttccaccggctagggacatagaccaccacattcatttgattccacacttcactctggtcaacgtgcgtccctaccgttacccacactaccagaagcatgaaatcgagctccaggatgggtcctggaaattctgcatggattttcgtgctctgaatgcggtcatcgttcgggataggttccttattccgacgatcgatgagttgttggaaaaattaggaggcacgaagtatttttcgaagctagacctgttgcagggatactaccaaattagaatgcatgtcgccgatatacccaagacagcttttaggacccaccatggtcattacgagttcaaagtagagtatcttggccatatggtttctcagaaaggtgtggaacctgtagcttcaaaggtggaggccattcatcaatggccagtgcctcagtccattagagcagtacaaagctttctggggctcgtgggtttctatcgtcgatttattagaggctatgccaccattgccgcctctctgatcagaatcaccatcgtgaaaccattcaagtggacctctcaagctcagctggcattcgaacaacttaaagcagctctctcaacgacccttattctagctttacccgatttccagctacctttcactattgagatggatgcctccaacatggaaataggtggtcaaaaagtggcaccagtacctcctcgatcatcgtttcaccattatcaccaaccaccgaagcctcaaggaattactaactcaagtaatttagacgttggaacaacacatgtatctgtgccctccttatcctttttggaagaactccgttgccagttggaagatcacccaaaatatagacgtcaacatcaggagatcattgagaatctgaccaaatatcctcccttcttgctttcgcagaatctggtgaggaagtatgagacacagacgatggtggggttgttgtgccccctttcggtaccacaccagccttgggaggatctctcattagacttcattgtcggccttccgacgtaccatggtaacacaaccatcttagttgtggtggatcatttttcgaaggggattcatctgggtatgttaccctctgctcatacggctcacatgccgcttctgacaagagctcttccgatccagtggaacccaattgtgaatgagttccgcataccatcctcagagaaatggtcaaacggaggaactggaaccgccccatacgaggttacttttggctggaaaccattcaattttccagagtacatcactgggtcttctaacatcaaagttgttgagagttttttgactgacagagatgaaactttccaagcaattcgcaagaagattctaaaagcgcaagatggcatgaaaaggcaagctgacagcaaatgccgtgaaggcctttctccaaatgaaacctcttgggaggattggacgcaattacagagggactatcactttgaggacaaggtgatcttacaaggatcgaaggatgataagaacatagaagcatcatcagagatcgaaaatgcaaaagaaggggtgctgaaagaagaaaagcccaaagggaagatcatgaaaccaccttacctcaacgactatgtttga

SEQ ID NO: 61386 - DNA, 252 bp, Glycine max
  Peptide Sequence Number=SeqID_178164
atggctaactcggcttgttccacgtccactatggaccgcatcgaagtagccatcgtggaactcaccgctgcccaagacgccattgccaccaaattggacaaacttcttccgctgttggccctttttgagaccactcaacattcttcattttttccttttgggaagtcaccaccattagcgggaaccatgccgattccatttcccatggtaaccagccaacactccctgtgggataaaggggcttgggaataa

SEQ ID NO: 61387 - DNA, 703 bp, Glycine max
  Peptide Sequence Number=SeqID_178165
gattcgttggaggatcatgcctcacagggttcctttgtcgcctatggacgtcaggatgtattgactgttgccattgggcgaccagaacaccctggtcgtgtgcatgttgttggagttggtgtcacaatcaaacaatactttggaccggctccaaggacctcccgcacttcttcgtccatggctcctgaagacctggatcccaatttcaatcgcagatgcaatcataaggactcacactgcctcttgagccagaggttggtccttcagctgctcgtgtccataaaggagagttatgtttatccctcaagcaacgacccatacacgggtgactcagagaaatacgggttgtacgttgaagaaaaccttccccgcctggttgccctaggaagactttatgagggatccacaaccgttcacaacatgtctttgtgccatgatcaactcaaggttggtgttgaggaagttagagatgtagatgctctcattcctatacccactcaaaagggagttctgggaccaacgaaacctgcagataggccggatcatgatgtcgatgatcctctatatctaatgacattgaccatcccacaactttttctaaagccgttgcaggttatgtgggatgctatcgtgtttgggatgtttaatgacgacttccccttgtacataaagcatgaagatctgttcgaaatagcacacggtg

SEQ ID NO: 61388 - DNA, 102 bp, Glycine max
  Peptide Sequence Number=SeqID_178166
gaaggagcacaagctacgtcttaagagcaaaccaaacactaagaactaccatgctgctttgaccaacaaatcctggacatgttatccatggccttatcaaaa

SEQ ID NO: 61389 - DNA, 387 bp, Glycine max
  Peptide Sequence Number=SeqID_178167
atgagccccccaagctccaggagaaagagattgtctagtgtcgaaggagattgtctcgtatcgaagggtgacgagtttgtggagcgcctaagtatggacgagtattgtccattgtcgggtgtgcttgtgaatcccctaagcttggacaagtatagtctgagttgcttttgtcaagttgtccgtgagggacatgtctttggcgtcttaggcgtgtgtgacacatgtgcaatactcttgcatatgtgtcagtcgcggagtgggcacttattggagtcgcggttcgtgcatgagtgggagagcatgatggtgccaaattttagggcaccaattcagctccgaccagttattgaagagttcgtctctcttttaaatggagtgaacgtttga

SEQ ID NO: 61390 - DNA, 963 bp, Glycine max
  Peptide Sequence Number=SeqID_178168
atgccctcgcctttagaggactacatgtctttctcttcaaatggctatacacccttgccttcaaaggacttcacgtcctcctcttcagagggctgcacgccctcgcatttagggggttgcatgcccttgcgttttgaggactacacggctacacgccctcgctttagagcactacacatcatcgccttcagaggactacacgtcctccccttgagaaggcttcatgccctcacctttagaggactacacgtcctcgcctttagaggactacatgccctcgacttcagagggctgcacgccctcacctttagaggactacacgtcctcgccttcagaggactacgggtcctcgccgtcagaggactacacggcctcgccttcagagggcttctcgcactccccttcagaggactacacgtcctcgaccgaagagtactacatgtcctcgccttcagaaggctacgcaccctcaccttaaaagggctacatgccacccttagaggactacacgtcctcgccttcagaggactacatgtccttgccttcagagggctacatgccctcaccataagaggactacacctcctggccttgagagggctgcacgcccatgcctttagaagactacacgccctcacctttagaaggctacacgccctcacctttagagggctacacgccacctttagaggactacacgtcctcgccttcagaggactgcatgtcctcgccttcagagggctgcatgccctcgcctttagaggactacatgtccttctcttcaaatggctatacaccctcgccttcaaaggacttcacgtcctcctcttcagagggctgcacgccctcgccttcagacgactacacgtcctcaccttcaaagggctgcatgccctcaccttcagaaggttgtgggccctctccttcagagggcctcacgccctcaccttaagaggactacat

SEQ ID NO: 61391 - DNA, 129 bp, Glycine max
  Peptide Sequence Number=SeqID_178169
atggctgcttcggtgcaaaacaacccaatagacgtgtcggaggaaaaattggaggaatctcagggaatcgctagagatgctgctatcactgtcggaagacacgtgagtccgtttagaggtaagggatga

SEQ ID NO: 61392 - DNA, 288 bp, Glycine max
  Peptide Sequence Number=SeqID_178170
atgtgggtgcaagccattggtccatttgctcaagcgacctgtgctcctgagtttggacttccaagaccattcaatcagagattactcatcttgcacgttgggggggctgccgtaaaacaacgtggacaacccttcccttgtgttcaagaatcccctacaacaagagacccacggtctcttaatcccttttcagaaataagaagaagagaagaagagatctctcttaaaagagatagattgtacagtgaagatcaatcaaaattccttattgaatatgcaagtggttga

SEQ ID NO: 61393 - DNA, 1845 bp, Glycine max
  Peptide Sequence Number=SeqID_178171
atgattggccaaaagaaggtgcttattgttcttgatgatgtgaatgattcagagcagctggaagaattatttggaactccagactggtatgggtcaggtagtagaattattataacaactagagatataaaagttcttatagccaacaaagttcctgaaatataccatgttggtggattgagttcctgtgaagcatttcagctttttaagttgaatgcctttaaccaaggtgatcttgaaatggagttttacgagctatcaaagagggtggttgattatgccaagggcattccattagttcttaaaatattggctcatcttctttgtggaaaagataaggaggtatggaaaagtcaactagaaaagcttaaaggaatcaagagtaacaatgttcatgattttgtgaaacttagttttgacgatctacaccatgaagaacaagagattcttttagatcttgcatgtttctgccgtagagcaaatatgacagagaattttaatatgaaagtggattctataaacatattattgggagattgtggaagtcataatgcagtggttgttgggttagaaaggctgaaagaaaaatctcttataactatttctgaagataatgttgtatctatgcatgatactgtacaagaaatggcatgggagattgtttgccaagaatctaatgaccttggaaatcgcagtcgattatgggatcctattgagatctatgatgttttgaaaaatgacaaggggactaaggcaattagaagcataacaacacctttgtcaacattgaagaatctgaagttacgtcctgatgcatttgttaggatgagcaatctacaatttttggattttggtaataattctccttctcttccacaagggcttcaatctttgccaaatgagttaagatatcttcattggatgcattaccctttgacatgcttgccagagcaattttctgctgagaagcttgttatattagacttgtcatgtagcagagtggaaaaattatggcatgaagtgaaaaatctggtgaatttaaagaatgttaaactccgttggtgtgtattgctgaatgagcttccagacttctcaaaatccacaaatctcaaggtactggatgttagttgttccagtgggttgactagtgtgcatccatctattttctctctacacaagcttgagaaattggaccttagtggatgcagttccctcatcaaattttcaagtgatgatgatggtcatttaagctccctactttatctcaacctcagtgactgtgaagaactaagggaattctcagtgacagccgagaatgtggttgaactagatttaaccggcattctcatcagttcattgcccttgtcttttggaagtctacgaaagttagaaatgctacatctaatacgtagtgacattgaaagcttgccaacatgcatcaataatcttacaagactgcgatatcttgacttgagttgttgcagcaatctctgcattctaccgaagcttcccccatcccttgaaactctacatgctgatgagtgtgaatcactggagactgtattgttcccttccacggcagttgaacaatttgaggaaaacaggaaacgagttgagttttggaattgcttaaagttggatgaattttctctgatggctattgagttaaatgcgcaaatcaatgtaatgaaatttgcataccaacatttatcagcaccaatacttgatcatgtggaaaattacaatgattacaaggatctcatgattcttatcaagcagtgtacatgtatccaggaagcagtgttccagagtggttggcatataagactagaaaggattatgtaa

SEQ ID NO: 61394 - DNA, 456 bp, Glycine max
  Peptide Sequence Number=SeqID_178172
atgggcgatgccggggaagccggcgagggcggccacatcgccctccaccgtcagcgagagcaacaggaagccatgtgcgatggtatgcccacccggcatctgcgcctgcgcccgcgctggatcgacatggatccagttgtggtcgccggtggcgtcggcaaaagcatcgatgcgcgcctggtccacgcgggtcacgccactcagccgctcactggcggcccactgctgcaacgcctgcagggcgggaggcaggtcgctgtccgcactcacgccacacgctccagcaaggtcaggatcgcgtcacgcgcctctggctcggacagcatcggcgcgtgccccacatcgggcacctccaccaggcgggcactttccgaggtggccgccatctgccgcgcgacatcggccggcagaatgtcggacagcgcaccgcgtaccaccagcaccggcacccgtgcg

SEQ ID NO: 61395 - DNA, 408 bp, Glycine max
  Peptide Sequence Number=SeqID_178173
atggcttctagaaaatacacagacaatgttctggggagaaacattttacctgagagaaaggtagagctctatcacactgagctagatgactttaaggctaaattggaaaggcgtaatttccataaacgcctcaacaatttagccgatgggagcatagacctggctttggtgaaagagttctatgaaaatttatatagttctgaggactgtccaccaaagcagtccagagtcagaggtcatttggtgaagatggatgctgacagtctcaacgcattcctggagacacctatgctattagctgagagaaactctacccgcatactccagatactgcaagttgcctatggacttcagagagatagagcctgccttatgcatacctggttgagggttcatcttgaactctga

SEQ ID NO: 61396 - DNA, 501 bp, Glycine max
  Peptide Sequence Number=SeqID_178174
atggataaccactcgggtatttccgcccgtcagcgtggctcaaatgtcagtatgacagatcttgtgagcgcggaagatgacacagaaaaaaagaatgtttatacggattaccactcggatatttccgcccgtcagcgtgactcaaatgtcagtatgacagatcttgtgagcgcggaagatgacacagcaaaaaagaatgtttatacggataaccactcgggtatttccgcccgtcagcgtggctccaatgttagtatgacagatcttgtgagcgcggaagatgacataaatctccgcacagtaaaaaagaatgtttatacggataaccactcgggtatttcctcctgtcagcatgactcaaatgtcagtatgacagatcttgtgagcgcggaagatgacgtaaatctccgtgtgtcaacgggcgcagaagacgacacagcaaaaaagaatgtttatacggataaccactcgggtatttccgccggtcagcgtgactcaaat

SEQ ID NO: 61397 - DNA, 1557 bp, Glycine max
  Peptide Sequence Number=SeqID_178175
atgcaaggtgaatatgtattacctggcactcgagatgataaccctgttgacataaaaggggatggctttttaaaaaggttcttgtctgggcatcttggtagtgttatatcctcgatgggtaggtggagaatgaaacttgaagttcccagagctgaggttgctgagatgctccctcttgcaaggcttctttctcgaagtatggatcctgctgttctttcaagatcaaaggatttttttattcaaagtttgcagtcgataggattatattctatgagcactcaacaactgattgagttaataagggagcatcatgttccgtcaaatgatgttcttgaagatttgagccttcctggtttacttgaactcaaaggtcgctggcatggttctctcaatgcaagtggtggagggaatggagacaccctggcagaatttgactttcatggggaggattgggagtggggagaatacaaaactcagtgtgtcttggcagttggtacttatagtaatgttgatggcttgcacctggagaaaattttgatccagaaggataatgccacaattcatgctgatggaactttgttaggacctaaatccaaccttcattttgctgtcttaaactttcctgttagtctgataccaacagtagttcagatcattgactctacagcatccaacgctgttcattctctgtggcaattgttagcacccattagggggatcttgcatatggaaggagatcttagaggaagtttagcaaaaccagaatgtgatgctcaaattaggctacttgatggtgccattggtggaattgttcttgaacgagcagaagtcgttgcctctctgacctcaaccaatcgttttctattcaatgcaaaatttgaacctttgatccagaatggtcatgtactaattcaaggagctattcctgttacttttttccaaagtaacatgtcacagcaagatgtggaattagataagaatagggctacttgggctcctgaatgggtgaaaaagaagaacatgggggccaccgatgatgccagagacaaaaaagtttctagacgtagaaatgaagaaggttggaatactcaattagctgaaagccttaaaggtttaaattggcaaattttagatgttagagaagtcagggttgatgttgatataaaagatgggggaatgatgctagtaacagctttaactccttatgccaattggctttatggcagtgctgatatcatgcttgaggtcagaggtacagttgaccaaccagtgcttaatggatatgcatcattatgtagggcatctatctcttcacccgtgttccgaaattcactgaccaactttggtggaactgtgcacatgaaatcaaacaggttatccatcccctcactggagagtaggataggcagaaagggaaagctgcttgtaaaagggaaccttcccctcagaacaaaggaagcagctctcaatgacaagatcgagtttaagtgtgaagttctagaagtgcaggcaaaaaatattttaaggttggctttttaccttgcgcaagggatctaa

SEQ ID NO: 61398 - DNA, 528 bp, Glycine max
  Peptide Sequence Number=SeqID_178176
atgttggagaaaggaagtgcagctagtcttgttggtgaggtttcaatctctggtctcaaattgaatcaattgatgcttgcacctcagatgtctgggtcattgagtgtttctcctgattgcatcaagttgaatgcctctggtaggcctgatgaaagtcttgtgatggattttgttgggccactacagctcagtggtgaaagtggtctgaaaagtggacaactgatgtccatttcccttcataagggccagttgagggctaatgtagattttcaaccatgtcattcagctagcttggaggtatggcattttccacttgatgagctggaacttgcttctctcaagggaactatacagaggtcctgcctgaatgatgacttggtgaaggcattatttaatggtcatgcagaaatccagcttaatcttcaaaaaagaagaggacatggaatcatatctgtacttcagccaaagttcaatggagtgcttggtgaagccctggatgtggcagctaggtggagtgagatgttgtga

SEQ ID NO: 61399 - DNA, 3183 bp, Glycine max
  Peptide Sequence Number=SeqID_178177
atggacactttgtttttcgggataaagcttcgtgctcctttggaagttaacaacactatcaaaagggttttccctagaagcaagaggtgcaatgtttctgcaaaacatgttcgttacccatcgaggcatgcttttaggttttgtagccaaaatgtaaacttgttgaggaaaccccatgtttctgcaagtgggtcgaggttgaaatgcttcaaggaaaaggaaccacccttttctctcagtgttagttatttcacctcattgtggaaagagggtgttcttttgatgagggcctctgtgttcactgttgttatctctggtttgtgtcttttggtttggtttggaaggaacaaagccaagggttttgttgaaacaaatattttgccttctgtttgttcagtgatcagtgagtatgttcagcgcgatgtttgctttggcaaggttgtgagaatctcacccttgagtgtaacattggagtcatgttcatttgggccaggtgaagaggaattttcctgtggtgaggctcccactgcgaaggttcgttttcgcccccttgccagtctgtggagggggaagtttgtgtttgatgcagttttgtcacatccgtgtgtcttagtagtgcaaaagaaagactatagctggttagggataccgctgtctcaagggggcattcagaggcgcttgtcaaccaacgaaggacttgatcatcgcactaaagtgaggagggttgcacgagaggaggcggctgctaaacatgttagagacagggatgatgccgctagggaagctgcagagatgggttactttgtttctgagaagaattgtggtccatccaagggtgatgataatttaaaggaaattgcaactcattcagtaggaggaacaaactccaagggttttttctgcatgaagaaggtggagcagcatggtcatcgttgtgtggacacaggtgttgattatgatatgaaacatgctgatttggaggagtcatttagggtgaagttccctgaaaaaggacttaagttttggaaaagagtcataaaagggcatagaaaacacaaatttaagcagaaggctaaaagaagtgacatcagtgcatctggtattgctctcagaaaaagaattcttgaacgtggtgcatttgcagcaaatgcatactttcacagtcaatcacatgggatgtttgagcatcctttgtcatcttctggatgttttcattctagagatcatgataggcaatgggtaaaaagtgattttgacaaaaatgctgtatctgttgccagtggtgatgataatagaaatgatgataaccgtaatggaacacaattcagagatctgggagtctggtctccttcggcaaatgaaaatattaatgggaattcaaaagatttaaattttttcggtgatctgtcttcacagacaagggagagtaaacatgaaaatttacaatctagtgaggatgttgcagaacatgccaatgctaatattagtacagagaaaaaggaggagttgagacttcatgttgcacacaatccaattgatgttagtgcaactaggggccaaagagatttggtttctgtgaagcctaggtctgtgctggcaacatattttcaggtttcgtttgagaccttgattatgaaatttggcttaacctcgttttttagaaacattgaggggttgacatctttcttccttgctggtcccattgaaaagttgaagtctgaaatgagtctgaaagttgaaggtaccgttgctgaaaatgtagatggggtagatgttctgcagtctgaagacctaactaagattcttcctgttacattggattctgttcaatttagaggtgcaactgtgatgctacttacatatggtgacagggaagttagggtgatggagaatgccaatggccatgtgaagtttcataaccactactacaaccgtataaatgtaaaactgggtggaaattgtaagacttggagatcagatgatatatgtgaaggtgatggctggttgtctgtcattgtttttgttgacactgttgagcagaaatggcatgctaatttgaagattgaccatttttttgtcccgctgtttgaaaggatcctagacattccaattacatggtctaaagggatggccagcggtcaggttcacttgtgcatgtcaaagggtgaaacttttccaaatcatcatggacagcttgacgtaacagggttgaacttccaaatattaaatgctccatcgtgtttttctgacatatcaggaagtttatgttttcgtggtcaaagtatatttttacacaatgcatgtggctggtttggcagcattcctctagaagcatcaggagattttggcattcatcctgaggaaggagaatttcatcttatgtgtcaggttcctagtgttgaagtgaatgctttgatgagaactttcaatatgagatctctcttgttcccactagcaggatcgataactgctctatttaattgtcaaggcccactggatactcctatatttgtgggaactggaacggtttcaaggacattctcttctttgcatgttgacactcctacaactgtagcatctgaagcacttgctaaaagtaaggaggctggagcattggcagcatttgatcgtgtaccattttcacatgtatctgccaatttcactttcaacactgatagctgtattgctgatttgtatggaattagagcgagccttgtggatggtggtgaaattcgaggggctgggactgtatggatatgctcagaggctgtgaatgatgagacagcaatagatgcaaacttctctggaagtttggcctttgaaaaaattatgcttcgctatattcccagttatcatcatttggtgccactcaaatttggggttttaagtgaaaacacaaaactttcaggatctcttttaagaccgaggtttgatataaaatggactgcaccgacggcagaagggcctttcagtgatgctagaggagatatcataatctcacatgatttcattactgttaattctgcttcggctgcattagatttgtatatgaaagttcaaacatctttttctgataatttttcttctaaaagagaagagttttatgcaccgagagccagtctattcactgttggtggagttgagtttgatttgcacatgcgtggatttgaattctttagtttg

SEQ ID NO: 61400 - DNA, 966 bp, Glycine max
  Peptide Sequence Number=SeqID_178178
atgttacggaacctcatggattgtacaacaatgcttcctttcgacttccggcatgtcacagagcttcatgggttgcctaacgatgggtgccaagtacctcgaagtggtcaaacgagggtcgcatcccaacaaacggatggtccacggacgaaattaggattcaatggtgaagatttcctaacaagacttagagggaagagtatcatgtttgtgggagactctttgggtttgaaccaatggcaatcactcacttgcatgcttcacatagctgtgccacaagccccatacagcttagcaaggaatggagatgtctccattttcacctttacgacctatgatgttaaggtaatgttctcgcgcaatgcattactggtggacattgttggtgagagtatcggtcgagtattgaaactagattcaattcaagctggccaaacatggaaagatatagatgtaatgatatttgattcttggcattggtggattcacacaggaagaaaacaaccatgggatttgattcaagtagggaatcgtacatatagagatatggatcgattggttgcatatgagatagcattgaatacatgggccaaatgggttgattacaatattgatcctacccgaacaagggtgttcttccaaggagtctctccaggtcatcaaaatccagcgcaatggggtgagccaagaccaaacttatgtgaagggaaaactaggccaatattgggattcaggtacccaggaggaccactcccagcagagttggtattggagaaagtgctaagagccatgcaaaagcctgtgtatttgctggacattactaccctatcccaactaaggatagatggccacccgtctgtttatggctttggagggcatttggacccggattgtagccactggtgcctagctggtgttcctgatacttggaatgagcttctgtatgctattctcgttaaaaattaa

SEQ ID NO: 61401 - DNA, 183 bp, Glycine max
  Peptide Sequence Number=SeqID_178179
atgttggtggcgactccgcgcatctttcctcctttggaaagcgcacccgtgagcctcgccttcgcccgcccgcaaaagggcatgttgcgacagttggcgactccactggggatctttttggttcatgggaatttaaggagtggaggtgaatctatcatcatgctaggtctccgacttgcttga

SEQ ID NO: 61402 - DNA, 139 bp, Glycine max
  Peptide Sequence Number=SeqID_178180
agaagcttggttgtgcttccctggaattgagtgtgggaggggaagctctaaaaaaggaggaaagggagagccagagaaagaggcaagcaatgttaggctgccacgtgtacgtatgatcaatgcggcagcgacaggttaa

SEQ ID NO: 61403 - DNA, 287 bp, Glycine max
  Peptide Sequence Number=SeqID_178181
tacctccagactccatccctacagtagagcaatttaatgaatgggtagcttggccagggactcaacctcctccacacagggacgatgaggatccagccgctcaggtaccacatcagtcatcggatgagtcatcagagtcttccacccctgagccattgatcaggaagaggaggatagttgtaactcaggaagccgcaaccactcctgaaaagtctcctgaggccactccagagcctctgacaccaatggcagataccacttccccacaactggcagcagatccttaa

SEQ ID NO: 61404 - DNA, 423 bp, Glycine max
  Peptide Sequence Number=SeqID_178182
atgcggggttaccttatggttacccgcacctttcgtccaccaagggcaaacgagcccgttgacgcacagagactaacatcgtcttctgcaacttttgtcgtgttgacccgtgaaggtaacattatggttacccgcacctttcgtcaactaggggaaaacgagcccggtgacgcacagagactaacatcgtcttctgcaacttttgtcgtgctgacccgtgaagggcaaacgacccttgacgcgcagagacttacatcttcttctgcacctttcgtcgtcctgacccgtgaagtcaggttacatgcggggttaccttatggttatccgcacctttcgtccacctggggcaaacgagcctttgacgtgcggagactaacatcgtcttctataccttttgtcgtcctaacccgtgaagtcaagtga

SEQ ID NO: 61405 - DNA, 219 bp, Glycine max
  Peptide Sequence Number=SeqID_178183
atgaagatacggttcttgtatctaaataagaatatccctcaccgagtgcaaggtttaatctcatcatgggtactgaaggtagaggataagccccttccaactaggtttgctatattagagttgagagatcaatctcctaatctcttgttatctctttgtctggtggtgaggaaggaaagggagggaatgaaagtgaatgagaaaagaaaagagaaatag

SEQ ID NO: 61406 - DNA, 453 bp, Glycine max
  Peptide Sequence Number=SeqID_178184
atggggttgtacattcaagatgatcaatctactcgcctggtggccttgggaaaagtatatgagggggcgccaaccatacaccacatgccttatgcaaataatgtggtgaaggattcacagatacatccaaagaaaaaagtagaacatgttcataggtcgaatcccattggtgaaattaaccccttaagttatttgattaagaatttgtatgatctttacaagaagtctcttgagttgttgtgggatggggccattggtgatgatgacatgttcaagagcaagggcaaggatccacttgaaggacttggaggacctatgacaagggctagagcaaggaaagtcaaggaagctcttcaacaagtgctgtccatactatttgaatacaagcccaagtttcaaggagaaaagtccaaggttgtgagttgtatcatggcccaaatggaggaggactaa

SEQ ID NO: 61407 - DNA, 429 bp, Glycine max
  Peptide Sequence Number=SeqID_178185
atggcagaagaccacccacagaggatgacgctagaggactactctagccttgccacacctcagtacttcaccagcatagccagaccagatgtgcaagcgaccaatatttcatatccacattccctcatccagctaattcaagggaatttatttcatggtctgccgagtgaagatccatacatacgcacacctggccacatacatcgagacttgcaacacggtgaagatagcagaagtgaagcgaaaagatggcttcactcattcaaggggaatagcctgcggacgtgggaagagatggtggagaagttcctgaagaagtacttcccgaagtccaagaccgctgagtggaaggtggaaatctcatttaatcatgtagaagaaaatagaaataataattcaagcacgctcaacaaaagtgttcataagtaa

SEQ ID NO: 61408 - DNA, 456 bp, Glycine max
  Peptide Sequence Number=SeqID_178186
atggtgttagatttggtcaacttgaaggcaagatttgggtggagtgacaaaagcttcactgaattgtttatcgtgttgaagaagatgcttcctaaagataacacattgccaaaaaatcaccacaaagcaaagaagatattatgtcctatgggtatggagtaccagaaatacatgcatgctttaatgattgcatattatacaaaaatcagtttcccaaaatgcgcaagtgccccatatatgatgcaaaaaaccttagatggcatgcagatggcagaaaaagtgatggatttctttgacatccagttatgcatgaagcacaaatacattatgttgtgtatgatgatagcgggtccaagacagccaagaaatgatattgatgtctatctttgtcccttgattgatgacttgagaagattgtgggtatacggggttgatgtgtttgatgagaatctctag

SEQ ID NO: 61409 - DNA, 243 bp, Glycine max
  Peptide Sequence Number=SeqID_178187
atggaacaagaaattattaatactgcctgcaagacagtggttaggaaggaatcatttatgcaaggttttggagcaggactaaggtcatcatcatcaagctcagaggaggagcggttgaaacgcaaggagatagaagctgacgtagctccatgtggagctagtaggccttggatcttcttcatcaatggagtcctttgtttcttgaagatcaatggcagtggaatgaagatggaagaaagatga

SEQ ID NO: 61410 - DNA, 390 bp, Glycine max
  Peptide Sequence Number=SeqID_178188
atgggtgtttcggtctttttctctttgttcatgtggggtgggatatcgccagtcgagaatgactttgaatggcaattcaaaaggaagagacaccaaaaatgggttttcctttgccgacagtcacttatcttgccgaaaatttatctggttttagcattctatttgctctcccttgaggagattccgctgtccttttcttcgggggaaatgatgaggattcttttgataggccaaggttcaaaaaagtctaaggttgtgtttcaatggggtcttttatcgtgggaacccaatcttgatatctggggcaaaacaaatttgggtgtcaaggtgtcggtctcaagccgaactcccatattactccacaaggcacgcgtgacaatgatgatttga

SEQ ID NO: 61411 - DNA, 237 bp, Glycine max
  Peptide Sequence Number=SeqID_178189
atggcaaagagggaattagctgacagagaaattgtggagtgtggggtacttctgttattggttacaccgttaagagttagagttcaacaccccaccccccttgcccacagttaccagccacaactacaactaagggttgttagccaggttgaatatccgtcactggttgatctgagggggcttcttttggacttagttgctataaattggtttggatccactattgttaaaatttaa

SEQ ID NO: 61412 - DNA, 510 bp, Glycine max
  Peptide Sequence Number=SeqID_178190
atgaagcttttgatgattttcaaaaacttgccaagaacacctcaacaaaatggtattctggagaggaaaaatagatcccttgaagaaggagttagagctcttctaaatgaaacaaagttaccaaagtacttttgggttgatgctgtgagtactgtttgctatactttaaacatgaaaatgctttggaagatgaagatggaggtttttaggatatggattctgctcttgaagatgaaaccaaaattgaaaagcttgaacaaagaaataaaatcactgccacacctcctaaagacctccctagagaatggagaactcaaaaagacctttccttggataactgtcggaacatgcccttttgcgggcgagcgaggcgaggctcacgggtgcgttttccaaaggaggaaaatgcgcggagtcgccaccaacgtttatttgtggaaaacgtcggaaaaatcgaaggaaaccggtcataaagaatattccaagttcgggagttgtatttacgtttga

SEQ ID NO: 61413 - DNA, 351 bp, Glycine max
  Peptide Sequence Number=SeqID_178191
atgtcgccacacgggggcgacatggatgggggtgaaaaaaggaaagagagggatggggtttctcttgcttttggcatagcgggccccggcgggaggcccgcacgacgggctattagctcagtggtagagcgcgcccctgataattgcgtcgttgtgcctggactttatctctcgagcacaggtttaggtttggcctcaatggaaaaaaacggagcacctaacaacgtatcttcacagaccaagaactacgaagatcgcccctttcattctggggtgacggtgggatcgtaccattcgagccttttttttcatgcttttcccgggggtctggagaaaattgcaatccaatag

SEQ ID NO: 61414 - DNA, 408 bp, Glycine max
  Peptide Sequence Number=SeqID_178192
ttatatggagtgcacttcgcccccaccaaggtcatcaggccccctactaaccaagctttcatcaagaagtactgcgcccccaggcaggcgcagggtgggacaccacaacagcctggggatgttcgacaacgagcaatagacgcatcgccaccacctccaaaagctggagcgttgcctacaacccgtggtcgaccagcaggcgaccaattccaaagccaaagtaggacacacctagttgttcatgatcctaggaatttaaataaaacaagcacaagctcggaaggtagcaagataccttggatatgcatgtatatagcaaaaataactcacaatatatgtaacaagataccttggatacacatgtatatagcaaaaacacctcacaaaaatatacatatgattaggtag

SEQ ID NO: 61415 - DNA, 1055 bp, Glycine max
  Peptide Sequence Number=SeqID_178193
atgccgcgaaagcccaggccggagaagaagtgcccgtcggtaaagccttcgcccaacagcatttcgctgcgccagggcaagatcgcgcgctgtcgagtcgagatcgcgggtttgcccctgtcggtaactgacgtggtactggttgaggttgtaattgacgaaggccatcgattcgccgctgtccaggctggcgggattgacgctgccgcgcggccggccgttcaacagcgcctgcggaatgctcagatccagccgcagccgcgagatatcggcgttcaccgtgatgtccttcagatcccggccgggcagcaggcattccgcttcggcggccgccggcggatttttcagcccgaagcgcgtcagctgcggccgatcgaaacagggcagcacctgtttgcctgcgcgtacgaagcgaatttgatcgcgttcgagaaactggccattgaggtacagatcgatctgatagctgcccggagcgacggcgtcctgttggttgaactggctcagggcgctgttgctcagcacgctgccgcgcagcagcgcgggatcgaaggtatagccgtcggcggcggcgcagcccagcggcagcgccagcagcgcgcaacaccagcgtgcgggcagcggcgccgccttgcgagcatcgaacatgaatacctccctgtctggtttcagcgcgcgacgttcaggatccgcctgcgggatggcgatgcgcttcgcgccgctcaggatcgcggcctggctgatgttggcgtagtagccggtcgggttgtcgacgcgcagcgcgttgccggcctggcgcaggctgagccgatcgatgacgtggttggcgtcgccggccagcccggcggggcgatagaacaccttcagccgattggtgaccaccagcagcagtttgttcttgtcgctgtccgtctggcgcacggcgggcacctgcaggaagttgagatagaacagcgattcgcgatcgcgcggcagcggctggccgacgaacgacagccgcaccatctgcccgctgtgcggattcatgcggaagatctgcggcgaggcgacgaaag

SEQ ID NO: 61416 - DNA, 517 bp, Glycine max
  Peptide Sequence Number=SeqID_178194
atggacccaaagaagctttctgctaaaagagccaggaaagtcgctataggagatggatcaagtatggctccacctgaaaggcaggtccagctagcagaggggaattgggtgcggatcatgcgcactagcatgaccactctaactcaaatctggacgacctttctactcaagaacatccttccaagcgaccacaactatgatctcacgctacccaaatgtcagttggtctacaacatcatgaccaagatcagtgttcatgtggcgcagcttatcttagatgccatccaccagttcgtaggtattgcacctctaagacacccagtggacccagagaagtccaacagggcactaggatttctgacattgattccagccactgtcgcatggcctagggacaagcccaactttcaggaggaggcagatcctacagatgctcaaggagctgcccaagggaacgaaggtggagctgaggatgatggagacatggcagatttgtttgatttcttcattggaggag

SEQ ID NO: 61417 - DNA, 267 bp, Glycine max
  Peptide Sequence Number=SeqID_178195
atgtcatcgttgaatatgcgaaaaggatttgaaggccaaaggataaagagggaaatatccaccttgaagctgctgaagcatccgaacgtgaggaacttagatcaattggaagacttactcaacaaggttaaattgaagaccataagtactgaaccaccttctgcatctattgctggcacaagttggtgtatctttggtgtttctgtagattctgtagttgctgcgttacaatttgtggctccctctgcaaagggattctttttgtaa

SEQ ID NO: 61418 - DNA, 183 bp, Glycine max
  Peptide Sequence Number=SeqID_178196
atgacattgtggagacaactatgcatggacgttcaagaaagatttgttaagaagcaagctgctaatggagttgctcgtgagttagcaaggatgacttcgttgttccctagcctatactctattaatcatgtaattccttgtattgagcattgtagaagcaaacaaaacaagaagagaagttga

SEQ ID NO: 61419 - DNA, 600 bp, Glycine max
  Peptide Sequence Number=SeqID_178197
atgaacaatatcactaataatcttaagctgccaaagtcaaacaaatattacttaaataacagaattatcagtactctaaaatctaaaaattacttcaggggtcaatctagaacagtgcacaacaacaaactaaatggacaatcaattcacttaacgaaaaatcagttctgctactgcctactcgctttacaaatctgttacccctcatgtgccttgttaaaacacttgtttcagattgttcataaccaaattgaagaccatgacaatgtaattcttcctagcctgggcctgattcctaaggatgaaactgttggtgggaaggtggctgtgcctgatgctggaatagctgtggcggctgaggctgctgctggaactgcagcgtcggctggtgatggtggaactgcggcagatgaaatggaggatatgtttgctgaaatattggtgcctgtggctgtggcggcagttgttgtggtgctaggtgttgctgtggtggctgctgttgtggtggtgggaactgttgctgcggtggctgctgctgctgctgcagtggtggctgctcctcttgcggtggaagtgtttcatcccttagtggagcattga

SEQ ID NO: 61420 - DNA, 132 bp, Glycine max
  Peptide Sequence Number=SeqID_178198
gggtcaacttctgctagtactactcaaaatgctgctaatgaagatctcaggaggaagcttgaacactttttcttaagcctcattttaaccatgaaagtccagtcactgcaattgctgccattcaagagttag

SEQ ID NO: 61421 - DNA, 345 bp, Glycine max
  Peptide Sequence Number=SeqID_178199
atggcttcgagaaagcattccacaaagaaatctaggaaggacgccacagccgaagggactagtgctgctcctgagttcgatagccatcgtttcaggagcgctgagcaccaggacgacgagtacacagatttccaggaggagatagctcgccagcgttggacgttgctggtcactcccatggccaagtttgatccggatatagttctcgagttttatgccaatgcttggcctacagaggagggcgtgcgggacatgcggtcatgggtaaggggccagtggattccttttgatgcagaccccctcagtcaattcctgggatacccgctagtgttggaggagggctag

SEQ ID NO: 61422 - DNA, 351 bp, Glycine max
  Peptide Sequence Number=SeqID_178200
atggttggttgtgaccctaaagggaccttctcagttggggctaagctttcccgctctaggatcttttttggcttcctctcggactcgccatacgaggtcgccagtctccttgttgatgattccccaccttttatggggatcatggtgtctgtgccatatgcctttagacttgtcaagtctagtacgcagggccctgagaatgactcgattagttgcctctgcatgtccattagtctaaggatgttcaacagagctcctagggcctttggtagcagtcccagtatgtccattcccacatggcgaaagggcaagcgccacatggcgaaggaccaaggggagcttagactgtga

SEQ ID NO: 61423 - DNA, 204 bp, Glycine max
  Peptide Sequence Number=SeqID_178201
gtgaaaaagaggctaagtcatgaagtgctaaaagtgacatttgagcttagctcattagttaggctaagcgcgcatccaccgttaagcgcagcttcagcgcacttagcgctcagcgcacgactggtgctaagcttaaatccacttactcgcgctaagcgcgagggtggcgctaagcgcaacgttgcgggttcagagcctatttaa

SEQ ID NO: 61424 - DNA, 216 bp, Glycine max
  Peptide Sequence Number=SeqID_178202
ggtgtcacagatagagatcctagaggtgaaggagacatcctcaccacttgtatatttgcaatctttcatcttgttcttctctttgttgttaagaaggcttcctgggctgagttgtcgtgctttaatgaggaattggggtgcgataagttagttgagtatgtgcgtcttaatgcggtcttggttgagttaagtcttttaagaggaatctgcggatga

SEQ ID NO: 61425 - DNA, 366 bp, Glycine max
  Peptide Sequence Number=SeqID_178203
atgtcatttatctgcttttttagatcattgatttttcttgcagtaacagacccgttctgttatcatagactacttttaattgacgctgttcttgaaggttgttcgggttatagcaactccagtgtagtttacaaaagcaaaggtgaaacgaaagatattgagctggtagaggaggaacaagcacaaattggtgctgatccttctagtgagacctccaataaatctgagaattataaggaggaagcacggaagaaaacacagaagcataaaccaaagagggtggagagtgtcaacgctgatgcagaagcctttgttgatgactggaaaattctgattgctctatgcattgtgaagctgaagcagtag

SEQ ID NO: 61426 - DNA, 270 bp, Glycine max
  Peptide Sequence Number=SeqID_178204
atgtcatccgcctttacttttcaaagactatcacagtcttttatcttgcagagacaatcaagcttgcctgggcgagctgtcatgaccctaaatgccttgttttgctataaatatgatgtagctccattggagcttgtaggcctaggatcttcttcatcaatggattcctttgcttctctaaagatgaatggcagtggaatggagaaggaagagagagaggagacgccacttcaaggagaagatgagtctagaagaagcttaccaccatag

SEQ ID NO: 61427 - DNA, 420 bp, Glycine max
  Peptide Sequence Number=SeqID_178205
atgacttggggtctatttcctcgattctgccttttgaatccaatgcctgtattaagaatggtggataaggttcaaggaaatgcagctcacagaatgcaagctaaatcagttgcttatcacattgtatcttcaaaagagcaaggtagaactccttatgggaaaaaagttaagggattcccagtctggctttacagaagaaaaatagattttggatattcttgtaaatctaaccatggcattgatatcaaagagattgcacttaacatgattctagttatgaaagccatactccaagaggattgggctagagctgctaaagaaggccttggggttctcatgaacccctggaccaagctaagctgtagcttctttaggaatcttctcaaggaagcttctcaagaaggtgagcttagttattag

SEQ ID NO: 61428 - DNA, 405 bp, Glycine max
  Peptide Sequence Number=SeqID_178206
atgggagctattgctggagaagagctgctaaaatgggagaagatgcaaggagtgagtagtcgcaaagagaagattctggtgtcaataagactaaggcctttgaatgagaaggaaattgctgctaatgaatcagcaaactgggaatgcattaatgatactaccatcttctgtattaagggaagacatgggcacatcaattacagagattccaagttgacacgcatactgcaaccttgtttgggtggaaatgctagaacaactatcatttgcactttgagccctgcacgtagccataatgagcaaaccagaaacacacttctttttgcttgttgtgaaaaagaggtgaccactaaagcacaggttaatgtcaagatgtctgataaggcattggtcaagcatttgtaa

SEQ ID NO: 61429 - DNA, 666 bp, Glycine max
  Peptide Sequence Number=SeqID_178207
atgtcgaatttgtacggggattataaccaaaagattgattacgtgttcaaggtggtgttgattggggactccgcagttggcaaaactcaattgcttgcacgctttgctaggaacgaattcagtcttgattccaaggcaaccattggggttgagtttcagactaaaactctcatcattgataacaagatcatcaaggctcaaatatgggacaccgctggccaagaaagggcagttacaagtgcctactatagaggtgctgttggggcaatgttagtgtatgacatgactaagcgccaatcgtttgatcacatggtaaagtggttggaagagttgcgaggccatgctgaccaaaacattgtgataatgctaattggtaacaagtgtgatttggggagcctaagagcagtgccaatggaagatgcagaggagcttgcacaaagagagaaccttttctttatggagacatctgcacttgagtccacaaatgttgaaacttgctttttgaccattttaactgagatatatcgaatccatgccaagaaatcactcactaccagtgatgatgatattgggggttcggggcttctcaagggaagcagaataattgttcccaatcaagagatatataatggtggaaaaaagggtggttgttgttttgcctcctag

SEQ ID NO: 61430 - DNA, 405 bp, Glycine max
  Peptide Sequence Number=SeqID_178208
atgcttccttttgagttccggcatgtcacagaacttcacgaattgcctaacgatggatgccaagtacctcaaaatggtcaaatgaaagttgcatgccaccaagcaaagatgttttcaattattcacagggagaaggatattagggagctaactaagcaacgtgaccttgctcaatcaaaggttgaggatttgcttcacatggtcggaaaggatcagatatctggaaaagtagtttctattttgaaagggaagatatctaggaagatgattgttcagtatcagagtcatccagcatttgtggtcctcatcgtcctaatacacacattagagacttcaacaatcctcattataatggtagagatagtgatcctgatgttgttggacaagtggcctcagaaatattaa

SEQ ID NO: 61431 - DNA, 1610 bp, Glycine max
  Peptide Sequence Number=SeqID_178209
atggagggaagagagagcaaatcttctctcacctcacaaacggaacctcgcgacaacccccattcccgtttctccactccaatgcaacaacaccaatctcatcatgagttaccgatgtggaactctaaatctgattggagaagagtacagaaagaaatggtggctttgaagaaggcatatgcggatgtgattctgaacactgtgaaggaggctgcaggtcgggtaatggtggcggaaaggagagctcttatgttccagcaagagcatgcttcatcgaaagaagaggctcttcatatgttaatgcgtttgaagcagatgatggatgctaagacagctgaagcagaaaaggcatcattggagaagcaaagaaaaattgatgagcttgaagcacaattgaatgaagccgaggatatcataacagatctaagggcagagttgaagcttgtatatctggagttagagatggcaaggaataaccaggtccggcctttgagtggacagaaatcacagaatgaaaagcaagctgtaacttttcaggagagtgcaaaacctgagatttcaatatccagtcctcataaagaacttagatgtgtaacaagctgtgatgtggcaaacaaatcattgactatgaacgttttagataataagtgttgtaatgcaaaacaacaaactgagcaattgcgcatctctaatttggaggattcttgtggtcatgactctgactttgcttccatcatcacgaaaagcaaggaacctgaacttttccgaaatggatttactcagagaatccatgcactcgaaggaaatttgctggatgaaaagctgctcaagcaagatgtacacaatcaacattatggtaaaaaactcaggatcattgctaaagatagtaatgggcaagttgcaaaatatagtgctttgactgagaaaatggaaattaagaagcacattaagcaccataaaataccaaaacggaagatatattcctatttctggtctcactttctttcttgtaaaattcatttaaatgacaactgtaaatccagcaaagttgtgtgctctctaccttctatcaagcttagtgccattagcaaatggaaaagaaagagaagaagacatccacatttgggaatgaaatcttttgcttttaggagttgtaaaccatcattttctcttaagcagtgcccatctgtctctgataataaaaaatgttgtgaagatgaatatgatgcaaagatgaagtcagtggcacctttgactgatgtagaacctgtgcttgggaccactggtgttacagaaagtgtccaggctgttaataaattcaagcttgtggagaaggcaattgagaaggataatgagttattaaatttagaagaaagtgctgcacagaatctaacaggtccaagttctgatatgaaagttgaggttttcgatgttccatccacgaatactgatttggaagatgcaaaagcttttgaaaaaaatgatagatctgccagtcaagtaaatgacagtaggcctctgaagtatacattccaaaggaagcgaaaaaaggaatccttgggaaacacagaccaaaacattgattctgagaagcgtatagtgaagaggag

SEQ ID NO: 61432 - DNA, 814 bp, Glycine max
  Peptide Sequence Number=SeqID_178210
gcttcggcacgctggacgccgaaaccctcgataccgcgctggacgcgctggacagcctgaacgcctccggcaaaaccattggcgtgatcagccacgtcgaggcgatgaaagagcgtattccggtgcagatcaaggtgaaaaaggtcaacgggctcggcgtcagccggctggaggcgcacttcaggctggaatgatcacgccgtgcgcggcgcagaagtgtgaccgcggcggcactccgcggcataacaggattgttactgatgctgaaacaccgggaaagaccatgaaaatcgctaaaatactcaataataacgtggtgattacgctggacgaccgtcaggaagagacggtggtaatgggaaaaggaatcggctttaaaaagaagcccggcgacacgctggacgaaagcctgatcgaaaaggtattcacccataacggcggcgaaatcgccgagcgctataaagagctgctctccgagatcccgctggcctgcgtcaccaccgccgaccggattattaccctcgcccgcgaacggctgccgggcaagttgcataacatcgtctacatcacgctgaccgaccacatccatttcgctctgcagcgccacgcggaaggattggatatcaaaaatgcgttgctgtgggagattaaaaagctctatcaggccgagttcgccgtcgggctggaggcgctggccttgatcgccgagcggctgaataccgcgctgccggaagacgaggccggatttatcgccctgcatctggtcaacgcccagcttaacgacgagatgcacaacacgctgcacattacccgc

SEQ ID NO: 61433 - DNA, 723 bp, Glycine max
  Peptide Sequence Number=SeqID_178211
atggctttagttgctttctatcaaggacaagtgctgaacaagtttagatcagctgcattacttagcccaattgcccatatgaatcaaatgacatcaatactaacaaaaattgctgctgttgcatttctagctaatgaaatatgctggttaggactccgcgaatttgttccaaacggggatgttgcagtaaaatttgcgaaagacttctgccatattctaaacttgaagtgctcaaacctaatgacacttttcgcaggtcccaattgctgcttaaattcgtccacgatagatgtctttcttgatcatgaaccacagccaacatcaactaagaatttggtccatctatctcaaaattatagatatagatttgttgttgatgtttcatgctatggatttggagcagtgatcagaacaggaacaatagcaaaatatgattatggtgatcaaggacaaaatatgcagcactatggacaaccacttcctcctctttatgacatgaccggaattccgaatgaatttcctcttttcctcagctatggagggcaagatacgctatctgatgcaaaggatgtgcaggttttgctcaatgacctcaaagatcatgataggaacaagctcgtggtaatgttgaacgaagactatgctcacgttgattttgttatgggtgttaatgctaatcaaatgatctatgatcctatgatggatttcttcaaggttaattga

SEQ ID NO: 61434 - DNA, 315 bp, Glycine max
  Peptide Sequence Number=SeqID_178212
atgagaattgaggagtggatgcactggaggttgattaaaaacattaagggaggactggcagaagtaacagacacagtggatgacgatgatgtactagatgtggaaccaaatacagacttgcttacagagtatatcgtcgaagaggaatcagaggtgccaagttcaaaagatgtgacaggacttgaagaaggaaacaatgaattcccagaaacaaaagctacacttgctgcagggctagacttcaaaatgattagtagacaacacactccccttcacgagatggaaggtggagttaacacttccagcttgggatga

SEQ ID NO: 61435 - DNA, 1131 bp, Glycine max
  Peptide Sequence Number=SeqID_178213
atggataatgttagagctatcaaagcaattttgagggcctttgaacttgtatcagggctcaaaatcaactttgctaaaagtgggtttggtgttttcggggtgtcggatcaatggagaattgtcgcaactgattacctcaattgtaacttgttgtcattccctttcacataccttggtattcctattggagcaaatctgagaagataccagacatgggaccctatcatttctaaggtgcccaaaaaggtggtggacaagttggtgagtctacaaaggcgtttcctatggggtgggggtcatggtcaaaacaagatatcatgggtcaagtgggaaactgtatgcttgtcaaaagaagaagggggcttgggagtcaaagacataaattcctttaacatgtcattactgggcaaatggatagggaatctatttcatcagcaggcggaattgtgggctagggtactcgaatcaaaatatggaggatggcggagtttaagtgaaggacctagagcaaatggtgattctatatggtggagagacctaaagttcgtgtttcagcagccacaacatggagctatgatgaagaacacaacattatggaaggtaggatgtggggataagtttaaattttgggaggacggctggattggtggagaggatacgttgttatcaagatatcctaggctgcggaggaggccattgttcgatagtgaaattgatatggcggtctcattcctaagggatgttgaaggtcacaggattcagccccagaaaggagatgagtgggatggagcatttgaggagttgtggaaactaaaaattccgtctaaaattgctatatttgcatggagattgattagagacaggttgccaacaagagtaaatctgggaaggcgacaaatagaggaaaataatttcagtttggtgggaatcaatgtcgtgggtgaatttggtgagtgttcttccaaaccacccaagacatcacttcctccaacacattgtgccaacggaatcctagatgatgcaattttcttactatggacttggctcaagaatttagagaaggatttcgacatcaactacaatcagtgggcttccaatatcagggatgggcttgtaatcacagcaggatag

SEQ ID NO: 61436 - DNA, 378 bp, Glycine max
  Peptide Sequence Number=SeqID_178214
atgaggttgatgtttggactcaacactgagcgagataaccagctcgatgcagtttgcgacaaagttgttaaggaagatgaaggaatggatgcaaatccaaccacttctcaagctgaaaagaaaactatgaagaaaatgaatgctccttcatccaaggttgttcttgctcaccaacgtccacctcccactcttgttgctcctaaagcaatagttgtaatggcccatgtgtccagaagggctacacctaagaagcagcaacctttgtccactattgaacgcctaagggcacttagtgagactgatagtgatgatgaccaagccttggtgtttaggaagagaaaagttgcacccccttcatatgagaccattaagccttaa

SEQ ID NO: 61437 - DNA, 303 bp, Glycine max
  Peptide Sequence Number=SeqID_178215
atggtgctaaaggaaggtgttatgtggaagatgggaagtggggctaatattcacgtgtgggatgaaccatggttaagagacaaggagagtgcttatattcgaacaccaactattaaaggttgcttagacttgagagcgtattcagcttcaccaagagttggagaaattcatcaattctgcagagttgtgctcataattgttcttcaacatgttttcatccttgcagagctagcaacaacagcgtatggccatgctagtgtggagtacctagaggagacgcaaccacaaggtttaggacaataa

SEQ ID NO: 61438 - DNA, 498 bp, Glycine max
  Peptide Sequence Number=SeqID_178216
atggatgatgaagttcagcatgaagcacctccatccccatcaaccttgatcgcttccaacatcaagaatgcttacaacattgaacgaagagtggacgcaaaatttcaaccaccagtggattggatgaaatttcctttagatattgaagaaaagaaagttacatgcccttcgtccatccatagagattctcaagttgcatcttctacttctactgagttggagcccccaaccaagattgaagttcttcctccactaccatggaagcgacttcaccctaaggtgtccaaaccttcgtccattgcagcccagcacaaaagtgtctacaagattccatcagggacttgcaaagaaaatatgagatacaataaggacatcattagatggtttcagaaaattgatgcccaacggattgcccatcctttattgatttccaaccaccttttctatgtccaaagcacatccaactattcactccaacatccaagttcattcctttag

SEQ ID NO: 61439 - DNA, 300 bp, Glycine max
  Peptide Sequence Number=SeqID_178217
atgagaaggaaacgcaagagctggacatcaaaggatgaaacaagggatgaaacatgccttgaagaaaaggacgagacgtttgaaactggtccggcaagtttccagtggccggagggcagcgcgtggacttcacgcaccggaaacgaggcgctgttgtggctgcgctgctggtcacatgacttgcaggggtgggtcgcgctcctcgaggcgcacccaaccctggttttgccggaaaatttgacagcagcggcaaacagagacagtcagaacgggatcgtacccgctctgataccatgttaa

SEQ ID NO: 61440 - DNA, 519 bp, Glycine max
  Peptide Sequence Number=SeqID_178218
atgaggatgttgcggtggatgtgtggtaagactcgacaggataaaattagaaatgaagctattagagagagggttggagtagcgcctattgtagagaagatggtggaaaatagacttaggtggtttgggcatgtagagagaagaccggtagactctgtagtgaggagagtagaccagatggagagaagacaaataattcgaggcagaggaagacccaaaaagactataagagaggttatcaaaaaggatctcgaacttaatgatttggatagaagtatgaactcaaaatatggatcaaaacttttgataaatgaaaagattctagagattgaagacttcaaaaagagattaaaaagcgattggagctatgagggatatcccaactataaaaggaaaaatgattttgcagaggcaaaatacacatgtcttggatgtggcagtttagaatccaagtcaaagattcataccaaaatcaatattcaaatttcattctatgggattgagaatgttcccacttga

SEQ ID NO: 61441 - DNA, 442 bp, Glycine max
  Peptide Sequence Number=SeqID_178219
atgcttataaggggattgctattggcactaccctcggatatgctaggtgcacccagcaatattgctggtgcacccagcaattcaatgaaagcttcttccccgacaagcttcttccccgacaagcttcttctccgcgagcttctccgacagcccttggacccatttgctttcgaggggttcttccggaagttccggaagaacgttttccggaaagtttccggaagaagtgttcttccggaagtaaccaaacgtcttccggaagaacacttcttccggaagacttccggaaaacgtcttccgggaactttccggaagaagtggttcatccggaagaattccggaagactcgcacttccggaagaagtttcaaacttccggaagacctttccggaagaacccttcttccggagtgtttccggaagaaccacttcttccggaagtg

SEQ ID NO: 61442 - DNA, 603 bp, Glycine max
  Peptide Sequence Number=SeqID_178220
atgcttcttagagaaaccattcgcaagaccagggttttatttcacaagaccctccgaagcttcaagtctgtcatctttggagggtaccaaaaacttcccagatctctctccttcaatcctttcgtcggtcgaagtggaaatgcaagaacttacacaagcgagcaattctacaatgagttttatgacatgctgcagtctgatctgaacagaataaagaggagtgatagcaatagcatgagcaggtcgagagagcatgcaattggagatgctgtgaacactgaaattcttaggaagcaaagttcacaaaaaagcattgctgaagagggagtagtagtggaagagaagaaaaacaaagggagctgtgaaatgggaaagaaggaatgcttgaataattcaaaaagcatgaatgagggagttcatgatttggcggaaaagatgaaggaattggagatgatggatacgggtgatgttgagcacgagctagacattgaagaggcactccactactattcacgtcttaaaagtcctgtttatttagacatcgtggacaagttcttcatggacatgcactctgaattctctgttcaagagtcctctatcagt

SEQ ID NO: 61443 - DNA, 565 bp, Glycine max
  Peptide Sequence Number=SeqID_178221
ttcagttccggaagaaggttcttccggaaacttccggatgacgatcttccggacgaagttcgtgagtacttccggaattcccaaattctttttccggaagaagtatttccgtaaacttttcggaacaagcttttccggaaggtttccggaaatacttcttccggaagaagaattgttgaagggcaatttggccacttcactgtttgctgggtgccccagcaataatgctggagctgggcttgcccacagttatttatttccattgttaccccttaacatggggaagggaacagggagcttcggtaagaggaggaacaagacccacactctctgtgtgaggtgtggccgccgcagcttccacctccagaagagtcgctgcgccgcttgtgctttccccgctgcacgcacgcggaaatataactggagcgtcaaggcaattcgcagaaagaccaccggaactggcaggatgagatacttgcgtaacgtgcctcgccgtttcaagagtggcttcagagaaggtaccgaagctgcaccaaggaagaagggagcagctaccactgcatag

SEQ ID NO: 61444 - DNA, 614 bp, Glycine max
  Peptide Sequence Number=SeqID_178222
agggtgagactttacccatatactccagatactgtaggttgcccacagattacagagagattgaggttgccttatgcatactaggccgagggttcatcttgaacaccgagggccatcctggaaagattctcaagaaggatttgaatactctagctcaggtgtggagtgttctctcatactccaacctggcccccacatcacatacctctaacctgaaagtggacagagctaggctgatctttggcctaatctctcgcttggacatgaacataggagctcttatttcttgtcagatgacttttatagcccaatttaacacttccagacttggatttcctactctgatcactgcattatgtagagccagaggggttgtctctgaaagccttacttttgagcgcctaagcccggtcattaacttgacctacatcaggaagaactgttggaatctagaggatctaatagtttccatccgaggggctaggagggcaagggcaaggccagctgagcttccttccacttctgcagcttctactccagcagctccttgtgtcccagctcagacagattctcagtgctttgaagccatgcttcaaagcattcatcagggatag

SEQ ID NO: 61445 - DNA, 494 bp, Glycine max
  Peptide Sequence Number=SeqID_178223
ggtggaccctcaaaggattgcacatcctcgccatcagagggctgcaagccctcaccttcaaaggactacacatcctcaccttcagagggatatacgtcctcaccttcaaaggactacacttcctcaccttcagaggactacacgtcctcgccttcaaagggctacaagtcctcgccattagagagctacaggtcctcgtcttcagaggactacacgtcctcgccatcagaggcctacacgtcctcgccttcagaggactacatgtccttactttcagaggactacacgtcctcacctttagagggttacacatcctcactttcagaggactacacgtcctcgccttcagaggactacacgtcctcgccatcagaaggctgcacgccctcacctctaaaggactgcacctcctcaccttcagaggactgcacgtccttacctttagatggctgcacgccctcgccttcagagggctacacgcccttgcctattga

SEQ ID NO: 61446 - DNA, 873 bp, Glycine max
  Peptide Sequence Number=SeqID_178224
atggagaggtgttttcatgacaagttttacagacctcaacctgaggaaactatagctgatttgatgaatacaaaacaaatgttgcccgaagtagaatctgcagctatggtaacaggtaacgtccttcctcagttgaaagacaagttggtggctcatgaatatgttaatcttgatgaagagaatggtgagagttatgaagaggaagctaaaatcatggctgcattaaagcctagtaaaggcaaaagtgttggtgatgggaaggtcgaatatgactttgatatctctaagggaagaaatactgtaagtagcataattccaacaaccattttacgaccaattgcattgagtttcgacaagttgtacaaaaggactttgaaagaaggttgttttaagctagtcgacaagggtatggccgaaatggcagtggatggagaccctttcccaaagagaaagatgaagtatgcttggcagccaaaaatagaggtgaagcaagaaactacatggaccaccagaaggacttcagtgtttgaaaggttgcagtcttcacaattagcaagaggagtatgtgtgcctcatcagatccgaaagaggaaaggggaattcacgaaatttgataggataaaacgacaaatacccgctaaaagggaaacagttcaagtactacaaattgatgagagccctatcccaaaaaacagaaggagatgggctaagttgaatgttgtaaacaaaatgaagactttacatatcactgtcgacaataaggacaatcatcagctcaaaatgatcaggccctctactagaacaaaggagattgcaaagggacaaggttgtaaagaaaatgaaacaaacattgacaatgatggtagatcttaa

SEQ ID NO: 61447 - DNA, 1077 bp, Glycine max
  Peptide Sequence Number=SeqID_178225
atggaggaaagcaaaccaaagtccaatgaaatagatatgatcttggaggcatggttgaatgatgatgatttgctaggtcatgaagtagatgctataagtttaatccttaaggtcgacaaaagagtcaatatcacatttgacaagcctacaccagagatgaccaaacatttggagtctttgtatgtcaaggcccagataaatggtaaaacattggcaaagatagagagtttcactgggggagttactgctgcattaggagttttggtagctaaaatcacaattggtccaaaaaccatgtatttagcattcttcatagtagatgctaaaccaacctattctgttttgttaggaagagattggattcatgctagtcaatttctaccttctaccttgcatcattttgggaggaagattaggatgcttgaacctttgttttacttgccttacttgacccctattcaaatttctaatgactataaggaagaatcacctagttttgaggctcaagatcccttagaagaagtcaatcttggtacagaaacaaatgtaagaatgaccaagatcaatgaccataaattacccaccaaagcaagtttcaaaccacatcagaaacctcccaagcattgtaacccacaagtgttgcctcaaattaaggcagaaatagagaagatgttgggggtaagggatctaaatctagttactcccaaagatgagtatgtaatgcctatagctgacatgttggtagatgttgttgccaaacatggtgcgcttgggatttatgaatggttaatcatgtcgttcggattggagaatgctagacctacttaccaaagggacatgattcttatattccattatgccattggcaagaatatggagaaaataaggattcatggtctaaaaatgaatttggctaagtgtgctttaggtgtaccgactagcaacttttcgggattcctagtccatcaacaaggtataaaggtagacacgaataaagctaaagatattttagaagctagacctccccagaacaaaaatgagttacaaagtttaataggcaagattaatttcttgtga

SEQ ID NO: 61448 - DNA, 903 bp, Glycine max
  Peptide Sequence Number=SeqID_178226
atggcttcgacccttttcacaaagatgcttttgggccaacgattgatccatccttattcgttcctcactcaccagccacagattctctcttctctattcagtaaacggctgttttgtatacgagctgtcccggtctcagcctctacatcccaaaacatcaaaacaactggttgggctccttgtatggcttcttcctcagttggtagaagagctacatattcaacacaatctgtatcgacaaatgagccagttgtatctgtagattggctttatgataacctgaaggagccagatatcaaggtactagatgcttcgtggtacatgccggatgagcagaggaatccaattcaagaatatcaggttgctcacattcctggtgcccttttctttgatgtagatggaatagcagatcggactacaaaattaccacacatgctgccatcagcggaagcgtttgctgctgctgtttctgctcttggcatagagaacaaagatgatttggttgtttatgatggaaaaggattatttagtgcagctcgtgtttggtggatgttccgagtatttgggcatgacagagtttgggtattagatggtggcctgccgagatggcgtgcatcaggttatgatgttgaatccagtgcttcaagtgatgctattcttaaagccagtgctgctactgaggctatagagaaagtatataagggacaaacagttggcccactcacatttcagactaaatttcagccacatcttgtttggaacattgatcaggagaacaacactttggaaaaatggaggttgacaatgttggtagttgtagaagtatcaaaaattttcttgttagagtccataattagttacctcaaggatgaagttaggtttgaagtagcagctgcaatttga

SEQ ID NO: 61449 - DNA, 420 bp, Glycine max
  Peptide Sequence Number=SeqID_178227
atgcaaactgtgaagagtaagcagacaacagagatctgcatgaaggatttgcatgattgtggagaccagcagacaatgccagacttgagcaaaaatgttgctgatgagcaatttgatggaactgtacaagagcctcgaaagggaatcagaagtggtcatgtacctggtagcaaatgcatcccttttgcacagttgttagatagttcacagacattgttaccagcagatgagttgaagaagcgatttgaacaagaaggcatctctctggaaagcccagctgtgacttcatgtggaacaggcgtaactgcttgcattcttgcattgggtcttcatcgtcttagaaagtctgatgttgcagtttatgatggatcttggactgaatggggagcacaatcaaatacacctgttgacactttatga

SEQ ID NO: 61450 - DNA, 216 bp, Glycine max
  Peptide Sequence Number=SeqID_178228
atggcttcggaagcgttcagtatgtttgttgcccgcaacaatccgaagagaaacctcgtcgccatggcagccttcgagcacttctctagcagaagattcgaaaccatcgtctctagacgctccttatgcttcgcctttgtcacaacggaggaagaagaagacgacgacagtaacgatttcgatctcgaaacttcaggaatgtacttcttagcataa

SEQ ID NO: 61451 - DNA, 135 bp, Glycine max
  Peptide Sequence Number=SeqID_178229
atgaaaattttcatgtccctatttcaaaggtggaatgggtgtcgccagtggaagttgcgaggtggcaaagtgtatgtcgcgactgacgacactgtgcagagttgtatcgccaaaaccagtagcgaaataggctga

SEQ ID NO: 61452 - DNA, 474 bp, Glycine max
  Peptide Sequence Number=SeqID_178230
atgaggttagttggaatcttgctttgtgcaagtgctatgtatttagaaattaaaggagctttgattggcattatattttggattggaactgtaaactttcattttatgtctgatggaaagaattttgccatgtggacatggtggagtgacatgtttgacatgggttggttcatcgtgtgtggcaactggatgcgtggatggaattgtgagattatgggatattcggtctggtcaagaacacttcataataacaaagatgatgatctcaagaatcaaagaatgagttcaagatgttcaagattgaatcaagaacacttcaacgttcaaagagaaaatttgatttcaagaatcaagaatcaagtttcaagattcaagttccaagaatcaagatcaagattcaagactcaagattcaagaatcaagagaagacttaatcaagataagtatgaaaaagttttttcaaaaactgagtag

SEQ ID NO: 61453 - DNA, 570 bp, Glycine max
  Peptide Sequence Number=SeqID_178231
atgtcaggacatcgtgtccgacatcgtggatcctgcagcttcacttctgcacttgacttttatcttgcattgtacagcaattccagtattctcgggcaggatgtcaggacattgtatccgacatcgtggatcctgcagcttcacttctgcacttgtcttttatcttgcattgtacagcaactccagtattctcgagcaggatgtcaggacattgtatccgacatcgtggatcctgcaacttcaattcttcatttgacattttatcttgccttttttgcacattatcatgtccatgataggcttctcatccagattccattaaatgtgttggtttctcgccaagggtacatcctttgtggtacaagtagagggtacatctactgggttgttgtgactgagaacaagagagggtacatctcttgtggattagttcaagtggagggtacatccacttggttgttcaaagagaacaagggagggtacatcccttgtggatctttgcttgtaaaggattttacaaggttgaaaagaaatctcaatgactgcaagtcgcttggggactggatgtag

SEQ ID NO: 61454 - DNA, 231 bp, Glycine max
  Peptide Sequence Number=SeqID_178232
atgggcgacggcaatggccatcacggccatggacatggacacaacaatttcaggaacaaggtctggcgtatgagcgatggcccttattgtcgtcccaagcactggaagcacaacacctccattgccacggtctgcatcgttctcatatacatccccatcgttatgaaatctgctaaactcgagctgaatatgagcaaaattgcagaggataacgcaactatttcctattag

SEQ ID NO: 61455 - DNA, 695 bp, Glycine max
  Peptide Sequence Number=SeqID_178233
atatctggaacatacattgtcacatacttatgttgttggtgcaattgatgaaatggacattgatggaactgctgatattaatgatgagaactctgacaaaaccaagggaaaatgcaaattttatgtaggatctcagtcactaggataccgtagagaccatatggaggtgctatcacccttgaagaatggagttgttgttgactggaatattgtagacaacatatgggatcatgctttgagtccaattgtgaatgttactggacatgcactagacaaggattctagcacttttgattctaatataatcattaagaaggaagaaaaagaactccatggaacctctgaaagctctggaagttcaaaacttcttttggagcttcatgaaaagagatcagataatcctgaaaagattgaggcagagaaagctctgctgctattcttgtgtggctttgttgttatcaaggacttccctggatctggctctgaagtttcagcagagatggcagcagcagcactttatgttgctgataaacagaggttcgcttacacaattagagcagtacaaggcgcctttgatcataagttcaattttccatgtgcatatgggattgttgggcatttggaggttcctaagcccactttctacagtaccttatgtaatgtttactggactctgtcttcttggattcccaatg

SEQ ID NO: 61456 - DNA, 1440 bp, Glycine max
  Peptide Sequence Number=SeqID_178234
atggttgacttggccccaatcagacatgaagacataactaaatgcaaaactcaaagatctataaaagacacagttcaacgtgctccccgtctatcatttacttctttgaatctacatttcctcaagatgcatcctctagtgttcatggtgttcatgttattagccttatactctccttcttctatatccactagagaagccggtgaaggcctaaggggtttcagcatcgaccttatccatcgtgactcaccattgtcacccttttacgacccttcactcactccatcagaacgcatcacaaacgctgcctttcgctccagctctcgattaaaccgagtatcacacttcctagatgaaaacaatctacccgaatctcttctaatcccagaaaatggtgaatatctcatgacattatacattggtacccctcccgtggaaaggcttgctattgcagacacaggaagtgatctcatttgggtacaatgttccccttgccaaaattgtttcccccaagacaccccattgtttgaacccctcaagtcttccacattcaaggctgcgacatgtgattcacaaccttgcacatcagttccacctagccaacgtcaatgtggaaaagtaggtcagtgcatatatagttacagttatggtgacaaatcattcaccgttggagtagtgggcactgaaaccctaagttttggttccacgggtgatgcacaaaccgtttcatttcctagctctattttcgggtgtggagtgtacaataatttcacatttcatacaagtgacaaagtcacaggtttagtgggtcttgggggaggaccattgtcactagtgtcacaactaggtcctcaaattggttacaaattctcgtattgtttgcttcctttttcttcaaattccactagcaaattgaaatttgggagtgaagcaatagtaaccacaaatggggttgtgtccacccccctcataatcaaacccttgtttccaagcttttacttcctcaacctcgaagccgtcaccattggacagaaggtggtgccaacgggtcgaaccgatggcaacataatcattgactcaggcacggtgttgacgtatcttgaacaaaccttttacaacaattttgtggcttcgttgcaagaagtccttagtgttgagtcagcgcaagatcttccatttccgttcaagttttgttttccatatcgtgacatgactattcctgttattgcgtttcaatttaccggagctagtgttgcactgcagcctaagaaccttctcattaagttgcaagataggaacatgctttgcttggcggtggtgccaagctcactaagtggaatttccatctttggaaatgttgcacagtttgattttcaagtggtgtacgatctcgaagggaagaaagtttcttttgctcctacggattgcactaaagtttaa

SEQ ID NO: 61457 - DNA, 1271 bp, Glycine max
  Peptide Sequence Number=SeqID_178235
atgcatccttgggtgttcatgattttagctttattctcactttctactttatcctctagagaagcccgtgaaggcctaaggggcttcagcgttgaccttatccaccgtgactcaccttcatcacccttttacaatccttcactcaccccatcagaacgcatcataaacgctgccttgcgctccatgtctcgattacaacgagtatcccattttctagatgaaaacaaactacccgaatctcttctaatcccagacaaaggtgaatacctaatgagattttacatcggttcccctcccgtggaaaggcttgctatggtagacacagggagtagtctcatttggctgcaatgttccccctgtcataattgcttcccccaagaaactcctttgtttgaacccctcaaatcttccacttacaagtatgcgacatgtgactcacaaccttgcacattactccaacctagccaacgtgattgtggaaaactaggtcagtgcatatatggaatcatgtacggtgacaaatcattctccgttggaatactgggcaccgaaaccctaagttttggttccacgggtggtgcacaaactgtttcatttcctaacactattttcgggtgtggagtggacaataatttcacaatttatactagcaataaagtcatgggtatagcgggtcttggtgcaggaccattgtcgctagtgtcacaactaggagctcaaattggtcacaaattctcctattgtttgcttccttacgattcaacctccaccagcaaattgaaatttgggagcgaagcaataataactacaaatggggttgtgtccactcccctcataatcaaaccctctttgcctacctattacttcctcaaccttgaagccgtcaccattggacaaaaggtggtgtcaacgggtcaaactgatggcaacatagtcattgattcggggacacccttgacgtatcttgaaaacaccttttacaacaactttgtggcttcgttgcaagaaacccttggtgttaagttgctgcaagatcttccatcacccctaaagacttgttttccaaatcgtgccaacttggctatccctgatattgcgtttcaatttactggagctagtgttgcactgaggcctaagaatgttcttattccgctcacagatagcaacatactttgcttggcggtggtgcccagctcaggaattgggatttccctctttggaagtattgcacagtatgattttcaagtggagtacgatctcgaggggaaaaa

SEQ ID NO: 61458 - DNA, 216 bp, Glycine max
  Peptide Sequence Number=SeqID_178236
gaatataaagctgaatctcatcctgaaaatctacatgctctagttgtttctccctttgttcaagagaagctgtacacggaggaaaggtgctttgtgccaaaagaaattgtcaccactttggcaaatcatgaggatcttcaatcaagacctaccatccttgaggatcttaaacagctgattaggacagacattgagaagaaagcaaagaaagaataa

SEQ ID NO: 61459 - DNA, 213 bp, Glycine max
  Peptide Sequence Number=SeqID_178237
atgggtgccaagtacctcgaactggtcaaacgagggtcgcatcctaacaacggatggtccttggacgaaactaggtgcttctttgtccaattgctcttaaggtggtcggccccttgctttttgactcaaattcttcaaggtatggcaccaatcttcctttccaattccctatatggcaactcacaagcaaggaaacaaacagacaagcaataa

SEQ ID NO: 61460 - DNA, 332 bp, Glycine max
  Peptide Sequence Number=SeqID_178238
tcaaatataatctccatgttctgaagcgtgatgtcgtgacatctgaagcatttaagaaacatgctttaagggaagggagtggaaggtggaagacaaacatttgggttcattgtgaagacgaagacaaagttccactctggaagacacctctgataaaaataacatgcgatgatgatgaagagagattaagtctgaaagcaagcaggggctgttcttgttcttcaacttgccaaggctgctcaacttgttactgtgaagggtgcatcaagtgccgctttgaggattgcaattgccaagaatgcagagactttatgctatatgctaaaccttaa

SEQ ID NO: 61461 - DNA, 135 bp, Glycine max
  Peptide Sequence Number=SeqID_178239
atgatggcacatcacagatataatatcgaaacttccaacggtgagaatgctcggaactgggttgtgaacggggtgctcaaatttcacaaagatccaacggtgaatgagtccgagattgtcatttttctgagacag

SEQ ID NO: 61462 - DNA, 324 bp, Glycine max
  Peptide Sequence Number=SeqID_178240
atgaaatgcaactcttctgaatctcattcatgtctcaaatttattgtggcaactggcaactccttgcacacaggcaataaaccaagcaatgctaaagtgaaccagttagtgaaagctgcagaaaaatacactcttgcaaaccatctattttggggtttgtggggacttatttcgagttatgtgaacaaaattgactttgactataaggagtatggaaggcagaggtttcagcaatactggataaggaagcctactttattggactcaccaagcatcgtttccctagatgaaactgtgaatggattgctgtcatccttcacgtga

SEQ ID NO: 61463 - DNA, 657 bp, Glycine max
  Peptide Sequence Number=SeqID_178241
gttggagcagagtttgtggggactttcatattgatatttgccgcaacggcaggaccaatagtgaacaacaagtacaatggagtagagagtctaatgggaaatgcagcttgtgcagggttaactgtgatgtttatcattctgtccattggccacatctcaggtgcacacctgaatccatccctcaccattgccttcgcggcctttcgccacttcccttggacccatgtcccggcctacatagcagcacaagtctctgcctccatatgtgcatgttatgctctcaaaggtgtttaccaccctttcctctccggtggggtcactgtccccaccgtcagcgtcgcccaggcttttgcaaccgagtttatcatcacttttattctcttgtttgttgtcactgctgtcgccaccgatactcgtgcggttggtgaattggcaggtattgctgttggggctacagttttactcaacattctcatatcagggccgacaagtggtggttcgatgaatccggtgcgcacgttgggtccagccgttgcagcaggaaattacaagcatatatggatctatttggtggcaccaacgttgggtgctctcgctggtgctggtgtttatacgctcgtcaagctgcgtgacgaggaggccgaaccgccgcgacaa

SEQ ID NO: 61464 - DNA, 237 bp, Glycine max
  Peptide Sequence Number=SeqID_178242
atgaaacaagaaggtcgaagcctcacttgtgcagatctcaacttcaataatgatggtatgcatcaaagtcaaaggataggaaatttgagcacagacaatttaacttgcctgtatcaaatggtcaaagaaaaaggacaacatgaaggaggggaagacaataaatacgaagtagtcaacgaccataaacatcaaataagagatgaaggcaatgtagaaaaagaaagggcgtggtattaa

SEQ ID NO: 61465 - DNA, 238 bp, Glycine max
  Peptide Sequence Number=SeqID_178243
atggctttcatgatggaggccatgttaggaatgaggcaactcatggagaaaaacatggccaccgctgccgccgttagttcgactgccgaagcagacccaactctcctagcttccgtgcaccatcctcccccaaatacgataggacgaatgtcgcaacctccccttcgaaaaactggaaaagacgtggtctacgaactttatgtgaaaggtttgggagttgtatttacgcacggggaag

SEQ ID NO: 61466 - DNA, 282 bp, Glycine max
  Peptide Sequence Number=SeqID_178244
atgggttcatgtcagtgtcacaaaggcaacattgtttttagcctaaatggaaatgggtacctgaaaagggagaatctttggggaaggaagaagaaaaagaagaagattggagtatttgatgaggaaccaaaaacaaggatcttcgcgaagaacatgaaagggtgttgtgagtggctaaagaagagaaccaaagcctcagggacaacatcagctagtttgtctgactttcaaccagaggaatacagtgaacagaaacaccttactggttctctttggaattaa

SEQ ID NO: 61467 - DNA, 1381 bp, Glycine max
  Peptide Sequence Number=SeqID_178245
agatggaatgagacaagccgctaaaaccgatgtagcaactggggaagtaacatctctgggtcttggaaaatcattgaagtgtagagggacatcatcagtaacagtttcgggagatgatgcaataatagggggtcctatgagtctgcgtggtatgggtggtatgattatgggtttgggttctatgggggggggtacgggtggtattataatagggccatcatcagtaacagtttcgggttctatgggtggtattataatagggggtcctatgggtcctatgggtcctatgggtcttgtgggtcttgtgggtctgggtggtattataatagggggtcctatgggtcctatgggtcctatgggtcttctgggtggtatgggtatgggatctattacgggtgcgggttttatgggtggtattaacacaatcgaagcaccttttacaagttgtgaagttctagggttagtaggagtagttttgagtggggctgctgctccatgctctagcaagcaactatccatagaatccaaaaggcaaagagccaacacatttggacgatgcaatgcttgttcttcacttccactgctgcatgtttcagcaacatgccaagtgcattgtttcactaagtttttgaatataggagactcatacgcctctggttggctattaagcatagggttagtggcttcaccaatattaacaacttcttcaacgggattagtggctgctttaccaacaccagcatcttctgcagaatttgtgactttgtcaatgcctgttttgtctgcaattaccgcacctaaaacaataatagggcggtccttctccctctccctatctgctggtctggcactctcaattccctcttgtgagtttcctctcaaggagctccacgtccatcgccaccgtgtcaaagctcgtcggatgcgtgaacggcaccaagcgccactcaccggtgtcggagttcatgtacagcttgacatccttttttcttcgttgctcgatctcgtcagtgacagagagaatgtgttggaagacgagtgcgtctccagaagcgttggtccaggagagcctggcgccgaggaaggtgtgatgaacggtgtggttagggtcgaagtggaggaagatgtcggagggattggggccggagaagaggttcgtgtaattagaatcttcaatggagggaagagaatcgaggtaggtgaggatttttcggtagagactattgtccaaagagtgaagattatagcgagggattttgaaggactagtgaaggtggagacggtttttgaagcaaaggaaccattggttaaggatgtgaagtgcagagttgtagttgcagggtacaagcaagcaggggaaagaactttgtatgagaaagag

SEQ ID NO: 61468 - DNA, 588 bp, Glycine max
  Peptide Sequence Number=SeqID_178246
atggtgtattttttatcatttgcacattacaaagggtgcatcaccgacagaatgcaaccttcattggcaacaagaagattgtctttcacctctgcttctcaagtgagggcattaaaagagcccaagattgagcctcctcaatgtgtcaaacacattaagcattttgcaaaaaacttgtcttcactcaaacaacaaacgggtaaaggtgagtggcggtgtgtgaagacagatagacaacttgttggtcttcctacagggtggtctgatgttactaaggatgttctttacctaacaatgttcatgtgttctatgtcgtctcttggactactaaaccccgatcccttgtgcatgtttagcctaatcctaatcaagcatcgttctcaaatccctcttattggactaaatttaaccaaaaccgcattaagacaaacatatcaaaaactaagttatcgtaccccaatctctcgtgcattgtttacatcaaataccccatgggaagaaccaactgaggatttagctctccatagcagggaagcttcttttacaacaatggaaagagaagatgaaaaactgaagaaatacaagtag

SEQ ID NO: 61469 - DNA, 2444 bp, Glycine max
  Peptide Sequence Number=SeqID_178247
atggaagctagacacgacgaataccaccagcctgggtcacagtcagtgatgcaggaccatctggatagcacacattccagtagaagaccagctgacctcaatacatcagaagttaaacctgtacttaattactccatacagacaggtgaggaatttgctcttgaatttatgagagatagggtgaatatcaggaagcctgtattatcaaatgtcagcgattccaattataccccaggttatatggaactgaaaggcattttaggcatcagtcatgcaggatctgaaagtggatctgatatttctatgctctcaatagttgacaaatatccaaaagaatttgatagaatgaatacatcattacctggagacagaagcaactatgggtcgattcaatcaatgccaagaacttcattgaatcaggacaatagacaatttgtgccggggtatggctcttttggagtttatgatagatccatgatgatgaagtttctttgcagctttggtggtagaatattgccacgaccatgtgatggaaagctaaggtatgttggaggccaaacacgtattcttcgaataagaaaggacatatcttggcaggagctcatgcagaaagcattacaaatctataatcaggttcatgcaatcaagtatcagcttcctggggaagatctcgatgctttagtatctgtgtcatctgatgaggatttgcagaatatgatggaggaatgtaatcatctattagatagagaaggatcacaaaagcttaggatgtttttattctctatgagtgatttggaggatgctcagtttggtctcagcagcatcggcgatgattctgagatccagtatgttgctgctgttaatggcatggacttggaatcaagaaaaaacacaaccatgtttggtgtcagtttttctgcaaatgatataaatgaattggacaggcaaagtattgacagggagactagtagagttggtgtagaatctattgcacagagtgctcccctgactaacaattttgactcatcattggctactcattcttcaccaccagtgctaccaacttcctcaaattcttatgatgcgtatccacagttttatggtgatcaaatgatgcaccatggggaacctagtgatcaatatactattaatcatggccttaatccttctcataaacctgttattggagagactcctatcattatgcctcctcatatgctttttaatcaacaagggattttgggtgaaagccttcaacctcgtggaatacaagtacaaaattcagaaataccaggaacattggcaaacaatctggttgatagttcaattcaacaaggaagtgaccctggcaaagttttagtctcagaattaccgtcaacagctcctgcacaactgcttaataatggttacatgaaaaataattttcctgaagcatcagttgttgttactgcaccagaggggcattcgttgcatccaacaaagatggacaagctccaggattatgaagtgacttcttctacatctagcagtgcatttggtgctgcttatgttgattcccgctccaatgcagctgacttgagttcgcttcatcctcctcctcttcctaaaagagtttattattcggagagaattccacgggaacaattagagttgctgaatcggtcctcaaaatcagatgatacacacagttctcagtttcatgtttcagatttactttctgacatcaacccaccagattcagttacagaatctggtgacaagttgcatggtggaaatctgcctaatctatctgaggaattaggcatcgcggaaaatcacttgcatgcagatgactatgctgttgataatgtggctgtcaatcatcaaatatacaaacagctgcctgatgcaagcagtcagatgaaatcaaagctaactgagcatgtgaatcctgagttgaagcaagtattattggacaatggaggatgcaaagatttgttaaataaggatgatgctgttgggttggaaacggaaatttatagtaaaaataactatatcaaacccctggttgatgagacaaaagccagcaaaccagacttgcctaatttgcgccaggtttcttctgataagctccttgatgatccagcatccaatcttccagaagttgattggggtgatacttctgtgaaggagtctaatgaggatattaatgttcaagccttacctgtttccataaatgggaatacaactacagaagattattctgaagaatttccttcaaatgttgtttccaaacaagtgcaagctgacatccttattgatattaatgatcggttcccccgtgaatttttcactgatatgttctctaaagcagtacttgaagaagatccctctagtctgcatccattaacctcagatggagtgggcttaagtgtaaacatggaaaatcgtgaacctatacgatg

SEQ ID NO: 61470 - DNA, 720 bp, Glycine max
  Peptide Sequence Number=SeqID_178248
atgcattttatgaacaactcaatctcattcttggttgtggtcataatgaatgacgatcttgaagagctgaaggaactgggttctggtacctttgggactgtgtatcatgggaaatggcgaggaacagatgttgccattaaaagaataaagaaaatctgcttcactggtcgatcatctgagcaagagagactgactgtagaattctggcgggaagcagaaattctttccaagcttcatcatccaaatgtggtggcattttatggtgtagtgcaggatggaccaggaggaacgatggctactgttgcagagtacatggtggatggttctcttaggcatgtattacttcgcaaggataggtatcttgatcgtcgcaagagactgataattgcaatggatgcagcttttggaatggaatatttgcactcaaaaaatattgtacactttgacttaaaatgtgacaatttgttggtgaacttgaaagatcctatgcggcctatatgcaaggttggggattttggcttgtccaaaattaaacgaaataccttggtttctggtggtgtgcgagggacacttccttggatggcaccagagcttctgaatggtagcagcaacaaggtctcagaaaaggttgatgtgttctcctttggcatagtattatgggagattctaactggtgaggagccatatgccaatatgcactatggtgcaatcataggttaa

SEQ ID NO: 61471 - DNA, 216 bp, Glycine max
  Peptide Sequence Number=SeqID_178249
atgacacgcatatgccagtctaaaaagggtggcattgtgaataacacattaaggccaacaatcccagatcattgtgattctgaatggagaacactgatggagcagtgttgggcacctaatcctgctgctaggccatccttcactgaaatagccagtcgattgcgcctaatgtctgcagcagctagccaaaccaaaacactgaagccaactaaatga

SEQ ID NO: 61472 - DNA, 363 bp, Glycine max
  Peptide Sequence Number=SeqID_178250
atggcaatattggagtgtagtaatagtttccacttcctaaatggggtttacatggtgctgttgttttgtcttggtattgtggtccttgtgaattcgcacatgttgagtggtaattctgtgaaactttaccaactcaatctatctggtgctttggctccttccatctataatcttccaaagcttcttgagttgaatttatcgaaatatttcatctctggccccattcctaatgtgccagaggagcttgggaatttagtatcacttgaggagttggtcatttatagcaataacttaaccggaagaattccatcatcaataggaaagtgttcggtttccggcaagtgcaccggatcgcacaagtag

SEQ ID NO: 61473 - DNA, 3786 bp, Glycine max
  Peptide Sequence Number=SeqID_178251
atgcagaaacatcaatacaattccatggaacctaacaatgaggaattccattctgcaccacagttggtcccgcaagaccttcgcgatggcatgcatataaatgcacgacctccagcatttaatatggcagaaaataaacctgtacttaattactccatacagactggtgaggaatttgctcttgagtttatgagagatagggtgaatctcaggaagcctgcctttccaaatgttgtgggtgatcccaattattcaacaggctatatggaattgaaaggcattttgggccatccaggatctgagagtggatcagatatttctgtgctcacaaaggttgaaaagggtccaaaagagtttgacagaaggaactcttctcaacaccaggacagaagtaattatggttcagctcgatccattcctagaacttcatctaatcaagacagttaccgagtacttcatggtactgcctcttctagtgtttctgaaagcacaccaatgaagatgaaggttctatgcagctttgggggtagaatattgccacgacctggtgatggaaagcttagatatgttgggggtgaaacgcgtattattagtataagaagggacatacgttttcatgagcttatgcttaaaacattgtcaatctataatgaaactcatgtgataaaatatcagctccctggagaagatcttgatgcgttagtttcagtatcttctgatgaggatctgcggaatatgatggaggaatgtcatgatctacaaggcggccgaggatcaaataagcttaggatttttctgttctctttgaatgatttggatgatactcagttcggtataggtagcatggatggtgattctgaaatccagtatgtagttgctgttaatggtatggacatgggttcaagaaacaactcaatcctttgtggtgaaagtggctctactcataacttacatgaattgaatgaacaaaataatgagagggagaccaacagagttctaatggacacatttggtgttagcggttcatccttgactgacaatgttaaaccatcattgactattcaatcttcacaaccagtgcttccaatctcctctaatgcttatgaaacccatccattgttttatgatgacccggtcattcgccatggggaggctagtcaatatccactacagcatggtcttggtccttctaacaactctgctcacaatatccaagagattccagtttctatgcctactcatggtcatgttgaccaaggaataatgaatgatggacaagcatccagtgagttgcaggtacaaatttcagctatgccagaaacgctggtaaaaagaaagggtgataatttcattcatacagacaatgaccccggaaaagttttccccttggaagcaacatatcctattccttcgcagccatttgagggcaatttgcatgctaatttatcagaggcatcagctacaactgctatatcagaagggcttcatcctgcattgccatcaaagaacaagggtaagcaccagcagtctgaagatgcctcttcattatttagtagtatgaatcccacacagactcctaagtctgttgaagatgacttctttactacatccaatgatgcattcagccgagctcatgttgatgccgagtccaatgtgatagatttcagttaccttgaaccacctccacttccaaacagagtctattattcagagagaattccaagggagcaggcagatttgctgaaccgatctacaaagtcagatgatgctcatggttctcacttactcatgtcagatttgctttctgacttcagccagaagaattcaattacagaatccagtgacatattacacagtgggaatatgtcaaatctgaacatgatgtccagctcagcagcaaagcctttgcaagcagatggccatactattaatgatgtcctgccacagacatacaaacagttgcctgatacgacaagtaaggtgaattcgaagttattgcagcatgtgaattctgagtcgaagcaagtgttagaagataataaagtttctagaaatgaggatcaggtccttagttctgaaaacagaaccaaaggtgctgaacatcttgcatttcatcgggttccttctgttgaacacaatcagaatctaacatctaaacttccagacctcaatttgtctgaggtttctaccagggagtctgataatgatactaaggtccaatcccagacttttcctttaactggaaacacaggccaagatgtttctcaagaatttcccccagaagctaaatctagacctacacagggcgacattctgattgatattgaggacaggtttccccgggatttcctttatgacatgttctccaaagcaataatttctgaagattcctcaagcattggtccattaccaacagatagagcaggtttgagcttaaacatgggcaatcatgagcctaaacgttggtcatattttcagaacttggccaaagaggggtttgataatgtatctctaattgatcaggataatcttggtttttcgtctgctgtgagaaaagtacaagagggggatagtaaatctcagccatctgctcctctaccagctgctggtgttttggcaggacacacggaatcccacctcaatgttggtgaagaaagtcagaaaaatgtacctgtggcaactaaaacagaagcaacaatctttcaccaaaaatatgagcattcccaactaaagggcaatgaaaataagaacatggatgccgtaatggaaaacatacaaccacaggagtctgaataccaggatggcaaggatgaaccaaggaatgtggttgtagcaggggaattcgacaccagtactgtgcaggttaaagtattttctggcaggatacttattctaccttgcttaactactttgatgttcataaagaatgaagatctagaagagttgcgagagctgggttctggtacgtttgggactgtgtaccatggaaaatggagaggatcggatgttgcaattaaaagaataaagaaaagctgcttcgctggtcgatcttcagaacaagaaaggctgaccatagagttctggcgggaagctgacatactttccaagcttcaccatccaaatgtggtggcattttatggtgtagttcaggatggaccaggagcaacactagcgactgttgccgagtacatggtggatggttctcttaggaatgttttgcttcgtaaggataggtatcttgatcgccgcaagagactgataattgccatggatgctgcttttggaatggaatatttacactcgaaaaatattgtgcattttgacttgaaatgtgacaatttgctcgtgaacttgaaggatcctatgcggccaatatgcaaggttggtgattttggcctatcaaagattaagcgaaataccttggtgtctggtggtgttcgtggaactctaccttggatggcaccagagctactaaatggtagtagcaataaggtctcagaaaaggttgatgtgttctcttttggcattgtcttatgggagattcttactggtgatgagccatatgctaatatgcactatggtgcaatcataggaggcattgtgaataacacattaagaccaacaatccccagttattgtgatcttgactggaaaacactaatggagcaatgttgggcacccaatccagcagtcaggccatccttcaccgaaattgctcgccgcttgcgtgtgatgtctgcagccgctagtcagatcaaaggacagggccacaaggcatctaaatga

SEQ ID NO: 61474 - DNA, 222 bp, Glycine max
  Peptide Sequence Number=SeqID_178252
atgagggagtttagattcaagtttccaatcttcaagagtgctaaactacaagtgggaatagagcaagaaaataaagtgaaaatcaagcttagagttgaaaataaggatcacttaccaaagcttgatggaagaagggctcgagaacacttggtaaaacttgaaagaagaagaaaaatatggtctcctctttctccaaaatcttcagcaaaatggaagaactga

SEQ ID NO: 61475 - DNA, 480 bp, Glycine max
  Peptide Sequence Number=SeqID_178253
atggagttaccacaagagagagctagtgtagtaagactaaagttgagtataagtccgagtaaaattataccgctagagagttacactactactaaggcttgtagatgtaggaagtttgtagatggtttaaggtttaaggtgcaaagggaaattgttcctatggctatcagagagtttcctaccttagttaagaaggtgaagattgtggagcacttggagtgtagtaattgggtggtgaagactcgtggagatggatcatctggatccaagaaaggaaaccatcaaaagaagccatacagtaggcctcaacaacatcatggaggttcaactgtgcctcaggtggggaaacaaggtgaggtgttgcgcttgtggtggaccacactatgcttatcaatgtactcaaaaggaggtcaaagtgccaaaagctcgaacacattgccaagtttctatgaagactacaccttttgggggtgtagctag

SEQ ID NO: 61476 - DNA, 300 bp, Glycine max
  Peptide Sequence Number=SeqID_178254
atggacagagatacacttgggtgtattgggtggagaggttcgaagaacctaggggaattagcgagtggtgactacccgatatttgtggagtttgacgagcgaaggactcacccctgcaaccaccatgtagaagcaagcttcatgatgatgaaccaagaaattttaataatgccaaaagcccaagtgattgattcaagattgattcaagacttcaagatcaagcatcaagaatccaatccaagatataagattcaagagaaggaatcaagaagcaacaagtcaagacttcatataggataa

SEQ ID NO: 61477 - DNA, 222 bp, Glycine max
  Peptide Sequence Number=SeqID_178255
atgccggaatcggagatagggacgccgacggcggcgtcggtgccggcgacgccggatactccgggaggaccgttattcacgtcgctgcgagttgactcactgtcacatgaacgtgagtcgttctcaatggctgggtgcaagtgtctgccgaccaagggccatagctgcttcactgatttctcagttggtgttccacttcccaatgtttctctcactcaaaag

SEQ ID NO: 61478 - DNA, 324 bp, Glycine max
  Peptide Sequence Number=SeqID_178256
atgaagagattaatgggagatgatgatgatcgaagtggatggggtgtgtctgttgttgttgaggttggaatggaatcggagaaaacttgtgacaagggttgtgatgcaacttggaagttggagaaaagggaaaagctagcttgggttgaaggtggagggagaaggaaaacaaaagtggcgggaaatgggaatggaggagaagtgaggatggattataataataatgaggtcgtcttgatacgggaaaaggtcaaagacgacgtcggaagaggtagggacgatgaagttgttgtagttggtaattgtgacacagttgacgagaag

SEQ ID NO: 61479 - DNA, 723 bp, Glycine max
  Peptide Sequence Number=SeqID_178257
atggcacttcccaacgttttcccaaacctccaaatttctcctcactttctcgccccccctccgttttccctcggattttcccgtactttccccgccgcgactcgagtacgcagaagagccttccgcgaatggcgggagtacgaggaggcggtgaagcggaaggacctcgccggagccctgcggttcctcaagtccctcgaatcggaacagccgctcgtaaacggcggttctccgtcgagcgagtcgactcggctccggttcggcgagttggagcggttcgggccgcagagggactgggaggttctggacacgtgtttgaatgctgatgacatgaaacttgtcgctaacgcttacaggttcctcagagataggggtttcttgcccaatttcggtaaatgcagaaacattgttttggagggaccgaggaaagtgacaccagatgtcttgagctcctctactggtttggaagtgactaaacttgctcctaagaagtggggtctttcagatggttcaagcattgttttggttgcttttcttggtggggtgtcctttcttatatcacaaggaattgacctcaggcccaaccttgcagtgatattaggtctagctgctgcagatgctatacttctgggtggtacctgcttagctcaaatctcaagttactggccaccatataggcgtcggattcttgttcatgaagctggacatctactaacaggttaa

SEQ ID NO: 61480 - DNA, 291 bp, Glycine max
  Peptide Sequence Number=SeqID_178258
atggtgctttttgctggcattgcagctgaagctcttgtttacggtgaggcagagggtggagaaaatgatgaaaatctatttagaggcatctgtcttcttcttgatcctccattgtctacagctgagatgtccaatcaagcaagatgggcagttttgcaatcttataatttgctcaagtggcatagagctgcacaccgagctgctgttaaagcattggaaagcggtgacagtctgagtgttgtaattaggagtatcgaggagacaatggttctcgctatgtatctgaagtga

SEQ ID NO: 61481 - DNA, 552 bp, Glycine max
  Peptide Sequence Number=SeqID_178259
atgggagaaaaaggagaatcatccaaatcggctatgctgaagcatgcagaggaagaagaattgaatacaaaaagattgaaaactgtggagggggaagaatccaatatggtagaagaaacagaaaacattaagctgaaaacttcagatgaaatcatcttcgaggtggaaccctcgatcgtgaaggagatggtgacgatacagaccttcatcgaggacaacaacaacgaaacttccatccccattccgctccccaacgtcaccagtaatactctccgtcgaatcctcgagttcaaagctcgaggattcgacgaagagttcgtgaagacgttgggcatggacgaggttttcgaactgatcctcgctgccaactacctcaacatgaaaaccctcctggatatcctgactaagatcattgcagacttcatcaagaataagagcgtggagtttgttaggaagttcttcaacatcgtcaacgatttcacacccgaggaagaggccaagattcgtgaagaaaatgcctgggcctttgagggatttgagtgcgatgattga

SEQ ID NO: 61482 - DNA, 1776 bp, Glycine max
  Peptide Sequence Number=SeqID_178260
atggaccaatcacaactcttacatgacccaaatttccctctcttcaaaacccctcgcaaaaccccttcttcacccgccgtaaccaccaccgccactagcaaacccccttcaaccgccgcaaaccccacctccgacggcgagcgcatcgaagaccaccccgacgaaaccgccaccgtcgccgacaccgacaccgatgccgacgccgagacgttcggcgaccttgggctcgcggaatgggcggtgaagacgtgccgggagctcgggatgcggaggccgcggggcgtgcagcggcggtgcatcccgcgcgtgctggagggccggcacgtgcttggcgtcgatgagaccgggagcgggaagacggcggccttcgcgctcccgatcttgcaccgcctcgctgagcacccgttcggcgtcttcgccctcgtcgtgacccccacgcgcgagctcgccttccagctcgccgagcagttccgcgccctcggctccgccgtgcacctccgcatcacggtggtcgtcgggggcatggacatgctcaggcaggccaaggagctcgccgcgaggccgcaccttgtcatcgccaccccggggaggatccacgccctgctccgcaataaccctgatattcctcccgttttctccagaaccaagttccttgtcttggatgaagcagatcgagtcctggatgttggttttcaggaggaattgagatttatctttcagtgcttaccagaaaatcgacaaaacctgttcttttctgcaacaactacaagtaatctgcaaaagttgcgtgggcgttaccaagataagatgtatgtctatgaggcttatgaaggctttaaaacagttgaaacacttaagcaacaggctatattcatccctaaaaaggtgaaggatgtatatttgatgcatattttggataaaatggaagatatgggaattcggtctgccatcgtatttatctcaacatgcagagattgtcatcgtttgagtttaatgctggaagtgcttgatcaagaagcagcagctctatattcattcaaatcacaagctcagaggcttgaagcacttcatcaatttaaatcgggaaaggtttctatacttcttgcaactgatgttgccagccgtggtttggatattcctacagttgaccttgttatcaattatgatgttccaaggtttccacgagattatattcatcgtgtaggccgtacagcaagagctggtagagggggactggctttgagccttgtcacccagaatgatgttgatcttattcatgaaattgaagcacttattgagaagcaacttgaaatgattgaatacaaagaaaatgacgcgctttctctcatgaaaaaggttttcagtgctaagaatgtagcagaaatgaagatgatagatgatggctttgaggagaaagctaaagagcggaaaaaacagaagctgaaaatgctagaagagaaaggattgttaactaaaagaagtaaaaagagaaaacgaaataaagaatttgcagaggaagggaaagaacaaaagaaagaggttttaactgctaggaatgtggcggaaatgaagatgatggatgagggtggcattgaggagaaagcagaagaggggggaaaacaaaaattgcgaacagagaaaggtttgtcaaagaaaaaaaagtcaaaagaaagaagaaaagaatctgcagaggaagggaaaaaacagagaaaagaggaagtagaaccattagcagatatagcaactccaaagaaaaggagtaagaagagacagtaa

SEQ ID NO: 61483 - DNA, 309 bp, Glycine max
  Peptide Sequence Number=SeqID_178261
atgttagagccacggggaactgttcgtgaaatgattcctggattcaatggaaaggagggctattggtggttggtcaatgcagagcagtattttgagaacagattaccagaagagatggaactatcattggtttgtgcatttgcaataagaggaaaagctctcaaatggtgggtttcctggaaggaaagcaatcataatgcaacaaggtggacctttgagaaggctgtgcttaagcaaatccaaccagaacttggacatttcagtcgacccaccaccaccaacggtttaattcttggacatttcagttga

SEQ ID NO: 61484 - DNA, 327 bp, Glycine max
  Peptide Sequence Number=SeqID_178262
atggccgaacttggagttgagaagctccttgatatcttccctgacactcttcaactcatcaggatcagtgtgtatctaccctgtgaaacaccaattggggtgaaagaactaagagaaaaggaactgaaacagctaaggggtgatggatggggacttagggtatcttctgatagaatctatgactatgatgtatacaatgatttgggtgattcagacaaaggagataggtttgcaaggccaacactgggtggtcaacacaacccttaccccacacgttgccgcactggacgaccaccatctaccgttggtcagtttcactcatcatag

SEQ ID NO: 61485 - DNA, 1011 bp, Glycine max
  Peptide Sequence Number=SeqID_178263
atggcggtggtgatgagaacgagcaagagcacgatgacgcagtcgacaacaagccatgcaccgggaaggcttcttctaaggaggaagcaagggcttgaggatccctaccatggagttaccactatccacatcgactatgaaccttcaatccatgtagagcatttctctgatatcaatgaactggagaaagtaggtctcaaactcaacgagactctactattctatggtgtaagactattctttaatgagcctcaaaccatctacccagaactcatcagaatgttctggaggaatgctgagtttttgatcattaaggccactgtgtccaaggttcttggagttcaggcctatgactcctatgtaactagagctttgtacaaggagaatgcagaaaaggatcaaggagattatcacgtgtttgataagatggatgaggactccaagcacatcatcacaatcaaaggttttgttgttgctaagcaacaaaaattcagcaaaaccaaccttaaggctatgaaggaagctatcaacaggagaaaaccaaaaaggcttgttaaagctatcgctaatgaagataagaacctacgtagctttggcattcccaggaaggttgaagtaaacaaaaccactcagaagctaagggatttgagtgaaaccgaggatgaaggtgatgatactccagttgctttaaggaagatgaaatcaactattaaaaaaaaaccttctcctacacccaagagggataaagtaaccagacaaccaattatcccttttgaggttccaaagagagtaaaaataagagtcaccaaggctaatcccaaaatagtggaaaaggaatggatccccccctcacctccatcatcatccagtaatgagaacaatgatgaccctatctctcaagtgcagacttctccacctactacaaccaagcaacatctacctctatatccaatccacttggaaagattcacactttattggaaaaagaagacacctctagcaaatgcataa

SEQ ID NO: 61486 - DNA, 405 bp, Glycine max
  Peptide Sequence Number=SeqID_178264
atggcttgttgtcgactgcgtcatcgtgctcttgctcgttctcatcaccaccgccataacaaaggcaaagaagaagaaaatgaacaagtgacatctgagctaggtttattttctgagtgtacaaagggaaatgtgagagttgtgaacaccaaaagcaacaacagaggacaatggccacagataatttcgtgcaacctgccattcctcgttttgatggagtattggcaagttgtatctgatggaattcccgtaggagaggccaacatgacaatgacagatgcacaaaaaacagaaatagaagggctgcgtttgaaggatctcaaggtaaagaattatcttttccaagtaattgatcgcccaatctttgaaactatcctttgcaaggatacgtccaaggacatttag

SEQ ID NO: 61487 - DNA, 1011 bp, Glycine max
  Peptide Sequence Number=SeqID_178265
atggatgctgaaattgcagccataaaaaagaacaatacttgggagttgatggagcttcccaaaggtcaaaagacaattggtgtgaagtggatttacaagaccaaactgaaagagaatggcgaagttgaaaaattcaaggcgcggttggtagcaaaaggctacaaacaagagttcgggattgactacaaagaagtctttgcttcggtggcgaggcataatacaattagattggtgattgctttagcagcacaaaaatcatggcccatcttccagttggatgggaaatcagcattcttgcacgaaaacttggaagagcaggtatttgttgatcaacctctcggttacattaagatcagaaatgatcataaagtgtataaattgagaaagtttctttatggactaaaacaagcaccacaggcttggtatagtcatattgaagcttattttttgagagaaggatttctgaaatgtccttatgaacacacactttttgttaaaattactaatggtggaaaaatgctcattgtatgtgtgtacgtggatgatcttatttttactgggaatgatgttgccatgtttgacaaatttaagaagtccatgatgattaaattcgatatgactgatcttggcatgttgcattattttttgggcattgaagttgtgcaatctgctgatggaatctttatttctcaaaagaagtatgtgcaagaaatattggacaggtttcagatgacaaattgtaattctgttaacacaccggttgagtatggtttgaaactaaccaaggatcatggaggaaaaaaagttaaagtgtggtgtcaagttctcttatgtggtggctcatggtctaccggagtaaatctccccaatgtttactcccctcgaatttcccctaacaactggtatcagaaccgttggttttacttggactggcttagacgaagggggagaccactgaatcttaccatgtggaagagactcacacttgaaggggagattgttggagtataa

SEQ ID NO: 61488 - DNA, 885 bp, Glycine max
  Peptide Sequence Number=SeqID_178266
atgacaatcgtcaacaagatgcaaatccatggtgacaatacggaggacaccattgtagttgagaagattcttcgatcattgactacaaaattcaattttgttgcttgtgctatcgaagaagctcatgacattgaggaactttcacttgatcagctgcaaagttccttattggttcaagagaagaaaattaaccagcaggagacaaaggagaaagcattgaaagtctcaatcaaaaatcatcccacatcaaaaggaaaaagagggtatggtcattatcaatcagaatgttggactaatatgaacaaagacaatggagagagaactaactttgcagaaaaggaaaaggaacaggaagtgtcttttttgatggtatgccatgtaaaggaagaaactcaacaaaatttgtggtatttagacactggttgtagcaaccatatgtgtggagacaaggaggtgttctctgagttagatgagacttttcgcaatacagtcaagtttggcaataactccactatctctgtcctgggaaaaggaatggtaacactccatgccaaagagaattcaactcacaatatttctaatgttttgtttgttccagatttaaaaaccatcttgcttagtgtgggtcaactacaagagaagggatatgaaatttctatgaaagacgacgtatgtcaaatcagagatgaaaagttagacttaattgctcaagttaacatgacgccaaatcgcatgttcccactttatctccacagcaccagtcactcgtgcttctcaaccaaattgaaagattacgcttggctttggcactttcgttatggtcacttgaacttcggtgggttgaagactttgtggcagaaaaatatggtgacaggtcttccttaa

SEQ ID NO: 61489 - DNA, 543 bp, Glycine max
  Peptide Sequence Number=SeqID_178267
atgggtgaaaatgaagatgatttcatcattaatggcattttagacatctacaacattgatatgtggaacattaaggttgatgaagttaaaaggctagaatttgcatatcttgagactgcatatacttattttattgtggatggtgatgttgccatgaagaatgtgataagaagagcttgtagggattgtcttaccataagattgagactccaagccaaagttgatagagatgtgcaaatgctcacgaaatggaagcttgctaaagtagtgtcagatttagaccgaaatcataaccaacctcatagtgtggtgacttgggaagctttagagttggatgcttataaatgcaatgtggatgcaacattttggagtcaaggtggtggaggaggctacataggtggtggtgaagatagtggtagaggtgtgggttcaatagaggcaagaataaaggataagaggggtggttcaatggcaggtggtggtggttggacgatagtaggagcaacaacaacacctgacataaacaaaggtagcttcatttga

SEQ ID NO: 61490 - DNA, 402 bp, Glycine max
  Peptide Sequence Number=SeqID_178268
atggctagaaaggatcactttagcaccataaccagtcaagtacttgatggtgggaacagcagcacggactctagtgtcatcggtgatgttaaggttgtcatccaaaggcacgttcagatcgaccctcacgaataccctcttccccttcaaatcaccctccttcaacgttcccacgctcctcttagtcgccatttattcgcaaacctgcgcaaacccaaatccaaaaacgagaaagggatcaggacccagatgaggaaacgcagaaaagattcaaactttggaggcgacactcacaacaacgcaaacgggtttggtggaaatatcggtgtagtgtggcaactagcaagagatcaggttcggggagtgaagaaacgttctagaaagatttatagagagaggtga

SEQ ID NO: 61491 - DNA, 174 bp, Glycine max
  Peptide Sequence Number=SeqID_178269
atgaataacaagcactcactagacgagttgagacgctggcaattcatgcggctgcaagagtggcatgcatcacaccgtggtgatggtaggataacagaaaggttagtgttgatgggttgtgtgattcgcgatttgattttggcggtggtagttcagagagaggctttttgttag

SEQ ID NO: 61492 - DNA, 1146 bp, Glycine max
  Peptide Sequence Number=SeqID_178270
atggggaaaggaagagcaccatgctgtgataagactcaagtgaagagaggtccttggagccctgcagaagaccttaagctcatagccttcatccagaaatatggccacgaaaactggcgtgctctcccaaaacaagcagggctcctgcgatgtgggaaaagttgtcgtttgagatggatcaattatctaaggcctgatgtgaagagaggcaattttacaccagaggaagaggaaaccataataaggctacacaaggccttaggaaacaagtggtcaaagattgcatcaggtttgcctggtaggactgacaatgagatcaagaatgtgtggaacacccacttgaagaaaagattggctccaaaaaaagtctcagaatcaagtgctgatgaatccaagccagaatcatcaatcacttcctcctcttcctcatcatctgaatcatttttctccaatgagagaccaaattcaccaaagaccaccacacctagtaacaatgaattcaatgaccaagctgagaaattatcagtggaagataaaatggacaaggattcagaaaaacaactgtccaacgaacttgttaacatcactgaggatccaaaagagtcatcagtttcattgtcttctgttgaatcaaacattgtaaacacaagccagattgttgaacacaaaccagaagaagaacaattggcctctccattaccctacttaggacattatgatgttggaagcatattagaagaggtggataaaccaaaccacctgattgaaattccatgggagccagattatgatttttggaagttgttagatgatgataatagccttggatcttttcaatcaaatgaagtccaattaggtgagttcccagccatccaaaacatcattcttggagaagagggtgttcatgatgctgaagccaagaagtggtcccatgattttgaaaatgagtttggagtagttggtgggataaaggagtcaagcaaggatcatttcctaccaaagaactatgctgttgagccagaaatggaccacactcaagcatttgattttgatgacattgacatggcaaggccagaatctgaattagactttggttatatccaattatggccctcttgccctcaaaataataatactagtctttag

SEQ ID NO: 61493 - DNA, 801 bp, Glycine max
  Peptide Sequence Number=SeqID_178271
cccttctcaatcttcatgcttctgtcatcccaaagcataaagcaactgtttcacagattcttccttcgagtccacatgaaaacatagagatagaatctcttgaaacgaatgaaagattgcaaaacatgttcaagtatcctctagaagctgaaagccaaatgggaacagataaaaatgatgaaaatgttgctggttactctgttggagctgggcatagtgtacctgttgttgttggattgcaaaacatgttcaagtatcctctagaagctgaaagccaaatgggaacagataaaaatgatgaaaatgttgctggttactctgttggagctgggcatagtgtacctgttgttgttggattgcaaaacatgttcaagtatcttctagaagttgaaagccaaatgggaacagataaaaatgatgaaaatgtttctggttactctgttggagttgggcatagtgtacctgttgctgctggtgttggggatacaaacatatgtgggtgtatagttcagttgtatttggataatattttggacagatgtttggatttcagtgaacaagttttgaaaactacaggctatgtagacgtggagcaaaacgaagcttatggtgatattgcaatctctaaactcccaaaattagatcaaacatttttatttgatggtaggacgattctgcatgttagtgtctatggttgcatcgcaacaacattattttccaaggttctgcgtattaaggatgttaattcggtgttgaagcatattaaggcaatcttgtggtcttggatctgcatcaaagggg

SEQ ID NO: 61494 - DNA, 543 bp, Glycine max
  Peptide Sequence Number=SeqID_178272
atgcacaaattgggaagaggtcatcgtgacaaactccagcagttcataacaataactggagccagatatccacttagttgtgttgtgtgtgtggaatttggatggggttggggtggtgggagagagttaggatctattgagaaaatagcactgcaggctctgaaggctagtgattggcatcttgaaggagcatttgatttcttttacaaccaaccccagcttaaaacatttactgattctaggcacttggaggagctatacaatagatataaagatgcatatgttgatatgattttggcagatggcatcactgtcctttgcaatgatatccaggtggatcctcaagatatagtaatgttagttctttcatggcacatgaaggctggaaccatgtgtgaattttccaagaaggagtttattgaaggtttacagtctttggggattgattctctggataagttccgtgaaaagataccatatatgcgctctgagctgaaagatgaacgtatgggcaacagtattcagactgcagctcaaaactag

SEQ ID NO: 61495 - DNA, 174 bp, Glycine max
  Peptide Sequence Number=SeqID_178273
atgaccgagagacaccagattctgatcctcttccacccacctaaaacattcgactttttggctctttacaaaggagcagatgtgaccacaatacaatacaatacagataaaaaagaagaaagaaatgacgaggactaccgaggtgcaatgcaaaattcttatgtcaatcattga

SEQ ID NO: 61496 - DNA, 302 bp, Glycine max
  Peptide Sequence Number=SeqID_178274
gtctttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatggacgaatcaaagcgacaagggctgaatctcagtggatcgtgctcaaggccactctgccacttacaataccccgtcgc

SEQ ID NO: 61497 - DNA, 762 bp, Glycine max
  Peptide Sequence Number=SeqID_178275
atggagtgtcttgccttctctaacttgattcccacctcccacacttctaatgtcactcttgacagggccagacttatttatggcattattatgaagatggatatgaatgtggggtaccttatctcccaccagatctccctcactgctcagcatgacacatccagacttggattcccggccttgattacagctttatgtaaggctaggggggttcagtctgattcgagatccctggagagcctgagtcctgccattaatttggcttatattaagaagaactgttggaatctggatgagccaacagtaaccttcagaggacccaggaaggctagagacaagagatttgaggccttttccacaacgccatcagagataggaggtccttcttcttctacacttcctacttcttcctacacagagatcccagtgattcctcctgcacccacacagattccactaccagctcctctttctataggtccaacagattttattttcactcctcagatgcttcactccatgctccagagcatccatagagggcagtccatcatcatgcagagccttcagggcttaggcttgccctccattatgagcatggaggagtttgacacacgggtggcctggccaggagatcagccttcttcctctggagggggtggggcctctacagcccaggagcctgtgagtgaggaaccaccagcaccagcaccatcaccaacagcagcagaggaggagaccactccagctcagaccccatag

SEQ ID NO: 61498 - DNA, 514 bp, Glycine max
  Peptide Sequence Number=SeqID_178276
aggactacatgtccgcaccttcagaggactacatgtcctcgcctttagagggctacacgtcgtcaccttcagaggactacacgtcctccccttcagagggatacatgccctcactttcgtagggctacacaccctcacccttagaggacttcgcgtgctcgccttcagagggctacacgtcctcaccttcagagggttgcacgccctcgccttcatagggttgcatgccctcgccttcataggactccacatctgcgccttcaaagaactcaagggatcgcccccacaagacacccagtggacccggagaagtcccacagggccctggggtttccagctctggttatgggcctctgtcagtcctaccgggtgctcgtccccccagcaagggatcacgcccgcaagacacccagtggaccctgagaagtccaacaggggagtgcccgtcgcccccaacaaggtcatcaggccccctattaatcgggctttcataaagaagtattgcaccccccag

SEQ ID NO: 61499 - DNA, 320 bp, Glycine max
  Peptide Sequence Number=SeqID_178277
tcttacggatagcaaatgagactttttcacagtcttggccggaagacgctgacatcttcagggaagatgctggcatctccggggaagctgcggatgacgacattaatgctgacatctctgggaaaggtggagtcttacggatagcaaatgagactttttcgcagtctctaccgaaagatgctgacatctcctggaaagatgcagggcgtctccgcgtgccaacggactcacaggtcacgatagcaaaagttggggcggtcgacaaaagcgaggcttttgctcctacgtatcctcaatttgtgatgaggaactcagactga

SEQ ID NO: 61500 - DNA, 195 bp, Glycine max
  Peptide Sequence Number=SeqID_178278
atggcattagcccgtgacttttgtattagaaataccaagatgtgcatgtatgcaatttttgatagccaaagtgctttgagtatgcatcatttcttggtaaaaactaactttccaaatgtttgccttcgcaagaatggccccgaggaagcttgcctcaaagaggtccaggaaggacaaggcggccgaaggaactag

SEQ ID NO: 61501 - DNA, 258 bp, Glycine max
  Peptide Sequence Number=SeqID_178279
gatttttacaaggttgaaaagaaatctcaaggatcgcaggtcgcttggggactggatgtaggcacgagttgttgccgaaccagtataaaaactcttggaaaactgccaggaagccacattataaacagaacctcgaagaaagttgagcttcgtcctcaaaaggaaacaacaccagaatatttagccttccatagattcaataaaagcagaaaagtaaatgaaactaaaagcaaaaacataaatgaagaagaaacgtaa

SEQ ID NO: 61502 - DNA, 347 bp, Glycine max
  Peptide Sequence Number=SeqID_178280
atgtcagtgccgcattcgaggtcatcggctacggaaaaaaaactcatcgttgcatcgtttggcatcaagaactacgataagggaggtgcaagtcccatcgactccttcacaaactacaacgttaacatgaacaacccccaagaacaagagaacttctcgatctatgcaaatagaaccgttggtccccctcctatcctcttgacaaaggctcttctcaaagcccacgtgcaaaatgcagaagcccacttcagccacatccaccctgatacgagcatctggatgccttccgagcttagctcacctaggcgagctggttacttcacctctaagtttcctaatgggcctag

SEQ ID NO: 61503 - DNA, 447 bp, Glycine max
  Peptide Sequence Number=SeqID_178281
atgacctttcaagcagcagatacatccaggttggaggaatcatccaaatctaagacgggcaagtcctccacgacaacaacagcctgccctgctttccagaatggtgttggtccaagcaagccatatgttcctcctccaatgcagcaacaacaacaacaacaacaaagacaacaagcaactaaggccccttcgcaaccttccttagaagagctaactgtgaaaaattcgaaaaatgtgagtgccatcaccatgaggtctggcaagcaaattgaagtgcctccactagcagcagcacctgcacctgcacctgaacctgtcaagcttcattctgcacctgaaaaagaggatgcgatagttgcacaaaagagaaagcttcctgatcaaaagggagctaacaaaaattttcatgcaagtggaccttattctaataattctgacttgcaatag

SEQ ID NO: 61504 - DNA, 204 bp, Glycine max
  Peptide Sequence Number=SeqID_178282
atgaaagccaacaaaacaagaaatgaattgaaagtctcggattcgaaaacttaccggttgaagaacgaagaacggacgaaaaacggcgaagaacgacagaaaatcttcacgaaattgctcacgaaaacgtctcgaaagcgttacggaagcaccttggcttggattttcttcacggaaacacattttttcacccaaaacaattga

SEQ ID NO: 61505 - DNA, 270 bp, Glycine max
  Peptide Sequence Number=SeqID_178283
atgaacgaaaacgcaattcatggggctccgaaaaagggtagagaatggagaattgcactaagcaatcactacgcatggctccaaactcgtgggtggaggatgcatgaacgaaaacgcaattcatggggctccgaaaagaggggtagagaatggagaattgcactaagcaatcactacgcatggctccaaattcgtgggtggaggacgcatgaacgaaaatgcaattcatggggctccgaaaaagggttagagaatggagaattgcactaa

SEQ ID NO: 61506 - DNA, 495 bp, Glycine max
  Peptide Sequence Number=SeqID_178284
atgccaggttaccatctggtcggttcatgtaatgggttgcactgtggggttagcgaaataccagaaggataccgtgtttgtttttggaacaaggcgacaagggtgatatccagagaatcgccaacgctgtctttttccccgggcattggtcgtagaacaatgtttgggtttggctatgatccgtcaagtgacaaatacaaggttgtagcaattgcattgactatgctttcacttgacgtatctcaaaagactgagatgaaagtttatagcgcgggtgacagtagttggagaaaccttaaaggttttcctgttctttggactttacctaaagttggtggagtgtatctgagtggaacccttaattgggttgttattaagggaaaagaaaccattcattctgaaatcgtaattatttttgttgacctggagaaggaggcttgcagatcattgtttcttcccgacgatttttgctttgttgataccaatcaattctga

SEQ ID NO: 61507 - DNA, 324 bp, Glycine max
  Peptide Sequence Number=SeqID_178285
atggagaagactcaggaagagagaggagagttccgattattaagtgaaattaaatggggagtgaaaatccgccaatcaaggagtgacatatattcgaaactgcacttgcaacgcgacatgtggcgggggcaacagaaaaaaggtgtacccaacaatattgtttgtgcacacaacaatttcagtgaagcattctatattcttccgctgcaacgtagcttcctcctttgtctttgcgttatcgttgtcacatcgtcgccgtctcagtctccattggctccgttcaggtcgtccgcaccacagcagtggttttctgccgtcaagtaa

SEQ ID NO: 61508 - DNA, 170 bp, Glycine max
  Peptide Sequence Number=SeqID_178286
atggcggtgcaaatagacaccaggcccacttgggccctccagaatattcctccagaagccgaggcgcttccgaaacgtttccgtaacgtttaccgtgaggaattcgcaaaggtttcaaccgttcttcgacgtacttcattcgttcttcatcgttcttcgatcttcaacgg

SEQ ID NO: 61509 - DNA, 372 bp, Glycine max
  Peptide Sequence Number=SeqID_178287
atgccgatctccccctgtggaagtatcagttggatcgcgcccacaagacacccagtggtcccggagaagtctaacagggccctggggtttctagctctggttacgggcctttgtcagtcctatagggtgcccgtccccccagcaagaatcgcgcccgcaagacacccaatggacccggagaagtccaacaggatcctggggttttcagctttgattacgagtctctgtcaattttacagagtgcttgtcacccccagcaaggtcatcaggccccctattaatagggctttcatcgagaagtactgcacccccaggcaggtgcagggcgaggcatcacagagtgggcaacgggcgcatagccaccacctctag

SEQ ID NO: 61510 - DNA, 498 bp, Glycine max
  Peptide Sequence Number=SeqID_178288
atgcttcagagcattcatcagggacagatcattttattacagagtttacaggtggtggcgactccaggatctaatcctttagttgagcagttcagggagatgatagcctggccccggactcaaccttctcttcatagggaagataaaggtcccacagcccaggtaccaaagcatatggaggatgaatcatctgaggccaccattctagagccatttgttctaggggaggaggaaggtgagacacaggtgagacaggtagttgctgtcactcccgagagatctcttgaggccacttcagagcctcctgcaccattagtggacctaccctcacctcagcgtacaacaaacccctccactcctattctagagatgccagaggaccaaaccacactagtcctgactatggacacttctcctccagctactccagtacttcatctgacaaatgaggaggatgttcagacacaagatactcaagaccagtcacaggaattctaa

SEQ ID NO: 61511 - DNA, 433 bp, Glycine max
  Peptide Sequence Number=SeqID_178289
atgatttatcatacagaatttgatgagttcaaggctgagttggaaagaaggaattggcacaaggagctgaccaatttcatggatgggagcatcgatgttgccattgttaaggagttctacactaacctttatgatcttgaggataaatcacctaagcaggtgagggtgagaggccacttaattaagtttgatgaagacaccctaaacacctttctgaggacccccatgatcatagagaagggggagaacctgcctacttactccagattctatcgtttgaggcaagatccacaggaactggcagcccgactatgcatccctgggaagggatttgagcttaatgctgatgggctgccattgaagatcttgcaaaagaatctgaccatgcttgctcaaacatggagcgttttatcattctctaacttggccccta

SEQ ID NO: 61512 - DNA, 321 bp, Glycine max
  Peptide Sequence Number=SeqID_178290
atgaacttgggtgttggtgaggaaaagaaggaggtaaaggttggcactggcatgaccacacttatccgagatgaattggtggctctattacgagactaccaagacattttcgctttgtcataccaagatatgcctagcttaaaccccaacattgtgcagcataagttgcctctgaatccagttgctccccggaggaggtcaaaaagcaacttgacgtcggcttcttggcaaccacttgatatccagaatgggttgccaacattgtcccagttcccaagaaggatgggaaagtacgaatatgcatggactattaggatctaa

SEQ ID NO: 61513 - DNA, 834 bp, Glycine max
  Peptide Sequence Number=SeqID_178291
atggcacgcagagaaaaatatggtcatctgtcccctttggtcaaagactcaatgtctttcgatcgagactattgcagtctccctttgccaaccagagataagcgagtccattggcacgcggagacaaattatggtcatctgccacctttgctatccagagacaataaagtccgatggcatgtagagataattatgagacaaacgagtccaatagcacgcggagagaaattatggtcatccgccaccctttctatccaaagacaagggagtccgatagcacgcgaagacaaattatggtcatccgccacccttgatatccagagacaagtgactccgatagcatgcagagacaaattatggtcatccgctacccttgctatccagagacaagcgagtccgatagcatgcgaggacaaattatggtcatctgctacctttgccaaccagagacaagtgagtccattggcatgtggagaccatcatggtcattcgtttttaattgatttcaagactattgaagtctcccttgccatccagagacaagcaagtcagttggcacgcggagaccatcatggtcatccggtttcgctgattgagctagtggccggtcgggtggagaggggcattcttcaacccctaggcccacctgggcctattagaaaacttcaaagtaaagcaaccagctcgcctgggcgagctgtgttgcaacctctaatgcaatcctaccccgcaagggcattggatagaagactacaagtagattgggccaaagatgcaagagaagatcctagggttcttatgagccttaaggtagacttcgggcccatgggctaa

SEQ ID NO: 61514 - DNA, 405 bp, Glycine max
  Peptide Sequence Number=SeqID_178292
atggataagagcttaaaggtaggagaagatgagtggatggagagggagacagaggaacaaaattttgagagagagaagagggataatgagctatggtttagcccactaatccaagattctccacaaagtgtgtttaggtgtcatgaggcatcaagcaaatgctcactgtcacaacctacccttcggcgggagggcgacgcggggctcatgggtgcgtcttccaagggaggaaggcgcgcggagtcgcctctaatgtttattcgaggaaaacgtcataaaaatcaaatgtgcggtctacgaactttaagtgtgaaaggttcaggagttgtttttactcacggggaaggctgtttccctcgctcctacgtattcctcaattatgatgaggaaatcaaacttatgtag

SEQ ID NO: 61515 - DNA, 498 bp, Glycine max
  Peptide Sequence Number=SeqID_178293
atgggggagacgcatgagataccctaccataatctagccgacttcgagccttgcctcggatatgccactgaagggcaagtagttggtgtacccaatgtcgtcacccctcccaagttcaaggtgttggactttgacaagtacaagggaactacttgccccaagaatcatctaaagatgtattgtcggaagatgggggcatacgcaagagatgagaaattgcttatacatttcttccaagaaagtcttactggggcagctgccacctggtatactaacttggaaccttcccaagtccattctaggaaggacctaatggttgcctttgttagacagtatcagtacaattctgatgtggctccggataggatgcaactacataacatgggtaaaaaggggcatgaatccttcaaaggatatggcagcccaactggcgcccccaatgacggaaagggagatgataacagtgatagtggacacgttaccaatgttttactatga

SEQ ID NO: 61516 - DNA, 255 bp, Glycine max
  Peptide Sequence Number=SeqID_178294
atgatgcaattttcccaaggaggggacccatcaccagagtcatggctagaagactctgttgatgaagaagatccaaaggcttacaagctctacatagagccacattatgtgggaggggatgatgtaatcctcccaaggaagggacccatcaccagagtcatggctaggagactccaggaagattgggtcagggattcaagagaagaccctagggttctcatgagcctcatggtagattttaggcccatgggctaa

SEQ ID NO: 61517 - DNA, 669 bp, Glycine max
  Peptide Sequence Number=SeqID_178295
atgcttcaaaactgcatcgacgaacgcaacctcctcaagggtcaaaagaaacctccacgtacctctcagagcattcttgaagccaacgagctttctgctacctccgttattttctacttcacgccgatttcggttcctttgaaaacagagccaccggttggaatacagagagcagcgactcccccggaggattccccgtcgccgccgccgcctcctgctccggtggaggacggagattccgactctttcaagaaattggttattgttggaatcgtggttggggtgactattccgacgacgcattcttggtctgtttcttctgaaggggttcgttacgcgattgagtcgttgagtgtgttcaagtttgaggagttgcagaaggcaacggcgttcttcggtgaagagaacaagatcaagggttctgtttatagggcttctttcaagggtgattatgctgcggttaaagttctcaaaggtggcgtgtcgggtgagattaaccttctcaagaggattaaccacttcaacagtataaggttgtcgggtttttgtgtctacaaaggtgacacctatcttttgtacgagttagcggagaatgattctcttgaagattggcttcacagtgttaacaagaagtatgagaattccgtgcctttgagttgggtgcagagg

SEQ ID NO: 61518 - DNA, 183 bp, Glycine max
  Peptide Sequence Number=SeqID_178296
atgtcccatgctgtcaaggacaatcgagggaaatgggccccgaattacgaagggccttttgttgtgaagagggctttcttcggaggagccctggggcaggatcatcttcagctaccttctggggtagagacagaacatgaacagcagaaaccaatcaaggtacacaggaacggatgcaagtga

SEQ ID NO: 61519 - DNA, 246 bp, Glycine max
  Peptide Sequence Number=SeqID_178297
atggaaattctcatcctgggtcaaggtttatggtggtttgaggtcttggctcaaaaggcttgcagaacagccggacatgatgtatttcagggtgttggtttggccagcggttcagggataaaggggatgtcccacatttatttccatgacacacatacaacaatgatgatttggaaattttatgcaaaactgatcatgcatgcacccatgtggacactcaagcatcaagtttttatgctcatgtga

SEQ ID NO: 61520 - DNA, 594 bp, Glycine max
  Peptide Sequence Number=SeqID_178298
atgcaattactcacccctcgtttgtccctcagccggttacagccggaagactggcagattttcaaagcggttcatgaagatgccgcgaccatgacctgggtgagcgagatccccgatgaaaacgacatccgccagcgctttaacgagcggctggcaccgtggcaacccagcagttttcacatgctgtgcctggtggcgcgcctgcgcgacagcggtgaagcgattggtctgtttggctgcagcgccgagtggcatccgtatcgtcaggccgaagtgggttacatgctgcgtcacgcctgtaccggtcagggctacggcagcgaagcgttgcaggcattgtgtacgttcctgctgcaggccgacttccacaaactcaaagcgctggtgattgagggcaactggccgtcgcggcgcattctggaaaagaacggtttcgcgctggaaggcacgctgcgcgataattaccggctcaacggccagtgggctaagaaaatttgccgtcccccctcgacaatattgttatcagcgcgttatgttcttgtttcggtcaccgcagtgaccagcgtcgctcggacggtccgggcgctaacgtaa

SEQ ID NO: 61521 - DNA, 345 bp, Glycine max
  Peptide Sequence Number=SeqID_178299
atggaaaataatggtgaaggttcagatgatggttgggtctggacaagtttgattctgatggatttttttgctaaggcttgggtttggcttgctccccttacgtctggtgagatgacactccagactcaagatccaaaagctattcctgtctttacaaaggtttcccccttcaaccaagtgactccaaatgatggctacattgaagaggcatccactccagttgttgggaaccttcttattacctctatctgggcgaggctttccatagaggaacatatctatgatttcctaggttgtcccttctcccaatctttgatcattgtcagacttcaagagcgcatctag

SEQ ID NO: 61522 - DNA, 633 bp, Glycine max
  Peptide Sequence Number=SeqID_178300
atgattcagtctattattgaagtgtcattgcaagggtctgattccattgttaacgcaaatactattgaaatagaccctggggttgcacccattcaacctcatccagtcacaactaaagatgaagttgatgtggatgctttacttgctcaacctatatcagaagtagacatccaaagaataaaaatcatatatggagccactgagtttgtacctttagatgcaatgaaggtcagattagagttcaagaaaaggattgatgttgtgtttgcacctcaacccccgtctaacatctttaaggttgcatcaacaatctcagaagggcaaacttgcaaccaagcattgaaggagaagatagactttggcacgcaacacctagacccagagatgcaaaagatagaacttgagaatttaaatatggttaagttttggaaggaaggaatgtcggggattgattccttctcctatcctactcaggagatctttgaaaaagaagaggatcgttctaaatcgagggagtcctttcatactgaagacatctaccttgaagatcctgaggagagtccaaacttcgtagattggaaattctacgactatggaccacatatgcaagagaaagccctagggttctcatga

SEQ ID NO: 61523 - DNA, 447 bp, Glycine max
  Peptide Sequence Number=SeqID_178301
atggagaacaaaaacaacaagagcaatgacttgaagtcagagccatgggtggtggttatcattttcctcttgaagatagatcggtcctcctcagtcgttgccgctatgccgtcggcaatgccaccttcgcccttcaaggcggcgcgttatatgttttatgcaatcactcgattacaattcatcacgtatggggagagttttgaggaatgtgcagcaagagaagtgaaagaggaaacagggttggacataggaaactcagtttttgagagtaacaaacaatgtgatgttggagcagccaaaaaaagtttgaaagagcaagtgccacaaaatcttgaacctaccaagtgtgatgattgggattggtatgagtgggatcatttgtcacaccctctgtttgggcctcttgagaaaatggttaaaggagctttcgacccatttctaatttga

SEQ ID NO: 61524 - DNA, 375 bp, Glycine max
  Peptide Sequence Number=SeqID_178302
atggaggcattggggatcccttggatagatgtacttcaaggctcagataatcctaaaggtgctaaacatctttcccaaggtataggaatcaaagaccacaaccacccaagaagcaagagatttttgaaaaatcatgcatgtgatgagtttcttggtattctaagagtctatgaagttcactttcagaatagggagcatctacaaaagaagaattacactgctccaagtctaaagagaaaagcttcaaaagagaagaaagtaaaaacttgtttaaggcttttgaattgcagatgtgagaatctactagaccagacaactttgatggatccaaagatgaggaggtcgctttcatgtccagaaagttctaacagatga

SEQ ID NO: 61525 - DNA, 537 bp, Glycine max
  Peptide Sequence Number=SeqID_178303
atggaggaggagaagaaggagaaaatggtgaaggatgacaaacaagagctggtaattgagccaacacctgaaccagtgcaacccttttgtgaacttatagaggaagaagaagaagacaagaaggatgaacaaaggagagagacaccaataaatttgactgaaaaagaaataaatgaaaaagaaaagaaggaaaaagaaaaagaaaaagataatgaaaaaaatgaaaaagaaaaagagagaaaagaagagacgaaaaagagtacgagtgagttagtaagagagaaaagaaaggaagtagcttctgatgagggaaaagaggtgccataccatttggtaccttccaagaaagacaaggaacgccatttgatgaggttccttgatattttcaggaaactggaaattaatatgccttttggagaagctctacaacaaatgcctctctactgtaaatttcagaaggacatgttgacaaggaagaacaaatacattcacagtgagaatatagtagtggagggtaactgcagtgcagtcatttag

SEQ ID NO: 61526 - DNA, 210 bp, Glycine max
  Peptide Sequence Number=SeqID_178304
atgactttgagattagctcatcagtgggctaagcgcacatccaccgctaagtgcaactttggcatgcttaatgcgctagaagaatctggcaaagcatcaatatcaaggtcgtgcgctaagcatgagatcagtgcgctaagcgcagtagttgtcttcagccaggctcaatgcatgattggcgctaagctcaaatccacttactcgtgctaa

SEQ ID NO: 61527 - DNA, 366 bp, Glycine max
  Peptide Sequence Number=SeqID_178305
atggggcatcgaaagcggagttcttcgatgttggtgtggtttaatgtttattttttgatgaacaagttcaagcaattgcataagggttatgaccttgttgaccatgaaattttttgtgttgttactaatgaaggtggtgccctcattagtgttgtggatttcaccattgtatgtattcaatgtgggttgctacagctgaagaactttttcctggctctccaaacgaatatggtgcatcaaactgttgtaaaagaagctaaatatgatgccacagaatttggtatatccaaatcgacaccaaataaattggtcatccattcatggctagttgcgttgaatgactcgccagtctggccaaaagtttga

SEQ ID NO: 61528 - DNA, 366 bp, Glycine max
  Peptide Sequence Number=SeqID_178306
atgggttccaaaaagagaaagagtattggtacaaggcccacattgcagtatgatacaaggaggttccactcctttgaggcctggacccgatacacagataatgttctaggaagacatatactgcctgagaggaaggtagaaatttaccacactgagcaggacgagtttaaggctgaattggagaggcgtaacttccataaatgcctcaccaatttagttgacaacaacatagatctagctttggtgaaggagttttatgccaatctttacagttccgaaggaccttcaccaaatcaagtcagggtcagaggccacgtggtgaagattgatgcagacagcctcaacaccttcctggaaacacctatg

SEQ ID NO: 61529 - DNA, 204 bp, Glycine max
  Peptide Sequence Number=SeqID_178307
atgaagccgcttagcagaagttgcagaagttgcagagcttcgctcgctaagctctcaaaccttagtggaatttttgaagagttggtgccgctaagcgtgaccttcaagagcttagtgcatatccttgcggcaaatgttcagcttagcgggcgttgtcccgctaagccaattctgcaaaagctgaatttctgcaacttccactaa

SEQ ID NO: 61530 - DNA, 534 bp, Glycine max
  Peptide Sequence Number=SeqID_178308
atgccctcaccttcagaagactacatgccctcgccttcagagggctacacgccctcacctttagaggactacacgtctttgctatcagaggactgcaagtcctcgcttttagaggactacacgtcctcaccttcagaggaccacacgttctcactctcagaaggctacacgccctcaccttcagaggactacacgtcctcgtcgttagaggactgcatgtcctcacgtgcagagggctacacgccctcccttttagaggactacacgtcctcgccttcagaggattatagaggaccgcacatcctcgcctttagagggctacacgccctcaccttaagaggactacacatcctcgcctttagaggactgcaagtcctcgcttttagaggacttcacgttttcacctatagaggaccgcaggtcttcgccttcagagggctatacgccctcaccttcagagggccatacgccctcaccttcaaaggactacatctcctcgccttcagagggctgcacgccatcaccttcagatga

SEQ ID NO: 61531 - DNA, 171 bp, Glycine max
  Peptide Sequence Number=SeqID_178309
atgggacgatatgacaagtggttaggaatacaaaggatggaaagatataaccttgatggtgctaagaattggataagggagattgagaaaatctttggagtgatagggtgttcaaaggggcaaaaggttgcttttagtacatatattctggtggaagaagctgagtattag

SEQ ID NO: 61532 - DNA, 228 bp, Glycine max
  Peptide Sequence Number=SeqID_178310
atgtcagatgaactttttgttggaggtgttgagagtagaaaactcaaacgtaagattgaggaggcatcttccacagatgttgtggattcagagttcgtattgtctctaggtcttggcaataacaaaatgactggtgaatcctcatctaatttcttatgcaagtcattgaaaggccataaggagtcaccatgttttgcttcaaaacttgtagagaacactaataatcaa

SEQ ID NO: 61533 - DNA, 216 bp, Glycine max
  Peptide Sequence Number=SeqID_178311
atgaaggagttgattaacaaaacacaactttctcccaaaataatcccaacgtcatcacgtcgactcggcggctccacaaaagaatctcacttctcgtactctactgctgtcattctactcccacgaacaaaggttcgcgatcatcacagtatgatgcatgcacctgacctcaactctcaactgcaatgtagtatcatccccaaggaaatagcctaa

SEQ ID NO: 61534 - DNA, 102 bp, Glycine max
  Peptide Sequence Number=SeqID_178312
atggctacggatgaagcacctagagatgcacacgctgatttagagcaacctcgacatgcaatggaggcttgccaagcaatagctgaaaggttggaaaggtag

SEQ ID NO: 61535 - DNA, 438 bp, Glycine max
  Peptide Sequence Number=SeqID_178313
atgactaatgcaaattgtccgctagaattattgcattcagtctcaaacgggaatctaaggggatcattcaaggcttgcaagaaactcatagcatctccaaaagataggttatatgatttggaaggaaagagcgttgaattggttccagtgatttacttttcagaatatccatatggtgctaatggagttgtgattgaaattggatgctggattgatcatacaggtgtgtgtgtgtgtgtgtgtgaagagcacaaggtggatttcaaggataacaggtcagtagacccagagaaatacactttcagcctaacaggaaggaagcctattagtttggaagagaaaaggaagcttggtgaaaggtatattccactgctgcaaacctctataccagagaaaaaggagacacttacatcacattttcgtgttagagtaggatga

SEQ ID NO: 61536 - DNA, 216 bp, Glycine max
  Peptide Sequence Number=SeqID_178314
atggaatccaatcaggcgtcttccaagacaagtcctctaacacctcaaacaggttcggtagatatatctggttcgttgtttttgaatcgtagagaggatgagggcttgggtggagaagacactaggcctagtcgtgctactcttgtggctttgttctcatgtggtgggttcaaagtgcaagcaattggatgtcataggttcatagtcggtgtttga

SEQ ID NO: 61537 - DNA, 117 bp, Glycine max
  Peptide Sequence Number=SeqID_178315
ctgagattgaaagagccctccatcttggatgaggcggctgaacctgaggttgagttggagatcgacgacctcattcctgatcgacagccggtgttaaccgaagaccggccaaactaa

SEQ ID NO: 61538 - DNA, 1230 bp, Glycine max
  Peptide Sequence Number=SeqID_178316
atgggaggtacatgtaaaaaggactttgatgagcaagtcagtggtgctctaaggtgtttatgcatctatgtgtggaatgataaaaacgtacctgatagggccatgtcagccacgccaactaactgctccaagtgtcatggggagctgagggccaccacaatccaaccaatgacattgccattcaggctctgcgccgagtgcaggagtgctcgggaggagaactgccacatggatgtggaagcaatgccttccaagattattttgatgatgccaaagaatcaaaagttaagcaaagtttcaagcaaagattcaagactcaagaatcaagattcaagaataatcaagatcaagattcaagactcaagattcaagaatcaagaagaagactcaggtacatcctttgtggtacaagtagagggtacatctacttgggttgttgtaactgaaaacaagagagggtacatctcttgtggatcagttcaagtggagggtacatccacttggttgtttaaagagaacaagggagggtacatcccttgtggatctttgcttgtaaaggtttttacaaggttgaaagaaatctcaagaaccgcaggttgcttggggactggatgtaggcacgggaagcacaacggagcaagtctaacaacccgaccctccaaggagtttgtcgtttcaagaagcgcaacgaggcacattcctttgttctttgcttcttgcattatgtcttcctctgctacggaggatgggtctcccatcaggggtacctctcttgtgggcaaggaggttaggggcatatgggagtttgggaatgaggaagagttatctatttcgtccctttcatccgtttatgattccgagagaacgaaggatttcctggtgagtgccggtgagagggtgggggttcaggaggagatgacgaagatggaggagttgaaaaggaagatcgacatgatgacattagatgatgtcgagttgttgatcgtggagccttgtagcgccaaggagcgtgtgtttatgagggtgtcaaaggacgttttgaagggctacgactacaagaacctgaagagtttggtggttgatgaccaaactcaagttgagaaaatgaagaagagaaaacgagtgaaggaatcatctaagactgagaagaaagtggtgaagtctgcggaggagcaaaaagaggtcgaccgtgctgaggtggagattgttaatttggataggcccgaggtg

SEQ ID NO: 61539 - DNA, 153 bp, Glycine max
  Peptide Sequence Number=SeqID_178317
atggaaaagagcttaaaggtaggtgaagatgagtggaaggagagggagagaggggggcatgaaatttatgcctcaaatgagctatggttcagcccactattccaagattctccacaaagtgtgcttaggtgtcatgaagaatgtaaagcatga

SEQ ID NO: 61540 - DNA, 186 bp, Glycine max
  Peptide Sequence Number=SeqID_178318
atggaggagggccatcatagacttctatgccacttcatgcttgaagagtctgtcaggccttgcctttacctagcatgtttcaacaaggctcaccaaagcgcaagtcaattcctcaattcatctataagatgcccaatcaaagcattaagtatggaaataaataaagaactcaagatgaagtgttga

SEQ ID NO: 61541 - DNA, 174 bp, Glycine max
  Peptide Sequence Number=SeqID_178319
atggctttcatgatttccagagctgaattagaggccgagaagtctagccttaaacacatggaagacaaggactctaacacacttgatggagtctcaagccagctccagctaaaatcctcattgtcttccaaagcctcatcgcaaaccttgaacagacaacaagtcaaggtataa

SEQ ID NO: 61542 - DNA, 846 bp, Glycine max
  Peptide Sequence Number=SeqID_178320
atgtacatgctaaatgtttctcaggatgaaatgaagcaactagccaagagtgagaggatggctgttcatgtgtcaaatatgtgtaacttggtgctgtttgcagcaaaggtttatgcttcaattgcgagcagatcattagcagtcattgcctcaaccatggattctctcttggacctcttgtcagggttcatattgtggtttactgctcatgccatgaaaaacccaaatcaatatcactatccaattggaaagaaacgcatgcaaccagtgtctaagcctgatatggatccaacgaaacttcattggatgatcggaattatggtgtgtgtgactgtagtgaagttcattcttatggtctactgtcgaagattcaaaaatgaaattgttagagcatatgcacaagatcacttttttgatgtcattactaattctgttggattagctgctgctgtgctagctgtcaagttctactggtggattgatccaacaggagctattattatagcattgtatacaatcaatacatgggccaagactgtcattgagaatgtttggtcactcataggaaggacagcaccacctgattttctagccaagttaactttcctcatatggaatcaccatgaacagatcaagcacatagatactgttagagcatacacctttggtgcacattactttgtggaagttgacattgtgttacctgaagacatgcttctccaccaagcacacaacattggtgagacactccaagagaagctggagcagcttccagaagttgaaagggctttcgttcacatagattttgagttcactcacaggccagagcacaagaccatggtgtga

SEQ ID NO: 61543 - DNA, 607 bp, Glycine max
  Peptide Sequence Number=SeqID_178321
atccaccgtggagtacattacctccttggatttcactgcaattgagtttcggcgtatggttggcatgtgccccgagattctgaccacccaagtctcagacctcatacctgtcttcaccttccttcatcgtgaggttcatgtgcctggctcggatattaagcgtgtaataaatcgtcgtcccaggttgcttgtcagcagtgttagtaagcgacttcgtcctaccctgtacttcctccaaagtattggcatagaagaggtaaacaagcacactgacttgctatcatgtagtgttgaggaaaagttcatgcccaggattgattactttgagaatattgggttttctcgccgtgatgcaacttcaatgttccgaagatttcctcagctattttgttatagtattaaaaataacttggagcctaaatacagttactttgtggtggagatggggagagatctgaaggagctgaaagaattcccacagtatttctcatttagcctagagaataggattaagcctaggcataaacagtgtgtagaaatggggtacaacattgatggtgctgtgcctggctccccgagtcatgcgacttgtggaggtttttattga

SEQ ID NO: 61544 - DNA, 399 bp, Glycine max
  Peptide Sequence Number=SeqID_178322
atggaagaggaaagagttgttatactgagcaaaaactgtgaggaggtcaccctcgataagatcaaaggggatgccaccgacaaatacgaccttggaggggaggttagaggagaaatcaaaggtccagtcacggaagtaagggaaggaagggttatgggattggaagagagggttattgccgcaatcagagtggtgacaaagggagggagtggcggtggcggtggccatcgggtgatgaggctagtgatgtcgttgcgccattggaggacgaacgcgagggtggcgagtgtcaaggggaggacaatgaagagcaagaggagacgtggagatggttattggtggtggatggtgctatggcaaatgttacttgcgcgaaaccctagctcggcaaaaacatga

SEQ ID NO: 61545 - DNA, 177 bp, Glycine max
  Peptide Sequence Number=SeqID_178323
atggcgttggagagaacattaagaatcccaatgcaaatactagaagggatctcgtttcgagaaccagctttagtgccttggaatcaaaatcaaataagaatacatggtggtagagagaataaatttcgtcttccctttaaatgtttgcctaacctaccccatgaaccagccaattaa

SEQ ID NO: 61546 - DNA, 1155 bp, Glycine max
  Peptide Sequence Number=SeqID_178324
atgcgaagctgcatcaacctctggatcgtggcggcactcgtcatccccgtgctcctcactctcagaagccctcgaggcgaaacccaaacccaaacccaaaccacttcttctttctccgattcttctaccttctccgtgaagcttgcgaactcatttccattcaaccaaaggatccgagatgggtcgaatctcgaatacgacttctacatggatacgtgtccccaagcggagggtgttgttcgttcggcgctcactcgcatctacttcgaccacagggacgttgcacctgctcttcttcgtctcttcttccacgattgcttcatcgaggggtgtgatgcttcgttgctgttggatgagaacaatggtgatagaaacctttccgtggagaagcaggccgtgccgaatcagacattgagaggttttgacaaaattgacttgatcaaggaagaggtggagcaagcatgtcccggggttgtgtcttgtgctgacatacttgctcttgcagcaagagattccattgttttggctggtggacctttctatccagttttaacaggcagaagggatagccatcaatcatttttcgaggaagcaactgatcagattcccagacctgatgataacgttacacgcacacttaatctcttcaatctcagaggatttaatgcaagagaaacagtcagccttcttggaggacacaacattggcaaaatcggttgtgacttcattcagcaaaggctgtacaactttcaaggcacaggacagccagaccccagcatcccccttgatttccttcgtcagatgaggctaaactgcccagatagcaagaacagcagcacaagtgtagacgagtttacgatctccaaaatggggatgtcatacatgcaagcactctcatcttcagtttcatcaggagcatcatttgacactcactactaccagagcctgctaagaggaagagggcttcttttcgccgatcagcagctgatggccgaggagaaaaccgctagattggtctctgcttatgcttcagatgatggatcaacctttcgcatggactttgccagggtcatgttgaaaatgtctaaccttgatgttctcactggacttcaaggccaggttcgagtcaattgctcactacctgtgtcttcttaa

SEQ ID NO: 61547 - DNA, 240 bp, Glycine max
  Peptide Sequence Number=SeqID_178325
atgagggaggggaatgtttttgcactcaaaaacttcccccctcattctaaaagagcaaggctttcgggactcacggtttttgctcccccaagccacctttggttgcattttgctttcatttttggtactcctactcattctaacaagcctatgttgtattctgaagcaatggggcatgccacattgcccccactctcttgctattcatgcctaaacatgcgcccaccaagtgctcggtga

SEQ ID NO: 61548 - DNA, 105 bp, Glycine max
  Peptide Sequence Number=SeqID_178326
atggccccctacagcgacattttccgcttgtccagcgccgggaagggacgacaatctgtcggtcgtgaccctatcctctatttgcatccgtccctaagtacctga

SEQ ID NO: 61549 - DNA, 144 bp, Glycine max
  Peptide Sequence Number=SeqID_178327
atgaaggcagtcatgattcaaggcacatctcctctagctttcatttacatgcagatctgggtcatggttggtggctggtcaaaggagaatggttggtgttgcaaggtggttgatggtggccaaggtcattggaggaatggttga

SEQ ID NO: 61550 - DNA, 271 bp, Glycine max
  Peptide Sequence Number=SeqID_178328
atgaaactcatattcagctcaactaggaaaatattttgtcacacgtgcagttataactctttctatgagagaggtgggaatagaggaggcaaaggagggaaaattggttttggtggtggaggtggtggtggtgatggggtcaaacctggtattactattggtgggaaagggggaaacaaagatggtggtgggcttggaggaggctggaatgggttagggataagtggtggtgggcttggagggggctggaaaggattaggaaagagagttg

SEQ ID NO: 61551 - DNA, 261 bp, Glycine max
  Peptide Sequence Number=SeqID_178329
atgggtgccaagtacctcgaagtagtcaaacgagggtcgcatcccaacaatggatggtccccggacaaaattagggcgcaaaatgaccataatttgtctccgtgtgtctttggacgcgatcgagcctgggcggcaaggcgcagaatgaccataacttgtctctgcgtgccaccggacacgatcgcctctggatggcgaaaaggtgtacggaatgaccataatttgtctccgccgccctctcgacttactgtcaccgaatga

SEQ ID NO: 61552 - DNA, 672 bp, Glycine max
  misc_feature (5)..(5): n is a, c, g, or t
  Peptide Sequence Number=SeqID_178330
agaanagacgtcctctccttcaaaggactacacgtgctcgccttcagaggactacacgtcctcacctttagagggttgcacgcccttgccttcatagggctacacaccttcaccttcagaggactacgcatctttgccttcatagggctacacgccctcgccttcagaggactacacgtcttcaccttcacaagactacacgtcctcgccttcagagggttaccagccctcgcatttagaggggtgcacgccctcgccttcaaaggactgcacatccttgtcttaagagggccacacgccatcacctttagaggaccgcacgtcctcaccttccaagggctacacatcctcgccttcaaagggttgaacgacctcgccttcagaggactgcacgtcctcacctgcgaaagactgcacatcctcgccttcagaggactgcacatcctcactttcagagggccacacgtcctggccttcagagggctacacgtccttgcctttagagggctgcacgccatcgcctttaaagggctgcatgccctcgacttcagagggcttcacatcctccctttcatagggctacccatcctcggctttggggactacatgctctcaatttcagaggactacacatcctcacctttagaggcctatgcatccttaccatcatag

SEQ ID NO: 61553 - DNA, 579 bp, Glycine max
  Peptide Sequence Number=SeqID_178331
gcagatccatttctcttcatctatcatcataacactgtaagtctctaccttcttgtctacgttgatgacattattttgaccggtagtaatcattttgccatccaaaccatcctggctaaaattcgagttgattttgccatcaaggatctaggtcgtctaagttattttcttggtcttgagactcctggtcttgattatgatcatacattcagtcctatggtgaaggcatcaattgttcatgttattcttactctagcagtcatgcaacattggccccttcatcaaccggatgttaacaatgccttcttgaacggactcttggcaaatccagtctacatggagcaacctcctggattcattgatcctcgcttccctcaccatgcagatccatttctcttaatctatcatcataacactacaactctctgccttcttgtctacgttgatgacattattttgaccggtagtaatcattttgccatccaaaccatcttggctaaaattcgagttgattttgccatcaaggatctaggtcgtctgatcgaggccgtacccgaatcaaataaacatgaaaatgca

SEQ ID NO: 61554 - DNA, 237 bp, Glycine max
  Peptide Sequence Number=SeqID_178332
atggcgctaagcacgccttcgcggacaagaagccctttttttaagcttgatttgtggagaatgaaagtaggcaaaaaatacacaagaagaagtagccgtcagagcttgaagagtgaaatacagaggcaaagaacagagcaaaaagccaagggctttagcattgaaagatgtattgtctccttagaacttgatagagtaggattaggttaccgtatgtctggacacggagtgtggtaa

SEQ ID NO: 61555 - DNA, 265 bp, Glycine max
  Peptide Sequence Number=SeqID_178333
ggatcacgctcgtaagacacccagtggacccggagaagtccaacagggtcttagggtttccaactctgattacgggcctctgtcagttctacggagtgcctgtcgccccccaacaagggcgagacaccatagcatcctggggatggccgacagcggataatagacgcactgccaccatctccagagcccttcagctcatctacaaaagctggagcgttgcctacgacccatggccgaccagcaggcgaccaagtcaaagccaaag

SEQ ID NO: 61556 - DNA, 637 bp, Glycine max
  Peptide Sequence Number=SeqID_178334
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgcttttttcgagaaatacgagacatctaagtcatccaattttcatttcccatctcatggaaaacccttttcgctccgcttagccctacctccccctagtagggtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgaattacttatccctcg

SEQ ID NO: 61557 - DNA, 345 bp, Glycine max
  Peptide Sequence Number=SeqID_178335
atgccgcacgaaaaagtgaaaacaagaagcaaagcttttttgaaaatggagccggagaagaagagaagagatagcggcgaagaaagaaagatgacggaggcatatataaggaagaagcccgggatggcgagcgtgaaggacatgccggttctccaggacggtccaccaccaggcgggttcgctccggtccggttcgcccggcgcatccccaacaaagggccccagcgccgttgccatcttcctcactgctttcggcgctttctcttggggcatgtaccaggtcggccagggcaacaagatccgaagaaggattgggcttgtgctactgctcgacctgattcttaa

SEQ ID NO: 61558 - DNA, 441 bp, Glycine max
  Peptide Sequence Number=SeqID_178336
atgaagaaaaagagaagaaggtatctaccttcggatcttgttgccctggccgacctggtacatgccccaagagaaagcgccgaaagcagtgaggaagatggcaacggcgctggggccctttgttggggatgcgccgggcgaaccggaccggagcgaacccgcctggtggtggaccgtcctggagaaccggcatcaacgttgagcgcagcggtgaaggtgaagtttccggcgtcaagctttgtggtggtcggtggcggcaaacaaggtacgcagatggtgtttgttcgtcacagacgtacggatgacttccggatcaagttgatccatgagtggatgtatgaaataatgtctgaacgagcggatatggattatgaaaatgcagaatcatgtggtgcgaatgaactacatgttgattgttcggatgcgttcaagacttctcag

SEQ ID NO: 61559 - DNA, 138 bp, Glycine max
  Peptide Sequence Number=SeqID_178337
atggaagaatctcatctacttcaccaaattcccaaaggcgtattgcgaggaacacctatggagagtatttcaacgttatggaaggcttgggaatcattcattgagtcagcttggtcctgctacagagctatatcctaa

SEQ ID NO: 61560 - DNA, 219 bp, Glycine max
  Peptide Sequence Number=SeqID_178338
atgtgtacatatgtggttgtcctgactcaaatatgggacattgaaagtggagatgttggatatgatggtggtgccctcattagtgttggaaatttggctgttgtagtaaacacaaacatatgcatttgggtgacacatagtgtcacatgcactggtaaatggcatttgagtctatgtagcacatggcctcgagatgcgataagggtgttcactgtgtaa

SEQ ID NO: 61561 - DNA, 321 bp, Glycine max
  Peptide Sequence Number=SeqID_178339
atgcaaaaagaaagcaagaatgcaggttgcacaaatttgggcgagagagaaaatgcaggatatgctttgagaatctttggaaaattgctaagcgagcctgagagacttttgtgtagaagcaagcttcatgatgaatcaagattgattcaaagaagttttgatgatgacaaaggtaatgacaaaaagctcaaagatcaagaacacttcatgataacaaagatgaagatctcaaagaatcaagaatcaagattcaaggttcaagttccaagaatcaagatcaagattcaagactcaagattcaagaatcaagagaagacttaa

SEQ ID NO: 61562 - DNA, 198 bp, Glycine max
  Peptide Sequence Number=SeqID_178340
atgaatcatgacactgtaaatcatgccattgacactcatttcatccagcaccttcagcatccctctgcaaactctgcaacacccttcataatagtggtggtggtgctagaaacagtaaagctagaagtttcggaattgaagaggtatagagatgtcaacatcgacagttttaaagaaaaatacagtagaagaacataa

SEQ ID NO: 61563 - DNA, 576 bp, Glycine max
  Peptide Sequence Number=SeqID_178341
atgtatagggtacgacttggtgttgatgtagggagttggattttaccattaatgcatcaacaattagaacaaaaatggagtgacctaaattggcaagataaagcaaaaactaatgccaacaatagggattcctctgatgatggttcactagatacaagaggatcaattcctacatctgagcattttaagagactaagagagactcacacgagatatttgaggatgatgtgtctagttgtcaagtctaatgacaatgtcttttatgatgttggaggtatggacagaaaaggacgggtatttggtctaggttcagagattggaaaatacaaaccttcctcatccatattgtttgatggtttctcatcacatgtatacgagaaaatgaaatctcaactttccaatttgacaaaagaaaataagaacatgaaagaggtgtttcttgcatcacaagaagagtcctgtttgtttcgtgagcaaatgactcgatttatggagagtttttctcttggtcaaacatttcaaccagttcaatgtgatccacaacctcctataggtgatcgacaagatgatgaatga

SEQ ID NO: 61564 - DNA, 423 bp, Glycine max
  Peptide Sequence Number=SeqID_178342
atggaaaatgattattacggggtcttgattgataatgttgaagtggagtatactgctcaacaagcagagcaagtgtactttacatcattttcagaagggcaacaagattggttaggtgttgtaaaaatcaaggcatgcagtataattcaatcatttgaaaataataagcctgaagttgcataccaagatgatgatgaacatcaaattgtgcctatagttgttgcaaatggggattttgcagaaagtcttgttgacactcatggcattggacagaaagtgccaattgattgggaagaagaagaagacatagaattcatgtggagtagtgaagaggaatttattgacaaagatatagaagaagagcgtctacaagaagaggaagatgacaattatgaagcttatcaagatagagattcaaactaa

SEQ ID NO: 61565 - DNA, 441 bp, Glycine max
  Peptide Sequence Number=SeqID_178343
atggcaaataatcagaatatgagtggtagaggaagaggtactggtagagggattagtagaggtaggggaagagggagaggtagaggtactattttgccacaaccttctacttctcaactgacacatcctattgggcaaccaattcctcctacacttgagcattgttccacatcccaaacacctgcagctccccaacttaaccgatctacatgtagctctcattttcaggccacacatccttccatatcccaaacacctacggctccccaaattaacctgtctacatctaatcctctatctcagcccacatatcctactggacagcccatgaatttttccacaacaagcacacaactcccatcacatgcccaagtagatgttgcatctgctgacagtccacatgtagcatcatcacatgttgatccaccaccgcagatttga

SEQ ID NO: 61566 - DNA, 386 bp, Glycine max
  Peptide Sequence Number=SeqID_178344
atggcggtaaccccctgtcaggtgtgtattgccagtgacaatggcgagaccgtccacgtcagcctgtctcaccaatggcaatggcagttcgaggcacgtgactataatgttgtgccaacgacgacggtgttcactggacccaacgtcgttgaagtaatgtttctgaaattcaaagacaggatagaagactcacaggaaaaccctagtaggatccttgaatcagatggcaatgccattattatggatatgaccgctaatgttgttattgatgttggaggtggaaagtttaagcttatagtgcaagacgaagacatgacattcaatgttttcgatgtcatgaaccccaaggggttaaggttgaccacaaccatccatctcaatgacat

SEQ ID NO: 61567 - DNA, 546 bp, Glycine max
  Peptide Sequence Number=SeqID_178345
atggcgcgtcacgctccttgcgtaaatactttactttcgaaagagaacctattaggtaaattgtttgtaaaagtgaccctcgtaaattttccgaactctcccttcctcaatcatcgtgactccttcgtcatcttcaatctcgtggtgaaggctttagaaagggagtttttgagtgatagtgtggcggttaagttgccctggcatttgaaacagaacataattgatgagatcttgcagagacttaggagcttgaattccagtagaacagatattgctaaggaacgaggtcatggaggtagtgatggattgcatggttatgttccatctcttgatcatgtggttgtagatacaattagatcagacaatcctgggataccatgctttctctttggtcactccactgggggagctgtggtcttgaaagcagcttcccatcctcatattgaagtaatggtggaaggaattatattaacctcaccagctttacgtgtgaagccagctcatcctattgttggtgtaaattttgcatttgttagttgtgcataa

SEQ ID NO: 61568 - DNA, 909 bp, Glycine max
  Peptide Sequence Number=SeqID_178346
atggggtggaacgggatcattccaacttacacaaagtggacatggcatggtgaattgccagacaatccatcagtctctcacactaagtcagtcaaggcagacaggggttgtcgtatagaagacatgattcgcgacctaggccaggatggttttcaagaagcgcatgcacctttgtatgagaaaatggagaatgattcaaagattcctttgtattctgggtgcacaactttcacaaggttgtctacagtgttagctttgaaattgcttcctgaagataacatgttgcccaaaaatcaatacgaggccaagaagatcttatatccagtgggaatggagtaccagaaaatccatgcatgtccaaatgattgcatattgtatagaaatgagtttgcagaaacaagtgatgttgtaaccgcagagaacaatcgtccaacaaaggttgaaaaactgatggattgctatgacatcccgctaatagtccgcaatggaagacattcaattctttgtatcctgatgaatcgccttcttcttgttcgtcaccctctactagctttatccaagctaccaccattatcacccttttcccaaacctattattattcatacacacccacacgaataaattctcaaatatataagattaaggaccctcctcgcacaagcgctacattttgcagtaccaacaaagagttgtcatctaagaagtgtgtaccttgcaatacaaaggacttgcaactcatgactgaggatgcagcacgcactctgcttccccagggctttgattggcacaagaaagaagctgccttccaccttcaagttcagaaacttacagagagaaacacttatttggagcagctgctgctagatatgcagaacagggaatctgcatcgataaatagcaatttttaa

SEQ ID NO: 61569 - DNA, 645 bp, Glycine max
  Peptide Sequence Number=SeqID_178347
atgtatgtggttttcaatattaaagttgaagcacatagttctagcttttacaccaaagactcatttgatgacatcatttttttcttggggaacgaagttccaaacataattaatgtggaaccagtgtttactgtggggagcattccagaaacttcttacaatgttgtgaaggaccagaagtactgtggggagatcaaggttgcactcacctttaatcctgaggaagaacactggaagggttgtgctgagtcacgagagtctacgggtgcgccgtcgcggaaggtgtcagctgagtatgaccacgagattgaagatgacgaaggagtcacgatgattgaggaagggagagttcggaaaatttacgagggcgctaacatggacggtcccgccattagcaatggcgatacaagctggcgtggagtctgttttgcatggaagccacaactggcattggcgatatggtgtgacccgccactgccaatagcgatacaggcactgacgtggacggtgccattagcgatacaggtgctgacgtggacggtcccgccattagcaatggtgatacaagctgacgtgaagtatctcgccagaagcattggcaatataggttgtaggctagggcaagaggttgcgcagaggtcagag

SEQ ID NO: 61570 - DNA, 288 bp, Glycine max
  Peptide Sequence Number=SeqID_178348
atgccaggacccatcgtgcttcttgaccaaaagaacaggggacgagaaagggctgatgcttggacggataagccctttctgcaacatgtcctcaacttggctttcaatttcttgtttctgaaagtgagggtatctatatggtctaacattcacagggtcagagttgggttgaaggtggatgtggtggtttgtgggatgagatggaggaagctctgtggttgtgattgcaatatggaaataagcgctcgcgccatccttccggagaagacgatgaacctggggaggtga

SEQ ID NO: 61571 - DNA, 399 bp, Glycine max
  Peptide Sequence Number=SeqID_178349
atggccaagcgtccacctaatgtggctaggccaattggtttccaccagtgtaccctgccaaaatatgttgaaagcactttagagctacaagttcctaactttgctacattttcaagaaaggatggtatgtcggctatggagcataatgacttttactggtactctaaccaacctcctaattttattagcaattggatagacatgggagattgcattcatgacaaattatattctcctcaaccaaatgtttcaatggtggacttgataaataccaagcaaccagataatgaatttgtggctaatttcttggagaaacttaggcaaataaagagcaaatgcaatgttcaattcccaaaagtgaaatatggcaacataactgatagtaacatgagttcctaa

SEQ ID NO: 61572 - DNA, 1328 bp, Glycine max
  Peptide Sequence Number=SeqID_178350
atttggacttggttgttatgtctcttgacttggttgtgatgattacaagaactgatgatgaccttccaccaacccatcaaaatagaatttccaggggaggaagaggacatctcgctgggaatgagagatctgttgttggttcaattccttacccaaggatgtatagtgaaattgatagggagacccaaattcatctacttgagcaagaagcatacagttcagttctaagagcctttaaagctcaagccgatgctattacttgggagaaagaaagtttgattacaaggctgagaaaagaactgagattgtcaaatgaggagcacaaagaacttccaggtcgggttaatgttgatgttgtgcctccttgttgtgcccctagggaaagctcttatgtttcagtaggaacatgtaaagattgcaccacgtgttttggtcactctgatctccataatgatcatccatctacaacacaatttaggaagaaactgccatggtttcttagttctctgccatctgcagattgtgcaaaaggtggtcatggagcttacaccagcagtgttgaactgaaagtagtgtggactcctaatacaacattagcaccacttagaggtagaaggggagttatggcttgggaggacatgcccaacaacttggctagtggttctttaataaagttatgggtactccccccatcaactaaaattaccacagggtgtgccaagtggcctgaaagggagtggaagctaatttgggttggagttgggtttgggtcatcaggcgggtcagctaattctattggtgagaggcgcttcagaggaacaggggtgggtgagggtgattttaagggtgtgggcagtaataaagggcttattaaggatgaaatgggtaaggggttcaggaaagtaattgatgaaggattcggggaagcaattgatgaagggttgataggccaaggtcaagggttggagagcctacacttcgcggtgtatctccagagacaaccccgaaatgaagcaactcaaaaggaaaggggacgacagaccaatgatacaattcgccagatcctcgagctcagagagaaaaactggccaagagggtcgcatgatttcaaagaattggttgatcttaaagatccaaccaagcgggtttgcaccattaaacctcgggacatcgagcttcatgcgatgatgaatgagctcatcgattttgtgagtgaggtgctggatagtgtcactgagggaaagttggtgactggtgagcttgcacaatttctagtttcgagggtccagttcctccaagaagcaaaagacaagagtaaaaaggaataa

SEQ ID NO: 61573 - DNA, 351 bp, Glycine max
  Peptide Sequence Number=SeqID_178351
atggagacccccacggaggtgctggtgaatctcaacaagtacaactcccctatcatggagcccaagtcgcaagtcacttcccaggtcgtgctctatggcgtgggtctctttgaggacgacatggccaagccgcaagttggtgtctcctcggtgtggtacaagggcaacacctacaacatgcacctcctacgtctctacgcctctctgaggccgtttgtgacggcgtcgccaccaccggcatggttcccttccacttcaacactgtcggcgtcagcaacaccatctctattggcacccaaagcatgtgctacaacctgtagtccaaggacctcatcgctgacaacatcttga

SEQ ID NO: 61574 - DNA, 650 bp, Glycine max
  Peptide Sequence Number=SeqID_178352
atggagggagaaatatcatacacaacatgtccaccaccaattttcgatggtgaggagttcgaattatgggatgcaaggatgactgctcatcttgaagcattggatctttgggggacaatagaagaaaactatgatctccctgaactacctttaaatccaacagcggctcagatgaagaatcacaaagagaggaagacaaaaaagggaactgataaatgctctacagacacagaagtagagaagaatgatgacacaagaggaggcggtacaaggatacgagttccatatccatttcaatggggagcacctacatttgatgcaagtgaagcctttgccatgatgatggcatcctttgttgctcttgtagagatcccttatggccgtggacacattcctggtttcattagccaacataatttaagagttggggatatcatcatcaaagatcaagtcagcattatgtctctaattagtattgtcattggtgaacttcagtcgttgtccaagattaatttgagttccaatgctttatctggttcaatccctgacttcattggtgattttcctagcatttgctttgtagatttgtccaagaatggcttcactgtggagataccttcggctttgtttacctactgctacaaaaccaa

SEQ ID NO: 61575 - DNA, 663 bp, Glycine max
  Peptide Sequence Number=SeqID_178353
atgcctaggcaactagctcacctgggtgagcttattccttcagggctaagcatcagctcgcctaggggttccaaggaagaaggaagaaaagcgaagccgaggcgctaccaaattgtgatcgtgatcattccctacatcgttctcttgttctatgtccctcgtgcaacagtcggtctttctccaaaggagtttggcaattttggaggagaatggattgcgacaccaagagactgtgtagaaggtggcctccttggaggcagagtaaggtcaaaccgccaactgtctaccaaagttagtggtgtattggccaatttgctatgcacccgattagatggtgatgaattgtttatatgctacaaagacttgcaggctgagaagatggacctaggtggcaatgtggagagcttggcggctgagaaggataggcttgctaagttgattctgtacaagaaagaggtcgtggagcagcatgaaaaagggtttcagaaggtcgtcaggcaaactgatttcttagtgaaggacctcgacttagatatcttcgatcccttcaaggatgtgaaggatggtgtccagctcgatgaggaagacattgttgttgcggaggaggaggctgctgatgaaggacaaggtgctgcggagcatggcgatgatacctgtgactag

SEQ ID NO: 61576 - DNA, 201 bp, Glycine max
  Peptide Sequence Number=SeqID_178354
atgacgaaggatgcgatccacagtcataactctatagcgcctgactccactttctcgcactttcttccttacagcgagcttcccctgaatttgagccatgaggtgcagacaaaactcgcccaggtgatttgcttgcctaatgctcaaggtactcactcgcttaagcaagctatagctagcccaggcgagttgtttgcttag

SEQ ID NO: 61577 - DNA, 1230 bp, Glycine max
  Peptide Sequence Number=SeqID_178355
atgaaattccctacattgatagaggagattgtaaccgtcaaggatgaccaaaagcaagcacaacagtgctatgtagaaagcctgaaggtaacaccatatcctcccatcggggagccgatcatgcctctctccataatggctaaaggcactcaagtcataacagtggacaaaaggcctcaaattcgagccctaaccatccaccaatttagcctggactatgaatttgacatagattcgcgagacaaaacctctgacagaggtctgaaacccatcgaagagcttgtccagttgcaactcgaaccaaaaccgggtgtcgtccaagaagaagtcgacaagctcctccatgcaaacttcatcaaagaagttaagttttctacctggctcaccaacatcgtcatggttaaaaaggcctactgcaaatggcgaatgtgcaccgactacactgatctaaacatggcataccccaaagacatcataccccaacatgtggtggacctagaagaagtatttgggaaactacgcaactacaacatgcacctcaaccctgaaaaatctttcctagctttcaagaagaccatagccacaccggcagttttgaatcaacccaggccgggagcaccccttctcctgtatctctcggtagctgacgaagctatcagctcagccctcgtacaagaggaagggaagcaccaactccctatctattttaccagccacatgctccatgatgctaagaagtgctaccaaatgattgaaaaggtggcgctagcactcatcacctcggctcgattgcttaggccctacttccagagtcatcaagtggtaatcaagacgaactaccctatcatgcatgttttgagaaagcttgaacccacaggaaggatggtggccaggtccattaaactttcagagtttgacattcagtatgaaccacgtgaccccatgaagacacagttcatggctaacattctggcagaatttgctggaaacggcacaaccaacccagactggtggaccctttacattgatggtgcatccaacgtgaaaggaagtgaggcagggatcattctcaaaggccctgacaatatcactttaagagcaagccctcaagctcaacttcagagcctcaaacaaccaggcaaagtacgaggcgctcattgtaggtctaaaactagcaagagaagtcgaagccaagaggctacgatgctacatagactcgcagctagttga

SEQ ID NO: 61578 - DNA, 315 bp, Glycine max
  Peptide Sequence Number=SeqID_178356
atgtcattttgggttattttttgctcatttagggttcaaaatacctctatttgtttgaatttgagacctaagtccaaaaatagcacttaccttgatgatcatggcattgatgtctggccccttcttggacatcttatgcaaaaaaccattggcaacattggacgagttgagagcaagattgctggtcacaacaccaaaggatgcactaccctcaaggaaaagatagaaaaattgatcaagaaaagggagttgcaaagattcattaaggacaaggaaccttcacgagagcaagaaagggagtgcaataagagttga

SEQ ID NO: 61579 - DNA, 1032 bp, Glycine max
  Peptide Sequence Number=SeqID_178357
atggggcgtggagactctgcctccaatctccttgagtgtctttttgtcgataaaggcaaaatatctgatggtgaagctcttggagagctttccctgaatgaaggtggtcatcaagtccacgcagcctctggtctcgactctctcacctgtaaatccgaggagtggaccaacatgaggacgaatagtgttgggaatttacaagatagtggaactctcaagcgggttgcttggggactggacgtaggcacaagggccacttgtctaacacactatgatgatggagacaaccacgaggtcgtattggttaaaggggttgacgcctttaaagtccctatctgtaaaggactggctggactgtcctccataggaaaaaccaacagcaatggtgttgattacacctctgatgtgttaggagggttcctatgtcctctaggtcttgctcctgcttggtggttgtctgtgatattgcagtatttgggtacctcctggttgaatgcttccttgagaatcattgtacaattggtcgttagagattgccaaggtggccaaggtcatgcgatgagacctgctggtggagtattgcatactgaatcgttcaatgaaggtgtcgaagatgtctatggacctaggtggaagtccaccatactagacatccaaatgcttgtctggatctgttgtcctatcgtaccagtcgaggttgagtggtttccacccaagggtgtgtctgcctccataatgcggtcaataaaaggatgtcgacgaacagtctgtgttgctggacggtgcatgtgggcgagacttaagttgtcaaaagtattgcctgtgcgtcgggggtgtgattccccttgggtgcatttaggcaagagtgtttgtgtctgtcatagctgccagacgaggatgagagtctgtgagggtagtctcacgtctgaggcaagacgtgagaagattgacgagaggccacgtggtcccgaacttcacatgtcggctaggagaggtgtctttgacaggagggggaacatgcaaaacaaatga

SEQ ID NO: 61580 - DNA, 273 bp, Glycine max
  Peptide Sequence Number=SeqID_178358
atggggcatgtcaacttgctaaccactttcaaagatgagaaaggttccaagaccatcatgatcaggatttatcaaagaagtgcaatatgccacatggtcaacgaatgtggtaatgcactatccaaatttatatcaagagcacttgacatggacaagactttcttcaaactattgaagaagcatgagggaacaaagtggaacgagaaatgtgaagccaactttcagaagctcaaagagttcctcactttaccacctatcctcattagcctttaa

SEQ ID NO: 61581 - DNA, 552 bp, Glycine max
  Peptide Sequence Number=SeqID_178359
atggtgcaaggattgtttgttgcacaccagctctttatgtatggctggtctcgcacctctttagtcatgaaagtagactcgtctatcccttgcaaggtcaccgcatatgcgctgagaaagggaaggccaattgggagcaactcttggctagtatggtgggggcatccattaattggttcccccgatgaaaggaaggaagagccgaggttttatccttatagcgcggtacaaaggaaagataaggagcttaggggaagcaacaataggatcattggcggctatcacaagtggctgaaggctctgatgcaagaattagattggctcccgaagctaaagagctcaagtgaggaagaggctgaaaccactgaggagagtgaggaggtgcaagccttaaaggtggaacttgaaagggcacaagcggtcaaggaaaagttcaagacgacgaccatcaaggttcaaaaagagtgcgacaaactaagagacgttaatgtggccacatctgacgcattggaatgggaaacaaagagggcccgaaaagaagaatggggctga

SEQ ID NO: 61582 - DNA, 1461 bp, Glycine max
  Peptide Sequence Number=SeqID_178360
atgagccacagcctggaagcctcgctggtgttcaacgattctctggcggccaacgaaacgcttgcggccctgggtaaacaggggcagtttgccatggccgaggtggtcaacgcgcataaaaagcggtttgcttactggtcctggaacccggaggataacaacgacacgctgggcgccctggtcagtcgctggctttttcccgttccggttgcgcagcccatcatgcataacggcgcaatggtcggcgaaattcgccttaccgcgcgagacagtctcatcagtcatttcatctggatgtcgtttgccgtgcttaccggctgcattctttttgctaccgtcgtcgcactcaccattacccagtctttgcatcacggtatggtgacggccctgcaaaacatcaccgatgtcgtgcatgatgtccgcactaaccgcaacttctcccgcagggtgaaagatggccgcatcgaagagtttcaccagtttggtgaagacttcaacagtcttctggatgagatggaagagtggcagctaaaactgcaggccaagaacgcccagctgttgcggaccgccatgcacgacccgctcaccggccttgccaaccgtgcggcgtttcgtaacagcattgcagctttaatgaacgatccttccgccagaactaactcggccctgctcttcctcgacggtgataactttaagtttattaacgacacctggggacatgcggcaggagactgcgtgctgattgaagtggcgagcagaatgatggagtttggcgacaaacgtcatcagtcctatcgccttggcggtgacgaatttgccatggtgctctacggcgtgcactctgagcttgaggttcaacacatttgtgctgcgctttcgcagcagtttattcgtccgtttgatctccataacggacaaaaagcatcaatgtcactcagcattggctttgctctggcgtgggaaaatgcttccgtggaagcattactggagagggctgaccgcaatatgtaccaggttaaaaaccagcgctgtcagtcgccgccggaaggcaaattcactcctgagcaaatcgcggcgatgaagtcttacggttttaacgaactgaacggtgactggtcacttggcctgtcggataccatcctgtttgataaaaatgacgcccggctgcgaccggaaagtgaaacacagatcaagtccatggcctctcgccttgccgaaaccggcctgaaccacgcgcgaatggacggccacacggacaattacggtgaagaaaactacaacaatgcgctgtcgttaaaacgcgccaatgccgtggccgacgcctgggcgaagggagcgaatatcccgcgcagcaatctcaccacgcagggattgggtcaaaaatacccggttgcgagcaacagtaccccacaaggacgtgctgaaaaccgccgggttgccgtggttatcagcacgccatag

SEQ ID NO: 61583 - DNA, 321 bp, Glycine max
  Peptide Sequence Number=SeqID_178361
atgatgaccaaaggttggagcttttttggagcttcaatggtggaggaagaagaagagaatggcaacatgagagagagggaaaaggcttctgaaattttggggctgaccacaggaagtgagaaaaatctgacctttgaaacgctaaagtcatgcctcggtttgcgtgccgtttctctggttccagtccctcgtgtttctctacacttgtcggggccagttttcgaaagtaggcaatatatatatcaaaacgctcagaatgaaaccccgagtgtggttcagaggttggttttgttaaattttaagtcgcacgtaaaacgatga

SEQ ID NO: 61584 - DNA, 136 bp, Glycine max
  Peptide Sequence Number=SeqID_178362
gtggattctcccgaggatgtcatgtcggcatatgaggcagactctacgaggatagtggccctggagagatggcgatcagtggaggctcttcatcatagtagacagctcattggactagttttatatacttttgagg

SEQ ID NO: 61585 - DNA, 252 bp, Glycine max
  Peptide Sequence Number=SeqID_178363
atgggaagtgaaagatggatggtgaaattaatatgtgggagtgacaatcatgaattggacaagtcattagttagacatccatatgttggtcgactgactaaggatgagaagattattattgctgatatgacaaagtcaatgatgaaaccaagaaatattcttctaatgttgaaggagcacaatgccaataattatacaacaatcaaacaaggatgtagcgttgatgaatgcaatgaaaactgtattccttga

SEQ ID NO: 61586 - DNA, 264 bp, Glycine max
  Peptide Sequence Number=SeqID_178364
atgaaaacaagtttttataggaattcatactttaaggcaaagtttgatatcgcagaagctacgaaggtgaagacgaaggttatgtcaacagtagcgacgagatggcgacaatttaagtccacattgactagcaaatttgtgtttgctaagagtgaaggtcaacaaacacaggatgttgtgacaaaatatggactagatcctgaagcatggaaacaatttgaagaaaaccggctcacacctaactgggagggtattaggaaatga

SEQ ID NO: 61587 - DNA, 890 bp, Glycine max
  Peptide Sequence Number=SeqID_178365
ctcgcttactcccgtattactgcgacagctgaacgcctgggaaaccacgcttccgccaggtttgaaaaaactgacgattgggggcgatctggctgcgccaaaagaggtggaagccttcttactccggcagccatggcttgagctatatctgacttatggcatcagcgaagccggaccccgagtgtcgacgtgcccggcacatctgctggggagaggatattatgcttcagccggacgtcctattgaccagacggaagttcgcatcctgccaggtgcagacgggcaggacgggcagggggagttgctgatctgttctgataccttgcttgtaaaacgtatcgggcggggtaaccgacaaacgtttattgagcttgatggcaaacgctggcttcgcactggagatatcttcttccaggacgctgatgggttcctttttttcaaaggcagaatcagtgatttcattgtcattagggatgagaaggtcaatatcggtgccgtgaaacagctgtgccgggaaattaaaggggaatcagatgtgtttgaaacatggccagcggacatcgttcgcctcaagtttcctgaggaacactgggattattatatttcacgttatgagcattttcgcgacgaggtcatacgtaacctgacgcctcaggactatcttcgcgaaatgctgaaacaaacacagcgtttaccctgtttctgttcggaaatggccgatgtcgcggcgatactgtatagccagattatcaataaacccaatgagcggattcggtattttgatatttctgcatatgcccaggtgctggaccgtaaaagaaggaaagtggttaagcctgccgagctggatgggtttgatgcgacagatatcacattcgatttcattgaag

SEQ ID NO: 61588 - DNA, 537 bp, Glycine max
  Peptide Sequence Number=SeqID_178366
atgtcctacccagtgatcataactccgaccttcctctgccaaagtgtcagctggtgtatgccacccaccaggcaccctctagacccggataagtctaacagggccctggggtttccagtgttgatcacgggcctctgccagtcattcgaggttcccatcacacctagtaaggtgatccggccgccgatcacccgagccttcattgagaagtattgcatgcctaggcaggcccagggtgatgcgccacaggccacagacgcaccgctgccacctcatcaggctgatcccactgggtcattaggcatggagcggtatctacaacacttgctcagcctcagtcagcagggccagggtttcgctccttttgcatgccctactccaaatcagtttagggctgaggtcgcatggcccggagattggcccgaggaccagacagaggaggcacctacaggagctcccgacgatgcagaggacgctcgcatggatgaggagatgacagacttgctcggcttcatgggaggaagcacagccacgtga

SEQ ID NO: 61589 - DNA, 246 bp, Glycine max
  Peptide Sequence Number=SeqID_178367
atgtatgttgttattcaagaaaaagaaaagctaagtgcggaaaggcaaaaaaaccatgatttgtttacagcccagcctcattacaagcctagcaaaaaggagctatttcgaagaagtgccaaaggagtcgtcgcgctaagcgagctcaatgcgcttagtgcgcatcaacagctaagcctagcactagtatgcttagcgagtaaaggggaatctggaaaggcgtctgctatgcaagcacgcgcttag

SEQ ID NO: 61590 - DNA, 609 bp, Glycine max
  Peptide Sequence Number=SeqID_178368
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatggaatcgggttaaaattcctgaaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacaccctctggttgatggaacaatgtag

SEQ ID NO: 61591 - DNA, 648 bp, Glycine max
  Peptide Sequence Number=SeqID_178369
atgtgcccggtggtcggttttggcccgtggctaggtcttggcaagccgttggttgaaattttgccccccggtcaacttcttggtttttgcccgttgttggcttggctagggtcggcggtgctgggttatggccccgtgctaagtttcggattggcacaagggggaggaggggcttggtcgtccgtccgcccggacacacacctagttagcaccattgaggcaaaacgagagagagccgacgaacggtatcctcttttggccaaacatagggagggaccatcccccgaccggcacgctgagacccgctctcgccggggaagcaggtcgagctgcccaccgacagccgacgggttcgggactgggacccccgtgcccttccctccgagccaatccttttccctaggttacggatccattttgccgacttcccttgcctacattgttccatcaaccagagggtgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 61592 - DNA, 507 bp, Glycine max
  Peptide Sequence Number=SeqID_178370
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcaggcaggcttatatttcttagtttcaataggactccttacgagtgttgtttctatctactattatttaccaataatcaagttattaatgactggacgaaaccaagaaataactcctcacgtgcgaaattatcgaaggccccctttaagatcaaacaattccatcgaattacgtctgatcgtattgtgtga

SEQ ID NO: 61593 - DNA, 501 bp, Glycine max
  Peptide Sequence Number=SeqID_178371
atgtgtcatgtctggtctacgattgacacatggaaatccaaatgcactagagctgccctcaaaaaactcaatttggtagaagatagatctattccaagggtacaagctcatttctttcctaagaatataaacacagatgttagctacagtaatatgaggaaggctgcttcttgggaagatttgactgacaactatttattctgttctaaagctgtagatcctcagtacaaggatttaaggcattttcagtggcattgggaaaagggggagcctgtcattgtcagcaatgtgcttgaatgtacatctggtttaagctgggaaccgcttgtcatgtggcgtgcattacgtcatgtaactaataccaagcatggccaatatttggcggagaaaacaattgattgcttagattggactgcggtttgcttaatttcccaatctttaactttattgaccatggagagctttttacacaaatttcattcttcaccttcattctcatga

SEQ ID NO: 61594 - DNA, 210 bp, Glycine max
  Peptide Sequence Number=SeqID_178372
atgcgagcatccgctaagcgcaacactcctgggctaagcacgaggaagaatccagaagaagatgagctgtacaggttcactaagcgcaccgcttcagttcatccgctaagcgagaaaggcgcgctaagccaaaaatcactaacgtgcgctaagcggtccatacatgcactaagcacacgagcacgaacaaggccgcctattgaagcctaa

SEQ ID NO: 61595 - DNA, 279 bp, Glycine max
  Peptide Sequence Number=SeqID_178373
atgagtcaagaagaagctcaccaccataggaagccatggataagagctcaaaggaaggagaagatgagtggagggagatggagagaaggagcacgaaattttgtgcctcaaatgaggattgcatcacagattcatcctggcttggagtggatccttggattggttgagtgtttagccttccatgatcatcactggtggaagagccatggaacttgtgcaagaaaaaggaagaacagaagtgaaaagaggaagaagaatgaaaaacacttgagagaataa

SEQ ID NO: 61596 - DNA, 432 bp, Glycine max
  Peptide Sequence Number=SeqID_178374
atggaatgctcagagttcaaatctatgggtagtgcggtggtcgatgttataaacagattcttcatcactgcacaagctggcaatctcttgctaggccagcagattgaacactatgagcataatagaactatagaagctaagttgttgcacatctatgatcctccagtgggaagaagcccgaagctctttacaaacattaacaacaagttaataagtagggacactaataatgttggtggttatggacctgtatctgaattggattatcatcgagacgatttcgaagcaagtgaaattggtctattcggttgtgaagaggatgacaatttggccgaagttgacaccacaatcaaaggtagaagagaagatgatggcatctttatgacactcagaatagcagataaggaagtttttctgatacttgctacataa

SEQ ID NO: 61597 - DNA, 369 bp, Glycine max
  Peptide Sequence Number=SeqID_178375
atggctcctacacttcaacatgcactttctcatctactcactctcgtagtttcactatcaatactcctagtggtaccctcctcttgtttcaaccccaaaaagattgtgaatgcttcctatgcttcatgctcatatggttcagattggtcacctgctatagccacttggtatggacttgccaaaggggacagtagtgaaggtggtgcttgtggttatggcagtgctgttggggaacctcctttctcattattgatatcggtgggaagccctcttttgtttgaatcaggcaaaggttgtggttcttgttatgagaatgtttcagaaactaagacggttacttgtaaccgtcttagattgtccgattcatag

SEQ ID NO: 61598 - DNA, 501 bp, Glycine max
  Peptide Sequence Number=SeqID_178376
atggagtggtggtaccttggccagattaacgtagaagaagaggggttgcttggagttagagacctgaatgcgattcttcttatacgaatcaaagatgttgatgttgttcactccctctgttatgtcaagagttgcacaaacttgaaatatggaaaatttagaaacataaaactgaagttggcctaccaaatgatgagatcaaagatgttgcatgccacagataagggcaacgaagggagaactgaaacacataaggaaaaattatggaatgaagaagttagtgccacaaatgagggtagtgcagagaatatcatgaaaagcaactataatgaagtcaataaatttgaagataaggacaaagaacaaaccatacagaattcaaaaatgaaaaccgagggtggttcagagaataatgtcaaaaacaaagatgttgaagatggtgtgtgtgatgtagatagaagttgtaattttggtaagatcttccttcctaacttcaaatga

SEQ ID NO: 61599 - DNA, 558 bp, Glycine max
  Peptide Sequence Number=SeqID_178377
atgccaaggttgctcacaaattataaagagattgaggctgccttatgtataccaggccgagggtttgttttgaactctgagggccatcctgggaagattctcaggaacgatttgatgactcttgctcaggtgtggagtgttctttcatattccaacctggctcctacttcacacacctcagacctgatagtagatagagctaggatgatctttggcctagtctctcagatggacatgaatgtgggagcccttatctctggccagatcacatctatagcccaatctaactcttctagacttgggttccctgctctgatcaccgtcctgtgtaaggacagaggggttacttctgacagcttggttttcgagcgcctgagcccggtcatcaacttggcctatatcaagaaaaacaattggaatcctgatgatctaacagtttctatcagaggggctaggcaggcaaggatgaggccagctgagcctccttccacatctacaactcctattccagcacgtacctcagtagctcattttgttctagcttatgcagatttttag

SEQ ID NO: 61600 - DNA, 793 bp, Glycine max
  Peptide Sequence Number=SeqID_178378
gcacatagctacaccacttagctcccttcctcctcctcttgagtcatcagcaccttcgtcatctacgtcacagaagataagaaaaaaaacatggcttagatcattggctaccaggcttattggggcaaagaaaccagtggttcatgtggatcctgccactgggaaaactaatgtccctgcagctcaaaaggatttgatcttggagggcattcagaagcatctgatcaaaggacgaagaaacaacccttcagaccgtaagagagcgatggaggcatttaagtcagatttaacctccaaatgggctttggcaaacagcaaggagagcgaggatgataaagatgtactgattgttgccattgcacaaccagagcaccttggtggtgtttgtgttgttggagtcggtgtcacgatcaaacaatactttggaccagattcaagaagctttcacagtctaggacttgcactggctcatgagcctgaggttagtctttctgctgctcgtgtcaggacaaagggaagttttgtggatccctcaaggcaagacctagacacgggtgactcagagaaatgtgggttagtttatgagggattgacaactgtccacaccgtccctttggacaatgatcaactgaaggtcggtgttgaggaacttcgagatgctattgcttgcattcctatacccattcaagaggtgtcgtgggatgctaccgtgtttggagtgtataatgataacttctccttgtgcataaagcatggagatttttctgaaatagcacacggtggtcaattgtga

SEQ ID NO: 61601 - DNA, 342 bp, Glycine max
  Peptide Sequence Number=SeqID_178379
atggagattaagagtaagtctaaacttactcgtggaggtgctgggatggaagagaataatattattaatgatgataataagttagaggcgcatttgacttctaccgctgcttttgtggagggtggaattcatgatgcttgtgatgatgcttgcagcatatgccttgaagctttctatgatagtgatccctccacggtgacaagttgcaagcatgagtttcatattcaatgcattatggaatgcttatgcgatgtgtcttggtcaccaaagtggttttctcaagtaaaaagtttatatggttgtatatttttcctcatattggttgaagaaagggatccttga

SEQ ID NO: 61602 - DNA, 207 bp, Glycine max
  Peptide Sequence Number=SeqID_178380
atgatttcttgtctagccaggccccattacaagccaataaaagtccttagtgatccaccaaatgggttagatgctcgggagaggtgcttgtttttgtgtatgcgaggtagaactgcagctggagatttagctcctgtcaacttggaaattgaagccgcttacaggcataacaacgctgcaagaaaaagaagggaacaagaagcataa

SEQ ID NO: 61603 - DNA, 270 bp, Glycine max
  Peptide Sequence Number=SeqID_178381
atggttcccaaggaccgtcttagaatgttcatcattctaagacggtctcgagtaaatgctggcttccaggctattgcctttgatttcataggtgtcgcaacgtgcccttttgcgggcgagcgaaggcgaggctcgcgggtgcgctttccaaaggaggaaagatgcgcggagtcgccaccaacgtttatttgtgggaaacatcgggaaaaccgaaggaaaccggtcgaaatgaaaattctaagttcgggagttgtatttacgcttgagtaa

SEQ ID NO: 61604 - DNA, 210 bp, Glycine max
  Peptide Sequence Number=SeqID_178382
atgtcagacgtcgtattgaagattgcaacggttagatcgtggacatctgtcctattaacctccagaccaaattttaggaagatccaacgggtgttacaaaggccgcgcgctaagcgcgagatcagtgtgctaagcgtagcaattgtcttcagccaggctcagtgcacgactggcgctaagctcaacgtcgtgaattcagagcctatttaa

SEQ ID NO: 61605 - DNA, 1023 bp, Glycine max
  Peptide Sequence Number=SeqID_178383
atgacgtttcgttttcgattaaaaccgttactcagcgtagcgctggcgtcagcgatgctgtgcggcacgctcagcgcgcaggccgcagaggccgtgtatggcgagcagctggaggggtttcactatccttatccgctgcagcattttaccttctcctcccagcagcagtcgctcagcatgggctacatggacgtgaagcccgcgcagcaggccaatggtcagacagtggtgctgatgcacggtaaaaacttctgcgctgccacctgggaagacaccatcaacgcgctgagccagcagggctatcgcgtgattgcgccggatcagattggtttctgcacctccaccaaacccgcccgctatcagtacagcttccagcagctggcgcaaaacacccatcagctgttagcgcagctcggcgttgagaaagcggtgatcgttggccactccaccggcggtatgctggcgacgcgttacgcactgatgtatccgcagcagacgcagaagctggtgctggtcaatccgattggccttgaggactggaaggcgaagggcgcgccgtggcgctcggtggatcaatggtatcagcgcgagctgaagctcgacgcggcgggcattaagaaatatgagcagcacacttattacagcggccagtggaagccggaatatgacaaatgggtgcagatgctggccgggctgaataaaggaccggggcatgagaaagtggcgtggaactcggcgctgatctacgacatgattttcacccagccggtctattacgagtttaaagacctgaaggtgccgaccacgctgatgatcggcacggccgataccaccgcgattggcagcgatatcgcttcaccagcggtgaaagcgcagctcggccattacaacgtgctgggcaaacaggtggcacagctgattcctggcgcgcggctgattgagttccccggcatggggcacgcgccacagatggaagcgccagcgaagtttaatcagacgctgattgacgacctggcgcattaa

SEQ ID NO: 61606 - DNA, 495 bp, Glycine max
  Peptide Sequence Number=SeqID_178384
atgatgcagcaaaaatacaaccaaggggtgattgattcggtgaccgaatggattatggccaacctggatcaacgtttgagcattgatgatattgcactgaaatctggctattccaaatggtatttacagaaactgtttgcccgttaccataacgaaacgctggcgcgttatattcgcaaaaagaaactgatttgttgtgtgaacgagctgaaattcagccgcacgccgattatcagtctggcggttaaataccatttcgaaagtcagcaatcctttacccgctcgtttaaacaggtgatgggctgcacgccgctattctgccgtaaacgccagctgagcgatgctgccgaagccctgttgcgcagcagtgacgatccctgcgcgctgtgtcgcaaggtcgggtttaatcgcagcgagcaggaaaaaccggttgttaatccggtcagcgaaaataatgggaagtttccagcgcgtattagctgcgcggtgcgttaa

SEQ ID NO: 61607 - DNA, 462 bp, Glycine max
  Peptide Sequence Number=SeqID_178385
atgaaggttgagcaacactttgcttgccaacatacaagtggggaaaggaaggttcctttggctacccttaacttccaaggggaaagaaggattcatggggatcctctagtagagtattgggatgacttgaaaagtgctcttaggaagaggcacatcccctcctactatgaaagggagcttatggacaagctcctaaggcttagacaagggagtatgattagtgttgaagagtataggcaacaaatggaactactccttttgagagctgggcttagggaggaggaaagaacaagtattgctaggttcctttgtgggcttaatatggatgtgagggacaaggttgagctccttccatatagggacctagatgacctagtccaactttgcataagggtagagcaacaacttaaaaggaaatcctacttcaaaatcttatggccttctaggaggccaatcttgtga

SEQ ID NO: 61608 - DNA, 665 bp, Glycine max
  Peptide Sequence Number=SeqID_178386
atggcaactcgcctaggtgagctgatgcttactcctgaagtaactggctcgcccaggcgagctggttacttcaccctgaagtcttttgggggcgcaggcgagccaaaggctagcctgggcgagctaggctcctctctgcatcgcttagagacctctctcgttcacatttgtcagtccaagcacaaggcaagcaacgacgactcatggtggccaccagtagtcatgggtggtggaggaggagtttctagggtggaatgcacttttggtgctaagcacaactttttgcgcttagcgcaatttctctgggcgcaacatttcacgttgagcgcaattccttctcgggttggaattgcgcttagcacgcttcttgcgctatgcgagatgtcaaaaattgctaattttcaaatcccaacgctcaaaaccattacatggcggattgtgactgatggtgtggttgatggggcagcactattgtgtatggaaatggatgtggcgcccatgatgggaggcaaagtgcaactgatgaaacccattgttgatggcctcacaaagaaggaaaaaaaccatacggttacgccggaaaatttgacggtggcgataataattggtttggagtatgacgaggaatgtggtgtttggatgaatgacagtggtgaagggaaatg

SEQ ID NO: 61609 - DNA, 204 bp, Glycine max
  Peptide Sequence Number=SeqID_178387
atgggattgaggcttcagtcctcactttgtgctttaaaccataatcgtcttaggcagtggtcaaatgttgggataggtctaaaggcaaaaactaatcaaggtaaaacggaacgggcgcaagtagaggctagggtcacgatcgatagatcatcatctcatgcccagcactggaccaacaggaagcgcagctgggggacagcctag

SEQ ID NO: 61610 - DNA, 273 bp, Glycine max
  Peptide Sequence Number=SeqID_178388
atgcccgcaagacacccagtggacccgaagaagcccaacaggttcttggagttgccagctctgataacgggcatctgtcagttctacgaagtgcctgtcgcctccagcaaggtcatcaggccccctactaatcgagctttcatcaagaagtactgcgcccccaggcaggcacagggtgaaacaccacagcagcctggggatggcaggcagcgggaaacagacgcaccgccaccacctctagagttcacctcagctcatccacaaaaaggttag

SEQ ID NO: 61611 - DNA, 228 bp, Glycine max
  Peptide Sequence Number=SeqID_178389
atggaaaatgattgttgtatccatttgagcttagctcttcagtgggctaagcgcgcatccaccactaagcatagcttcagcgtgcttagcacgaccgaagaatctggaagagcatcaatatcaaggctgcgcgctaagggcgagatcagtgtgttatgcgcagcagttgtcttcagccaggctcagtgcaagactggcgctaagctcaaatccacttactcgcgctaa

SEQ ID NO: 61612 - DNA, 210 bp, Glycine max
  Peptide Sequence Number=SeqID_178390
atgtcttcagggctccgagtgcagccgcagttgttgtttctgttgctgctgctgctgctgttgtcatcttggcttagttcgctagacacacatgagcttgatggtgatgttggtggcgctattggtaatcgagttggtgaatcaggcttgaaggatcaagctttgcctaaagggaagccacgctatgaacgggaaaagaaagtggggtga

SEQ ID NO: 61613 - DNA, 249 bp, Glycine max
  Peptide Sequence Number=SeqID_178391
atggaggtggcagtagcggtgccgatggtggtggtggaaatagcgatagcggtgccgatgataatgttggtggtggtagaggtgtcggtggtggtgtggcggggtttcgcatgttcgctgctacctccattatcgccagagaagggaaaccttaacgctggattattcttgtttgccaaagaactgtatgaacgacgatgccgtttaggagtgaaaataagtggagtggaaggaagactgttttactaa

SEQ ID NO: 61614 - DNA, 930 bp, Glycine max
  Peptide Sequence Number=SeqID_178392
atgcagtctcagtttcagtcccagatgcattctcagggacttgcactgcctccggagcctctggttggtccctcaggtcctcaagtaagcacaaaggagagttgtgttgatccctcaggaaacgatcctaagacgggtgactcagagaggtgcgacttgtacatcgaagcaaatcctgcccgcctggttgccctgggaagattttatgagggatccactgttgttcataacattcctttgttgcctggccaagtaaaggttgttgtggaggaggttaaagattcagatgctcccgttcctatacccactgatgagatttccttagtagggcaggcaattcacaccttccttgcttggccgacacatctggtcaagtctttatcacagcagccagatccggaggtcgatgatccactttatctgatggcattgaccatcctagagcttttcttgaggccttaccaagttacatgggatgccaccgtgttcggggtctttaatccagacttcccgctctacataaatcacgaagacctctccgaaatcgcacacggtggtcaatttctttgcatatcaatgttacagttgtggattctttacataaagagttggatgcagagttcgaaatgcgatgtctaccttggagccttcctgaatggcgggcactggcagatggtggtcatcatgcccaaggaacacctagttgtctggttttgttcattgtataacaggccagacaactaccttaaggggataattaacagtgctttaaaagttcttgatgatgcttcacagcctcaatcaaaggctcctgctaggtggattgtcgtcaagtattttaacgatcctagaccattggagctagagagattaaaggcgcttcggatccagtgggcacagtattatctccgagttagagctcagagctag

SEQ ID NO: 61615 - DNA, 354 bp, Glycine max
  Peptide Sequence Number=SeqID_178393
gatggtagtcgttgcataggtggtgatcgtggtagtagtgtcggtgcatatggttatggtggtggtggtagcggtgccggtggtggtggtggcaatagcgatagcgatgccgatgataatgttggtggtgatagaggtgccgatggtggtggtgattgcaaaaaaaatgaaaaatgtcaaatgtggaggtattcgaggtaccgcgttcgacgatggtggcatggtgcggtcgggagtggtggtggttttcgttggagaaggggaggaggtgaagaaggtaaatacgtggcagtgactaggcttgatgacgtgacactctgtctgccatttcatcacttaacggaaagggactaa

SEQ ID NO: 61616 - DNA, 636 bp, Glycine max
  Peptide Sequence Number=SeqID_178394
atgagcgataaaaaaggaagcacttcaaaccatggcttgaatttgaacatacccccaccaagggttgccaatcagatacctgattcaccaactcgattaccaatagcgccaccaacatcgccaacaagctcatgtgtgtccagcgaactaagcctagatgacaacagcagcagcagcagcaacaacaacaacaaccgcggctgcactcggagccctgaagacatttccatggtgctagtagggtgttctcgctgccttatgtatatgatggtcaatgagggtgaacccaatggtggtgtcaatattgatgacaattgtggttttggggaggatggtagtcgttgcataggtggtgattgtggtagtagtgtcagtgcatatggttatggtggtggcggtagcggtgccgatggtggtggtggcaatagcgatagcggtgccgatgataatggtttcgcatgttcgttgctacctccattatcgccggagaagggaaacattaacgctggattattcttgtttgcctatgaagtgtatgaacgacgatgccgtggaggtattcgaggtggcgcgttcgacggtggtggcgtggtgcggtcggcagtggtggtggttttcgttggagaaggggaggag

SEQ ID NO: 61617 - DNA, 999 bp, Glycine max
  Peptide Sequence Number=SeqID_178395
atggcatccttcagccacatccagtcccagcttcagtcgcagatgcaatctcagggacttgtagtgcctcctgagcctctggttggtccctccgaaaacgatcctgagatgggtgactctgacaggtgcgacttgtacatagaagcagatcctgcccgcctggttgccatggggagagtttatgaggaatccactgttgttcataacactcctttgttgcctggccaagtaaaggtgagcacttcacaccttccttgcttagccgacatatctggtcaagtctttatcacagcagtagttgtgtctctggcaaaaccacctccgaagcccgatccggaggtcaatgatccgctttatctgatgacattgaccatcccagagcttttcttgaggccttatcaggttagatgggatgccaccgtgttcagggtctttaatccagatttccccttctacataaagcgcgaagacctctccgaaatcgcacacggtggtcaatgtctcagcatatcagtgttacacttgtggattctgcatctcactgaaacatgtatgcgagtggggaattctgatatctatggattcctcgagccacagtccattcagaggtctgggcaatcgcagtttgagtctaaaagttacataaagagttggatgcagagttcacaacgcaatgtctatcttggagcctacctaaatggcggacaccggcagatggtggtcatcctgcccaaggaacacctagttgtctggttttgttcattgcataacaggccagacaactaccttaaggggattattaatagcctaaatcaaaggcttctgctaggtggattgtcgtcaagacaaaaaggaagtactgagtgcggctactatgtgatgcacaggatgtccaccatcattttaggaacttttaggaataattgggaagcgaccattggagccagagagattaaaggcattgcggatctagtgggcacagttttatctccgagttag

SEQ ID NO: 61618 - DNA, 360 bp, Glycine max
  Peptide Sequence Number=SeqID_178396
atggataaagatgctaattcagtaatccaactccctcctggatttagattccacctttctcatgaggagctaattgttcactatttgagaaacaaagtgacatcatcacccattcctgcttcattcatagcagaaatagatctttacaactataatccatgggagctcccaaacaggaagtatcccaatggagtgaggcctaatagagaagctacttctggttattggaaggctactgggactaacaaacccattttcacttcctgtgggatgaagagcattactgtcaagaaggcactcgtgttctacaagggtcgtccatcaaagggatcgaaaaccaactggatcatgcatgagtag

SEQ ID NO: 61619 - DNA, 384 bp, Glycine max
  Peptide Sequence Number=SeqID_178397
atgagcgataaaaaaggaagcacttcaaaccatggcttgaatttgaacatacccccaccaagggttgccaatcatatacctgattcaccaactcgattaccaatagcgccaccaacatcaccatcaagctcatgtgtgtccagcgaactaagccaagatgacaacagcagtagtagcagcaacaagatcaacaactgcggctgcactcagagccctgaagacatttccatggtgctagtagggtgttctcgctgcattatgtatatgatggtcaatgagggtgattacaacacggtgatggtggtgcagatgtcgactgtggcagtggtggttgcaatattgatgacaattgtggttttggggaggatggtagtcgttgcatag

SEQ ID NO: 61620 - DNA, 213 bp, Glycine max
  Peptide Sequence Number=SeqID_178398
atgggtgctcaaagctcaaagctttctacgctgccagttaacaagttgattgtgctttacgtggttttcaagcttgacgagagttacatgccgagcaaagtttccatccttgcccgtgatggttttcacaacttgaaggagattaagaccgtggaactcgagaagccaactgggtgggtttatctatccttgtctggagcttatcctaggtaa

SEQ ID NO: 61621 - DNA, 210 bp, Glycine max
  Peptide Sequence Number=SeqID_178399
atgtcttcagggctccgagtgcagccgcggttgttgttttttctgctgctgctgctgctgttgtcatcttggcttagttcgctggacacacatgagcttgttggtgatgttggtggcgctattggtaatcgagttggtgaatcaggcttgaaggatcaagctttgcctaaagggaagccaagctgtgaacgaaaaaagaaagtggggtga

SEQ ID NO: 61622 - DNA, 516 bp, Glycine max
  Peptide Sequence Number=SeqID_178400
atgggtccagttttgatagacccgtcaagatccctcgtaggaggatgtgcggaagaaagcacaggctatctagaagcaaaacatcgcccccacgtgttgtctcgtgggggttatggttatttagaacaaaagctaatggctaagaagacaaagaaaaaactagaggaagctgcacagttcggaagcactgagggcgtcattaacccttcatctcctgtcagacgacacgtgaagtggaagatggcccgcaccaagaaaactaggcagatgacgtctgaggccacaaaggaaatcactgagaatattgagcaggcgtcacagggttcgtttgtcccccatggacgccaggatgtcctgactgctgcccttgggcgaccagaacaccttggccgtgcgcgtgctgctggagccagtgtcaccacgaagctccacgaagctcccacagttcctcctccatccctcccgaagaactcaagcagctcactcaacaaatcaaggaccagctggaggagttga

SEQ ID NO: 61623 - DNA, 144 bp, Glycine max
  Peptide Sequence Number=SeqID_178401
atgccaagaccagacaaacccaattggcctacgatgcattcgcgctcagcgccacacctcgcgcttagcgcgttcagatcgcgcgctgggcgcgccatgcacgctgagcttgtgcttctgttggatcgggcgctgggcgcctag

SEQ ID NO: 61624 - DNA, 1632 bp, Glycine max
  Peptide Sequence Number=SeqID_178402
atgccagccagaaacttctccgtccacaccccacgaaggtcacccaggttcctcccccaacaaaaccacgacactcccaaccccaaatctgcgaaactcagcgtttctgccaacaaatcggagaagtgcgctgttgggtcgagaagatctccgaggctgaacaacgttgaagaacaatctccccctctgagacgatctcccatgttgaacaacgagccagtcggtaaacaattgaaaggcactagagtgaagaagggtggtgtaactgcaacgaaggaaaatcgtgtcgtttcggacgagggttttggtggaggaagaaagaaggagagaaacaggaagagggttgaagtggaaacgcaagaaagtgtcgtttcggacgaggggtttggtggaggaataaagaaggagagaaacaggaagagggttgaagttggaacgcaagaaaacggtgtcgtttcggacgaggggtttggaggaggaagaaagaaggagagaaactggaagagggttaaagtcaaaacaaaagaaaatcgtgtcgttttggatgaggggattggtggaggagcaaagaaggaggaaaatgggaagagggtgaaaacgaaagcaaatcgtgtcgtttcggatgagggttttggtggaggaagaaagaagggggaaaatggggagaagagaaagcgtggtggcgaagaaattagtaaagggtggacgaaggaacaggaattggctcttcaaagagcgtattttgctgcaaagcctagcccccatttctggaagaacgtctccaaactgatgttggaaaacagatttgatactcttgcatgttatttgatagctaaggattgcggatggcataggtggtttccagctaaaaatattcagaacaatggcatggtgccaggaaagtctcaacaagattgctttgatagaattcactgtgactatatgacaccacctcaaactcagcctcattcgagggcaaagacattgaagtcatcacccattcaccaattttctatatctgcaagtaaacttctcaaacctattgataaaacagttagaaaatccaatgttctaaaaccaaagaacatcattacccagaagtccattgagaagctgttacagcaccatcttaaagttgatctagatcgtgaagtggacatattttctgttcttgaaccaaacactgatttttctactaatgctctacagcctagtgaagcactttctactccaaagcagcaaaaggaaaacaaagggttcctgcaaaattgcactgaaacatcatcttcaagccataagaagccactttcaagatttagtggctcgtgcgttacagaacttgttagtcccccagtactaaagaaagtaaagaacagggtaatgcatgagaaatatatcaatcaattgcgctgtagagaatctaggagaagagcagccgctacgaaaataattggtgaaggaaccagcattcagaaaagggatgtagttaaaggagcaaaagttgccttggtttctgaagctagagatgctatcaataagtttcaacagtctcaagtcaatttgatggacaatacttgtagttctgatgaagataacggtgatggcgttgaatttgaagatgaaagtcaatag

SEQ ID NO: 61625 - DNA, 636 bp, Glycine max
  Peptide Sequence Number=SeqID_178403
atgtctgtgatcaggggaggaggtgaggtggtcgacaatgacaattcaggccttgacgtgggggaggtagctggagcggagcatgaagcgaaggaaggaggcagcgtagagcgtgtggttgaccatggtgacggagacagcgaggaggacgaggcacttggcgttgaagcagtgaagctggccttcattgcggaggcacatgatgatggactgggcgcgcgtgagagaagagagtgtattatggtaagagagctgaaagaccaagcgactgaggcaggtggagttaaggaggtgcgtggagtgggagtaggtgagccaagcttcttcagttttgcggtcgtgaaggagggagaaaagcttgtaatcgtaggttccgaggaggttgtggcggtggcgcgttggatgggagagagtgggggttgtaagagagtgatattcatgatgagcctccctatttctcttctctcacgcgactattcttcttcacctcttctctcacgtgacagtgcttcttcttgcaccgctgccttcttcttcatcccatgcgcccccgtttgtccctacattgtgctttggagctttgctttgatggcattgaggacgtgcattgggctttgctccaccgtcgaccgttga

SEQ ID NO: 61626 - DNA, 402 bp, Glycine max
  Peptide Sequence Number=SeqID_178404
atggctcgtgaacgcataacccgtcattctcattttgggtcctcacgggctacaaacccattgtcttacccacaccacacactcgtttgggctgatgctaggtgcaccagacttactgctggtgcacccagtatttttaaaaaatatcaaaaatgtctctcgtttatctttttcattaaaaagataggtgtgcagtgttttctctttagggctctgcctataaccctacctaaagcacaacctaagcctctagtgctcattaacatgtatagtgtgtactcgttgtgggagttcgttaaggatattggagagaagaaggatagtggactcctcaatgccaggattctaaatcagttcagtagttccttctccaggttgcggaaaaggaaggttgccttgtag

SEQ ID NO: 61627 - DNA, 1233 bp, Glycine max
  Peptide Sequence Number=SeqID_178405
atggtaaatgtagatgaaaagatgtgtagagcgttgtggggggatgatcatgtggagtggaaacaatctcgagcaaatcacttattattggtgatttcaatgccattagaaggagggaggaaaggaagagaagaggagggggatgccaacaaagatcttttcaagcttctcaaaaaagatatcaaaaagtggagtgtggagaagtttggtggtcatcaagctattgtcgaggctttgtctataataaaatggcttagagaaggggatgcaaatgcaagctttttccatgggatggttaattggagaagaagatccaatggtataaaaggtatcaagatggaacacatttggagtgaagaatcggtgaaggttaaaaaagaagagagatttagagatatcaaatgtgtcgtgtgggagtgtgatgacaacaagatttttggctcggatggacttaattttaatttcatcaaagcttgttgggaagtggtcaaagaggacattataatagctattcaagaatatcataggtttgggaggtggcctaaaggtgtgaatgcatctttcttggcacttatcccaaagaagcatgatctgcaagacttgggagagtataggcctatctcacttattggaaccgattttgagaagtcatcatcgatatttgttcttgtaaatggaagtccaacaaaggaattttttcctaagaaaggttttagacaaggtgatccctgggtgccttttctcttcttgatggtggcaggagggtttagcggggttggtggaagtaaggaatatttcaacatagcaaatgatcataaacaagatgcaaaaagaggttggcaacttggtgaagaaaacatttgtcatttggaaggagagattcaaaggaatttcttatcatgggtcaaatgggatgcagtgtgttcccctattgagaatggagggttggggaagtggttaggactagagagagaatacggtgttggaggtgtggggatggcatggggtgtttgggattggaatctgagttggaggaaagggaggtttcaatgggaaagtgaactaatacaacaattgatggaagacctacaaggaagatcacctattctcaacaagggtgatggttgggagtggaggagtggtaagcaaaaagaatatgttgtaaaggaggtatatgagttgttacatgaggaaggaagtctggaggatgctggttttttcaggaagatctag

SEQ ID NO: 61628 - DNA, 363 bp, Glycine max
  Peptide Sequence Number=SeqID_178406
atgataccagggccactcggaaacacaacaacaacaacagcaacaagtgtgcataatggagggccaagatctctcgccacctcgcatggacacatctcgaccgtccctcggcttccccttgggcactgccctcctcttgatcatcatcttcagcctcagcggcatcttctcttgttgctaccactgggacaagaggtgaagcaaagcaagggtgagagtttgccggtgttgatgcctggggatgaagtgcctaagttcatagccatgccttgcccgtgccaaccttcccggctggagactatcgttgtcaccgtcgagaagccgccgcacaaaccgccgctcgtggtggcgcctttgtgttaa

SEQ ID NO: 61629 - DNA, 338 bp, Glycine max
  Peptide Sequence Number=SeqID_178407
atgggtgtcagtgctggagtgttagaggcaattgccacagtgttccatgagtttattacaaggggaggcaaggtagcattgaagtttgaacacaaaagcaatatgagtagcaattatggaccaccatatgaggggaaagtttacaatacattaggcggtttccacggtgttccacgagttcattacaaggggaggcaaggcctcaactcgcccaagccagcatttggctcacctgggccaccaaataacttcaaggctaaggggctaggtcgcttgggtgagctcactgcttcagggttaagtttcagctcgcctgggcgtgctccaaccgccccaag

SEQ ID NO: 61630 - DNA, 600 bp, Glycine max
  Peptide Sequence Number=SeqID_178408
atgcataaggcattacgggccaatgcacctcttccatatcctcaattggtcaccctttttctccgtcattttcaaattcctcttgatgatgaaccttttgttcaagtcaagcgatcctttgctataggtcctggtgcagtcacttcatttggttaccgtaaggatcgtaatggtcaatggctgaagaaggacgcgctacctccgcaagacgagcgtactccctctcctcctcctcagcgagatgattcctcagcctttatgactgaagttctttcagagttacggggcctccgcacctatgttggtgaacgattcgattccttggatggtcactttgaaggcacggatacccgcatcacccagcttgaagagggtgaattaaattgtcatcatcaaaaagggggagattgtagaagcaaggactttgcctttgatgttttgatgatgccatatgatcgtgatgttttgatgccctatgaaaatgcgcttctcaagtttaattcaaggcaaaaatccaagaatacaagatacaacatcaagaagatctctagtgttttaggaagggaatttcaaattgaaacagcaaaacgtttggcctag

SEQ ID NO: 61631 - DNA, 248 bp, Glycine max
  Peptide Sequence Number=SeqID_178409
atgaagatagcaggggtgccgaaaaatgctattagactaaatctattttcattctctccagtgggcgaagctaaagagatggttgctatgtttcaaggggaacgacttgaagacatgggagtaagtggtagaggaatttttgaagaaacaccgactcatggattcattgagcctaatcatttgaatatattcattgatggtttgaggccacattccaaggaattgttagatgcttcagccgaagggaa

SEQ ID NO: 61632 - DNA, 1016 bp, Glycine max
  Peptide Sequence Number=SeqID_178410
ggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggtctcgttgggagcgtgcgtgcacgcaaagggtcgtcgatgggtccagaactgaccgggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacg

SEQ ID NO: 61633 - DNA, 843 bp, Glycine max
  Peptide Sequence Number=SeqID_178411
gagaggacgtacagtcctctgaaggtgaggacgtgtagtcctctaaaggcgagggcgcgcagtcctctaaagaaggtgagggcatgtagccctctaaaggcgaggacgagtagtccttctaaggtgatggcgtgtagccctctgaaggcgatgacatgtagtcctctgaaagcgagggcgtgtagccctctgagggtgaggatgtgtattcctctaaaggcgagggcgtggagccctctcaaggtgaggacatgtagccctcggaaggcgaggacgtgtagtcctctgaaggcgagggcgtgtagcccttcgaaagtgagggcatgcagccctctaaaggcgggggcgtgtagccctctaaaggcgagggcgaacaggcctctaaagatgagggcatgcaggcctctaaaggcgagggcgtgcagccttctgaaggcgaggatgtgtagtcctctgaatgcgaggacgtgtagtcctctaaaggcgaggacgtgtagtcctcaaaaggcgagggcgcgtagccctcagatggcgaggacgtgtagtcctctgaataggaggacgtgtagtcctatgaaggcgacggcttgcagccctctgaaggcggagacgtgtattcctctgaaggagagggcatatagtcctctagaggcgagggcgtgtagccctcttaaggagaggacgtgcattcctctaaatatgaggacgtgtagtcctttgaaggcgagggcgtgcagccctctaaaggcgaggacgaatagtcctcaaaagttgagggcgtgtagccctctgaaggcgatgacgtgtagtcctttgagagcgaagacgtgtagccctctgaag

SEQ ID NO: 61634 - DNA, 498 bp, Glycine max
  Peptide Sequence Number=SeqID_178412
atggcgaaggcgcggataaccatgaggtatctccgcatgctatcagaccctcgagtcacgatagcagatttgtgtgtatggataaccataaggccggaagacgttgacatctccaggaagggtgcagaagaccacattggtgcagataaccataaggtatcttcatatactaccagaccctcgagtcacgatatcaaaggtgagactttttcgcagtctcggccggaagacgctgacatttttgggaaggataaccataaggtatctccacatgctaccggaccctcgagtcacgatagcaaaggtgagactttttcgtggtctcggccagaagacgctgacatttttgggaagggtgcagatgaccacattgatacactcaaaggcgaggatggacattctcaccctgggtcaaggtttatggtgagttgggattttggctcaaggcttgtagaacggctggacatgatatatgtcagggcgttggtttggccagcg

SEQ ID NO: 61635 - DNA, 384 bp, Glycine max
  Peptide Sequence Number=SeqID_178413
atggctatccagttttatcactttcaaggctatgaggtttcgctggttgagctattggttggtcagcattgggaccatctagaacattctggagagggtgcactcatcaaattggggggtgcactcaggaaagcttcatcactaagcaacctggaggggggtgaactcatcaaattgggggtgcactcaggaaacttcatccagaacattctagaagggggtgaacttatcaaattgggggtgtgctcaagaaacttcctaaggaagcctctagagaggggggtgaacttatcaattatgggtgcgctcaggaaaacttcatcactaagcaatctagagggggtgcactcatcaaattgggggtgcgctcaggaaacttcctga

SEQ ID NO: 61636 - DNA, 2043 bp, Glycine max
  Peptide Sequence Number=SeqID_178414
atggttactgggtggagaagagcgttctgcacatccatccccaaagacagagaacccaaagtgttaacagagaaacaacaacaacaaccacaacaacagcattgcgagaacaccaccaccaccaccaacaacaacaacaataatcacagttccaagtttggatttttctccaacccatcaagaccccggtgcgagtctcagccttcatcaacccctagccttcgatgtcaaaccacatgctcagtcccaaacagcccaaaacttcaatgcaaaacaaaaactccaaggttgttccataactccaatccctcatcccccaagtcaccttccagcttctcacttctcaaatccaccctacgcatatccaaaagtcgatgtggaatctgtatgcagagcgtgaggagtgggcaaggaactgcaatattcacagcggaatgctctcacacgtttcacttcccttgcatagtgaagaagcacccgatcgtcacgtgccccgtgtgcaacacaagctggaaggagcttcctgtgctctccatcaaccacaacaacgacaagtgcgacaagagaggattcaaggtctacaacgacgacgagcctctcatgtctccaacttcactctctcgcttcaatcctattcccgagtccgaaaacgaagacgaagacgaagatgataacattaaaacggagtttaagggctttaatgtcaatccactttccaatttaccgtcctctccggcaattaggaggaacctcgagctatcgttgatgccggaggtggccattgtcgccgccaaccgaaactacgagagttacgtcgtcgttttgaagctgaagccgccgcacctgaccaaaccggcgcgtcgagctccaattgatctcgttgccgtgctcgacgtcggcggagccatgtccggcaacaagctccgcctcatgaaaaactccatgcggcaagtgatctcatcgctccgtccaaccgatcgtctttctatcgtcgcattctccgccggatccaagcggctgcttccgctgcggcgtatgaccggcggaggccagcggtcagcgcgtcggatcgtcgacgccctcgctgcgattgaccgaacacgagaaggaactccggtgaagaatgatgctgtgaaaaaagccgcgaaagttctcgaggaccgccgcgagaagaacgtcgtcgcgagcattgtagtcctctccgatatcaaggactcgcacgccgggatcagtatccacaaaccctcgctcgtttccaccacacgccttactcaccttgaagtgcctgtccacgcggtgcggctgggagagtctccccacgcgctttccgacgacgcgctcgcgaaattcgtgggaggtttgttgaacgtggtggctcaggacgttaggattcagttagaggtggtgtctcgatcacgcgccgtggagatcgcgggcgtgtactcattttcgggtcgacccgttccactcgggtcgtcgggttggatccgtctcggcgacctctacgtcgaagaagagatagaattgctcgtggagctcaaggtacctgcagcttccgctgggtcccaccacgttctgaccgtacgatcttcctatcgggaccctctcactcgagagcctttaaatcccgttgagcaggcaatgctcgttccccgtccccacgccgtacgatcatcgtgcgccaggatcgaacgcttgcggaacttccacgtcaccgcacgagccgtcgctgagtctagccggctcgcggaacacaatgatctcactggagctcatcagttgctctcctcggctcgcgcgcttctcttgcagtcaagtgagccggatgaggagtttctccgctggctcgaagccgaacaagccgagcttcaacggcgcaggcaaaggcaaacactgagaaacagtcgcgttgaagagaaggctgagccgcttacgccgacttcggcttggcgagccgctgagaggttggctaaagtggctatcatgagaaagtctatgaacagagttagtgacttgcatggatttgagaatgccagattttag

SEQ ID NO: 61637 - DNA, 411 bp, Glycine max
  Peptide Sequence Number=SeqID_178415
atgaccggtagattgctggccggatcattaaccattgattgtcgcatcattcactatattattgttagaattttgcttccccgttcttctaatttggctcaagcctctgaggaggacttgattttgatgtgggcttttctttccggttgtcagatcgactgggctcacttggttaggtaccgaatgcataaggcattacgggccaatgcacctctccccttatcctcaattgagttacggggcctccgcacctatgttggtgaacgattcgattctttggatggtcgctttgaaggcatggatacccgcatcacccagcttgaagaggacgtgaattatattcgtcagagcttcgatcttccaccaccaccaccaccaccttctcagtttttagattattattattgttga

SEQ ID NO: 61638 - DNA, 183 bp, Glycine max
  Peptide Sequence Number=SeqID_178416
atggtgtggcgtctccaatcacctttcctccttctcttttctgctaccattgatcttcaagaagcgaaggactctagtgatgaagaagattcaaggcatacaagctctacatggagctacattatgcgcctccgctttcgccacaaaagtcaccaccttccattcctcaacctccatccttga

SEQ ID NO: 61639 - DNA, 624 bp, Glycine max
  Peptide Sequence Number=SeqID_178417
atggctttgtgttcagtttttctcaatcttcatctttggctttttgtttgtttgaccattgaagcgttaggtgtgccgaagccttcagtagctagttaccttagccaggagctactggcagagcaagaagttgatagagtgcatggattactagcgcagcctccagtgaagctcaacaatatgttggttatatcactgtcaatgaaactcaaggaagagatctgttctattggtttttcgaggccacccataaatcggaacaaaaacccgttctcttatggctcaatggagaatcacaaaccagaaggtcaggaagtgagtgcagcaggagtaaacattgataatcacatgaatgaagagggcaatgctggtgcactcataaattttgaggtccttgatttcttacgagctaaaggagcttcacaggatccaacaagagttattgccaaattaccgcagtttgaatacaaggtttatgattatttggttgacactgttgcctctgttcaaacaagagagagcatcaatgagttcttgacaagtgttaaacagtatgacctggcaaaagctgaggctctgaacatattaaacattgggccagctgcttattttgaactataccca

SEQ ID NO: 61640 - DNA, 141 bp, Glycine max
  Peptide Sequence Number=SeqID_178418
atggttatcctaacccaacccatggttaaccatttaagcctggtcaagttttacacctttcctcatttccgcagtagcaacctgcgaatcaacctctctgaactaatcagctggaaatacggtgaaaatctcttcatgtga

SEQ ID NO: 61641 - DNA, 309 bp, Glycine max
  Peptide Sequence Number=SeqID_178419
atgacaccattggtccctagaggatcagtagcttcatatgtgaccggcatatctcgtgcacttcaaagaaagggccacctggtggaggttatattgccaaagtatgcaagtttaaacctagatgaggtgcaagggttgcacgaagttaatgtagaggttacctcgtattttaatggccaattacacggaaatagaatttggactggtgttgtttttggcattggagtcactttgatagagccaaagtactattcatcatttttcagccatgagatgatatatggatacccagatgattttgaaaggtga

SEQ ID NO: 61642 - DNA, 417 bp, Glycine max
  Peptide Sequence Number=SeqID_178420
atgtcccagtccatgtgtgatgatgaccagaatgtgaaacaagataatatttggcaattgttcaaagaagctcaacagaacatactatacttgaacaaacaacgccttggggccattgagaaacttgacaaaacaaacagagaaaaacagtcgcttctcagtaagataaagaagttggaagcagaaaaacaggctggtgctggtaaagataacctatcaacttgttcagaattgctgcttcggatagatgccatggttctcagcagcatgattagtgctggagaagcatctgaattaagaagtttggtgatgaaccacaaagtgagtctggctgatgtttttaatatcatctcacacaaaaaagatcctgaacttctaggagaacttcgtcgcttttcagatggacacaaaaagtaa

SEQ ID NO: 61643 - DNA, 894 bp, Glycine max
  Peptide Sequence Number=SeqID_178421
atgggagatgtggcaaaggacctaacagctgggactgttggaggggcagcacaactgatagttggacacccatttgacaccatcaaggtcaagctccagagccagccaacaccactccccggccagcttcccaagtattctggtgcaattgatgctgtcaagcagacggtggcagctgaagggccaaggggtttatacaagggtatgggagccccacttgccacagtagctgccttcaatgctgtcctgtttacagttaggggacaaatggaagcattactgaggtcgcatcccggtgctaccctcacaataaatcagcaggttgtttgtggagctggagctggagttgctgtttcttttctagcttgcccaactgaattgatcaaatgcagattgcaagcacaaagtgtgctagctggcactggaacagctgcagtggcagtgaaatatgggggacccatggatgtggccaggcaagttctcaggtcagaagggggcgtaaaaggtcttttcaagggcttggttcccaccatggctcgcgaagtacctggaaatgctgcaatgtttggtgtatatgaagcattaaagcgattacttgcaggtggcactgatacctcaggactgggtagaggttctctgatgcttgctggaggtgtggctggagctgctttctggctcatggtttacccgactgatgttgttaagagtgtgattcaagtagatgattacaaaaacccaaagttctctggttcaattgatgctttcagaagaatttcagcttctgaggggatcaagggcctttataagggttttggtcctgcaatggcccgaagtgttcctgccaatgcagcttgcttcttggcttatgagatgacaagatcagctctgggatga

SEQ ID NO: 61644 - DNA, 531 bp, Glycine max
  Peptide Sequence Number=SeqID_178422
atggagaaagccgagagctccgcctccacatcggagccagactccgacgagaaccaccaccgccacccgacgaaccaccacatcaaccctccctccggcctcaccccgctcgaccccaaacctacaagcacttcatcaagagctgcgccgtcaaagagccctttcacatggccgtcggccgtcactcgggacgtcaatgtcatctccggcctccccgccgccaccagcaccgaacgcctcgacctcctcgacgacatccgctgcgtcaccggctttagcatcatcggcggcgaacaccgcctccgcaactaccgctccgtcactaccgtccattccttcgaggacgacgccgacgacggcaagatctacaccgtcgtcctcgaatcctacgtcgtcgacgtccccgacggcaacaccgaagaggacacgcgtctcttcgccgacaccgtcgtcaagctcaacctccagaagctcgcctccgtcaccgaaggaaccaaccgcgacggtgacggtaagtcacactcgcggtga

SEQ ID NO: 61645 - DNA, 207 bp, Glycine max
  Peptide Sequence Number=SeqID_178423
atgagaaagggtaaagagagcgacttgggcccttttgagatcatccaattggatacaagttgccaacttgatactaaagaaaggggaaaacttggagatagagagcgacaaggaggaatagaagctacaaagactagcttttttagaagagggaaatgctcaaatgctgatgctcctgttagaaatttggaaaaggctttcgtataa

SEQ ID NO: 61646 - DNA, 360 bp, Glycine max
  Peptide Sequence Number=SeqID_178424
atggcctcctatggtgcaaaggaatccattgatgaagaagatcctaggcctacaagttctaatggagcttacattaatctttgtaaaagttattgccatttgaatttgctcggatcttccgtttttagtttcgagcaactcgatatatcatgggagacaatcggacatccgagtataccacatgatgtagctccatgtggagcttgtaggccttggatgtttttcatcaatgaagtcctttgcttcttgaagatgaatggcagcagaatggagaaggaagacggttggagatgccacttcaaggagaagatgagtcaagaagaagcaaacgatcataggaagccatggataagatcttga

SEQ ID NO: 61647 - DNA, 261 bp, Glycine max
  Peptide Sequence Number=SeqID_178425
atggagaaagagatgataacaatgatagtagacacgttatcgatgttctactatgagaagatggtgggttacatgccttcaagctttgctgatttagctttcgccgacagaaggatcgaagtgggtctgaaaagaggcaaatttgattatcctgctttgatgaatgagaaaactggggcaaatagagaggatgcgaaagaggaaggaacccatgttgtgattgtcgttcctacatggtcaaatttcccaccagctcaataa

SEQ ID NO: 61648 - DNA, 204 bp, Glycine max
  Peptide Sequence Number=SeqID_178426
atgaagaacgatgaaaaacggagaaaagagggaagtggttgctgcccagctcgcccacgcgagctgggttgcttccaccagaaggcaccgccttctgttggtacccctttgaaggcccaaaactttacggattgcgcaacaatgcttgctttcgacttccagaatgttgcagaacttcacgaattgcctaacgatgggtcttaa

SEQ ID NO: 61649 - DNA, 283 bp, Glycine max
  Peptide Sequence Number=SeqID_178427
gtgtggggtttcgcggtacaaagtgaaggatgatgatgagtgtagtactgatgaaaactcaaagggcccaccagcaaaggtgttgtggtatcttcctatcatttcaaggtttaagcgtatgtttgctaatggagacgacacaaaatacctgacatggcatgcaaatgggagaaactgtgatggaatgcttcatcatccaactaattcctcgcagtggaaaaagattgatcatttgtattcagattttggcaaagaggcaagaaatattaggactagccactga

SEQ ID NO: 61650 - DNA, 1008 bp, Glycine max
  Peptide Sequence Number=SeqID_178428
cgcgtccaggcgctggccatcgagggtgatgctgcccttggtgggcgtctcgaagccgcccaggcagcgcagcagggtcgatttgccactgccggagccaccgagcagggcaaagatctcgcccttgcgcacgtccaggttgacgtcgtcgacggcgacgaaaccgtcgaattccttgcgcaggtcacgaatggagagatagccgggcgcaccggtcgtgtcgacgacggcggctaccggctgggcttcaacgggcatgggggctccgggagcgggcggtggacagcggcggccattctaacggccgggggccgaaggggatatgacggaggcaggtggcagcggccgctggccggcctcggggtcccgaggggtgtcggttttcccccgccatggtggcctgtccgctccaaggcctgggctcccctggacgaccctgcggccatcccggccaggcgccacgggcgttggcccgatctgcaacgattttcagaaccggatgtgttgaaggcccgggacattccccgcgcaatgccccggatcaaggccttgcatggacccacactggtgatttccgcggacagcccctcccccttcccgccccgcctgccgggctccctgcctgcaaggctgccactggtcatcatcggcgccggccaggccgggttgtccctcagcgcgctcctgcaggaggccggcgtcgcgcatcgcgtgctggaagccgaaaccgtgggcgccagctggcagcgacgctgggagtcgttccagaccaacaccgccaatgcgacgatggccctgcacggtcatgcctatgccggcgatgacccggaaggcttcatgggcgccccggaggtgatccggcacctccgcgagtatgcccacgagcgttccctgccgatcagcgaggggtgcgtggtccaccgggtcgggcccgagtccggtggctattgccatcgacagcagccaggggccgatccatgcccgcgcagtggtggtcgccaccggtga

SEQ ID NO: 61651 - DNA, 240 bp, Glycine max
  Peptide Sequence Number=SeqID_178429
atggcgcagccagggattttaggccctggaccccaacctcctccttctccgggccttatgtttccgttatctccttcaggcttttttccaatctcaagtcccagttgcttccttctaactggagagatccttggcttgttggttgaatatctggttcccatgcaaactcatgagcatgttcatgctatccagaacatgagcttgctgatgtattactcagatctacatgccatgccttga

SEQ ID NO: 61652 - DNA, 472 bp, Glycine max
  Peptide Sequence Number=SeqID_178430
atggataactccaaaaacaggcataatgatagtttgggtgtgaataagttggggaaaaatataaggaagagccctttgcaccagcccaattttgctaataatgctgctaggcaacaacctcagcctcaggtttacaacattagcaagaacgatttcagggacattgttcagcagcttactggatcaccctcccaggatcctccacctagacctccacacaatccaccaaagccgcagagcatgaggctgcagaaaattaggcctcccccgttaacgcccatcaatcggcctcgcatgccgccgccaatgcccatgcctgctgcccctccttccgttccgtacaataatgccataccaagacctgctcagtttggacaaccgcctactccgcctggggatatatggtctaatacaaccgagtcacccatctctgcttacatgcgttaccttcagaattcactactggatccag

SEQ ID NO: 61653 - DNA, 540 bp, Glycine max
  Peptide Sequence Number=SeqID_178431
atgccaaaatatagcaaccaggttgttctaatcagttccattttcaaatcctctcttgcaacccatcaccatcatcatgtcttcatcccacttcattccctttggcctaatttatataaactcattccctccccaccccattccaccaacctccctaccaacataaggaagagctggttttggttgcttgagacacaagaaatcaacaatacaatgagtctcaattgcctcacctgcagccagcttctccaaaggacagactcctatggggagttatttgcagaaaaggaatacactaaaatatgcaaacaggttgatagaagcttgtcaagtaacatgtcatcatcaacatccaaatgtgagctaccaaaaggtggtgctgtggccaaggttaaggccggtcatcgccgcaattatagcactggagacgttccttatcctcctggcagcccaggaccaacattggtgcgaagcagcggaatgagaagaaactggagttttgaggatgttgctgaaaagaaagaccagggtgtgagttga

SEQ ID NO: 61654 - DNA, 247 bp, Glycine max
  Peptide Sequence Number=SeqID_178432
atgacatttttaggagaaactagcagtcagacgattgtcaactcaaggttgtctttcatttttccaaatggatcaattattcacaatgatactggtgtttacttccaaacttcaactccggtgcccattcaagtaccaaacagctatgattttgcaagcctaaaaaccagaatacacaatacctttcagctatccgacaaacaatttttggatgaaattcactaccggaagccattcaccgatacag

SEQ ID NO: 61655 - DNA, 351 bp, Glycine max
  Peptide Sequence Number=SeqID_178433
atggctggtttggctagcaatcttcctctaattgttatgataggtctgcaaattcattatgcagcacttgccatattcacaagagccgctctcttagatgggttgagtacaacggtgtttgtagtatacaggcaaggcatagccactttggctttggcgcctatatttttctctcctaagaggagacaatcagtgaaagattctttgggattcaggagcttctttttgatgtttgtgaccgctcttgttgggtacactactctgccaaactcacttagtcacggcaaatcagaatgcatacttcaaaggattattttatgcatcttctactgcagctaccgctatgagtaa

SEQ ID NO: 61656 - DNA, 486 bp, Glycine max
  Peptide Sequence Number=SeqID_178434
atgattcctttctccatgagtggatctgacacaagttcaactcaacaggctgccctatttgccctgctttcagagtcggatcttcaagcatggattttgcaatcacctttacagatttcatgttctttatatgcaggaatcggaatagcggttagcttcttcattcaatcctggtgcatctcagaaagaggtcccctgtactgtgcaatgttcaaccctttggcaacagtcatcactgctttgataagtgcaactttcctagaggaagaggtgtacgttggaagtttggtaggggctgttggagttattgccggtttatatgttgtgctttggggtaaagccaaagagtttgctgagattaaaccagaggcaccacaatcatcaaacttactagatgatgagataagtagtaggatagatttggaacaaccccttctatcagagaaattgtctgaacatgcaacagaagcagatagcaaggtgtag

SEQ ID NO: 61657 - DNA, 122 bp, Glycine max
  Peptide Sequence Number=SeqID_178435
atggaaataatatgggacatcccctttatccctgaaccaaaccaaaccctgacatatgtcatgtccagccgttctacaagccttgagccgaaatcccaacttaccataaaccttgacccagg

SEQ ID NO: 61658 - DNA, 651 bp, Glycine max
  Peptide Sequence Number=SeqID_178436
atgtcttccagaaaaagaaagagcattggtgcaaggcccacagctcaatatgacacaagaagattccactcctttgaggcctggaccatatacacagacaatgtgctaggaagacatatactagctgagagaaaggtagaaatataccatatggagttggatgagttcaaggctgaattggagaggtgtaacttccataagcgcttcaccaatttagctgacagcagcattgacttagccttggtgaaggagttctacgccaacctccacagtcctgaagggccttccccaaaacaagtcagaatccgaggccacttgataaaaattgatgcagacagcctcaacaccttcctggagacacttgtggtactggctaagggagaatccttacccgcttactccagatactgtaggatgcctactgatatcagagagattgaggatgctttgtgtatactaggccgagggtttgttttaaatgctgaaggccatcctgggaagatcctcaggaaagatctgacaactcttgctcaggtttggagtgttctctcatactccaacctggctccgacttcccacacctcggatttgactttagatagagctaggttaatttttggcctagtctctcagttggacatgaatgtatga

SEQ ID NO: 61659 - DNA, 117 bp, Glycine max
  Peptide Sequence Number=SeqID_178437
atggaatcccctcctttgtgttcagtgattataaccaagaagttatgcccacttcttgcaatgaacccaaaagcggagaattataagcaattggacttggatccggaattgggctga

SEQ ID NO: 61660 - DNA, 396 bp, Glycine max
  Peptide Sequence Number=SeqID_178438
atgaggggggtacctacaaatgggactccaatgctcaaacgggagccttgggtccttgattatcgaggttgttataatagcataacaactttgttgataacttgtaacaacttaataaatggagacctgcaacttcgagagagttttgtagtgtcctataggccttgcataaggcagataggtcaagtaagcacaaaaattcaaaaaactaaaagaaggtatgaacaaggcacacataatcttcaatggatcctagcaatgcacaaaaatgagagatatggaaaatggaagaatggtctcaaggcaagaattgttaaggcgttggaccttgaaggttctcttgatcttggaaaggagagaatcgttaaggtgttggaccttcaaatgatctcttga

SEQ ID NO: 61661 - DNA, 591 bp, Glycine max
  Peptide Sequence Number=SeqID_178439
atgggggtcatcttgcttgatggggttgatgcctttgaaatctctgtcggtgaacattataggaggaaggcttctcgtgttcgtcttcttgcttttgttggggatggtgttcacacctttgtgggcccaatagtcttcagtattgtggtcatggttgcgatggtgtcaatagtgcttagttctatccaatccaggtctgggaggagggtgtataatgctcataccttagtcccctcgacaaaggctgacacttatcctatttgtgtcgcttgttcggcttgtgtgaatcggtccttgtactactttttcctttctcacacttttgtcaagcctggtattgtttgtctgacagggatgcgaatcatcctaggtgcgcttgttgatcatgtgagcggagtgttcgtccccttggagttcctccgtgtggtagcgttccatctctacaatgcaggcttgaagttggtggagaacatcattgtctatcatggtcgttggagggggattggaattttctgggagtggctctcacctgagaccagatcgtgtgctgaccataagtgtgtgttgaaaaaagacgatggaactcaataa

SEQ ID NO: 61662 - DNA, 186 bp, Glycine max
  Peptide Sequence Number=SeqID_178440
ccaggagaccagccctcttcttttggagggggtggagccattgcagcccagaagcctgtgactgaggagccaccagcatcagcaccagtagaggaggagactactgctgaggagactcagccttctacaccagttgcggagccagaacagcccaggattcatcagcagctccaacactggatttga

SEQ ID NO: 61663 - DNA, 246 bp, Glycine max
  Peptide Sequence Number=SeqID_178441
atgcggggttaccctatgtttaccctcaccttttgtcaaccaggggcaatcgagtcccttgacgtgcggagactgacatcgtcttctgcaccttttatcgtcctgaccatgaagtccggtgacatgcggggttacattatggttacccggacctttcgtcaactaggggaaaacgagctcgttgatgctcgaagactaacatcgtcatctgcaccttttgtcgtcctgacccgtgaagtcaggtga

SEQ ID NO: 61664 - DNA, 210 bp, Glycine max
  Peptide Sequence Number=SeqID_178442
atgcgggtttaccttatggttacccgcacctttggtcaaccaggggcaaacgagcccgttggcgcccggagattaacatcgtcttctgcaccttttgtcgtcctgacccgtgaaactaacatcgtcttctgcaccttttttcgacctgacccgtgtagtcaggtgacatgcggggtaagcttatggttacccgcaccattcgtcaagtag

SEQ ID NO: 61665 - DNA, 266 bp, Glycine max
  Peptide Sequence Number=SeqID_178443
catctattgtggaaaggtacattacagaagaagccattgaattttgtttagagtacattgaaaaagctaaacctgttggccttcccgagtctcggcatgacaaaatagtgggagacccttgtgatgaaaggtggttagtggttctacacaagaaaacaattggtgttaatgttgaagatgatgattcatacattgatacttatgtcagtcctttgtccatacaaatgtcgcctaatgtcatcgttgaagaagaagaagttgatgac

SEQ ID NO: 61666 - DNA, 165 bp, Glycine max
  Peptide Sequence Number=SeqID_178444
atgttgaatgtgtttggatgtatgacatactatcatgatttgggcaaggctgaggatgtcactaagcaggtggagtttgaaagttccacaatcagaaacattagtgataagaagcagtttgaagcacttgatgagattgatcaggatcttcaaatgcacacttga

SEQ ID NO: 61667 - DNA, 422 bp, Glycine max
  Peptide Sequence Number=SeqID_178445
ggggacggagcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcactggaatgtactgcctgtggtcattcctggtttgcttcccgtgatgaggtgtctgagctgactatagatgcatcagattcaaaaagaagtgtaggcacggcaccatgggccactgcaaaatttgaagatgttgagaagaagctgtctaggaaagatggaaacatccaagcttcaaaactcgctgactag

SEQ ID NO: 61668 - DNA, 309 bp, Glycine max
  Peptide Sequence Number=SeqID_178446
atggataaccacttgggtatctccgcctgccccctaacttcactggttagtattgacagaaactttctgtgtatggataacacttggggtatctccgtacgtcacctgacttcacgggtcaggatgacagaaagtgcggaagacgatgtaaatctccgcgtgtcaacgggctcgttggccgcgattgacaaagggtgcagaagacgacggtatctccgtacgtcacctgacttcacgggtcaggatgacagaaagtgcggaagacgacgtaaatctccgcgtgtcaacgggctcgttggacgcgattaa

SEQ ID NO: 61669 - DNA, 387 bp, Glycine max
  Peptide Sequence Number=SeqID_178447
atggcgcgattgtccggcagcctgggggcattcgtcgcagcgctgggggtgatcatcacctgggctgccagcgggccggccttccacttcaatgacacgtggcagctggtggtgaatacaggaaccaccatcgtgaccttcctgatggtgttcctgatccagcatacgcagaacgctgataccgctgcgctgcacatcaagctggatgaactgatccgggtgagcaaggacgccaatcaggagttgttgaacctggagtcgatggagccggcccatcttgaagagatacgccagcgttacgaggcactggcgaagaccgctgcagacatcaagtccaagaaggagcgctgcatgccctgcgatgcggatgcagccgccgaagcctga

SEQ ID NO: 61670 - DNA, 765 bp, Glycine max
  Peptide Sequence Number=SeqID_178448
atgaacactcttaacgttggcgactatttactgcatcgtttgcaccaggcgggtatccgccatctgttcggcgtacccggcgactacaacctgcaatttctcgacagcgtcattgaccatcccggtattacctgggtcggctgcgctaatgaactcaatgcagcctatgcggccgatggttacggtcgctgcaacggcgcggccgcgctgctgaccacctttggcgtcggtgaactcagcgcgattaacggcatcgccggcagttacgccgaatatgtgccggtgattcacatcgtcggcgctcccgccagccacgcccagcagcagggcgactgcgtgcatcattcgctcggcgacggcgatttcggccattttctgcgcatggcccaggaagtcagtgccgccagcgcggtgctgagcgccgacaacgctgtagctgaaattgatcgggtcatcgctagcgcgctacagcagcaccgtccgggctatctgctgctggcggtggatgtcgccgccgccacggtaacgctgccgtcagccagcgccagcccggcaccggctgaaaaccgcgacgtggcgcaggcgtttgccgcagcggcggagcgcctgctggcaccggcgcagcgcgtggcgctgctggccgattttctcgctgcccgctggcagctgcaggcaccgctggctgagctgcgtgcgctgcgcgccattccggctgccacgctactgatgggcaagggcgtgctggatgagcagcagccgggcttc

SEQ ID NO: 61671 - DNA, 201 bp, Glycine max
  Peptide Sequence Number=SeqID_178449
atggctttggacttggtcgcctactggtcggccacgtgtcgtaggcaacactccagtctttgtagaagagctgacgtggactctggaggtggtggtgctgcgtctgttgcccgctgttggccatcaccaggctgctgtggtgcctcgtcctacgcctgcttgggggcgtggattagcactagtctccttgcagtggtttga

SEQ ID NO: 61672 - DNA, 305 bp, Glycine max
  Peptide Sequence Number=SeqID_178450
atgacaaaaggtgcagaagacgacgttagtctctgcgcgtcaacaggctcgtttccccttattgacaaaagggcgtctccgcgtgccaatggactcttgggtcatgtgcaaggcgaaaaagtcaccgacgcacaggattttggttggcaatcaaagggagaggaccacttcaggcgaggatgggcattctcaccctgggtcaaggtttatggtgagttgggattttggctcaaggcttgtagaacggctggacatgatatatgtcagagtgttggtttggccagcgattcagggataaaggggat

SEQ ID NO: 61673 - DNA, 294 bp, Glycine max
  Peptide Sequence Number=SeqID_178451
atgtcaaattcattgtttgtgttttcaaatatcttaagaaactcgcttaccagaatgaccctttcatcatggaagaacaagctaaacaggtattttatgttcaagacccttgtgatgaaaggtggtcgatggttctacacgggaaaacaattggtgttaatgttgaagatgatgattcgctcattgatacttatgttagtcctttgtccacacaaatctcgcctaccatcgtcggagaagaagaagatgatgacgttcatgcaaatcgtaatgatcatgatgaaggagaattaa

SEQ ID NO: 61674 - DNA, 252 bp, Glycine max
  Peptide Sequence Number=SeqID_178452
atggctggccatatgggtagaggtgtcatagaggagcaggtatggaggaagggaccttggactgctgaaggggacaagttgcttgttgagtatgtcaggttgcatggtgaaggcagatggaactctgttgctaggcttgcaacaaacaagaactctgagtacttcgacatccttaccttgacagtagcaagatcgcgacaccactccaaagagcacgacttcggctatggcggtggtgggaacaacaggtag

SEQ ID NO: 61675 - DNA, 1650 bp, Glycine max
  Peptide Sequence Number=SeqID_178453
atggattatttggctgtaggagacaggaatttattattgaaaacagaagtttccatgaacacaatttctacattctgtgaggagaatgaagccttgtcagcaatctcaagtggactcgaaagcttccacattgccatagtggaggtgagttcaagcagtggccagggaggtttcaaatttcttgagaatgccaaggacttgccaaccattatgacttcaaacaatcattgcttgaacaccatgatgaagtgcatagcgcttggtgcagttgagttcctcagaaaaccactatctgaggacaagctcagaaatatctggcagcatgtggttcacaaggcattcaatgccagggcaagcatcctgtctgaatcacttaaacctgtcaaagaatctgtagtgtccatgttgcagctccaaacagacgatgaacaacatgaaagtagagtatccagggatatagagaaagtatcccgctttgttgataatgatcatgagttgtcttctggaaatgataaatatccagctccttcaaccccacaattgagacaagggacgagattgttggatgatggtgattgccaagagcagactaattgctccacaggaaaagaaagtggggaacatgaaggagaatctaaatctgtcgaaactacatgtggtaatttgaatgctgaaagtactcctcaacaaaggaaatctgaaattactttggttagggaggaagttgaaagtactcctcaacaaaggaaatctgaaattactttggttaaggaggaagtggatattgttgatgcttccaagggtgagagtgttgcttctccacatacacaaaaaagaaaagttctaagcaacactgacagaaatacaaaagctttaatcaaagtaggtgttcatagtgattcatgtgagataagaggaaatcagaaaaagataaaagtagactggacacctgagctgcacaaaacgtttgtgaaggcagtggagcaactaggcattgatcaagccattccttctcgaatattggaattaatgaaagtggagggcttgacaaggcataatgtggcaagccatctccagaagtatagaatgcataagagacaaatcttgcccaaggaagaacgaaaatggttgaatctaagagaaaggagctattgtgttaaaagaccaattatggcatttcctccatatcattctaatcacacccttcctctgcctcctgtatatcctatgtggggacaatctggcagtccaacggctggcatgcagatttggggctctccaggttatcccttttggcatactactgctgaaaattggcactggaaaccatttccagggatgcatgcagatgcatggggctgtccagtgttaccattaccacctcctcaaactcctggttttccctactctcagaatatgccttcgttgctcaatgctgatgcagtggatcacacatttaccatgccacaaagttccttcgagcattatccggcagaggaggtagttgacaaggtggtgaaagaggcaataagcaaaccatggctacccttgcccttgggtttgaaacctccttccccagatagtgtgttggctgagctatccaggcaaggcatttccaacatccctccaaagggttcaaattcatgctga

SEQ ID NO: 61676 - DNA, 447 bp, Glycine max
  Peptide Sequence Number=SeqID_178454
atgggaccaactttacccactatgggccagaagtgggaattgttagatgtagataaagaagtgagacatgccaatacaaaaagaaggaatccaaaaagtcaaaccattgtagtccatggcttcaagctttgcccttatctcggcagcagaaatgttgtctctctcaaggagaagaaccttgagccctttgggaaaatctttccattcttatcaacccccaaaacaaggttcagatcaaaacagccatgcccttttatcaccaatgaaacagctggtaaatcacaaaaaacatatattcccaccaatttttcaggaaacattttctacacaatacagaatcaaaagccaccacttttgtatttcaaagatctcatttcgatggcagatgccactttcacaaaacagcaaacagacaattatcccatcccagtaattgagatctcatga

SEQ ID NO: 61677 - DNA, 255 bp, Glycine max
  Peptide Sequence Number=SeqID_178455
atggtagaggatcctcttaatttagggaagtttagaccgatttccttggtgaactctttggataagatcttagctaaaattttagctaagagatggtctagagttttaccaaagataatttatgagaggcaaagtgcgttcttgggtggaagatccttacttcatagtgaacttgtggccaatgaagttgtggatgagacaaaaaggaagaagaagaagtggttggtttttaaggaaaattatgaaaaagcttaa

SEQ ID NO: 61678 - DNA, 237 bp, Glycine max
  Peptide Sequence Number=SeqID_178456
atggcggtttccgccatcgacgacaacaatggaggaagaagaagcaacgcaaaggagaaaacaaacgtgaagaagaaccacacccacagtcctacgcagaaacgcgaagaagaaatgcgaagaacaatgaaggaattgaaacgccaagaagcagaaacgccaagagcagtgaagaagatggaatcgcggcggcgcacaagaagaagattgaagaagcagatgattgaagaagattga

SEQ ID NO: 61679 - DNA, 342 bp, Glycine max
  Peptide Sequence Number=SeqID_178457
atggaactcgctaacattcaacaagatgagtatgagtccttaagagacttcatggagagacaacctgtgcaagaaattacctacaacattggaagagttgagagcaaggactgccagattcatccagatggaagagatgaccagattcaaagagaaagtatgtggctaatcatcaaggaaaccaatggagtgagagatcaagatctagagtgtaacacacccgattgtcaacttctcggtggttctcacattactacacttcatatgatgacacttcactcaacatgcttgttggttagaaccctccacaagttagaacccttcgtaggtagccctttttga

SEQ ID NO: 61680 - DNA, 477 bp, Glycine max
  Peptide Sequence Number=SeqID_178458
atgacgcgtcgcaggcctctacacggtagctgggcgtgctggatatacgagcactttcctacagtgcatacatccgtcgttcatgatgcttatgatgaggggagcccacgggcctgcaggtggcttacgagtaaggctcatatgacggggatcaagggagccccgtatcggagacgtttggatgccctgagtgtgactgacgtgtgctggatgcccaatggtgagcaccggggagtcagggcctttgacttgatatcgtcgtacaccggccagctcagatggggtcagattgtgcacccatttgtcacgcggaccgaggagactgttgcgccgagacatctgcctccccctcatcatgaggagttcgtcgagccacccatccccgaggtttcagtcgcgaccgatctccctatgcattcagtggttcactacgaaaggattgtcagggatggctcaggatttaggagcgattgctaa

SEQ ID NO: 61681 - DNA, 210 bp, Glycine max
  Peptide Sequence Number=SeqID_178459
atggagagcagcagattgatggcagaggagtttaagttcattcaattttcgacaaaattttcaagaaaaataaccaaaaaacagcaaaacatggtctgcggaagaagtttcgcatgttcttccgtgagaagaataggtagcctgcggaagaaggttccgcaagttcttctgcgaccaggaaatgttgtctgcggaaccttcttccgctga

SEQ ID NO: 61682 - DNA, 433 bp, Glycine max
  Peptide Sequence Number=SeqID_178460
tgccaaacggatgtgggacaccttagccattaccaacgaagggtcctttgagctaaaacataacaagttgagccttctaacacgtaagtatgaactctttggtatggaagatggagaagatatccaaaccataccacaggtcacaacattaagagccattaagaatcttgattcaatgactcttgaagagctcgtcagaatccttaaagtccatgagctagagcttgctcaagataaggaaataaagaaagggaaatctctagctcttacggaggacttagacgattcctcatctgacaatgatagtgaggaagaagccaacctatgtctgatggttgatgcatccaccagtaaggcagaatcagaactggacgcaagttcggatgatgaggactctcagcctgaggacgttgttaactctaatggtaaagag

SEQ ID NO: 61683 - DNA, 426 bp, Glycine max
  Peptide Sequence Number=SeqID_178461
atgtggggggggggggggggtccttgtacctttgataaacaactttttctcataaacatcaacggaagtgaagtcccaagtcaagtgcctatgcaagaaataccaatttggattgaggttcataacatccctcttggcttgacaacgatagctgttggtaacttcctggaccaatttgtagactatgatgacaaacacaattcaagcccgttgatgtcttacatgaggataaaagttatgatcgatgtcaacaaacctctgaaatgtaccaagaagatcaagaaggaagggcacaatgatgatttatgtgggaagctattcaaagtggagaatgacaatggtctaagttcatgggggccagaactccgggcggatgcgcgcgtccttcggccatggaaagaggctcttgttatcctagggaagtga

SEQ ID NO: 61684 - DNA, 171 bp, Glycine max
  Peptide Sequence Number=SeqID_178462
atgggatcttcgttagcgatgagatgttcatttcgatttgatgtttgtgtttgtggttgctgcgagggtgacataaattgggatgaaggatggttttgttggtcaaaggagggggtagttgtaattgtggacatgacgattgtggagacgatggctatggttgaagaataa

SEQ ID NO: 61685 - DNA, 987 bp, Glycine max
  Peptide Sequence Number=SeqID_178463
atggggtcgaaccaagcacatccttttaagaaaagggtttcatcaagtcagggtcaagcatggaagaaacaacacgctttatggtgcccttacggaacgcatgccagagctagagtaaggagtgaaatagaggaggtgcaagagcagatgaaggttgacatggaggccatgaaagagaaaatgaccacaatgatggaagccatgatgagtatgagaaggatgatggaggtaaatgcggctacagttgttgccacaagtaccaccatagaagtggacccgactcacccacccggcttcaatgaagtaaatcatctagcctcggatatcgtaggtcagggaggaaaagcattaggaagtacgggcggcccctattttgtgcagaatgtcgacaactccgcacccatacccattaagagccaacaaccccaatctgatcatgcatatgtctctcaacccatgggggagacacatgaagcaccccaagaccacaatctagctgacttaaaacctcacctcagatatgccactgaggggcaagcagttggtggtgtacccctgccaaacactttggggggtcctcagtttcgcccacaaccacaacccttacattttgcggtggaaaaactccttcctagtatggtggaatgggagaaatttgatcatatagaggaaagactgagggctattgaaggaggtagagattatgcctttgctgacatggcaaagttgtgcctaatgcccaacgtggtcattcctccaaagttcaaggtgccggacttcgataagtacaagcggactacttgccccaagaataacttgaagatgtactgcaggaaaatgggggcatatgcaaaagatgaaaaattgcttatgcatttcttcaaggaaagtcttactagggaagccttcacctggtacaccaatctggagtcttcccgggtccattcctggaaagacctaatggtttccttcattaggcagtattag

SEQ ID NO: 61686 - DNA, 228 bp, Glycine max
  Peptide Sequence Number=SeqID_178464
ccttccagttttcaggatttgctggtcttaccgttgttcggaggagctcctccttctgagaacacgggttcaagggccttgctactccaacgagggcaccctttatttaggcttcttcagtccatcggcgagaacaaaacaagccctttaagcagaactggaatcaaagcccttccgcctttgactagactctcggagaagcagatggttaagtcaaggccaaccaag

SEQ ID NO: 61687 - DNA, 360 bp, Glycine max
  Peptide Sequence Number=SeqID_178465
atgaagaaaatccaagtcgaggtgctgccataccgcttccgagacgttttcgtgagcaaatccgtgaagattttccatcgttcttcaccgctcttcgtccattcttcattcgttcttcggtcttcagccgtaccctcaccttcagaaggctacacgccctcgccttcagagggctacacgtcctcgccttcagagggatgcacgccctcgccttcagagggctccacgtcctccccttcaaaggactacatgtcctcaccttcagaggactacacatcctcaccttcagagaactacacgtcctcgcctttaaaggactacacgccctcaccatcagagggttacacgccatcaccttaa

SEQ ID NO: 61688 - DNA, 303 bp, Glycine max
  Peptide Sequence Number=SeqID_178466
atgttctacaacactgagtcactagataaaatgaaaagcataggaaactctttgcaatatcttgtggtggcattttcaatttatattggaaccttgttggttaatgttgtgcaccaactgactcggaagcatggtggaattgattggttgaatgatgacatcaatgctggaagattggactactattacttcctcatggctgggttagctttgattaatctcatatatatcttgttctgtgttaaacattaccgttataaggttaatgtcgaagaaaaagttgtggagaaacttgagccttga

SEQ ID NO: 61689 - DNA, 225 bp, Glycine max
  Peptide Sequence Number=SeqID_178467
atgtcagcgtcttccggccaagactgcgaaaaagtctcaatttcacaattgggaccagtgagtccgatagcatgcggagacaccttatggttatccgcacctcgtcatttggagaccccaagtccgattgacaagcaaaggccaatgtggtcatctgcacccttcccggagatgtcagcgtcttccagcagagaccgcgaaaaagtctcaattttgctatcgtga

SEQ ID NO: 61690 - DNA, 1000 bp, Glycine max
  Peptide Sequence Number=SeqID_178468
cctcaccttcagaggactacaggtcctcgcctttagagaactgcacgccctcgccttcagagggttgcacaccctcgcctttagaaggctacacgccctcaccttcagaggactgcacgccctcgccttcagagggctacacgccctcgccttcagagggctacacgcccttgccttcagaggactacacgtcctcgccttcagaggactgcccaccctcgccttcagagggctgcacgccctcgccttcagagggctgcacgccctcgccttcagagggctacacgccttcgccttcagagggctacacgtcctcaccttcagaggattacacgtcgtcgccttcagagggctaaacgtcctcgcttttagagggctcaacatatgcgcctttagagaactcaagggagacgagtgcggatcatgtgtaccaccacaactccgatctccccctaccgaagagtcagctagtttatgccatcatgacatagggatcgtgcccacaagacactcagtaggcccggataagtccaaaagggtcttggggtttccagctctgattacgtgcctctgtcagttctatagagtgcccatcgcccccagcagggtcatcaggcccctattaacagggctttcatcgagaagtactacgcccctaggcaggcacagggcaaggcatcacagtagcgggcaacagatgcaccaccaccacttgcagagtccacctcagctcatctacaaaggctggagcattacgtacgacacatggccgaccagtaggcgaccaaccacccgggcaggtaccagcaggtattgtgtccgtgatcgacaaatcgtcatcatgcatctggctcaagacgttaaagaagcgctactaggaggcaacctagaattggctacgaagaagctccccacgaagcagtccaggaagggcaccattgaagaggatttcagtgtggccccacaagccgacacaagctttgacaaacaccaattctag

SEQ ID NO: 61691 - DNA, 378 bp, Glycine max
  Peptide Sequence Number=SeqID_178469
atgtcccatgctgtcaaggacaatcgaggaaaatgggccccaaactacgaagggccttttgttgtgaagagggctttttccggaggagccctggtgcttaccaacatggatggcgaagagctaccttcacctgggcaggatcatctcgagctaccttttggggtggggacaaaacatgaacagcagaaaccaatcaaggtactttggaacggatgcaagtgggggatggggtcacaaccgaccggtcgttgccccttctctgcgctaaacaagcagagaacgtcgctgcaaggcagccccgtatcctttgtattcacagttttcttttactatttgtttgttttaaaaataagtaatcaacgcctaattctaacttaa

SEQ ID NO: 61692 - DNA, 887 bp, Glycine max
  Peptide Sequence Number=SeqID_178470
acaccaatatcagaggggatgattttgatactctaagaaaagacactgaccttgataaaagcctttctatagattcttcaattgaggatagcaaacccttgggtattgtggatgagaaggaagtatcagaacctaaaagttcagcttctcttgattcatctctccccgtttgttctgataattcaaatgacaatatgcaaatggaaatgaaaaatcattccaacaaaatatgcccagaaaagcaagagttgacaaagcctgattaccaaggaagtaacttagatcgcgatttggttgcaatctcaagtccagatatggttgcatgcaagaaaatagagtctgaaagcaaagattttagcactaaggaaagttctaatggcctaattaagaatcctgtttcaatgagaaacaggaaatttgccagtgatgtgaaatttgattcaaagtgccaacaagctaccaaagtggttgatcaagaatgcactcttggatctagtgaggatcctagtaatttggctagctcaaaggtggtgggtgacacaaagatcaacttagaaagtcaattgcggatgaagttgagccatggaaagacttcaaatgcaagctcttcaaagcttcctcttgcccttccttcaccaaaagctccttcagagtcttggcttaagcgcacattaccaacagttccctcgaagagtatatctttacggtctaatcttgctacctacttccatgcacctgttaaaacttctgaagttaatcatgggcatcttcagtttgctcagggacctaaaaatttctttttttggggccttaagctgatgcctaatttgtcttgcatcttgcaaggccgtgatttggaactactcccacccattccagaagcatga

SEQ ID NO: 61693 - DNA, 249 bp, Glycine max
  Peptide Sequence Number=SeqID_178471
atgtatgtgataaaggcaggacataggtactctgaagaggaaacaggagagtttcaggttcaagaaattgcaaacacgcaacttaggcgacaagcaatgacatgcactgtcaaattgaaccaatggttgtgtgattgtgaagaatttcaagcacttcaaattcctagctcgcattcaattgcagcgtgtgcttcttgcaatttaaattatgatgactttgttgacctacgagttggaaaatatttataa

SEQ ID NO: 61694 - DNA, 405 bp, Glycine max
  Peptide Sequence Number=SeqID_178472
atgactggtgaagaacccataataagagatcatgttagcaactttagtgacgaggattgggagcacgatgttcatgaaagtggagaaccaagcaatcaaaagaacaagagtgaaaaatatgttgttaagtgtatacaatatggtaatggatgtcattggagggagagagcatccttcagcaaaatacgcaggaggtgggagatgaagaaaataaatggtacaactattagatacaaaacatccacttcaatagaggatggtgaggatgagttttctaaggatatgatgcaatcctacccctcaagggcattggatagaagactccaagaagattgggccagagatgcaagagaaggccctaagattctcatgagccctatggtagattttgggcccatggactaa

SEQ ID NO: 61695 - DNA, 276 bp, Glycine max
  Peptide Sequence Number=SeqID_178473
gagcagaattgtcccagcccacggtcaaaagtcaagccaagtcaatggcagaaatcaaccaagggatggaagcgaatgaaggataggaccgcgaccgcccaagccccaaccattcccgacgctaaacaagcagagaacgtcgctgcaaggctcaagttaggcaaaacgctaacccatgaagaaggaggggacatggggatggccttaagcctagggtgcatcctgaagcaatggggcatgccacattgcccccactctcttgctattcatgcctaa

SEQ ID NO: 61696 - DNA, 1221 bp, Glycine max
  Peptide Sequence Number=SeqID_178474
tcaagggctacacgcccttgccttcagagggctacacgcccatgccttcagaggactacacgtcctccccttcagaggaatacatgccctcgccttaagagggctacaatcctcggcttcagaaggctacacgccctcgccatcaaaaggctaaatgccctcgcctttagagggcctcacatccttgcctttaggggactacacgtcctcgccttcagaaggctacacgtcctcgccttcagggcaccacagagggctacacgccctcacaatcaaaaggctacccgcccaagccttgcttttagaggacgacacatcctcgctgttagaggactacacgtcctcgccttcagaggtctacacgccttcgcctttagaggactaaacgtcctccccttcagagggctacacatcctcgctttcagaggactacacgtcctcgccatcagaggactacacgtcctcgccttcataggacaacatgtcctcgccttaagagggctacacgccctcacctttgtaggacgactcgtcctcaccttcagaggagtacactccctcgccttcagagggctgcacatcctcgccttcagaggactacacgtcgtccccttcataggactagacgtcctcgccttcagagggctacacgctctcaccattagagggctacacgccctcgactttagagggctacacggcgtcaccttcagaggactacaggtcctcgccatcagaggactacaggccctcacctttagaggacaacacgtcctcaccttcagaagactagacgtccgcacctttagagggctacacgccctcgcctcgattatagaggactctacgtcctcgcctacagaggactacacgtcctggccttcacagggctacacgccctcgcctttaaaggagtacacgtcctcggcttcagaggactacaatcttcgccttaagcggactacatgtccccaccttcagagggatacacgtcttggccttccgaggactacacgccctcacgttaagagggctacacgtcctcgccttcagaggactacacgtcctcggcttcagaggactacacgtccgcaccttcagaggactacacgtcttcttcttcagatggttacaattcctcgccatcagatatctacacgtcctcgccttcggaggactacacgtcctcgccctcagagggctacaggtcctcacctttag

SEQ ID NO: 61697 - DNA, 105 bp, Glycine max
  Peptide Sequence Number=SeqID_178475
atgggtacccgtaatgagcctaactacttatcagaaataggaacatgtgcgcctaacttccacgaagtggattacttcacgtgggctaacagttattacacgtga

SEQ ID NO: 61698 - DNA, 754 bp, Glycine max
  Peptide Sequence Number=SeqID_178476
atgaatcgcgtgcttgaacaatacctgcgttgctttgtccattctcaacccacaacgtggttccgatacttggcactcgcagaatggagttacaacacctcgttgcactcaagttcaggactgactccgttcgaaattacttacggcaagcctcctccaacggtgctggattacattccggggacaactaataatgaggctgtccattccttgctcgaaacacgccagaccatgcactctaaattgcaacgacgtctgaagcaggcccaggagagaatgaaggctcacgcagacgcaagacgcgaagacatttccttcgaggaggggcagtgggtctacgtgaaactcagaccagggcgacaaagttccatcatagggcgaccctaccagaaactttccaagcggttttttgggcctttccaggttctggaacgtatcggagcagtcgcatatcgccttcagctgccatcagaatcgcgtattcaccccgtcttccattgctctctccttcgccttcaccatggcccaccgccagatgaacacaccccttgccctctgctatttcgagaccagcgccctctccggaagccactatgtttcctggatatgaagattgacccttcctccacgacgccgaccccgttggttcttacacaatgggttggtgagcctcttaaagatacctcttgggagccatggccggagctccgtgatacctaccaccttgaggacaaggtggttttgggaggggagg

SEQ ID NO: 61699 - DNA, 216 bp, Glycine max
  Peptide Sequence Number=SeqID_178477
atggctagacacttccttgatgctcatgcaaatgaagcgggtttggtgcttcactctagccctatgtttttgtttcttatgattgttgcatccctttctattatttcaatgatcatatttgcctgtggtgatgacaacaaaagaaccaataagggtggtggcggtgggggtgggggatgtggcggtggtggatgtggcggtggatgtggtggttaa

SEQ ID NO: 61700 - DNA, 276 bp, Glycine max
  Peptide Sequence Number=SeqID_178478
atggctagagacttccttgatgctcatgcaaatgaagcgggtttggtgcttcactctggccctatatttttgtttctcatgattgttgcatccctttctattatttcaatgatcatatttgcctgtagtgatgacaacaaaggtaagaaaaaggttggtggcggtgggggatgtggtggcggtggcggtgggggatgtggtggcggtgggggatgtggcggtggcggtggtggtgggggatgtggcggtggaggtggtggtggtggtggctgctaa

SEQ ID NO: 61701 - DNA, 339 bp, Glycine max
  Peptide Sequence Number=SeqID_178479
atggcgttcaaagctctgcagttaacgcaaaaacgtcacaaaccatcatgtttcttgaccaataatacaggggatgagaatggactagtgcttggacgaattatgccactgttgagcaagacagacctaagttttgatttcttgcatttgataataagggtgccggtagggtcgaacgttgatgggttcagaattgggtatcaagtgtatgacgtggttggtggggcaggatggtggaagggtcgttggtgtgtggaacagggttgtgaattgggtgaggaaattggtgatttctgggttgttaactcgttggcaagtgtaccaaatcattacaagtag

SEQ ID NO: 61702 - DNA, 441 bp, Glycine max
  Peptide Sequence Number=SeqID_178480
atggccttgatgatggactttatcgaggtttctctcctctcctttgaaaggactttttccaaactcgattctgaatgtactggaacacttaagccttggaccttccaactacagttggcaaaccctgtgacaatcacctctatcatttctgaccatactgacaaggagaatgtccctccaataacatgtaataatagcaccaacaaggacaagagtaagaccctaattccacacatcatggccaaatctttcaagaacatgaagtgcactaagagaatgcgcaagagggtgcctcttgctgatatcaccaacctctttaacaattttgttacatcaattaccttcactctttcgcaccaacaacaacaatttggagtttcttcggctcttcctaggagggcacctcgtacctccaaaacattaaggatgggattcagatag

SEQ ID NO: 61703 - DNA, 2160 bp, Glycine max
  Peptide Sequence Number=SeqID_178481
atggcatttcgcacgcaccacgaccactatgagttttgcgtgatgttcattattgtcttcttcgacgatatcctaatctacaacaagaccttcactgataatctggagcacctcaacacagctttcacggtgttactagaaaggcatttcttcctgaaactcacgaagtgttcctttgcccagcaacaagtggagtatctaggccatatagtttcccagcgaggtgttgaacttgtgcccaccaaggtggaggtgattcaagtttggcctgttccctggacaaccagagccctgcacggtttcctgggtctctcgggtttctattgtcgcttcattaaaggctatgcctctattgtagcaccgttgactcacctcttggtcaaagaccaatttcagtggtcgctgaaggctcaacttgcttttgacaaactcaaggaagcaatttgcacaaccctggttctaagcttgtcagacttatctcaaccattcatcgttgagatggacgccttcgacgtcgacatgggagctgtcctgaaccaaccgcatcaccccattgctttctttagcaaaccattatatcccaaacttttgcgttcatccacatacgtgcgtgaactggagacaataacgacgacgttgaaacaacaactttatctagctcaccttctcggttatgactattccattcaatactgctctggcaaggccaactcagttgcagatgccttatcaaggatacatgaaactcctgatctaaaagaggagttacaaaattatgctaagtatcgagaactacgacagaacatcgtggatgacccacaagctcacccaacatatacagtcactcaagatttcattttccaacaaaatcgtatctggcttccccaaggatgtagcttttattcctctattgttgaaagagtttcattcaactctgacagtgggacacatgggactcaccaagaccctgagccgcatcgggcagaacttcatttagccaggaatgaagatggatgtgcaaaactttatgctatcatgccttcagtgccagcaaacgaaacagcttccacggtcgcaaccctcttcatggagatagtggggaagctccatggcatgccgcgaagcttggtttccgatagcgatcctctcttcgtgagtcatttcaggcaagagttgttcaagctttccgggaccaaactaaggatgagcttcgcatatcatcctcagtcggacgaacaaaccgaggtgatgaacagagttatagagcagtatctcagagcattcgtgcatcatcatccttcctcatggggcaaattcatcatctgggcagaatggttgtacaacacctatgttcatgtggcaaccggactcacgccgttcgaaataacttgtggcaagaaacctctgaatatcccagattatctcgctggcacttccaacatagatgccatggatgacttcctggtcaatcgcgatgcagtattcgccattgttaggaagaagttgcttaaagctcaacaagctatgaagaagtttactgatgggaacagacgcgatgtccacttccaagagggagactgggttttagtgaagctccgccctcgccggcaagtgttcgtcaccagacagggaaggcccaaattgtccaagaggtactacagcccatttcagatctctaagacgataggcccagttgcttacgaactcgcactacccccggaatcgcggatacaccctgtttttcattgctcactcctcaagcctttccaccagtcagaccaattgacgacacaagcagttgaccttccacttcagttagaagataatgatcctattgtcacgcctcttaccatactcaatacaaagtgggttactttagatactgggcctgaattgatggtactgattcagtggaaaggcttgttgcccgaagacacgtcgtgggaatcatgggctcagttgaaggagatttaccaccttgaggacaaggtgctttcggatggccatagggatgttatgaagcaaaccatacaaggcacaaaccagaatcagggaacatcagacaaagcagaatcaaccattcattcatggagcaagaggcaaatcaccaaaccacattacctgagggatttcgtaactaaccctgacaagggatgctga

SEQ ID NO: 61704 - DNA, 195 bp, Glycine max
  Peptide Sequence Number=SeqID_178482
atggcgttcatgtgtaatgaaaattctttggcatctatgattttcatagcaaggtatttcccttcttgctctcctatgtttactaggaacttcgaccagcatcctatcgtccaaggacttggtggaggaggggagagcatgcaggaatattctgtcggtcatgctgaacttgaagatgagatgaggggaggttga

SEQ ID NO: 61705 - DNA, 858 bp, Glycine max
  Peptide Sequence Number=SeqID_178483
atgcttactaatcgaataattggcttaccggcaccgtttctccttagttgcttcgtgtccgggctggctccagaaatcaggcgcgaggttcaagctcttcaccctttgaccctggtccaggcagcgggcctagcacgcattcaggaagagaagttggtggacaaacaccgtggtgccttcgactgtcctcattcgtgccaaccccatcccatctccaccctgttacctcctccacccctgacctctctgctattgccttcttccgctaaaccacccccactgcacatccaccaaaaggagagtacatgcgcaaaccctaatattgacctcagtacccaagtccctgacccacccgcgcaggacccgacccaggcccagattagtttttacacactcctgagccacctggccccagaaacacttcatctagtgggtcgtgtctctcaacagagcgtgatcatcctcatcgatggaggaagcacgcataatttcatgcatgaacgcttggttcgttcccttggtctcaaggcacagctcacgcatcctctccaagtcgtggtagggaatggcaacgagttagcttgtcaccaactttgctctggtgtcatgattaacattcaaggcccgccgcctgtggtgcgagcatggttctcggcgttctcaattgaccttcacgttcttcccctctattgtgcggacatggttctcagcgttcagtggctaaaatctcttggccctattctcatcgactataatgacttgacattgaaattcattcatgatggcaagatgatagaattaaaagggaatgtggctggcgctcttcaacctgtaactcccacccagttacgacgaatg

SEQ ID NO: 61706 - DNA, 267 bp, Glycine max
  Peptide Sequence Number=SeqID_178484
atggagaattgcactaagcaatcactacgcatggctccaaaaaagtggggaggatgcatgaacaaaaacgtaattcatggggctccaaaaaagggtagagaatggagaattgcactaagcaatcactacgcatggctccaactcgtgggtggaggacgcatgaacgaaaatgcaattcatggggctccgaaaaagggtagagaatggagaattgcactaagcaatcactacgcatggctccaaacttgtaggtgggaggatgcatga

SEQ ID NO: 61707 - DNA, 147 bp, Glycine max
  Peptide Sequence Number=SeqID_178485
atgaacgatagaatagcaggatcagctccaggcagctctgatttgagacccgccttcgtatccatgtctttctacatcggtccatcaaccgtcgttgtaaagtgtgggttttcaatgactcccgctacaacaacggctcataactga

SEQ ID NO: 61708 - DNA, 279 bp, Glycine max
  Peptide Sequence Number=SeqID_178486
atgttacgaaaccttacgcatcacgtaatcatccccttttttggcttccgggatgttacggaactttacggatcacgtaatcatccccttttttggcttccgagatgttacggaactttacggattgtgcaacaatgctttcttttgacttccgacatgtcatggagcttcacgaatcgcctaacgatgggttccaagtacctcgaagtggtcaaacgagggtcgcatcccaacaacggatggtccccggacgaaattagggtatggcacatgccttaa

SEQ ID NO: 61709 - DNA, 318 bp, Glycine max
  Peptide Sequence Number=SeqID_178487
atggcgaatcaagaggagtgggttccgtttgcggacgtattagctttgctaatctttggggttgtcctctttccaaacgtggacggtttggtggacctagctgcgattgatgctttccttgcatatcaccatagcaaagagagcccgatggtagctatcttgggggacttatttgatacatttgaccgaaggtgcgagaagagtagcgcacagatcatctgctgcttacccgctctttatgaggcagaacaatcaactggtttcctcgatggaaggaaggaaaggagggagttctcttctcatgtggggactacctaa

SEQ ID NO: 61710 - DNA, 912 bp, Glycine max
  Peptide Sequence Number=SeqID_178488
atgggtccagaccttaaacatgcgttagacgctattcgttgggccagagagtatttcctcaaagccacaagcatccacggttttgtgtttgcacaagtgggtgacccatatgctcatcacaattgctgggagagacctgaagacatggacacccccagaacagcctttgccgttagcagagacttccctggttctgaagtttcagtagcctcatcaattgtatatagcaagtatcatttaggttattctacaagacttctccaaagggctataaaggtttttgattttgcagataagtacagaggatcatacaatgacagcctcggagcgtgggtatgcccattctattgtgattttagtggctaccaggacgaattggtgtggggagcagcatggttgttcaaggctactaaacgccctaactacgtagattacattgacaaaaacattcataatctgaaaaactttgctgaatttggatgggactcaaaggatgttggcatcaacgtgctcgtctctaagcttctaattaatagtagctctaattctaagcctttcatcctcaacaatgcggacaagtttgtctgttcagtgctacctgaatcaccttcagtattggtctcatactcttcaggtgggcttctattcaagccaggagggagtaacttgcagcatgcaacaacaatctcatttctgtttctggtttatgctggctatttgaaacagacaaataaagagattaactgtgggggtaaagtttttgcttctccaaagcgactcaaacaaatagaaagaggccaggtggattacatactaggaagcaatccagcgaatatgtcatacatggtaggatacggagcaaaatatcctgaaagaatacatcattgtgaaaggaggatcattttattttga

SEQ ID NO: 61711 - DNA, 2196 bp, Glycine max
  Peptide Sequence Number=SeqID_178489
atgagagggtgggaattgggaaatatcttaccggagaatggggcgacggcagcatcgtgggccatctcccggaggagattctgtttgaacgtgttcgcggcggtttccgacacccgcacgcggaacgcgttgtcgttggtatcgtggagcttctaccggttggagcgcaagacgcgcacatctctcacgctccgcggcaacgcgcgtgacctccacctcatcccgacctccttcaagcacgtcacgcacctcgacctctccttcctctcgccgtggggccacgcgctcttctgctcctcctcctcctccgccgccgccgccgccgtcgaccaccagcgacacctcgcgcaacatctccgcgccgcgttcccgcgcgtcacctcactcgccgtctacgcgcgtgacccggacactctccgcctcctcctcctctccccatggccggagctctccgccgtcaagctcgtccggtggcaccagcgcccgccgacctccgcgaacgaagccgacttcgctgagctcttcaagaagtgccgatcgctcgcctccctcgacctctcctcctactaccactggacggaggacatcccgacggtgctcgccgcaaaccctatctccgccgcctttctccgccgcctcaacctcctaacaacctccttaacagaaggattcaagtctcacgaaatcgaatcgatcaccgcgtcgtgccctaacctggagcactttctcgcggtctgcaacttcgatcggagatatatagggtccgtcagcgacgacacgctggtttctattgcttccaattgcccaaagctatcgttgcttcacttggccgatacgtcgtcgttttcaagtcgcagagaggaggacgagggtttcgacggagaagacgctagcattagccgcgctgctcttatgactttgttctctggacttcctcttttggaagagctcgtgttagatgtttgtaaaaatgtcagagagagtagtttcgcttttgaagtggtgggttcaaagtgccctaatttgagggttctaaaattgggacagtttcaagggatttgcttggcctttgagtctcggcttgacggaattgccctttgccacgggcttcaatcgttgtctgttggtaactgcgcggaccttgatgacatggggttaattgagattgccagggggtgttcgagactggttagatttgagcttcagggttgcaggcttgtgacggagcgtggactgaggaccatggcttgtttgcttggcaggactctgattgatgtcagggtttcttgctgcgtaaaccttgacacagctgcgactctcagggctttggagccaattcgcgagcagattgagcggctccatgtggattgtgtgtggaatgggttgaaggagagtgatggcctgggacatgggtttcttagttttgatttgaatggtttggatgaacaggatgatgtgggtaaactcatggattactactttgggggtggagaatgtgagaacacaagcaaaaggaagaggcagagatgcgagtatcaaatgagggttcatgattcctttttggaaagcaatggcaatggtttctatggcaagagctgggacaagctgcagtatctttctctctggataaaagttggtgatctcttgactccattgccggtggcagggttggaagattgtcccgtcttggaagagattcggattaaggttgaaggagattgtagggggcagccaaagccagcagagagcgaatttggtctcagcattctggcttgttatcctcagctattgaagatgcagctggactgtggtgatactaaaggttatgctctcacggcaccctctgggcaaatggatttgagcctgtgggagaggtttcttctgaatggcattggcagtttgagtctcagtgagcttcattactggccaccacaagatgaggatgtgaaccagaggagtgtgtcacttccagctgctggcttgctacaagaatgttacactttgagaaagctcttcattcacggaacagcacatgaacatttcatgaacttttttcttaagatacaaaaccttagggatgtacagctgagagaagattattatccagctcctgaaaatgacatgagtacagagatgagggtaggttcgtgcagccgctttgaagatgcactgaataggcgtcgaatatgtgattga

SEQ ID NO: 61712 - DNA, 1254 bp, Glycine max
  Peptide Sequence Number=SeqID_178490
atgatgttggctagttggatttcatctgaagagctgtcagatccagctacaagtcagatggtgcttcctcatcagaagctcgtaggatacgaagaagtatcagcattacaccagagattggtgatgatattgctaggatctaatctatgtagggctgtccgggcgatgaatgaaacattaaagcaaaatcgtcttctgagagagcaggggggtgatagttcattgtctcattctccaattgatagaaccagcagtgcagatcttcagaaaaatgtgtcaaatttccatcttgataatcaccatgagaggtcccccttatatttgcgtgaccctgtgacgtctcaaaaggcaatgtcgttaccctcttctccgcatgattatagaggacaagcttctgagagaagcaaggcgtcagaatatatattgaatgatgaactggagtttacttggaataaaatccttgaatcaccaatgttcagtaatagacctctgttaccatatgaagaatggaatattgatttcacagaattgactgttggaactcgtgttggaattgggttcttcggagaagtttttcgtggcatatggaatggcacagatgttgcaatcaaggttttcctagagcaagatttaactactgaaaacatggaagatttctgcaatgagatatccattcttaggcccccacgcttgtcaatggtgactgaatacatggagatgggatctttgttttacttgattcatgtgagcggtcaaaagaagaagcttagctggcggagaagactaaagatgttgcaggatatatgccgtggcctgatgcacatacatcgtatgaagattattcaccgtgatgtgaaaagtgcaaattgccttgtggacaagcattggatagtgaaaatatgtgattttggactttcaagaatagtaacagaatcccccacgagagattcctcgtcagctggaaccccagaatggatggctcctgaactaattcgaaatgaaccattcactgaaaagtgtgatatctttagctttggggtgataatatgggagctctgcaccttgaataggccttgggaaggcgtacctccggagagggtggtttataccgttgctaatgagggtgctcgattggatattcctgatggcccgctaggcaggctgatttcagagtgttgggcggaaccacatgaacggccaagttgtgaggagattctctctcgattggtggacatcgagtactcaatgtgttga

SEQ ID NO: 61713 - DNA, 924 bp, Glycine max
  Peptide Sequence Number=SeqID_178491
atggaagagacacgagaagatgccgggcaaccagagcgaaggccatccaacatgtcatggtggccttcagattttgttgacaaattcgaatctgtttctttgagcgctcaagatgaaaccttaaataataaagaatcacctagacattctaaccaggatgttatgtcacctcagaaggcgtcacaaatcctgtggcgcactggaatgctttcagaaccaatacccaatggtttttattcagtcattccggagaaaagactcaagaaactttttgatagtattcctactttggatgagcttcaagctatgggtggagaaggttttagggctgatgtcattgttgtggatgcagagaaagatagaaggttatctatgttgaagcaactaattgtggcattagttagaggattgaattcaaatccacctgcgatgattaagaagatagctggattagtttctgacttttataagcccccaaatgttgaaagtccagcaaaagctgcacttgaggaatcatgcaacatgtttgagaatcgtggtgtccagatgctggggcaaatcaggcacggttcatgctgtcctcgagctatcttatttaaagtattagcagatagtgtaggtcttgaaagtaggcttatgatgggttttccaaatgatggagctgctgaatgtgtagactcttacaagcatatgtcagtgatagttgtgttaaatactgtggaactgctggttgatcttatgcgttttcctggccaattattaccacgatcaaccaagtcaattcttatgacacatatttctgcagcaggagagagtgattctgcagaaaatgattcctgtgattcaccattagaaccaaatagtcctttatatggggtttcagagagttttctaaatcatgcaattaagtccttgttgaagtga

SEQ ID NO: 61714 - DNA, 282 bp, Glycine max
  Peptide Sequence Number=SeqID_178492
atgacactctcacttaggaaaactaggcagcaagtgtcgaggtcaccctgtcgtgcacagacaactcccctcccccatggtgatcaacctaagtctcaaggaagttccaaaccgagtgacatgcccccaagtacaacatgcacatcaataaaaaaaaatatgatgcaatcctaccctgcaagggcattcgatagaacactccaagaagattgggccaaagatgcaagagaaggccctggggttctcatgagccttagggtagatttcgggctcatgggctaa

SEQ ID NO: 61715 - DNA, 159 bp, Glycine max
  Peptide Sequence Number=SeqID_178493
atgtttgcttacagtcctttcgctaagcgcaagcctcacgctaagcgcatctttgttcatgcgctaagccacgagtctcaagcgcttagtgatcaacccttgcatctggggcttatttggtccgctaagctggccaaggataagctaagccaactttaa

SEQ ID NO: 61716 - DNA, 452 bp, Glycine max
  Peptide Sequence Number=SeqID_178494
atgaccactattacacagatatggatgacgttgctacttagcaacattctgcccagcgaccgtaatgccgatctccccctgcggaagggtcgcgcccacaagacacctagtggacccaaagaagtccaacaggtctctggggtttccagctctggttacgggcctctatcagacctacagggtgcctcgatcgcacctacaaagacacctagtagacccagagaagtccaacagggccctgggatttccagctctggttacgggcccctggatcgcgcccacaagacacccagtggacccggagaagtccaacagggtcctggggtttccagctctgattatgagcctctgcaggcagagggcgagacaccacaacagcctggggatggccagcaacaggcaacaaatgcaccgccgccacctccagagcccctcatctcattcacaaaaag

SEQ ID NO: 61717 - DNA, 882 bp, Glycine max
  Peptide Sequence Number=SeqID_178495
atggaacctaggaatgaagagttccagtctggatctcaatcagtaattcaggaccatatggatggcatgcatactatcagaagaccgcctgactatagcatgtcagattttaaaccagtacttaattattcaatacagacaggtgaggaatttgctcttgaattcatgcgtgatagggtgaatctcaggaagcccgtattttcaaacgttagtgattcccattccaattacgcaactggttgtatggaactgaaaggcgtcttaggaatcagtcaagcaccttctgaaagtgggtctgacatttctatgctttcgaaagccgagaaaggttcaacagagtttaacagacagagtacttcattacatggagacagaagcaattatgggtcaattagatcaataccaagaacttcattgaatcaggagaatagtcgatttgtacgtgggtatggctcttctgttggttctgacagctcatcaacaatgatgaagtgtctctgtagctttggtggaagaatattaccacgaccaagtgatggaaagctaaggtatgttggaggtcaaactcgtattattcgtctaagaaaggacatatcttggcaggagctcatgcagaaagcattaccaatctataatctggttcatgtactaaaatatcaacttcctggggaagatcttgatgctttggtatctgtatcctctgaagaggatttgcagaatatgatggaggaatgtaatcttctagaagatagagaacgctcacaaaagcttaggttgtttttgttctcattgagtgatttagaagatgctcagtttgctctcggtagcataggtggtgattctcagctcaaccccactaggtgtcagtttttcagcagatga

SEQ ID NO: 61718 - DNA, 153 bp, Glycine max
  Peptide Sequence Number=SeqID_178496
atgagtgcgactgacggaggcgacgatgtcgataagtcagggcttagaatcggacgcaagctaagcgatgaagaggacgacccatgcacgtggaactatttcgaaaatttgcaaaccctagcacgagattggatacgttttcaagtggagtaa

SEQ ID NO: 61719 - DNA, 282 bp, Glycine max
  Peptide Sequence Number=SeqID_178497
atggagtttttgggctccacatcaaagagacgtcattttgcaggaattgcactaagcgagttggtgttgctaagcaaattatttcctttagatggaattgcgcttaacgagttggtgtcgtgcaagaagcatgctaagcatgattccaacctgagagggaattgtgctgagtgcgaattgtcgcgcttagcgcaagaagaattgcactcagcgcgaattgttgtgctcaacgcaaattccaacccgagaggaattgcactaagtgtgaaaattcgtgcttag

SEQ ID NO: 61720 - DNA, 279 bp, Glycine max
  Peptide Sequence Number=SeqID_178498
atgcaacagggaaagacatacatcgccatagttaagatccatgaccccaattacggagaaaggattagaagtcaagattatctcagagaagctatgaaagaaaggattgagggcttgttctccaccgaatccttgaggttgattctaaggattccacttcgattaaaatgttcctctcaatgtggaggttcaacggcaaccaacggtggcccgtggtggctactggtggtcgtgggtgttggaggaggaatttctagggtggcttggacagagttttga

SEQ ID NO: 61721 - DNA, 402 bp, Glycine max
  Peptide Sequence Number=SeqID_178499
atgaaaaagaaggcattgtcgccttttgaagacattgtcgtcttcaaaaagcattgtcgccttctgaagacattgtcatcttcagaatatagcaaaaagggtgcggatgaccaatggtcttcgcatgccatcgaacttgattgtctctggatggcaaagataaaggcgaggactttgagtcctattaaagcaaggactttgagtcctatgaaaaaagaggactttaagtcctataaaggagaggactttgagtcctatgaaaaaagagtgaggactttgagtcctatgaaggcgaggactttgagtcctatgaaagcgagtttgattcctatgaaggcgaggactttgagtcctatgaaagcgagtttgattcctataaaggcgaggcctcagaataattaa

SEQ ID NO: 61722 - DNA, 579 bp, Glycine max
  Peptide Sequence Number=SeqID_178500
atgttaatctacgggcttgtaatgcagagggatatgaacttggggcccctcatgtcaggtcagatctctcttatagctcagcacgactcctcgaggctatgttttccagccttgataactgccttatgcaaggctcgaggagtctcatctgattctctgacctttgaatctctgagcccagccattaatttggctttattaaaaagaatcactggaacttggatggccctttgcaccagcatctccagttcttacaggttttcctgctcagagcttagagcattccttgtctatgctgcagagcctgcatctatagaagcaaagcttcatggtgaatcaagaatgataacaaaagatgatgacaaaaatctcaaaggtctatcaaagaatgagttcaagatattcaagatagaatcaagaacacttcaagattcaagaggaaagttgatttcaagaatcaagattcaagagatcaagatttcaagaattaagattcaagagatcaagattcaagattcaagaatcaagagcaggcttaatcaagataagtatgaaaaggttttcttaaaaattgagtag

SEQ ID NO: 61723 - DNA, 314 bp, Glycine max
  Peptide Sequence Number=SeqID_178501
agggaagcattgttgttgctattgttaaagaattttatgctaacctctatgaccttgaagaaaaatcacctaagcaggtgagggtgcgagggcacctaattaaatttgatgttgacgccctcaacaccttcttgaagacaccagtggtcatagaggaaggggagagcttgccctcctactccagttttgctaatctgaggcctgtttctcaaaagcttgcagcccatctatgtatccctgggaggggatttaagttgaatgcagacgggctacctttgaagatcttaaggaagaatctgactactttggcctag

SEQ ID NO: 61724 - DNA, 1500 bp, Glycine max
  Peptide Sequence Number=SeqID_178502
atgggtcatcgtcgaacctatattggtgctatgccagggaggatggtacaatgccttaagaatgtgggcacagccaaccctcttgttttgactgatgagattgacaaattgggcagaggacatgctggtgatccagcaagtgctttgttagagcttctggatccagagcagaatgctaattttctggatcactatcttgatgttaccattgatctatcaaagttgttcaggttaaggtttaggggtaatcatcttagtggaaatattccttcaggttcttttgcagcaattcctaatttgacatacttggagttggataacaatgacttgaccagatcaataccggttgaattggaatcttgcaggaaaatgacaatgttgaatttagctcagaatcacttgactggtgtgttgccatcactgcttggtaatattaccaatcttcaagtcttgaggcttcaaatgaacaagcttaatggagcaatcccaatcgaaattggccaacttcataagttgtcaatactgaatttgagctggaattctcagggtggatcaattccatttgagattacaaagttgagaaatattactttcctgaacttgcaaaccaataatctaagtggttccataccaacatccattgacaacttgaaatttctctttgaactccaactcagggaaaacaaactaagtggtgtgataccaagcatgccggggagtttgcaggtgtcattgaatcttagtagcaaccactttagtggtaatactcccaacaattttggtaatttggatagcctgcaagtcttggatctctcaaataacaaatttcctggtccaattcccaaccaactaactggaacgtcaactttgacacaattgttacatgccaacaatgcactgctgtctggtgaaattccaaaattcagtcaacatcttaaagttgtatcttctggaactggtctaataaataatacctcacctgaccatacaatagccaataggcccaacattgtctctaagaagggaatatctgttcatgtgacaattctcattgcaattgtaccagctagttttcttgttggcattgtaattcaactggttgtctcaagaaaaagttgttggcaacctcaattcatcgtaagtaatttattaactcctaatgcaattcacaaatcaagaattaactttggtaaagccatggaagttgttgctgatacatcaaatgttactttgaaaactaggtttcaaacgtattacattgccatcatgccctttggatcaatctattttatcaagaatctaaactgttctaacaagatattgccattgggaagtcatgataaatttggaaaagagctagaagtctttgcaaaattgaacaattcaaatgtcatgactcctttgtcctatgttctgtccattgatactgcatatatactatatgaatatatctcgaatggctccctctatgattttcttcatggaagcatgctagattag

SEQ ID NO: 61725 - DNA, 486 bp, Glycine max
  Peptide Sequence Number=SeqID_178503
atgtctcaccaattccctcttgtttgtaaaatttctcaacaaaacttgcttatctacatgaacctggctgcaagagaaactggagctctccaagctgccaaaaataagcttgaaaagcaagttgaagaccttacattgaggttgcagctggaaaaacggctgaggatcaacattgaagaatcaaaaacacaagaaaatgaaaaactgcaatctgctttgcaagcgatgcaacttcagtttaaagaaaccaagttgttagttcaaaaggagcgtgaggctgcaaaaagagaagctgagagagcgcctgtcatacaggaggttcctgttgttgaccatgctttgttggagaagctcactagtgaaaatgagaaactcaagaccttggtgagttcattggaaaagaaaattgatgaaacagaaaaaagatatgaagaggcaaacaaaattagtgaagaaaggttgaagcaggctttggatgctgaataa

SEQ ID NO: 61726 - DNA, 736 bp, Glycine max
  Peptide Sequence Number=SeqID_178504
atgtactggagggctctgagactcggtgtgtgttatccttcagcttcctactccttttatagacctaagcatataggtgattttacttatccaaggcttgcagattttggtgctgcaatatccggggcaaataaattgcaatgccaacaagttctcgaagagctagatgtgtataagcgattaaaacttacactggagttggtaaagaaagagatggaaataagcaagattcaggaatcaattgctaaagcaattgaagaaaagataagtggtgagcagcgtcgttacttgttaaatgagcagcttaaggccataaagaaggaactgggactggagactgatgacaaaacagctcttactggtaaattcagggaaaggattgagccaaagagagaaaaatgcccacctcatattttacaagttatagatgaagaacttgcaaagctacagctgttggaggctagttccagtgaattcagtgttacccgtaactacttagactggttgactgcactgccttggggtgaatacagtgatgagaactttgatgttactcgggcgcaaaagattcttgatgaagaccattatggattaactgatgtgaaggaaaggatactggaattcatagctgttgggaaattaagagggacttcacaagggaaaattatctgtctttctggtccacctggagtgggcaaaacaagtattggtcgttcaattgcacgtgccttgaacc

SEQ ID NO: 61727 - DNA, 123 bp, Glycine max
  Peptide Sequence Number=SeqID_178505
atgatttatgtgatggttattcatcagaagtataggatttcctatgatgaaatcattaatgatttatgcccattagtcctcaggatggttggaaggatattaggagatttagggcctgtttag

SEQ ID NO: 61728 - DNA, 336 bp, Glycine max
  Peptide Sequence Number=SeqID_178506
atggaaacaatgctgctcaagtactatcacatagtgaagtctcttatcaacaatttcaaatgttttgaaatgtactacatccctagggaaaataatacccgagcggacctactctccaagctggtcagcaccaagaaggtcgggcacctcaggatcatcatccaggagatactccaaactccacccatagatgctgaggaaattatggttggagaagaggggaaacaaaactggatgaccccctacaagaacatcataatttggagggtcttgccgccaaacaaggatgaagctcgacgcctcaaacggaaggccagctactactcaaatgcataa

SEQ ID NO: 61729 - DNA, 298 bp, Glycine max
  Peptide Sequence Number=SeqID_178507
gtgggcaactggggatggtgtgcttatgcctgggcttgtggaaatgagatgtttgttttgcaccatcgcccgatcaccacctagtaccacatatgacggagtggtacctggggatatgtcgcgggggtcaggagaccttggggacgccaggtggggtgctattgcccaaaaccaagcttggccaatcccgacccaacccaggcatagtcagtcagtgagaacctgtgacgtacctaagcaggcgagctccaggcagtcgaccaataaaagaacaaaagtccacgaagcaaagaggctt

SEQ ID NO: 61730 - DNA, 199 bp, Glycine max
  Peptide Sequence Number=SeqID_178508
cgagaattcgctaagcgcaaccttcagcggctaagcgcgaggaagaatccagaagaagatgagctgtcaagttcgctaagcgcaccgctccagatctgcgctaagcacacgagcatgaacaaggccacctatttaagcctgaaatcagatttgcaaagggagtttgacacttttcttgagaagctctacatgcacgaag

SEQ ID NO: 61731 - DNA, 225 bp, Glycine max
  Peptide Sequence Number=SeqID_178509
atggttattttcctaatctatatcactatcattccaatcaattgcacgcctgatgacaacctcctagatcttctcagcacgcctatagtagaaggagagctcgtctccatggctaaaatcaccttcttgaaggaatttgtaccaagggagagtgacatacttatcaccgatgcctttgtcgagcacaactacattccattgcagggggaggtccgaatcttctga

SEQ ID NO: 61732 - DNA, 1152 bp, Glycine max
  Peptide Sequence Number=SeqID_178510
atgccctggactgagactgttaccatgcaacgccttgaattcatcctcgcctgccaggcaggcggggaatccatgacgcagctgtgtcaccgccacggcatcagccgcaaaaccggctacaagtggctcagccgctttaaccccggcgagctctcctcgcttgaaaatctctcccgcgcccgccatctccagcccgataaaatcgcccccgacatcgccgtgcgccttgttcagttccgccagcagcaccccgactgggggccaaaaaaaatccgccactggttcctcagcaacggcgctgacttcatcgtgcccgccgccagcaccatcggcgacctgctgaaggcggcgggaatggttcagccgcggacgccgcgtaagcgaacgccgggcaacctgcgcagtctcacgacgcccgtgaggaataaccacgtctggagcgctgattttaaagggcgcttccgcctgaaagacggcagctggtgccgccccttcacgctcaccgataaccacagccgctacctgctgtcctgcgagccgggcacgtcggagaccacggtgttcgtgcgcggctgcatggaaaaggccttcctggaaggcgggctgcccgacgttatccgcaccgacaacggctcgcccttcgttgcgccgggcatcctcgctctgacgcagctgagcgtgtggctgataaaactggggatacagccggaaagaaccgcgccgggctgtccggggcagaacgcccgccacgagcggatgcaccggtcgctgaaggtcgccatgagccatcacgacgtctttggctcgctgccggagcagcaggcgtggtgccgcggatggcggaacgagttcaatcaggaaaagccgcatgaggcgcacgggcagcagccgcccgcaaaaatatggacgccttcaccgcggagatgggacggaaaagtgccggaggtgggctatccggagggggcgaagctgtacaaagtcggcaaaaaaggcgacctgaggctgaacgggcgaaccttcctgagcgcagctttacggggcgagtacgtgcggttcctggaagtggacgacggcattgacgtcatcctcttcgacaggctcatccttgcgtattatgaccgggcagaaaagcgtattatccggatcgactga

SEQ ID NO: 61733 - DNA, 439 bp, Glycine max
  Peptide Sequence Number=SeqID_178511
atccgacaatgagtcttgtgaaggtaatgatgctgaggacacagatgtcaattttgagcaactgataaatcaagcggaggaaggggaagatgaggattgggggcttcccccagagctaaaaagaacggtcgaacaggaagatagggaagtgaagccacaccaaaaagaaacaaaaatcataaacttaggtgttggcgaagaaaggaaagaggtcaaggttggcgcgggcatgtccacacgtatccgagatgaattggtagctctgctgcaagactaccaagacatctttgcttggtcataccaagatatgcccggcttgagtcccaacatcgtgcaacatagattacctctgaatcccaagtgttccctggtaaagcaaaagctacagaggataaagcccgagatgtccttgaaaataaaagaagaggtgaaaaagtag

SEQ ID NO: 61734 - DNA, 969 bp, Glycine max
  Peptide Sequence Number=SeqID_178512
atgcctgcgttaccgcacgggaatcatcaattcggtagtggcaatggattctggtcgaagaatcgtgacgatgttggatacaatcagctccacaagctgtcaccgcaagctcggcaggagctcttgagaatagacaagcaaaccctttttgagcatgcacgaaaaaatatgtactgctccaggtgcaatgggttacttcttgaaggctttttgcagattgttacgtatgggaaatctttgcagcaagagggagcgggtgttcactttccttgcagcaaacctggaagtttgaaaaatcaaaataatggtggatcatccatatgtaatatggtccaggatgaaatgcaagatccaactgtccatccttggggtggtttgaccacaacgcgcgagggttcattgacacttttggactgctacttgtattcaaagtctctgaaaggactgcaaattgtatttgatggagcacgtgcaagggagcgggaaagagaattgctttatcctgatgcctgtggtgggggaggccgtggttggataagccaaggaattgtgagttatggtagagggcatgggacaagggaaacctgtgccttgcacactgccagactttcatgtgatacgctggtggatttttggtcggcactgggagacgagacaaggcaatctcttctaaggatgaaggaagaagattttattgagagactcatgtacagaaatgttattcgagaattcaaggaactaaaagaactgaagcgcatgagaagagaaccttgttgcaccagctggttttgtgttgctgatactgcctttcagtatgaggtatccgatgactcgattcaagctgattggcgccaaacgtttgcggatactgtgggattgtatgatcactttgagtgggctgtgggaacaactgaaggaaaatctgacattttggaatttgaaaatgttggaatgaatggatgtgtacaa

SEQ ID NO: 61735 - DNA, 930 bp, Glycine max
  Peptide Sequence Number=SeqID_178513
atgacgccttcgtcacgccgctgccggggcgggcgcaggtcgctttatggggggagggacgatgagccgccaactgatgatcgcagaggttttgagccagccgcaggcggtgagctggctgccgtgggccgtgcaatatttcttctttattggcattgccgcctgcgccgcgttgctggcctgcgtgtggcgctggcgcggtggagacaacgccgcacatttggagcgcgcggcgctgtttatcgggctgacgtgcgccatcaccgcgccgctggcgttgaccgccgatctgcatcaaaccgcccgtttctggcatttttacgcctacccgacgccctggtcgtggatgccgtggggcgcgctgttcttgccgctgtttaccttgctgatcggcctgtgaccggttgcgctgctgcgtgggatcgcgcccgcctgcgcgctggtggctatcggcctgctgttgtacaccgggcgcgaggtttccgtcgtgcgcgcgcgcccaatctggttcagctacgcatttccgatcgtgatgttcctcagcgcgctgcaggcgctcttggctctgttgctgttggcgatgcgcaaacggcccggcctgcaggcgccgctggcgcgcgggatgctgctgacgctgctgccgctcggcggggcgatcctgctgtgggtatgcggcgatacgctaaccggcgcggcggtacgccactggctgcagacgcaggcgacggcgcgtcagtatgctgccggctggatcgcgctgtgggggttggcgctggcgtgcgccgcctgggcggcctatcgacgtttgccgcgcggcggcgcaccgctgctggtggccggcgcgctggggctgagctggctgatgcgctggacgctgttgatcgaagtgcaaaccatcccgaaatacaacgcgtcttattccccctatag

SEQ ID NO: 61736 - DNA, 1413 bp, Glycine max
  Peptide Sequence Number=SeqID_178514
atggaagaaccaaaggcagagtcatctcagggaactattccagcagggatttgcctcaatcaaagaaagtttgggagcctatggagtcacacaagtcatggatttcagttcaatacagtaaggttttctgttgatgaagttggcggttcaggtgaaattgatgagggtgatagtaatttgaaaagaagcggaatgggtgaaggctgtcagaatgatcttgatgcagaagttggaggatcttgcagctccacagaaattgcatctgaggctggaatgtgtgtgatgggtggctctgcattgaataattcttctgatcccaatcaaggtaacacttctagttctgataactgctcatcatgcctaagtgagggtgataataatacaacctcttcaaaccgtgaaaatacagaatcctcaacatcggattcagaagatactagtcaacaatctgaagtgagagatagttcaacctgcattgacaatggattatctggctctcatggagctgagatgaagaaaatccataatgcaaatgatgaaggtttgactagcaggtcaccatttggtccatccttggatgtggcaagaggggatgtatccgggaatcctgtggtgaaaattgcacataagtttgataatggtttttcctccattagtatgtgttctcaacctcaaagcatgcttcctccagtgccaaaccaaaatattcaatttccagtgtttcggacttcttcagcaatgggttattaccatcaaaatccagtttcattgccagctgctcccacaaatgggttgatgcctttcccacacacaaacccctacttatatgctggcccttttggatatagcttaaacgaggatccacgcttctgcttgcagtatggtggcttacagcaaccaacacccctatttaacccagttgcatttccagtttatcagccaatcgccagagctaaaggcttaaatacagaggaatcgactctaatgtccaagccaacatctatgctgccagagcatcttaatagatcttcagtagaaaaggtttctctaaccggagctaattcgcaaaaagcagcattgaatggggaagttggacatggtaattctgcaaagtcaaaagacagtggtttttccctgtttcattttggtggccctgtagacctttcaactggtcataaatcggcaactgcatcttcaaatggcgacaatgttggagattttaacttaaagagttcagtagatcaagttgacgatgatcatgaatgcaataaaaaagaggctactgtcattgaggagtacaacttgtttgcggcaaagaaagattgcgagtgcagttatcttgaagggtttttttccccttgtttacttcatgttatccctaatgtgcatgtctcccttgaccttgcaatatga

SEQ ID NO: 61737 - DNA, 1047 bp, Glycine max
  Peptide Sequence Number=SeqID_178515
atgagtgaaatagaggaggcacaagagcggatgaaggtcaacatggaggccatgaaagagcaaatggccacaatgatggaggccataatgagcatgaagaagatgatggaggtcaatgtgcctgtagttgccacaactagcgctgttactgaggtggacccgactcccccatctggcctcaatcaaataagtcatcccatctcggatatgaataagcatgccttctcgccatatggcttgcctcccaattatacaccacccaatatggtgcacactcccaatgagaatgtcaataactccactcccatactcattgagagccaacaacctcaatctgatgatgcacatgtctctcaacccatgagggaggcacatgaaataccccaccataatctagtcgactttgagccttgcctcggatacgccactaagggacaagcagttggtggtgtacccctgccaaacacttttgagggccctcagctaagggccattgaaagagatggagattatgcctttgctgacatggaagatttgtgcctagtacccgacgtggtcattcctccgaagttcaaggtaccggacttcgatcaatacaaggggacaacctgccccaataatcacctaaaggtgtactgcaggaaaatgggagcatatgtgaaagatgaaaaattattgatgcatttcttccaagaaagtcttactggggaagctgtcacctggatgcaactacagaacatgtgcaaaaaggagcatgaatccttcaaggaatatgcccaaaggtggaggaacctggcagctcaagtagcacccccaatgacggagaaggagatgatagcaatgatagtagacacattaccagtgatcgaagtgggtctgataagaggcaaatttgatcatcctgctttgacaaataaaaagcctggggaaaatagagaggacaagaaggaggaaggaacccatgctatgattgtcgttcctacatggccaaatttcccaccaactcaacaatgtcattactcagccaatatcagcccttctcattaa

SEQ ID NO: 61738 - DNA, 315 bp, Glycine max
  Peptide Sequence Number=SeqID_178516
atgtcataccctaatttcgtccggggaccattgtttggtggcatgcaaccttcgcttgaccgcctcaagggggttccaacagaaggcggtgccttctggtggaagtacccagctcgcctggacctttccatgagcgatttcgtgaagattcttcaccgttcttcgtccgttcttcgttgttcttcaaccggatcttcttcatcaatggattcctttgcttcttggaagataaatggcagcggaaatgagaaggaagagagagaggagacgccacttcaaggagaagatgagtctagaagaagctcaccaccatag

SEQ ID NO: 61739 - DNA, 208 bp, Glycine max
  Peptide Sequence Number=SeqID_178517
atggcatgttcgaaggagcaaaaggttgcttttggcacatatacactagtagaagaagctaagtattggtgggagaacactcgccaatacctggaggctaaaggtcaagctctaatctgggagaacttcaagagggtatttctggagaaatatttccctgaagatgttaggaacaagaagaaaatggaattcctagagcccataagtg

SEQ ID NO: 61740 - DNA, 204 bp, Glycine max
  Peptide Sequence Number=SeqID_178518
atgacaaaaggtgcagaagacgacgttagtctctgcgtgctatcaggcgttgagtcttacagacagcaaaagcgtgcggatgaccatgatttgtctccgcgtgctatcaggcctgattgtctttggatagtgcaaaaagggcgtgggaccataaggttcccccgcatgtcatcggacccgccgtctctggatgacaaaaggtga

SEQ ID NO: 61741 - DNA, 402 bp, Glycine max
  Peptide Sequence Number=SeqID_178519
atgccaagttcattgcgaaggtggaagaacctatcccttgctaaaggtttagtgaagatatcagccagttataagtctgtatcaacaaactatatcacaatcacccttgtgaatatgaaccctaatgaaatgatgccatgtcctaataagtcacaagtgccacttgtactcttcctatccagtttgcatctagcaaagttagaatctgagtatcccactagagatatctcgacacctttagggaaccacaagtcgacatctaaggactcacccttgcaaccaccatttcagggggaggtcatggagcatccacggaggatgctcactgttggaccttgtggcctcaataatcttaagagggataggcttagaatgcagaagaagcaacaacaatcaatttag

SEQ ID NO: 61742 - DNA, 765 bp, Glycine max
  Peptide Sequence Number=SeqID_178520
atggcagagaagaagaacaagaggataaagagcattgggcatagacccacaaccccaaaaatgaagaaggagaaggaactaacaaagggcgttccttcagtcaaaggaaaatgggtgcacgttctccttcacctcctactacaccaaagtttggcgtggctaagaaataaaggctttgcttttcccaagttgattgagtatcacgagttgaagaagctggtggagatgaagggcacctactacacagacttggtaaaagttttctataccacaactcatattgatcgtgatattgggttcttgtgtgctgaagtgaaagggcaacaaattgtgatgacactagaggtttggtttgacattgttgggttatcatcgaaaggagttatggtcaacaagtacaagtctatgatgaagaatccttctacctatgttgatgttgttacaaaagcaaagggaaatgagtgttttggtactggactgttgatgcctaagcacaagcttttggcctatgtggttgcttggattattactccaagggggagaagtcatgctcagttgaaactaaagatcaattgggaagtctttggtttttttgaggcaaaatttgaagtaaagaccaaagtcttgaagcaaatggggtacataaagtctgaagaagttgggatttggtggattgagaagagaagagaacatcagatagaacaaaaagaagctgaagagaagaccatgagccttttatgcaattctaatctccaggattcgtga

SEQ ID NO: 61743 - DNA, 378 bp, Glycine max
  Peptide Sequence Number=SeqID_178521
atggacataacttttcacacggatgtccgattcaggcgcataatacatcgagatgctctaaatggaacaacggaagctatcaagaaattcaaatggtcaaaacttttcactcggatgtcctattcaggcgcatcacatatcgagacactcgaaatagaacaacggaagctctcgagatattcaaatggtcataacttttcacacggaggtgcgattcaggcgcataatatatcgagacgctcgaaattgaacaacgaaagctctcaagaaattcaaatggtcgaaactattcactcggatgttccgattcagcgcatcacatatagagacgctcgaaatagaacaatggaagctctcgacatattccaatggtcataa

SEQ ID NO: 61744 - DNA, 510 bp, Glycine max
  Peptide Sequence Number=SeqID_178522
atggctaggcttccctctattgatccaaatacaagtactgttttgatctatggatatcctaatgttggtgagagcttgttcattaacaagattatgagagctaatgtggatgtgcagccctatgctttcactaccaagtctctctttgtgggtcatattgattataaatacctgaggtaccaagtaattgatagggattttggacaggcctttgaagattttaatattattgagatgtgcagtatcacggctctagcacatttgagagctgcaatgttgtttatcttggacgtatctggatcttatggttatagtattgctcagcaggtagcgctatttcacagcattaagtctttgtttatgaacaagtcgttgattatagtatgcaacaagactaacttgcagccactggaggggataccaaaggaagtgatcggaatggagaaggaagagagagaggagacaccacttcaaggagaagatgaatctagaagaagctcaccagcatag

SEQ ID NO: 61745 - DNA, 225 bp, Glycine max
  Peptide Sequence Number=SeqID_178523
atggaagaaaagaataagagaataatgagagagaagagagaatttcctaaggaagagttctcaggctttggtggacttgggcttgcgtacttgcacttagcacgctctgctcgcttagcgcaggtgcctgttttcgtgtgtagtgcgctctgctcgcttaacgcaagtaccagttttcgcgctcagcgcgcgctgcgcgctgagcccgtcttgggttgggcctga

SEQ ID NO: 61746 - DNA, 168 bp, Glycine max
  Peptide Sequence Number=SeqID_178524
atgaagaagtccaaaggtgcacttaacgcgaaagctcacactaagtgcgaaagtcagtgtgaaaagtggaaatctcccgcagttcctcctccatccctcccaaagaagtcgagtagctcactcaacaaatcagggatcagttggaggagtcgatcacagaaaaagtga

SEQ ID NO: 61747 - DNA, 132 bp, Glycine max
  Peptide Sequence Number=SeqID_178525
aagttgaagaaggcagagaccttaatatgggtggactttgtggagtgtcctaaggttgaagtagtctatggttcaagttggaaaagtggagaccttaaaatggaggaccttgacatagacttgatggagtag

SEQ ID NO: 61748 - DNA, 537 bp, Glycine max
  Peptide Sequence Number=SeqID_178526
atggcaccaaattttcatttaagcagttctatagggttgccttgcagagagagtgtgtgcatcccaagtgagcgtgagacacttatgaagtttaagaataatctgaatgatccttcaaataggctttggtcttggaatcataataataccaactgttgccactggtatggagtcctctgccacaaccttacttcccatcttcttcagcttcacctcaacacttcacgttctgctttcgagtatgactactataatggattctaccgtagattcgatgaggaagcttatcggagatggagctttggtggagagataagtccttgtttggctgatttaaagcatttgaattacttggacttgagcggcaatagatttcttggagaaggtatgtcaattccttctttccttgggacaatgacttccttgactcacctcaacctctctcatactggattcatggggaagattcctcctcagatcgggaatctctcaaatttggtgtatcttgacctgagttctggttctgccaacggaaca

SEQ ID NO: 61749 - DNA, 3040 bp, Glycine max
  Peptide Sequence Number=SeqID_178527
tgagcgtgagacacttatgaagtttaagaataatctcatagatccttccaataggctttggtcttggaatcataataataccaactgttgccactggtatggagtcctctgccacaaccttacttcccatcttcttcagcttcacctccacacttcaccttctgttttctatcattactatgatggcaactatcacttcgattgggaagcttataggagatggagctttggtggagagataagtccttgtttggctgatttaaagcatttgaattacttggacttgagcggcaatagatttcttggagaaggtatgtcaattccttcttttcttgggacaatgacttccttgactcacctcaacctctctcatactggattccgtgggaagattcctcctcagattgggaatctctcaaatttggtgtatcttgacctgagttatgtttttgccaacggaacagtaccctctcagatcgggaatctctctaagcttcgatatcttgacttgagcgacaatgattttgaaggtatggcaattccttctttcctttgtgcaatgacctccttgactcacctcgacctctcttctggattcatggggaagattccatctcagattgggaatctctccaacttgatctatcttgaccttggaggtaattatctgttagctgaaaatgtagaatgggtatcaagtatgtggaagcttgaatatcttgatttgagttatgcaaacctatccttgctcaacttcaccgtaactctccaacctcttccttctttgacccacctatatttgtcagactgcacactccctcactataatgaaccatccttgctcaacttctcatctctgcaaactctccatctttccttcactagttattcccctgccatttcttttgtccccaagtggatattcaaattgaagaaacttgtttctcttcaattacagggtaatgaaatccaaggtccgattcctggtggtattcgaaacctcacacttcttcaaaatcttgacttgtctttcaattcattctcatcttctatacctgattgcttatatggtcttcatcgtctcaagttcctcaacctaggggacaacaacttccatgggactatttctgatgccctgggaaatttgacttctcttgttgaacttgatttgtcatataatcaacttgaaggaaccattcctacttctttgggtaatctctgcaacttaagggtgatacgtttatcatatctcaaactcaaccaacagtcttggatcactcttgatagctcagggaatagcacagcaagtcaagaggaggatgctacagtagcaacaacaggggtacacaaagcaaacaatgaggtgcaaatagagagcagaactaaaaggaagattgtgaggcccacgagctggtaccctcgaaaccagtattctaaattctgcacttatcaactctctaaattgtcatctcttcatattgatggcaatctttttcacggagttgtcaaggaagatgatcttgcaaatcttacaagcttgacggagtttggtgcatcggggaacaatttcactttaaaagtgggtcccaattggattcctaattttcaacttacctatttggaagtgacatcatggcagttaggtcccagctttccattgtggattcagtcacaaaaccaacttcattatgttggactatctaacacggggattttcgattctattcccacacagatgtgggaagcactttctcaggttttgtatttaaacctctctcgtaatcatatccatggtgagattgggactacattaaagaatccaatatctatcccaactattgatctaagctcaaatcacttgtgtggtaaattaccctatctttcaagtggtgtgtttcggttagatctttcaagcaattcattctttgaatccatgaatgattttttatgtaacgatcaggaacagccaacgcatttagaatttctgaatcttgcatcaaataatttgtcaggagagatacctgattgctggatgaattggacatttcttgtggatgtaaatttacaaagcaaccattttgttgggaacttaccccaatccatgggttccttggcagacctgcagtctttacaaattcgtaacaacacactctcaggaatatttccatccagtttgaagaagaataaccaattgatatccttggaccttggggaaaataatctttcaggaagtattccaacatgggttggagaaaagctcttaaatgtgaaaatcctccgccttcgatcaaacagatttggcagccacattccaaatgaaatatgtcagatgagtcatcttcaggttttagaccttgcacaaaacaatctgtctggcaatataccgagctgtttcagtaacttgagtgccatgacactaatgaaccaaagtacagatcctcgtatctattctatagcacgatatggtaggtcttactcttccatgcaaagtatagttagtgtgctactatggctgaaaggaagaggagatgagtacaaaaacattctgggtttgggaaatatcccaacaggaactcaattgcaaacctttgatgcctccagcttcatcggcaacaatctatgtggtccaccactgcccataaactgcagctccaatgggaaaacccatagttatgaaggaagtgatgggcatggagtgaattggttttttgtcagtatgacaattggatttattgtgggattctggatagtgattgctcctttgctgatttgtagatcatggcggagttggggctcattggattttgccgcgatggtggcagaggagatcacatttgttggattttatgacgaggttgcgtgccctatggttcaagttgaagaacaagtggggggacattcacatgaaattggtggagtgacctatgggatatgtatcaagttgaagaagtcagggaccttaatatggctggactatgtggagtgtcctaaggttcaagatgaaaaaatggaggaccttgacatggacttcatggagtag

SEQ ID NO: 61750 - DNA, 1005 bp, Glycine max
  Peptide Sequence Number=SeqID_178528
atgggatctcttcttcatcttcaagcattgctattgagaaacaacaacttaacagatgagatacctttctccttgaggagttgcacaaatctagtaatgctagatatttcagaaaacagattatcagggcttatcccttcttggattgggagcgaattacaagagttgcaatttttaagtttgggaagaaataatttccatggaagtttaccattgcaaatttgctacctaagtgacattcaactcttggatgtgtcactaaacagcatgtctgggcaaattcctaaatgcataaaaaattttacttcaatgactcaaaagacatcttcaagagattatcaaggtcattcatatcttgtcaataccatgggcatttctcttaattctacatatgatttgaatgcactcttgatgtggaaaggttcagaacaaatgttcaaaaataatgtgttactacttttaaaaagcattgatctctcaagcaatcacttttctggagaaattccactggaaatagaggatttatttggattggttttattgaatttatcaagaaaccatttgaccggaaagattccttcaaatattggaaagctaacatcacttgaatatcttgatttgtcaagaaaccagtttgttggttcaattcctccgagtcttactcaaatttattggctcagcgtgttagatttgtcacataaccatctaactggaaaaattccaaccagcacacagttacagagtttcaatgcctcgagttatgaagataatcttgatctttgtggaccgccacttgagaaattttgtattgatgagagaccaacacaaaaacccaatgttgaagttcaagaggatgaatattcacttttgagtcgtgaattttacatgagtatgacatttggatttgttataagcttttgggtggtgtttggctcaatcttattcaagcgttcttggagacatgcctatttcaagttcttgaacaatctatcaaacaatatttat

SEQ ID NO: 61751 - DNA, 804 bp, Glycine max
  Peptide Sequence Number=SeqID_178529
atgaagagaatcaaaactattagtcatgccatatttgtgatgttcatactctctctaagtgcaacatgtggacaagaagacctcgatattttaactcctatggagaaagtagagctggaagctctatactccaccattgaaagctttcttggtgattcctggaatagctcagatctctatccagatccttgtggttggactccaattcagggggtctcttgtgatctatttgatggattttggtatgtaactaccttgaacattggaccagtccatgataattctctgagttgtgctcaagatttggaatttagaccacatttatttaagcttaagcacctaaaatctctatcctttttcaattgctttccatcacaagacatgtttccagaaataccatcaagcattggcaatgtcatcaagttgaagaagcttgttcttgttggaaactatcttactagtaggattccagatgtttttgataggctaaatgagttattaatctttgacttatgtagcaattcattatctggctctttgcctttgacacttgggagcttaacttcagcattgaagcttgatgtcaacaacaaccaccttatggaccttatgaataatagccgcaacaacctcacagggaacctgtcactaaagctggaaactctgccttatctcaatgcactttaccttagtggaaacaatctcataaggcagagcttagcttctctaaagacttttttggaaaaatgggaaggcgttttggggattggaacaacccaaaactttgccaacaaattggactaa

SEQ ID NO: 61752 - DNA, 216 bp, Glycine max
  Peptide Sequence Number=SeqID_178530
atggaacatgcagggattgcatgtgtgatgaaggatggaaagttacaatttggtaaattgcaagatgaaggcatagatcattggaaagatctaaaggtatcgatcatcatgaggataggggagatgtgcctgatggatcacatgcatgatatggatgatgctaacttggatgacttagaggagacagaggcaaatcatggtaaggacttcctttga

SEQ ID NO: 61753 - DNA, 246 bp, Glycine max
  Peptide Sequence Number=SeqID_178531
atgaagggtctttggtccaaagctagaagatttcctcaactccaacaacaactctcgctacaggagaatccagcacacctcaaaccaaccaagaatttagattcaaaaccaaaaactaagcttttcccatgggatctccacgggtgctttagagaagaaaaggaagagaataaagaacaaacgaggaagagagtgaacttaccactctataggacaacaaaggaacacccaaataaggagaaataa

SEQ ID NO: 61754 - DNA, 498 bp, Glycine max
  Peptide Sequence Number=SeqID_178532
aaactctcttatcgatgaagaacacagtgtcattgtcgccgaacgtgaaccactgcacgtccgtctcattgcgatccatggcacgcggatcgcggaccacagcccgccgcggaacgaatgtgagggggtgggtggtggcgggggagtaccagaggttgatgtaggggagatggcggggccaagaggtggaggaggaggccacggagaagaggaggtggcagatgaaggcagagtagatgaggccgggaactacgaacgcgaggcatacaaaggtgaggtattttcacgccgggaactacgaggtacaaagcttatcagtagagagcatgagttcaatagctacgggatgaattacgaaaatgccaaccacgaacattctaagacggttattaacgaccgtcttagtatatacgtcgtagaaagcaaatttccgcaacttaattacaagtttgccaccgcttcacattctaagacggtcgcagataaccgtcttaaaat

SEQ ID NO: 61755 - DNA, 2354 bp, Glycine max
  Peptide Sequence Number=SeqID_178533
atgagcagcgctaaaagcgtgatgctgggcaacctggagtacgatgtggcgaccagtgtggcaatcctcgatcgtctgccggcggacgagcgtccgggctggctggcgaagctggcgcgcggcaactatcgctacagtctgtcgccgggcgaagcggggccgtatccctccggctggcgcacgcgcgacgcggtgcatctgacgctgcatgacggcgcgccgctcacgctcgatctctggccgcgcatgccggcgattgcgcgctggctgccgctggtgctgatggggcagctgctgctgttgctgtgctgcgcgtggctggcggtgcggcaggtggtgcgaccgtttgtgcgctttacccacgcggtggatgcgctcaaaccggccgccagccacgcacagctgatggcagagaacggcccggatgaagtgcagcaggcggcgcgtgcgtttaacgctatgcagctgcggattcaggatcacctcaaagcgcgtgcgcaaatcctcgcggccatctcccacgatctgcaaaccccgatcacgcgcatgaagctgcgtgtggagatggcggagcagcctgagctgcgcgacaaactgctgagtgatctcgataacatgagccgcctggtgcgcgagggcatcgcctatgcacgctcatcggaagtgctggaggagaagcgccagagcgtcagcctcaacgcgctgctggatagcgtcgtctgtgactatcaggatgtcggtaaagcggtgaactttgtgccgtgcaccggccatgacaccttcgccgtgcggccgcaggcactacggcgcatcatgaccaacctgatcgacaatgcgcttaagtttggcggcgaagcggaggttgaactttgttcgccccagggtgacagcgtagagattcgggtgcgtgataacgggactggcatcccggaggaggcgttacaggcggtgctggagcccttctaccgcgtggagagttcacgcaatcgccacaccggcgggaccggactcggcctggcgatcgccacccagctggtgagccagatggcgggcagcctgcagttgcgtaaccgggcagctggcgggctggaagcgtgcatcatcctgcagcagcaggatgtacgtactgccggacgcgcagacgtttatccaccgtatgaggttccctatgacactgcttatcgcttttctcgccgggatgctgacgctgctcagcccctgtaccttaccgattattccttttgtatttgccagcgtacgcggccgtcgcggacagctgctggcgctgctgagcggcatggtcctgatgttcacgctggtggcgctgctggtatcgcttaccagccactgggtcagtcaggtcaccagcattggtcgcgacctggcgctgttgttcctggcgatagccgcactgacgttaatctcgacgcgcatcgcccaatgcgttatccggcccggggtgctcgccgcgctgctggcgggcctggcaaccggtctgctgtggtcgccctgtgccggaccggtgctgggcgcgatcctcagcctggccgtcgtgggcgatcatccccggtcggttggcgtgttgctgctggcgtatggcagcggtgccgcgctgatgctggcgctgctctatttcgccggacgatcgctggtggcgcgactgcgtccggggctggcgatgagtgcgcggctgcgtcaggcggcgggcgtgctgatgctcgcctcggtgggcgtgattgttaccggctcacagagccagctgcaggcagcgcccgcttttgccctgaagctggagcagcagctgagccagtggctgaccacgccggcacccaaagtgcgcctggagccgcgtggctgaacggggcgccggtgacgcctgccacgttaaagggcaaagtggtactggtcgatttctggacctgggattgcattaattgccagcatacgctgccatacgtgcgcgactgggccagtaagtatcaacgtgacgggctggttgtcgtgggtgtgcacacgccggagtacccgtgggagcgcgatgaaaaggcgctgaagcgcgcaattacgcgctggcagctgccctacaccgtagtggcggataaccattacagcatctggaaccgttttggtaatcagtactggcccgcgcactacatctttgatgcacatggccagctgcgctacaccgcgtttggtgaaggcaactatgaagagcaggagagggtctggcggcccgcccgggccgccactgcttctcatttaggttgtgattcgcgggggatgcctttgaaagctggggtgactcagggactatcaggcaaacagcgtgcggcattgcctggacctcccagccc

SEQ ID NO: 61756 - DNA, 678 bp, Glycine max
  Peptide Sequence Number=SeqID_178534
atgggttactcgccctcacctttagaggactgcacgccctcgcctttagagggttgcacgccctcaccttcaaaggtagtttcccttgttcacccccctgatctcggaggagggccaactgtgcaagcacaaccagaggaggaggctatcgcgcagctactatgcataccggggcaagatttcacccatgccgctacaaagagacgagtgcggatcatgcacaccaacatgaccactcttacacagatatggatgacgttgctacttagcaacattctgcccaataaccataatgccgatcttcccctacagaaggatcgcgcccacaagacacccagtggaccaggaggagtccaacagggccctggggtttccagctctggttatcggcctctgtcagtcctacagagtgcccgtccccccccagcaaggtcacgccatcatcacatagggatcacgcccgcaagacacccagtgggcccgaagaagtccaacagcgtcatggggtttccaactctgattacaagcctctgtcaattctacggagtgcccatctcccctggcaaggtcatcaggccccctattaaccggactttcatcgagaagtattgtgccccaggcaggcgtagggcgaggcatcacagtagtgggcaacaggcacaccaccaccacttctag

SEQ ID NO: 61757 - DNA, 1863 bp, Glycine max
  Peptide Sequence Number=SeqID_178535
atgggtgtagagatgatggcagtcaactggcagacaatagataaggttgtatacatcaacctgaacaaacgcaaggatcgcagggtacgtatcgctcgtcaattaaaagcaattggcgtaccacgtgaaaagattgtccgctttgaggctattgaagaaacgccaggctatatcggctgtattaaatcacatattctcgtgctgcaaatggctcagcaaaacggctggaaaaatgtattgattctggaagacgatatggttttccatgatgatattcagaccaaacagcgaattgatctatttctctcctctttacagcagatcaactggcatgtcgcgctgctcgctgccaactatgataacgtcgtgccgttaaaaagtgtggattatattgttaagccgcaatatgcatggtgcgcttgcgcttacattgtgaacggtgattactactccactctcattgataattatgcagaaagcttgcaggggttgctggcgggtggcgttcctcagtgctgggctttagatgtacgctggaatagtttgataaaacgtgaccgctggttgggtatctttcccaatgcgggctatcaggccgctgataaaagtgatattgaaaaccaacctgttgattatcgagctcatttcgctaaaaaattagaagaaatagtctggccagcctatcaacctggcgaagaaaagataaaagtggatatctttttccagtgggcccccggctggactaactttgagtcggtatatcgcgctatgcaggccaaaccgcattttgattgccagattatccttgcgccctatttcagtcggggcacaaaagcaccggattacactgcacagcgtgatttattaaatgataagggtatccggtataccgagtatcacgagtatgagattacggcgcgtaagccccatgtggtttttttacaaaatccttatgatgatgcacgtcccaatgaactgcaaagtttgacgcttaatcgacgcaatatttctatcgcctatattccttatgggttagatatgggtgatggcgagagaaaccgtgtttatcagtacaatcttccctgtcaaaatgttgccaggtgggtattcgttcgctctcagcggcataaagatgagtttgctaaatattgcggaaatggcaatcatcacgtctatgttagcggacatccaaagctagataactatccatcacgctttggcgtccagacggatggcaaagttaataaaggcaagccaacgctattatgggcgccgcatttcgtcatgcctgatgatgaaaagatgtggtctacgtttaatttatatacacaggcaatgcttgatatcatcaaacgtgatgacgtcaatttgattattcggccacatccgctttttaaacaatttctggatattcgtaaagagcgcggaacacacagcgaaactgctcagaactggcaaatgctgcgcgaatactctcatctcaaatcacatgtggagtgggatttttctgctgattatcgctacgccttttcacaatcagatgcgctgatggcagatgcaggatcgtttttgctggagtatttaccgtcgcgtaagccaatccttttcctgactcatgaaaattgcctcggtattaacagtagcgctgaatttatttatgacgcttatgacgttgcgaatgaatctgcagatattaaaactttcgttgataatcttgtttcaggcaaggatcccatgcgtgataagcgactgcaggttttacgtgatgaacttcatatgccagagcagggcgcaggcagtgagattgtaaaaatcattgaaaaaacccttatgcccgctggagttcatcacaatgtcttctaa

SEQ ID NO: 61758 - DNA, 1254 bp, Glycine max
  Peptide Sequence Number=SeqID_178536
atggcgggcgttgggctggccgacagcttcaacatggtgatcatctccttttttgccgccatcgatctcggtaccacggtggtggtggcgttcagcctggccaaacgcaacggcaagcgtgcgcgtgcggcgacgcggcagtcgctgggattgatgacggtgctggcgtttgtgctggtcatcgccatcgagttctgggggcatctgatcgttgatgtgattgccggtaacgccgagccgcaggtcaaagaactggcgctcagctatctgcaaacctccgcgtggagctatccggcggcggcgattgcgctgataggcagcggcgcgttgcgcggtgccggcaacactaaaattccgatgctgatcaacggcggcatgaatatcctgaatatcatcatcagtagcgtgctgatctacggtgcgcttggctgggaagggatgggatttgtcggtgccgggctgggattaaccatttcacgctatatcggcgcggcggcggccatttacgtgctgtatcgcggcatcagtccggcgctgaaaatcacgctggccagctatttccgccgctgggatcgcaacatcctgatggaagtgctggggattggcgtaccggccagtatcgaatcggtgctgtttaacggcggcaaactgctgacgcagatttttgtcgccggcatgggcaccaatgagatcgccggtaattttattgccttctccatcgccaccctgatcaacctgccgggcaacgcgctgggttctgcgtcgaccattatcaccggcaggcgcttagggaaaaatcaggtgatgcaggcggagcggcagatcaagcacgtattctggctggcgatgattgggctatgtacgctggcgtttatcaccgtgccgctggcgggcacgctggcgcgattctacacccgcgatccgcaggtgattgaggtaaccaaacacctgatctggctaaatgccgcctttatgcctatctggaccgcctcctgggtgctgccggccggactaaaaggcgctcgcgacgcacggtacaccatgtatgtatcgatgttcagtatgtggggcgcgcgcgtggtggccggttatctgctcggcatcgtgctgggcatgggggtgattggcgtctggctcggcatgttcctcgactggacgatgcgcggtatctgtttctggtggcgtttaaccagcggcaaatggctgaacaattaccgcaaaatgctcgcgaagagcagtggcccacagggctga

SEQ ID NO: 61759 - DNA, 1125 bp, Glycine max
  Peptide Sequence Number=SeqID_178537
atggacgccttttttatacagcagctgattaacggcctgacgctgggcgcggtctacgggctgatcgccatcggctacaccatggtttacggcattatcggcatgatcaacttcgcccacggcgaggtgtacatgatctctgcttatctgtgtgcgatcgggctggcgctgctcagctacttcggcattcactcctttccgctgctgatctttggcacgctgttgttcaccatcgtggtcaccgccgcttacggctgggccattgagcgcattgcctatcgcccgctgcgcaattccacccggctggcaccgctgatctctgccattggcatgtcgctgatcctgcaaaactatgtgcagctcagccagggaccgaatcagcagggcattcccaccttgctcagtggcgtgctgcgtatggagatcgacggcggcgtggtgcaaatcacctggaccaaagtgtttatcctggtggcagcgctgtgcgggatggcgctgctgacctggattatccagtacaccaaactgggccgtatctgccgtgcggtccagcaggatcggcgcatggcgtcgattctcggtatcaataccgaccgggtgatttcgctggtgtttgtcatcggcgcggcgatggccgggctggccggggtgctggttaccatgaactacggcacgtttgatttctacgccggcttcattatcggcatcaaagccttcaccgcggcggtgctggggggcatcggttcgctgcccggtgcgatgctgggcggtttgctactgggcgtggccgaggcgcagttcgccgggctggtgaactctgattacaaagatgtgttctcgttttcgctgctggtggtgattttaatcttccgtccgcagggactgctgggccggccgctggtcgccaaagtgcggcatccgtcaggtgctgctcgacacgctgctggccggtgccgtcgcgctggtggtgttcggcccggtagtgggcgtggtactcagcggctacagttttacgctgtcgccgctgcgcgtggcgctgctggtggcggtggtgatggcaggacgtttgttgctggggctgtttctgcataccgccgtggggcgccgttttctgcgcaagtttga

SEQ ID NO: 61760 - DNA, 582 bp, Glycine max
  Peptide Sequence Number=SeqID_178538
gggctggcggatgccaccaaagcggcgctggagaaacgcggcgtgaaagaagtgctgtatgaggggctgtcgcgcggtgaaaaagacttcaacgcgctggtcaccaaaatcggcgcggtgaaaccggatgtggtctatttcggtggctgtcatccggaggcgggtccgctggtgcggcagatgcgtgagcagggcgtcaatgcggccttcttctccggcgactgcatcgtgacggaagaactggtgactgccgccggcggtccgcagttcactaaaggcgtgtacatgaccttcggcaatgacccgcgcaccatcgcggatggcaaagcggtgattgaaaaattccgcgccagcggttttgagccggaagggtatacgctgtacgcctacgcctccattcaggctctggccgccgcctacaaagcggcaggtaaagacaatgccaaagccagcgactggctgaaggccaacagcgttgacaccgtgatgggcaagaaggcgtgggacgaaaaaggcgaccttaaagtctcggattacgtggtctatcagtgggatgacaaaggcaaatatcaccagctgtaa

SEQ ID NO: 61761 - DNA, 138 bp, Glycine max
  Peptide Sequence Number=SeqID_178539
atggggcaagccacattgcccctattccctagttattggcacccgaaaggacagcatgtagaggttaagataagtgcccaaattaaggacttagacctaggaatccaagcctttggttttgagtgcaagaaagcataa

SEQ ID NO: 61762 - DNA, 249 bp, Glycine max
  Peptide Sequence Number=SeqID_178540
atgggtgaagtagacgaggtgcaagaacggatgaaggatgacatggaggccatgaaagagaaaatggccacaatgatggaggccatgataagcatgaagaagataatggaggtcaatgtggttgtagttgtcgttaccagcactgttgctgaggtggacccgactcctccatctggcttcaaccaaataaatcatccaacctcggatatggtaggcaaagaattaggaagtacgagtgtcataccctaa

SEQ ID NO: 61763 - DNA, 681 bp, Glycine max
  Peptide Sequence Number=SeqID_178541
atgggcattggcctgacaccgttcgcgggcgtgttctctgcgccgccgtcaattgcgccgacctttatgcagctggatatcgccggcgcgttcaacgttggcctggtgagcgtgatctttgcgttcctgtttgtcgacgtgtttgataacaccggcacgctgctgggcgtgacgaaacgcgccggtctggccgatgagcagggcaacgtgccgaaaatgggccgtgcgctgatcgccgatagcgccgctgcgctgttcggttcactgctgggtacctcaaccaccaccagctatgtggagtccgctgcgggcgtcagcgccggcggccgtaccggtctgacggcgattgtggtcgctattctgttcctgctcagcctgttcttctcgccactggcgggtagcgtgccggtctacgccacggcgccagcgctgctgttcgtcgcggtgctgatggcttccggtctggcagaaattgactggaaagatgtcaccacggcggcaccggtcaccgtaaccgcgctgaccatgccgctgacttactcgatcgccaacggtatcgcctttggttttattacctggacggtggtgaaactgctgagtggccgcaccaaagaggtcaatgcggcgctggtgattctgtcgattctgtttgtgattaaactcggctggctgagtgcctga

SEQ ID NO: 61764 - DNA, 471 bp, Glycine max
  Peptide Sequence Number=SeqID_178542
atgccgatcagtacggctccggtcacgcgacgcgcttccagcaccacaatgataaagaagcccagcagcgccagcagcggacccggtttggtcaggtcgcccagaccgaccagcgtagccgggttatccaccacgatgcccgccccttccagcgcaatcagtgcgaggaacaggccaatgcctgccgcaatcccggcacgcagcggcagcggaatgctggcaataatccattcgcgaattttaaaaatcgacagcgcaaagaagatcaccgccgagaggaacaccgcacccagcgcgatctgccaggcccatcagaatcgaaccgatggccgcggccagacaggtggcaacaaacaccgagcctttatccataccggtcgccccgaggatgctgggattcacaaacaggatgtaggccattgccagaaaggtcgtgataccggcaatgatttcggtgcgcaccgtggtgtg

SEQ ID NO: 61765 - DNA, 1725 bp, Glycine max
  Peptide Sequence Number=SeqID_178543
atgctttcaatcctcaacgggtcaggaacggagccataccacggcctgggagaaatcaatctgaaacacttcgagagcagtgtgcggcatcgcagccgggcggaaaacgtgcgatgtggcctccctgcacctgataaacatagccagccttttgccgcctaccagcaccgtgatggtgcagaatgcgttcgatcacagattcttcatcgtgatgagaggtttatccgctatgctctggtcaaatcggtccaaattgctgaaggagaatctatgaatacgcaacggaacggattgaccactgaacaggcgctggatcaattggagcgtctgtatgacgacgcggttgaagcgctgcgcaacgccattcgcacgttcactgccagcggcacattgccggacgccggactgcgccagcaggggctgtttgtctatccggagctgcgcatcacctggcagggtgaaggcccgcagcaaaatcgcacccgcgcctggggacgttttacccacaccggccgctacagcacgaccatcacgcgcccggcgctgctgcgtcactatctcagcgaacagctgcagatgatcgaaaaagagtacgacgtgctgattgaggtgggtccgtcacagcaggaaatcccttatccctatgtgattgatggctccgacctgtcgctggaccgctccatgagcgccagtattgcgcgccatttcccgacgaccgagctgtcgcagattggcgatgaaaccgctgatggcctgttcaacgccgacgcgctgttcccgctgtcgcattttgacgcgctacgcaccgatttctccctggcgcgcctgcgtcactacaccggcaccgcggtagaacacttccagccgtttgtactgttcactaactacacgcgctacgtcgatgagttcgtgcgctgggcgattgagcaggtgcaggaccccagcacgccttacgacagtctcgcctgcgccggcgatgtggtgatcacggcggagacgcaggacccaacggcgatgatgtcggatctggcgtggaagaagcatcagatgcccgcctggcatttaacctcgcccaatcgtcgcggcatcacgctggtcaatattggcgtcggtccgtcgaacgccaaaaccatctgcgaccacctcgcggtggtgcgcccacatgcgtggctgatgattggtcactgcggtggcctgcgtgaaagccagagcatcggcgattacgtactggcacacgcctatctgcgtgacgaccacgtgctggacagcgtattaccgccggatatcccgatcccgagcattgcggaggtgcagcgtgccctgtacgacgccaccaaagcggtcagcggtatgcccggcgaagaggtgaagcagcgcctgcgcaccggtacggtcgtcaccacggacgaccgcaactgggagctgcgctactccgcatctgcgttacgcttcaacctgagccgcgcggtggcggtggatatggagagcgccaccattgccgcacagggctatcgtttccgcgtgccgtacggtaccctgctgtgcgtctcggataaaccgctgcacggtgaaatcaagctgcccggccaggccaaccgtttctatgagggcgcgatctcggaacatctgcagattggcatctgcgccgttgagctgctgcgcgccgagggtgacaaactgcactccaggaaactacgcaccttcaacgaaccgcccttccgctaa

SEQ ID NO: 61766 - DNA, 320 bp, Glycine max
  Peptide Sequence Number=SeqID_178544
atggcgttctacgcgcaggctgacataaagatcggcgtggccggtccgtttaccggaccgaatgctacgtacggtacacaatactggaagggcgccagccaggccgcggcggacattaacgcggcgggcggcataaacggtgaaaaaattgtgctggtgcagggcgatgacgcctgcgaacccaagcaggcggtggccgttgccaaccggctggtggatcaggacaaagtgatggcggtggtgggccatttctgctcatcttcgaccatgccagcctcagaggtgtatgacgaggcgggcgtactggcagattacgcccg

SEQ ID NO: 61767 - DNA, 240 bp, Glycine max
  Peptide Sequence Number=SeqID_178545
atggcggacgtcatggtaatgaaggagatcgaggacacggcgctgcatctcgacgtcgatctctccattctcgatctcgacgccattcgcctccctcccgacgaagattgcggcatcgtcagtgatgacgaggtggtttaccaggaggagaatctcgagtttgagtctggatttggtaacatcattgtcgtggaggagaatcttgagtttgagtctggtttaccaggaggagaatcttga

SEQ ID NO: 61768 - DNA, 435 bp, Glycine max
  Peptide Sequence Number=SeqID_178546
atgtcacaagggactctgaggatgtatttaaacaagaaagagccgtactcactctcaatggaaacaatactaaggttagctctagatatatcaaggggcatggagtaccttcattcacaaggtgtgattcacagagaccttaagtcaagtaattttcttctcgatgatgacatgagggttaaggtggcagattttggtacatcttttcttgaaacgcgatgccagaaaagcaaagggaactctggaacatatcattggatggcaccggagatggttaaggaaaaaccttatactcgcaaagttgacgtgtacaattttggtattgtgctttgggagctcacaactgctctacttcccttccaaggaatgacaccagtgcaagctgcttttgctgtggctgagaaggtagcatggctatgcttgaactctaaatga

SEQ ID NO: 61769 - DNA, 1360 bp, Glycine max
  Peptide Sequence Number=SeqID_178547
ccagtggcgcgcgctggacacctcagctgccgccgaactgctggcgctgcacctcggctgggatgtcaccagttttggtgccgatgatttcagccagaccggcctgacgctgtttaccctgagcaacggttcacgcggcggacagccgtggggcaaaccgtatgcagagaagatcatgcacgtgcgcgaagggcaggtgacgccgatgcattatcatccgcaaaaaatggaagacattatcaaccgcggcggtggcaacctgattgtcacgctacacaatcgcgacggcgatcggctggcggattcgccggtacaggtcacgctcgatggcatctgccagacccatgccgccggttcccagctgcggctttcacccggcgagagcgtcacgttactgcccggtgtctggcacagcttctggggcgaaaccggctacggcgatgtgctggtgggcgaagtctccatgcccaatgacgatgagcacgacaacgagtgttccatggcactgatctctctggcgcagggcctcgcccatgcgcagcagcacggttacgcgctcggcgcgttcaacgttctcgacacccactttctgcgcgcgctgttccatgcggcggaacagcagcgttcgccgtttatcatcaacattgccgaggtgcattttaaatacgtcagcctggaaccgctgatcgccgctatccgtgccgaagcggcgctgcacgccatcccggtggtgctcaacctcgatcatggcctgcattttgatgcggtgatgcaggcgattcgcctcggcttcacctcggtaatgttcgatggttcaaccctgagctatgacgagaacattcgccagacgcgggaagtggtgaagatgtgccacgcgctaggcatttcggtcgaggctgagctgggcgccgtgggcggcgatgaggggggcgcgctgtttggcgaagcggacagcaataaattcaccgacccggcgctggcggcggaatttgtccaggcaaccggcatcgactgcctcgcagtggccatcggcaacgcgcacggcaaatacaaaggcgagccaaagcttgattttgaccgtctggcggcgattcgcgcagcggcctgcattccgctggtgctgcacggcggttccggcatcagcgacgccgatttccgtcgcgccatcagcctcggcatccacaaaatcaacttttacaccggtatgtcgcaggcggcgctcgcggcgattgaaacgcaaatcacccagcgcgacgcgcgctacgactcgttcgccgaactgttaatggcggttgaacgcgacatcgccagcgttgtggcccagcagatgcaggtgtttggcagcgccgggagggcctga

SEQ ID NO: 61770 - DNA, 174 bp, Glycine max
  Peptide Sequence Number=SeqID_178548
atgttggtggagaaaacgacgtcatcttcgattaggttgtcattgttggagaaaacgacggtgttggacaaagtgaggcctgacacgtggatgggatgccgaggaagcattcttgcaaggagagggttgtcttctattggagaaggggaagaaagagaagaagaaggggtttga

SEQ ID NO: 61771 - DNA, 705 bp, Glycine max
  Peptide Sequence Number=SeqID_178549
atggagccttttcagacaatacccaaaccaaccccaaagagcaatgcagaaagaaggagttgtagaagttctgaaggtaaggaaaaagagataacctgtaagacaagtagacaaaagagtgtagttaatggtgttgagccaaagaaaaccaaaaatcagcttgtaagagaggagaataaagtttccaaacctattccacctcaagcattaccttatcctcttgtgccaaccagaaaagacaaagaaaaacaatttgcatgtttcttaggcattttcaagaggctgcaaattaacatccctttttcagaagttgttgggaaaatgacaatttatgccaaattcatgaaagaactcctcaacaagaagaataattatatggaggaggatacaattcaattggaagctagaagcattactgtaattcaaaaatcattttattacaagcataaagatccaagaagcattaccattccaagctcaattgggaatctatttgtaggcaaagcactactgcatttgggagcaagcattaatcttatggcactctcaatgctcaacaaggttgaggatgtagagattgatgtagctccatgtggagcttgtaggccttggatcttcttcatcaatggattcctttgcttcttgaggtctgattgcagcggaatggagaaggagaaagatgaatggagacgccacttcaagtag

SEQ ID NO: 61772 - DNA, 1017 bp, Glycine max
  Peptide Sequence Number=SeqID_178550
atgaggggaaagataagagaggtggctctaaaggttgacattaggaaggcatacagtagagtggactggggtttcctgcttgctctcatgggaaaatggggcctacttggatctagtggatcaagattaataatgtgtcttaagagttgtcacactattacgtccaccatgggtgtcttggagtggatcggtactagaaaatacttgggtgctccatctatggtgggaacgaataagtgggtcgtttttggttatattcgtgatagagtgtggaagaaaatccagtcttgggaaggtagatggttgtcaaaggctggcaaggagctcggagaaaggagcaaggaggggttttcattggttctgttgggagaaattggccatgaggaaggatcaaggaggaatggggagctgaaagcttttaatattgccttattaagaaaacctgagagccttgttgcaagactgattaaggctagatactttcctagaattgaatttctaaattcgattggcaatggagcatccattcaagttttgtctagtccctggttgagggatgctaaaaatgctttcgtgaaacaagtaccagtcatggagaattcagatttgatggtgaaggatctaattaatgaggtcaggggcacttggagatgtgaggtgttgcttccatctagacaagcattgctagtgaagggtgttacttgctatggtctgtgcccgttctctgatgccccacttgagactagttggcacacactcgagaatcatgtggtctatcgagctcgtgattatctagcgaatcgaagagaagttcgtgtgctcaagaagaacaattcagtccccactgtcaataatcaggctgctctacaatggctcaaagatctagacattgaagatattattgtcgaatccgattgcctgcaagtgggaccagtcactagagtcatgagcaagatgttccaagaggattgtgctagagctgctgaagaaggtcctaggattctcatgaacctcagg

SEQ ID NO: 61773 - DNA, 639 bp, Glycine max
  Peptide Sequence Number=SeqID_178551
atggctctagtgactagtcccttcctagggaggattgcattagagattaagcccacaaggatgacacttcagctaactgacagatcgatcaaagtttcatttggagttgtggaagatgtgttagtgaaggtggacaaattcatattcccgactgactttgtaatcatggatatggaaaaggatgttgaagttcctatcattcttggaatactattcatgaggacagatcatgctctaatcaatatgaataagggcaaacttaagttgagaggtggatattgtggaaaaatttgttccacttctaagaagtcgctgactcatgcaacatgtttcaaaaagaatatcaaagctcatcacaacaaaacacttgcaaaaaggaatgttaagcctaaccaaaaagttccggtatgcaataaaaggtttaaattgttccctggaaagttaaagtccaaatggtttggaccttttgtcatcaaggaagtcaagccctatggtgcaatcactttagaagacccctcaacaagcaaaaattggactatcaatggtcaaaggctcaaaccatacttgggggtgaaattgaaaggatcaacaccatctttcacttttgtgatccttaaagatcaatcaatgtcaagctga

SEQ ID NO: 61774 - DNA, 600 bp, Glycine max
  Peptide Sequence Number=SeqID_178552
atgtcttgtccacacataagtgggttggttgcattgttaaaagcagcacatccaggatggagccccagtgcgataaaatcagcactcatgaccactgcctatgtacacgacaacaccaagttcccactccgtgacgcggcggggggtgcattttccaacccatgggctcacggtgcatgccacatgaacccacacaaagcactttctcctgggcttgtctacgatgccacagcatgggactacgttaagttcctatgttcctttggaaagttctctgaccctggccaattgaattacccttccttctcgatcctctttggtggtaagagggttgtgagatacacgcgcgtcttgatcaatgtgggtgaaacgggctcgatctataatgtcaccgtggatgcaccatccacgatgacaataaagatcaagcctaccagacttgtatttgaaaaagtaggggaaaggcaaaggtacacggtaacctttgtgtccaagagaggtgtgggggattccactaggtatggttttggaagcattatgtggagcaatgcgcaacaccaagttaggagcccagttgctttttcttggactttgttgtga

SEQ ID NO: 61775 - DNA, 414 bp, Glycine max
  Peptide Sequence Number=SeqID_178553
atgggtgctttgaacatcaaaacttgtcaagttgctgttcccacggcaaaccatgcaactgctgttctagttgtcttccatctaccaattgctcttgctgctctaatggaagatcacattgctgcaaagatagctgtggttgcaaaaattgttgcactctcccaagttgcaattttgggtggccttttccctcttgctgcatctgcaaatgctcttgctcttgctcttgcccaaaatgtcccaagcccatctgacctcagggcaattgacagcgataataaggttttcgattttccagaaattagttattcgaatcttgtgaaggaaatagccttgcctaggaagaacttgattctacccaaaatgacctcgggcttcacgcaaaataaaaagcaattggaagttgcaaattga

SEQ ID NO: 61776 - DNA, 714 bp, Glycine max
  Peptide Sequence Number=SeqID_178554
atgagagtttcagcccagaattccacctcattcttaccttcatcaccgtcttcgtcgtcgccaccactgtcgtccgaatccaagacagagaaacgcaaccgcgagtcgaacaatcacccggtgtaccgaggggtgcggatgcggaactgggggaaatgggtgtccgaaatccgcgagccgcgcaagaagtcacgcatatggctgggtacattccccacgccggaaatggcggcgagggcacatgacgtggcagccctcggtataaaggggaataacgccattctcaactttcctgaactcgcggccttactcccccgtccagtgtccttagcctcccgcgacgtgcaggctgctgcagccaaggcggctcacatggacctgccttcttcgtcttcttccatttcattgtctttgggttcaactactccgtcttcgtcatcttcatctctatcctccttagcttccaccgcggacttgttgttgttgtccactgcctcagaggaactgagcgagatcatcgagttgccgaggctggaaacaacgagttacgagctggggaacgagtttgtgttcatggactcgcaggacacgtggatgtatcagccaccgataccgtggttgcatactacatacgacggttctgatgcaaatgagtttgcagtgccagagagtcgggttgtgactaattttgagggttttctgtgggactactga

SEQ ID NO: 61777 - DNA, 567 bp, Glycine max
  Peptide Sequence Number=SeqID_178555
atggataatatgtcaatgaggaggcaaggggtgtttaggttgatttggggatgtattggaagtggtgctattgctattggtgttggtggggttttgggtattgaagggagggttgttgctatagatttaagccctctggttgttgttgttgttgcagcttacaatgacaagatgacacaagaaatgagtcaaagtgacaactttatagaaatttcaactaatgacagtgtgggtaaagtgctgggaaaggatcacactgggtgtatgcattgcttaggactaggaggtcttcacagtgttgcattttggtccaccacaagctttagtggtctagggtctagtttttcaaattttgattcaaccgagagctctagattgaaagaggagcttgtaggcctaggatattcttcatcaatggattcctttgcttcttggaagatgaatagcagggaaatggagaaggaagtgagagaggagacgccacttcaaggagaagatgagtctagaagaagctcaccaccatatgaggccatggataagagcttggaggaagaaggagatgaatga

SEQ ID NO: 61778 - DNA, 126 bp, Glycine max
  Peptide Sequence Number=SeqID_178556
atgccacttcgagatgtcatctgcaatcagcttcagcgccaaagcggagtccgactcgcaaataacccgtctaaatccaaccttatatttcataagctgctcgaagtagcatgtaaaataagctag

SEQ ID NO: 61779 - DNA, 1398 bp, Glycine max
  Peptide Sequence Number=SeqID_178557
atggcttccctttctaccttcattttttttttcttcttcttctttctcacacaatgctgcttcttaacatcatcagcgaaaaaaacctacatagttcacatgaaacaccacaaaaaatcttcagtttaccccacacacagtgactggtacaacaccactctcctccaatctcttactctcaccacaacagattcagattcaaaatccaatccgttactctattcatacacaaccgcctacaagggtttcgccgcgtcgcttaatgacgaacaggtcgaagagcttctcaaatccgaggatgttctcaaagtgtacgaggacacggtgtaccagttgcacaccacgcgcacccctgagtttctagggttggagaaggagacaaagttgtgggagggacatacagctcaagatctcaaccaagcgtcacatgatgttatcattggtgtgctcgacaccggagtgtggccggagtcatcgagcttcgacgacgctggaatgccagagattctggcgcggtggcgcggggagtgcgagaccggtccagatttctccacaaaaatgtgcaacaagaaactcattggcgcgagaagcttctctagagggttccacatggcctcggggattgaggttagagagaaggaaccggtgtcggcacgtgacagggacgggcatgagacctacacctcgagcaccacggcggggtcgcacgtaacgaacgcgagcctgttagggtacgcgagcgggaccgcacgtgggatggcgcccaccgcacatgtggctgcttataaggtctgctggaccgacggctgcttcgcctccgacattcttgccgaaatggatcgcgcgatcgaggatggcgtcgacgtcctctcgctctccctcggcgacggctccgcgccatacttccgcgacactatcatcgtcggcgcttttgccgctgtcgaaagagggatatttgtttcctgctccgctgggaacagtgggccccagaaggcctcgcttgccaacatggcgccgtggataatgacggttggtgcaggaaccctagatcgtgatttccttgcctacgcttctcttggtaataaaaaaagattcttcggtgtttcgctctacaatggaaaaggaatggggaatgaaccagttggtttggtttataacaaaggcttgaaccaatccagtagcatttgcttgcccggttcgcttgaaccgggtctggttcgtgggaaggtggttgtttgtgaccgtggaatcaatgcgcacatggggaagggtaaggtggtgtgtgatgctggtggtgttgggatgattctggccaacacaacaacgagtggggaggagttagttgcggatagtcacctgctaccagctgtggcggtggggaggatcgtgggggactag

SEQ ID NO: 61780 - DNA, 159 bp, Glycine max
  Peptide Sequence Number=SeqID_178558
atggagttcttcctaaagatcaaatggatcaagggttgtcttgaatcctcttgggatttagtgttggtaaatgatagctcatctcaagagtttaagtgttgtaaaggacttcgtccagccaatcctttagctcctttccttttttttggtgatgggtga

SEQ ID NO: 61781 - DNA, 942 bp, Glycine max
  Peptide Sequence Number=SeqID_178559
atggcggagttagggtttcaggaacgaagctcgtggagaaagagagaaaaaaaggctaaagttcaagatgatgaagatagggatgctgatattcaagaacccgtggagttggattctgccagaaactctttctctttagccctcaaagaatgtcaagacaagagatcaaaatttgaagccttgttgaagaaggctgcttctttggatctgaacaatgactttggctctggctcatcgcggcgccttcaaacattgaaaaaaagttccatttcttctcgaaggtctggtactgccactttccctattcctggtacacccaattttcacattgcaatgtacaagggatggagctccgagcaagttcccttgtatgcaggtgctacccagaagcacgtttttccgttcaacaatgggaaaacattgccgtcaaagtgggaagatgctgagaggtggattatcagccctgtttcggcagatacagagtcagtcatcatcaatgcccctccaaggttattcttctatgaacttaagaagtgtttggacaagtttggtgggttcaaagacgttggcaccaatgtgtcccgtgctgctttaaggagggacatggtgacccagatgatcccacagggtagctcatgctcctctcctaatctgaggccttctttctctgcctccaccctatcaaccttgcctgtcacagaattgcagactgttggttcctctattagggatatgcagggccctattcactggaagaggctcagagcaagccaaagttggaaaaaaggagaactaagtactcaatcgtcaacttgggatgtttctgaaacgtcaaagcctgcctcaaagacaagaggtgaggaacccaaaatctctgcatgggagaacttgcaaaaggcaaaagcggaagcagcaatacggaagctagaggttacttcctag

SEQ ID NO: 61782 - DNA, 513 bp, Glycine max
  Peptide Sequence Number=SeqID_178560
atgcccttgcttgtgtttaacagctttgccctttacacaggtaaggagtggaggcaaaggcaaataaggaagataacagatcgagtttttgacaaagtaaagaatcaaatagaaactgataacttgagttttgaagatctgtatattgctgttttacttgtgtacaatgatatcaacaagtatatacctggtccccattttgaccctccatcaaaagacaaagtcagagaagtcaaacagagctgtgatatcaacctcgatggtgatattgaccgtgatgaattttatgatttcatcctgataatgacagctgatacattcactattgttagccaaaaacttattctcacattggttgtagcaccaacagttgcagtggcaacaaagaaagctactgaaggtgttccaggtgttgggagactggtgcaaaagataccgaattcagtttatgcttccctcgtgacaattgcagctgtgtggttccaaaaaaaggctcagagttctccactgtag

SEQ ID NO: 61783 - DNA, 620 bp, Glycine max
  Peptide Sequence Number=SeqID_178561
atggagtactcactctcttattaccattttcagaaccagttgataagtccagcatcgcatctcccattctacattgatgttattgagaccaagtgggaacatgatgacatgctccatatggatcacttctctgagttcctatgttgttgtcgtatactagatgttcaggagctaggatttgtatcattcactttttcttttcatggaactagactacgttgtcctattgtcgcttcgcgatgcccatgcttgaggactatccaaggaggaagagcttggcttgagtggctcaacatggatggaccaatcactagagcaaggagtaagagatttcaaaaagagtttgatgctactccaccatctccaaaaaccgctaggctcatggtagagatgattaaacttggtgatcaaatgagaagaatgagttatgaagatgaagaaaggatagagagaatgagaaagaagaataaggagagtctaggaagaatacatagtagtagtgaagctttaagtgtgaggattgaaaatacagagcaaagaagaaaggacaaatcatctaattcttctcatagagaagataaggggtatgaagaggatgggggaggaaggaggaatgagag

SEQ ID NO: 61784 - DNA, 324 bp, Glycine max
  Peptide Sequence Number=SeqID_178562
atgacaataagggggacctgcaaaacagaggacttcgacgctcaagcgaaagagattatccagtgtcaaaggagattaccccgtgtcaaaggagattgtctgatgtcgaggtttgtcgagcccccgagcatggacaagtgttgtccaatgtcgagagtagtagccccgacaagtgtgaaaattattagtttgtcaagcttttcaagcccctcaggctggactggtgttgtcggggctacttctgtcaaattgtcagaggtggacatgcttttggttttacaggcaaggcctgactttctagttgagggaagcctctctatttga

SEQ ID NO: 61785 - DNA, 997 bp, Glycine max
  Peptide Sequence Number=SeqID_178563
tgggttgtggggttggtcatgcaaatcaacgatgatagcaagggagaattgtgctctaagatgcctttcaccagcttgttacgagctcatctacgagagtgacccgctcgaagagggagaaaaggactttattcgaagccaagagtacaaatactgcatgcacaaaaagctagatgataagaacttcttgttgtggcgacaagaaatcgagccagcgatcattgcgctcggactcaatcacttcgttgcgaaaacaagatcagtttctccttgtttggcttcagtctatgctttcgagctcaatgcttgcttgagttcttggatcgaaacactcgtatcagagctccgtcacacgatgctggactaccgtccagtttccgatttcctctcttggataaaagcgcttattgatgcgcttgcgtcagtagtcatctaccacacatcaccgttgaagaagttgaaggatagattcttgagtgggagctatgtctttgcaaatacaccagacttgaatcttgaagtaacttcttcacgccaacatattcttcagattcgcgaggttctagtggccataatggccgtggcggaggcagtttcaaccgtggtggtggtcgtggcggtcggagctcagtcctgtgtcaagttagtcaatcataatcacacggctctgacttgctacaatagattcaaccctcagtatcaagctgccaatggtggtaacaatagcaattatgggaacaacaacaatggcaattatgggaataacgaaaatcataataactggtctcacaatcagaatcagaatcaaaattggggtcagaatctgaaccaaaacaactggagcaattcttctgcttccaattggaattcacagaaaaatcagaatcacaacttcagaactctaattctaggcctcctcaagctatgggtgaggaaatctgactttgaggtggagatgaatttgaagagggaggaggatgagaaagagactcaatga

SEQ ID NO: 61786 - DNA, 330 bp, Glycine max
  Peptide Sequence Number=SeqID_178564
atgggattcaggaaggacttcctagggattttgactcgaccattgcctctaattgaaagtcgtctaccacacatcaccattgaagaagctaaaggatacattcttgcacaggagctacggcttcgcaaatacaccagacttgaatcttcaagtaattgcttcatgccaacagtaaatctcactcaatattcttcagattcacgaggctctggtggccgtagcggaggtggtttcatgcttgagttgggtctctctcttctcagccatgcatcccttcctctttccttttgggatcatgcttttcaaattgttgtgtatcttataaactga

SEQ ID NO: 61787 - DNA, 937 bp, Glycine max
  Peptide Sequence Number=SeqID_178565
atggaagaagacttcgacatccccggcggcgaggaaatggatctcggcgaagacgaggtcggcgaggagagggagatcggctctggcggcctcaagaagaagctcctcaaggaaggtcaaggctgggaaacccccgaagtcggtgacgaagtccaagttcattacacggggactttgctcgacgggactaagttcgattcgagccgcgacagggattctcccttcagcttcacgctcggacaaggaaatgctgaaaacactttctttttgctttcatcatttcctgtacaaagcattgaaagcaggaaattaagtgaaaactgtgggcaagtaattaaaggatgggatgaaggtattaaaaccatgaagaaaggtgaaaatgctattttcaccatccctcccgagctagcttatggtgaatctggttcccctcctactattcctcctaatgctacactccaatttgatgttgagctgctgtcatggactagtgtaaaggacatatgcaaggatggcggtatatttaagaagataattactgagggggagaaatgggagaaccctaaggatcctgatgaagtattggttaagtatgaagttcatctagaaaatggaaagcttttagcaaagtctgatggggaggagttcacagtcagagagggtcattattgtcctgcattgtcaaaggctgttaaaaccatgaagaagggagagaaagtgcttttgacagttaagccacaatatggatttggtgagaaggggaagccagaacaaggggatgaaggtgcagttccaccaaatgcaacattgcagattactcttgaattagtttcatggaaaactgtttcagaagtaactgatgacaagaaggtcataaagaagatcctcaaggaaggggaaggatatgagcgtccaaatgagggggccattgttaaag

SEQ ID NO: 61788 - DNA, 1218 bp, Glycine max
  Peptide Sequence Number=SeqID_178566
atgatgaacttaacaagcaagatcggttgggtctccttaaacaacatgtctaagaagttgttcaagtttgacatgaatgtttttcaccgtttcaaggaccgtttattcaaggtcctcgatactgatgtcggggctgatgatttgccattgatgttcaaccagccttggacaacaaagtgtcttaccttgtcctcttttgtgtctaaggtaggtattataggtgacttcccttggaggccacttatgaagcaggctgaacctgttggtgggactgtgccaccgtctgttgttgcccctgtattgagccttcgtgaactaaggaaaagttcaaggttgacgcccagttcaggtcgcccttcaagtttacaagatgtgcctttggttccatcggccattgaggcttctgctcttgttgttactgttcctctacctcttcctattgtgcctgttcaggaggccactcttgttgttggagttgatgtgctagccactttggttggtcttgtcatgactccgtcgtccatcattgttgcacccttgttgagtcctagtgtggcgaccatgagtgctccccatttgtcgcctcctcctgctttggctccccggattcctccctccatcgtgttgacgtcggcgtcacctttctcctcttctcacccccttgtttccttggaccacatctacacctctagcgatgttgatccccatggggcgctaagaaaagtggcgtcgttggaggcagaggtcgccaaatggagggctactgctcgcacggtttggagagtggagtgccctaaggtagctaatgccactgtttccttcgctgaagctgtgaagtcgaaccaccaactgctttccaaggttggcagtgttttggccagcttggacagtgatgaactattcgaatgctgcaaagacttgaagaagaagaagaagaaggacttggttggcaaggtggagggcattgtggcagagaagaacgagcttgccaagatggtgggggacctcgaggccaagctaaaagagttagagtccaggttggaggagttcgagttgcgagcgactaggaagagggaggccaagaaggagcttttacagaaaggaggtcgtggagacgtgaaggacaatgttttgcttgacaaggaagatattgttgctaaaggggaggctggcgaggagcaggatgctaaggaacaagacgatgatgccaatgtttag

SEQ ID NO: 61789 - DNA, 1404 bp, Glycine max
  Peptide Sequence Number=SeqID_178567
atggctatgcttcttctcattccactgttcctatcatccattttactattcccaatatcaagcgcaacaacgttctcaccccaacccggaatctgctacggccagctcggagacaaccttccaccgccgcgagaatctgtctccctcataacctccgtccatgcgaagcgcgtgaagctctacgacgcgaacccatccatcctccacgcgcttcaagacacgcgcctgcaagtttccatcatggtccccaacgacctcatcttgaacatctccacgaaccaaaccctgtccgaccagtgggtctccgacaacgtcgtaccctaccacccccgcaccctcatccgctacctcctcgtcggcaacgaagtcaccagcaccaccgcggccaccgccacgtggccccacctggtccccgccatgcgccgcatcaaacgctcactgaaatcccacgggatccgcaaaatcaaagtcggaacctcatccgctatggacgtgcttcaaacctcgttccctccctcaaacggtgcgtttcgcaaagacctaactgcccccgtcatgaaacccatgttaaaattcctcaaccggaccaaatcgtttttcttcttagacgtgtaccctttcttcacttggtccgctgaccccttgaatataaaccttgattacgctttatttgaatccaaaactgtaaccgttaaggatccggtttcgggtttggtttacactaacctgtttgaccaaatggtggacgcggtttattttgcgatgaagagattaggttttccgggtgttcggatctttatcgcggaaacgggttggcccaatggaggcgacttggaccagattggagcaaatacttacaacgctgccacttacaaccgaaacttcataaagaaagtcactaaaaaaccgcgggtggggacaccggctcgaccgggttcggctcttccgtcttttttattcgccctcttcaatgagaatcagaaaccgggtccgagtacggagcggcatttcgggttgttgcacccgaacgggtcgagggtttacgacgtggatttgtccggggaaacgccggaggcggagttccggccgcttccggtgccggagaataatgaaaagtttaaggggaggatatggtgcgtggcggcgcgccgggataacgcgacggcgctgacggcggcgcttgcgtacgcgtgctcgcaggggaatggcacgtgcgacccgatccaatcgaaggggaagtgttttaaacccgattcggttttctggcacgcgagctatgcgtttagtgcttattgggcgcagtttaggaaggttggcggaacttgttacttcaatgggcttgcaactcaaaccgcaaaggatccaagttatggatcctgcaagttccctagcgtgacactttga

SEQ ID NO: 61790 - DNA, 441 bp, Glycine max
  Peptide Sequence Number=SeqID_178568
atgctccaaccatatgggattagcataggcttaaaggagcactcaaacccggtgacccccaaggcctacactcgaagagtccgtcaaggcctctccctcctgattcaggatagcagcatctctagcgattccctgatattcctccggttttttcctctaactgctccgatagaattctcaaacatcagagagacaaataagggattgaagcctccacttgtactgtctgggtacaattcatttttctctctccgtgaatattatctcacaaataccaatggtgaagaccattttgggtttctatgggaaagaaaaaggctacgatgcaaaaggtatttctctcagctcaaagatcctatcaaagtttccaacggtgacaattcttggaattgggttgcgaacggggtgctcaaatttcacgacgatccaacggtgaattag

SEQ ID NO: 61791 - DNA, 210 bp, Glycine max
  Peptide Sequence Number=SeqID_178569
atgggctttgcaaagtacacaggaaagagggtgaaggaggtgacacaaaggtggagaaagaggcatgaggatgaaggagggcttcgcaaggctgccattgcgcttctttggtttcaaataacggagtgcaagattcaaatgccaacaacaaccttagctcagaaaggttccctagtgtacataaagactgatccaagtgcaaaacattag

SEQ ID NO: 61792 - DNA, 477 bp, Glycine max
  Peptide Sequence Number=SeqID_178570
atgtggactataccaagatcacctaggtttaccattgaccaaattttaattgacaacgagggcgataaaattctagctcaaatgaaaaatgttgatcttgaaattggaaacataaattttcaagttggtcaaacttatattattcaaagttttgaagttgagatcaatagtgatgctattggtgaagttgttgaaattggtcaatggaatctgcatgggaagccaaagaaaatggtttttacaatgaaagatgaatgtggaagtgtcatcagttgtactttgtgggagacacttgttatggagcttaaggactgtttggataagcatgttactgggccggtgatgttgttgctgagtatggctaaaattaaagaagctacagcaatatataattcaatgtatagttcccaaatatctgtgaatagcgactttaaggaaattgtggaactcaaggattggttggctgcttcatactga

SEQ ID NO: 61793 - DNA, 543 bp, Glycine max
  Peptide Sequence Number=SeqID_178571
atggcctcggtgtcgtctctgtggccgccaaccccctcggcttcgtcaccgcctcctcctcccttgataacttcgttcgcgtcttcaatgtcaattccaacgccaccattgccaccctcaaggctcctccctttgaagttgaagtttggaaaatgcacttcgatcccaagaaaaacctatttttggcattgcatagagagtttttggcatccatcgtgttctctttccctccctttagagagaaataacagtgcaagaagtgagagtggttttgtgggagtgcttgtcaagtttctcctgaagcaagcaaatgttgacaagagaacatgtgatctttttggaaatcgagatctaatgaatattgcccataacgtggctcgtagtttgaaggtttcatacaagaattctgctactgctcttgtaaaggaggttagagcaatggagtcatcataccctcctaaagaaccaaagtgcatactttttccttctcagatgttatcttcagaagttaagcttgtactatcaaccatggagttgctctaa

SEQ ID NO: 61794 - DNA, 495 bp, Glycine max
  Peptide Sequence Number=SeqID_178572
atgttcattggaaacatcaaggtaattggccatcagaagatgttcttgttcaatattgcttgtcacatgcagatatattcaggaatggaagcgaagcaacaagcactggcagagagaagttcacccatggaaaaaatgaactataggaaccaggagaagaagaagcaattaacaagtgaccaattgaaagcaaggaagcagtttgttaatcaaatgaggttgcaattggcattgaattcctttacatgctgttgttcgcttattttcagggaacaacataagaagttgtttatccttgagatgaaactagctacaactagacagggaaggtgtggaaggtggaagaacaagcaacttgaacacttgtatgattcacttcaacaggaatttaatgtcatatccaaggaaaagcagaagctcaagcaagaggacggtttttatgaaactgccgtagaaagtgaaaactttcttgacgttggttacaatgacggttaa

SEQ ID NO: 61795 - DNA, 552 bp, Glycine max
  Peptide Sequence Number=SeqID_178573
atggagctttcaaagggcaaggaggtattgttgtgtttggcttctgagggatataaatggaaagtggattcggggttttcccagaaacttagggagaggaaggctcaagcttgttcttcagaaagggatggcaacaaagtgggaagttttgttggttggagattggtgtcacagatttgccacttaatgactagcattcctcgtattagacttgttcttatcttcagagagggtaatgggtgtgcggatgttcttgcggactatgcatctttcatcgtcgtcgtcttctcaagaccatcgtgcccccgtcgaagtctgaactcctccaccacattactctcatcattagaagtgattgtgggtgttgatgacattgcgtttgaggtgtggcagaaggagcattggggtttgggttgtggtctaggccatggtggaggagcgttggggatgagttggttctacttttcctctctctacttagtggttgacttctctcgctacaaacatgaggttgaagtttctgggcaattaggtcagaagagtggtgtttga

SEQ ID NO: 61796 - DNA, 570 bp, Glycine max
  Peptide Sequence Number=SeqID_178574
atggatgctgatgggaactgcaaagctattcgtgtcatcttcttcatctctctgcgtattgttgttatcctagacatgttggatgcttcctatgcctatagttttacagcagatattgagcttatgggttctttgtttagtatggctaatacaaaggccaatcaaagtgagtctagtgcaacctcaccaaatgagacctataagaggcaaagaatgtcacctgcctctgttgaagaatgtccaacacttattcctaatatccctgatgagttatatcccttcagattattgctagacttcctagaatttgttactaccatggtttgctcattggggtcacacacatggaaaaacataaagactgcatatatgaataggaagttagcctacaacattttaaccacgaaccccaacgctcctccaccatggcctagaccacaacccaaaccccaatgctccttctgccacacctcaaacgcaatgtcatcaacacccacaatcactccgaccccaacggaattcaacaaaagacatcaaaatgcaagagatcgaggggttcataccttctaa

SEQ ID NO: 61797 - DNA, 369 bp, Glycine max
  Peptide Sequence Number=SeqID_178575
atggaacattggaaaacaaagaaggttctgatatacttacaccgaataaaagatcacatgctcacatataggaggtttgatcacattgaggttattgggtattcagattcaaactctgctggatgtgtggttacaagaaaatccactcttggctatgtatttcttttagccggaggagtagtattgtggaagaatgcaaagcaatcagtggttgatacatctaccatggaagatgaatttgtagcatggcttggaattgtcgacagtattgctaggccactgaaagtgtattttgataactcggcaagagtatttttctctaagaacaataagtactctatgggtgctaagcatatggaattgaagtag

SEQ ID NO: 61798 - DNA, 384 bp, Glycine max
  Peptide Sequence Number=SeqID_178576
atgaggaacaagatcaaaaaccccaacgtcatggattacatggctgttgcaagtatgactgatggaatggttggtgcagagctagccaacataattgaggttgctgccattaatatgatgcgtgattcaaggactgaggtaatagcatatacaatattgccagatagttattgttcagtctccacaataagaagtcccttaaagaatgcgatgctacaagacagtaagtaccgtgctcgccgaataaaaaaagaacaaaatgaaaatgtggaaattttaaaactggtatataaatggagaaataattctgatagtggtatacctaccataagaacaatggcctatagcagagaagtgaatgcaaaacctaaggaagctagctag

SEQ ID NO: 61799 - DNA, 258 bp, Glycine max
  Peptide Sequence Number=SeqID_178577
atgtcacgaaaccttacggattacgcaattatcccttctttggcttccggaatgttacggaactttatgtattgcacattaacacttcctttcaactcccgacatgtcgcggaacttcacggattgcctaacgatgggtgtcaagtacctcgaagtggtcaagcgagggtcgcatcccaacaaacagatgatccctggacgaaattaggaatagtcatcaactataacaagggcatagtaaacttcctccaaggttga

SEQ ID NO: 61800 - DNA, 579 bp, Glycine max
  Peptide Sequence Number=SeqID_178578
gatgatggggaaattgaaggggatgtgaatcatcgcattcaagcaggatggatgaaatggagaaaagcatcgggggtgttatgtgatgcaaaggtaccaatcaagctaaagggaaagttttatcggactgcggtaagaccggcgattttgtacggaacagaatgttgggcagtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcaaaattaatggtttggatagaaaggccccacttgcaacacatgtaattaatgtggtagaagtgtgctacatcctccatgtatgggcaatacatgtgacactatctagcaagcggtga

SEQ ID NO: 61801 - DNA, 267 bp, Glycine max
  Peptide Sequence Number=SeqID_178579
atggcaatactggaagctgctttgtctgtcacccttgagcaagcacacatgattacagaatttgctgaagcaacttggtggcataatggggaagctatagagcagaaagaagttttatttcaggaagataggaagaaagcagatcacaaggatatccaggttgaatcactctcctgtagtaagcattttactgagatccaggcacagaatgctcaaacacaacaaggtatacaaatgcagaagacattccagagaccttcactatag

SEQ ID NO: 61802 - DNA, 270 bp, Glycine max
  Peptide Sequence Number=SeqID_178580
atggctctttctgtcctaacagtcaagttaatggagcatgggttgctgtctccagaaagagctaagagagcatttgagaagaagcagaggaaacagaaacagctacggacagggactccggttaagccatcaaagccagcaactaaaactgaaacttcccagaagcaacaacagacatccaaaaatggtgacataaaagccaagaaaagaattgtagagagcgacgacgatgatgatttcattttaagtcataaaagaagaaaaggatag

SEQ ID NO: 61803 - DNA, 354 bp, Glycine max
  Peptide Sequence Number=SeqID_178581
atggctctcttgctatggaagaattgtggaaatgtggcaacaaagaggagtgttagaagttgtgaagaaaaacaaggtttggaggggactcaaagagggaaggaattggaagagttcaatctctttattgaagagatggagtttatggacatcccaatgagataccttggatcattgccccttactagtgaaaaacaaccttgtggattgggccctaaaccatttggggttttaaattgttggttccaagatagtaggttctttgaggtgatgaaggatgcttggaggaagcaagatgtagttggatgtggaggagcctatggtggtaaagggggaagtaaagaagttctttga

SEQ ID NO: 61804 - DNA, 297 bp, Glycine max
  Peptide Sequence Number=SeqID_178582
atggttgtgtctaattggtatttttttgtggatacacatttgaaggtcaaatccaaatcgacatcgtcatcttcaaaaacagtaacaaagacaactacaaaagtgagagagaagaaagtctacagtctgcctgggcagaaacatgatcctccagaacagaaagaacccctgagggttttctatgagtcattgtcaaaacagataccaactagtgaaatggcagaattttggttagtatcctttcaatcttacagctgtttacccaccattttcactcccatgaatgaacattggtag

SEQ ID NO: 61805 - DNA, 327 bp, Glycine max
  Peptide Sequence Number=SeqID_178583
atgtttctcttgccaatttgtaaagcatcccgatgcaggtggtaccagaaccttgcatccaaaattaaagaagcaaaagataaaagaggacatgctgtaaaaaattctcaaggaaatgatttgattgttgatccacgtaacttggagtggatgagagaagccaattgtcccattgtagctgatataactcactcactacaacagcctgctggaaagaagacatacactggaaatatattgatagccgtgaatcctattcaaaggttacctcatttgagtgcaactagtaccattgcaaagtataaaggggtggcttttggtgagtag

SEQ ID NO: 61806 - DNA, 243 bp, Glycine max
  Peptide Sequence Number=SeqID_178584
atgcatggaaatatagcaaaccgccgttggcaatggcggtttgctgaccatctcccacgtggcaaggaaaacgccagtggtgatggcgagttcttgacatctgcaaatcgcctctccttctggcgagtccgtgcacagggagttgcaactgccattggcaacttgagggcaagttgcaactcccaccagcgatttagggaagaagaaatagccagtgctggtagcgatttaagtgctatataa

SEQ ID NO: 61807 - DNA, 1680 bp, Glycine max
  Peptide Sequence Number=SeqID_178585
atggatgaagaatccccaataaagacattgaccatttacgaaacaactaggggaaatcaagacgacgtattttacgtagatcctcgcgatgatactatcgacaaaagcccaaaaccaatcaaagagctcatcaacctacaacatggacccaaacctaggcaaaacattcagctcaacaaagacctcactagcataatatgccacaaattggtcatctgtcctcaggcaaaacagtcgaaggaatgtagatttattcgcatggcaaccattggatatgtcagggtatgccccaaggacgcatatcccttgcccagtatcgacaggcttgtggatggtgagtctagcttccaattattaagcttcttggatgcttactcagggtacaaccaaatcaggatgcaccctcatgacgaggaaaaaaccgccttcataactgaagatgccaatttctgttatagggtcatgccctttggactcaagaatgcaggagccacataccaaaggcttatggatcgggtcttcaaaaaacagataggatggaatgtcaaggtctatgtggatgatatggtcatcaagtctcacagcatggcccaacatgtggcagatttggaagaggtgtttagagagattcaaaagtatgacatgcgccttaatcccaaaaagggcacctttagtcctaccaacgtcagagaagttcaaaagctgaacggtagactggcgtctttgtctaggttcctcccaaagctggtggagaaggtaagaccattcaacaagctactttggaaaactaagctattccagtgggacaaggcttgcgagaaagccttcatagcctttaagccatactttctgagtcaccaagtcactgtcaagacgaaccaccctatcaggcaagtgttgcaaaagcctgagctggcaggaagaatgatgacatggtctatagaattgttagagtttgacctccaatatgaacattgcgattccatgaagactcacttcatggcagactttctagtagaattcaccagcaacgtccaacctactcacgaatggtggaacttgtatgtagacggtgtgtccaatgtgaaaggaactggggcagctggcaaaagaagtggtgcaaggaaactcaggtgctatagtgattcacaacttgtccagggacaatttgcaaaaagttatcaagcaaaggagacagttctactcatatactatcacgatgtaaaaaccctggttgatgagttcgattgtttcaaaatataccacatacctagggaaagcaatgctagggcagacttgctctctaagctggcaagcaccaagaagattggacacctcaagaccatcatccaggagacactccaaccaccaacagtagacaccaaggaggtcatgataagaaaagaaaaggaaccagactggatgaacccctacaagaactttttaactcaaggggtgttaccaccaaatgaaagtgaagcccaacgcctaaaaagaaaggctagttactacatcatcctcgacggagaactattcagaagagggttgacaacaccttttctcaagtgtctgaacaacctacaagcagactacataatgcgagattttacagcctccatatggggggcgctccctggcaaccaatgtagtgcacattggatactattggccgaaacttaa

SEQ ID NO: 61808 - DNA, 147 bp, Glycine max
  Peptide Sequence Number=SeqID_178586
atgggttggagaatagtcggaagagatatattagcaatgacaggggagagatgcgccctggggaatggatctcttgtgtttaaaagtgtgaggcctttgaattgtagcaatcaatatttgatgttaggagtaggtggcaacaattga

SEQ ID NO: 61809 - DNA, 949 bp, Glycine max
  Peptide Sequence Number=SeqID_178587
atgttcgagttcaactcaaacatgtttcacaaattcaaggaccatttcttcaagatgcatgatgggaatggggaacctcgtatccccttttacgggcaatcgggccccatgagagtcaaccctcctagagtttctgaagctagtgaggataaagttgttgaggttaaacccgacgtgcttccacctgtggctaccaagaggaagcacaatgaaggggcggaggggtctggtcagtgcaagaagtcgaaggcccctttcagtcttcagactttgaagcaggctattggtatgatgttcggttcaagtcgccctttccctgccaactcccaaggtccacctttagcccccttggttgttcaagttgtcattgttgttgcagctgtttctgaccccccctgttccaccgtctctgcctattcaagcaattcctgctcctttttcctctacaccggctacgttagtccctttggcaattcctatttcttctcctctttcttctactatgatgccattgttaagtgttggtgtgacaacaacaagcgtcttggtgaacctgcctcctccttccttggccttgctatcctcagctttgactgttttgccttcagcaatgccttcctcctctccaggagtcctactaactttgtatccccctttgatcaaaaccttattcgatcagtcggggctctgaataagattacatctttaaaggctgaggtcgccaaatggagagccattgctcagactgtgtggagaatggagcgtcttaaagtggtcgatgatgtctttgctaagttagtgagcacaagactagatggtgacaaggagttcgaactagaggcgatcaaggagaaagaggcgaataaggaactagaggaagaacttctaatttttaagaaagaggtcgtggagcagcaccaggaaaggatttttcaataccgtcaagcag

SEQ ID NO: 61810 - DNA, 240 bp, Glycine max
  Peptide Sequence Number=SeqID_178588
atgaagttaggaaaggaccacgttcaagtgcctcagtatggcaatttggaaggtgttcaacagaaaggtcaagttcaggaccttgaacatgcagtgatagacgtagaagaagggtggataacctggatcagcgcacatgaatgggaacttgtcctccctgcaagcctggacagtcatcttgctggggtcgcttggcttggccagctcaagctcgtactacagagtcttgacacccactga

SEQ ID NO: 61811 - DNA, 681 bp, Glycine max
  Peptide Sequence Number=SeqID_178589
atggttagatcgttgaatattgtgaagggtctggatgtcgcaggaaaaggattctcaagagttttgcagaacagacatccaaacttagttgccagatgtttggaggatttcacaactgcttgtgctctacgccagaaaaatggttcttctcgaatttttaggaccagttccactgatgcaattgacagagaacagttatctgaattctggaatcaggatgaggaagcaaatggatcagaggaagatatacctgattcagatggaagtgtggttattagactatacattcatgtggatgaattttcattggtggatggtaatgagtttgtcaacaacctaacccggtcgaagcttcaatccaaattaggagtaaatgaaaagcttgctatgttacaacgggcagaagaaaacttctatcgaaataataatgcttacaaacagagcaacaaagttgacaaaaatgctatttctgatccaatgcgaggagcaagcaggcaaaggttacaaaatgctctaaaacaggttcaacaacggcttgacaacttcaaggttgaaatggaaacatcagcatctttgctaaaagatgaatgctacaagaaatatggcaaggctgctgaacaacccctcaccccagctgaagagtccctcacatcactacctgagccacaaataccaagttga

SEQ ID NO: 61812 - DNA, 276 bp, Glycine max
  Peptide Sequence Number=SeqID_178590
atggctgcaaatatgaagtcatttatgcctaaaacaaacaatgcaagggagttcatgaaattggtcagggattgctcacaatctaacattattgacaagccaattacgggaagcctatcaaaaatggctaatctggcagcaaacttgaatttcataggaattctagaggaaaggatattaaagaaaatgaaggacaactcaattcatctcatgactcatgatggagccagtactagtaagagcaagcctgataaaaaggacaagggcaaatcctaa

SEQ ID NO: 61813 - DNA, 1245 bp, Glycine max
  Peptide Sequence Number=SeqID_178591
atggctactccagctgcctcgcctcttcctcctcctcctgcagacgcatcagcgtctccatctaccttgaagcggacactggtccacgttgatcctacgaccgacaaggtcgacggtccccacaagaagaaattaagaacatatttggggattgtcgctcgtgataaggtcgatgtggcatacgagaactggaaggaagtccctgctgctcagaaggatttgatatgggaggatattcaaccgacaaggaaattggcacttgcagccgacaaggacagtgtggacgacactgtctgtgaaaaatacgacattagcaaggagaaatgggcccagttttgtcagacctgtagagaccctcgtgggagactagacgaagttgcccagtccggaagcactaagggcgtcattgaccgtccatctcccatcagacgccacgtaaagtggaagatggcccgcaccaagaaatctgggcagacgacgtctgaggcagcaaagaaaattgctgagaagattgatgtcctgactgctgcccttgggcgaccagaacaccctggccgtgtccatgctgctggagtcggtgtcaccataaaacaatacttcggatcggctccacgaacctcccgtagttcttcctccctacctcctgaagacctccatatgcagtcccagtttcagtcacagatgcaatcacaggaacttgcactgcctctggagcctgaggttggtccctcagatgcacgtgtcagcacaaaggagagttgtgtcgatcccttagggaacaatccagagacgggtaagtcaaacaaatgcgggttgtacattgaagaaaatccttctcgcatggtttccctaggaagactttatgagggatccacagcggttcacaacatccctttattgcatgaccaagtgaaggttggtgttgaggaggttaaagatgaagaggctcgcattcctgtacccactgacaaggttaccctagtggggcagacacttaacaccttacttgcttggccgacacatcacgtgaagcgtttatcagaacaggttatgtgggatgctactatgttcggagtgtttaatcaaaacttcccgttgtacataaagcacgaagatctctttgaaattgcatacgattatctgttatacagttgtggattctgcaagtatgcgagcggggaattccgatgtgtatggattcctcaagccacagtccatttagagatctgggcaatcgcaatttga

SEQ ID NO: 61814 - DNA, 936 bp, Glycine max
  Peptide Sequence Number=SeqID_178592
atggaaagtggcaattctgaaaagttgcttaatgttatgaaagaagagttgaaatcaatggatgacaataaattttgggatctagttaagtttcttgaaggtttcactcaaaaagatggcattaactacaaagagaccatctctcctatttctaagaaagaattttttaggattgtattggctttggtggctcattatgatttagagcttcaccaaatgaatgtaaagataacttttttgaatggtgacttagaagaagaagtttatatggatcaacctaaaggtgattgggagatgtatatagatgctgctgaagttatgcttgaggatgatgttgcctcaaatagagctattggttcgtatggagctagtattattcaacatcaaacagagaaacaaaagttttctgttttgactcattgcaatactggaagtctagccacagctggatatggtactgctctgggtgtgatccgtgcacttcacagtgctggagttctagaaagggtttattgcacagaaacacgcccattcaatcaaggatctagactcactgcttttgagttggtgcatgaaaaattatcaggaactcttatttccaattctgctgcagctgcattaatgaaagcaggacatgtggatgctgttgttgttggggcagatcgtgttgcatcaaacggtgacacagccaacaaaataggaaccgacagcgttgccttgtctgctaagtttcataatgtctccaaggaattgttgaacacacatggaggacttggagagcagattgctgcctcaggaatttccgtctggaacccagcttttgatgttactcctgctaatctaatatccgggatcatcactgagaagggtgtcgttacaaagacaactgctggtggtgcatttgacatcaaagctttcgtacagaaaactggttaa

SEQ ID NO: 61815 - DNA, 3162 bp, Glycine max
  Peptide Sequence Number=SeqID_178593
atggctgggaatgaatggattgatgggtacctggaggctatactttcaactggagcatcaaccattgaagagcaaaagcctgcacctgtgactctaaaagatggaggccatttcaaccccaccaagtactttgtggaagaggtggtggcaagtgttgatgagtctgatttgtaccgcacatggatcaaggtggttgccaccaggaacactagggaaaggagttcaaggttagagaacatgtgctggcgcatttggcatcttacccgcaagaagaaacagttggaatgggaggaagtccagagggttacaagccgaagatgggagcgagaacaaggtctcagagaggcagcagaggacatgtctgaagacttgtcagaaggagaaaaaggtgatagtgttgtggagatggtgcaaagtgataccccaaagaaaaaattccagcgccagacttcaaacttagaagtatggtctgatgacaaaaaggaaaagaagctctatgttgtcctcttaagtttgcatggattggttcgaggagaaaacatggagcttggtcgagattctgatactggtggacagattaaatatgtggtagaacttgctcgtgcgcttgccaaaatgcctggagtatatagagtggatctttttacgcgccaaatctcatcacctgaaattgactggagctacggagagcctacagaaatgctaacggcaggtgatgatgatgatgataaccttggggagagcagtggtgcatatatcataagaatacccttcggtccacgcaataaatacctccggaaagaacttctttggccttatattcaagaatttgtggatggagcattagcacacattctcaatatgtcaaaagtattgggtgaacaagttggtgggggccaacctgtctggccatatgtaattcatggacattacgctgatgctggagatactgctgctattctttcaggtgctttaaatgtaccaatggtgcttacaggtcattcacttggaagaaacaagcttgaacaacttctcaagcagggacgccaatcaaaagaggatatcaattcaacttataagatgatgaggaggattgaggcagaagaactttctctggatgcagcagaacttgttatcactagtacaagacaagaaattgatgagcagtgggggctttatgatggatttgatgtcaagcttgagaaagtattgcgtgctcgtgctaggcgtggtgtcaactgtcatggtcgatacatgccaaggatggcggttatccctcctggtatggactttagcaatgttgtgcgtcaagaagatggccctgaaattgatggagagcttgctcagcttactgctagtgtagaaggatcttcaccaaaagctatgccttcaatttggtcagacgtaatgcgtttctttagaaatcctcacaagccagtgatcttggccttatcaaggccagatacaaagaagaacttaaccactctgttaaaagcctttggagaaagccgccccttaagagaacttgctaatcttactctcataatgggaaatagggatgacatagatgagatgtcttctgggaatgccagtgtgctcacaacagtgttgaaaatgattgataagtatgacctatatgggcaagtggcataccctaaacatcacaagcaatctgatgttccggagatataccgatatgctgcaaaaacaaagggtgttttcatcaatcctgctttagtggaaccttttggtcttactttaattgaggcagcagcacatgggcttccaatggtggcaactaaaaatgggggaccagtggacattcatcgggccctgaacaatggtttgcttgtggaccctcatgatcagcaagcaattactgatgcattgatcaagttgctgtcagacaaaaacctgtggcatgattgcaggaaaaatggttggaagaacatacaccttttctcgtggcctgaacactgccgaacttatttgactagggtggctgcctgcaggatgaggcatccacaatggcaaactaacactccagggaatgatatagctggtgaagagtctttcaatgactcacttaaggatgtgcaggacatgtccctgaggctctcaattgatgctgacttagcaggtttaagttctggatccgacatgcaagaccaagtgaagcgcctcctaagcaggatgaagaagccagatgctggtggttcaaatgactctgatggtgggaataagatgtctgacaatgtaactgggaaatatcctctactgtggagaagacgtcggttgattgttatagcactggatttctatgacaacaatggagctcctgataagaaaatgatccagatagttcaaaggatcattaaagcttctcaactagaccctcaaaatgcaagagtttcaggatttgctttgtcaacagctatgccaatgcaagaaaccgtagagttcttcaaatcaggcaacattcaagtaaatgattttgatgttttgatttgcagtagtggtagtgaagtttactatcccggtacttacatggaagatggaaagcttttgcctgatccggattatgaagtgcatattgactatcgttggggttgtgaaggtctaaagaaaaccatttggaatcttatgaatactgctgaaggtgaagaaaaacaatcttcgagccccattgtggaagattcgaaatctagcaacgctcattgcatctcatacaaaataaaggatctcagtaaggcaaagagagttgatgacttgagacagaagcttcggatgcgaggcctacgttgtcatcctatgtactgcaggggatcatcttgtgtgcaggttattccactccttgcatctagagcacaggcactcaggtatctctttgttcgttggggactgaatgttgcaaacatgtatgtctttcttggagaaactggggacactgattatgaggagttgatttctggaactcacaagaccataatattgaagggtgttgtgtctaagggttcagaaggaatacttagaggtcccggaagctaccatagagaggatgttgtacctaatgagagtcctcttgttgcatgcattagtgaaacaaccgaggacaagattgccaatactttgaaggaactatcaaaatctggggcaatgtga

SEQ ID NO: 61816 - DNA, 141 bp, Glycine max
  misc_feature (20)..(20): n is a, c, g, or t
  Peptide Sequence Number=SeqID_178594
gatgtcaagacatctcacgngacatcagctttctgctccccctgtctccatgctcctactgttgtgaagcagttcactgcggcattctgcaagttgcaaatctacaagtcttttccaggatgtcaagacatctcatggtga

SEQ ID NO: 61817 - DNA, 222 bp, Glycine max
  Peptide Sequence Number=SeqID_178595
atgaaggtggtgtttgtaataatggaagctggaccttgccgttaccacaacacaaacgaaactttggattgctactgtagtataatgccttgtattgttatgattatccatctggaaaaagggatgaatttttggggcatggaatggagtggagctatagtaaaggaaggagatggtgtaaggtgtgacccccaacccagcggagtgagaaaatcaaactag

SEQ ID NO: 61818 - DNA, 822 bp, Glycine max
  Peptide Sequence Number=SeqID_178596
atggaagcgcaaacaattttacattcaaggagactattccaacaatttattgttgatggctataccgtggtagaatcagagagactttcattcatcagaagaaaccaatcaaaattaagggtgaacaaatattgtgatatgcatgaaacatctaaccatggtgctattcaagggtcaaacagaggcaagtgggtcattttaccttctacatttgttggcagtcgtaggtacatggatcaattgtacttcgatgacacgtacaccattgaattccaaaaaagtggactgccacatgcacatttgctcctatttttgcatccatcgagcaagtatccaacacctaaagatattgacaacattatatgtgctgagatgccatcaaagaatgagcaaaatgaactttaccagctggtccaaacacacatgatacacggtccatgtggcatagccaaccgatcatcaccctgtatgaaggatggaaagtgttcaatattctatcctaagaaattccagacttgcactgtggttgattctgatggatatccaatctataggcgcaaggacactagtaacacaatcctaaaaagtggtgttattttagacaactacagtgttgttccatataatccaacacttctactcagatatcaagcttacattaatattgaatggtgcaatcaaagcacatcaattaaatacctctttaaatatatcaataaaggctatgataaaattacggctactattgagaacaaagaagatgttcataagaatttagatgaaatcaaacacttcctagattgcaggtctatcacaaattaa

SEQ ID NO: 61819 - DNA, 360 bp, Glycine max
  Peptide Sequence Number=SeqID_178597
atgttggatcattgtaattcacatgcaaaatgctttcgaatggctagggatatattaaaagataaagttgttcctgatgttaaattgaagctcatttctaatagagagaaggatggaagaattgacaatataccaacagtctctgaagttgctacacttattactggggatgctgaggtaggtttgacacaggatatcattctcgaaacacaaactggacagttgcagaggataaatgaattacacaccagttatctagccctacaataccctcttttatttccatacggcgaggatggatataggcatgatgtcctccaccgaaacacatcaatgaatcaatctcaaaaacgggtgtga

SEQ ID NO: 61820 - DNA, 196 bp, Glycine max
  Peptide Sequence Number=SeqID_178598
atgactgaacttttcgccgtagttaaaacaaatacccttttcgcggtgtaccgccctcttttccggagagagacgcttgaaggacgtatctcaagtgctaacagggaaatgaagcaactcaataggaaggggggagggcccccgtggggtcttcgtactgcgacaaagcaaaacaagcttgcaacgctagaagaag

SEQ ID NO: 61821 - DNA, 1005 bp, Glycine max
  Peptide Sequence Number=SeqID_178599
atggtgggtaatgggaatgaaattgagtgtcatcagctttgtacgggagtggtcattcatgttcaggtccaagccttcactgttgatctacatgtcttaccattgtgtggggcggacctcatgctggaggtccaatggctgaaatccttaggacccgttttcaccaattacaatgacttgacgatgaagttcatgcactctggtaggatggagcaagtggtttttttaacatttgtgtcatatccatcgagcccccttaacccaaaccaacaactcacttcaccactacccaaaaatatcgaccctaactcacaaattcaccacccttttccaagctccgatgaccttaccaccgaaatcaaaaatcaagttaggtccatgttgcaaaatgggattattcgccaaagtatgagccttttctcttcccctgttctcttggtcaagaaaagagacagttcttggcgatttagtgtggactatcgtgctctcaacgcgattatgccccattacactgcacatacagttgcacttcttttcatggatattgttggcaaacttcatggtatgcctcgaagcctagtttcagaccgtgatctattatttatcagtcgttttgtgcaagaattgttcaaattgagtgggaccaagttaggggtgagttcagcatatcattcccaatttgatggacagatagaggctgagtggtcttacaacacatccaggtattctactggtgtttctctttttgaaattacctttgacaagaaacctcctagctttccacaatatcttgttggtacatccaatattgaagtagttgatgattttttgactaacagggaggtcgtgttcgccagtttgaaaaagaaacttatgaaggcacaaaaacgtatgaagcaatttgctgacaatcatacaagagaggcagactgggctagtttggaagttagctatcaccttaaggacaaggtatttttagatggcataagggatgataggaaatga

SEQ ID NO: 61822 - DNA, 180 bp, Glycine max
  Peptide Sequence Number=SeqID_178600
atgacccccaatggtttgattcaacaaaaatatggaaacaaaaataaaggaactagaattggaagaggccacaatccaaggattgataagtctatgaatgccacaaggataagcacccttgataagttcagagtttctaaaaaagaacctaagagaactagtctaactaacaatggatga

SEQ ID NO: 61823 - DNA, 354 bp, Glycine max
  Peptide Sequence Number=SeqID_178601
atgccggcggcgacttccaccttgaaccaactgttgtggggattcgcggagagggaacgaaggggtgcagagagaggaggggttggggaagaaatattgtctcaggccaaacctgatgaacctgaaatgtttgatgttgtgaatgacagaaacactttgaaggaacccttcctagggctatgcaaattgaagcaagctttatctttagtggacctgccagaaatgaaatggcttacagattctttgcttagggcccaggacaacatgcatactctacaggaagaaatttccacaatcaaggaatcatcccgtaactatattgatcagcttagtttttctcttttgctggcttag

SEQ ID NO: 61824 - DNA, 805 bp, Glycine max
  Peptide Sequence Number=SeqID_178602
gagagaaaatgaaagaaagcctcaagaggctaacattaacctcccatacttccatgggaaggacaatgtagaggctaacttagattgggaaataagggtagagcaacaacttaaaagaaagtctacttcaaaatcttatggctctcactcttatccaaagaaagaccaaggtcaaggcatcttagggatgacaccttctaagcccaaagatgataaggggaagactatagaaaagcagccccttaaggctagtatgcaagagaagactagctccataaagtgctttaaatgtcttggaagaggacacattacttctcaatgccccaccaagaaaaccatgattatgaggggccaagacatttatagtagccaagatgaggctactacttcaccttcctctagtgaaagtgaagaagcgaaaggggaagaatatagtgaagaaatctacccccaagaagaaggacaacctttaatggttaaggaggagtgtaaggaggtaagtgtctcctccaagaggttagctaagaaggaaagtcattttgaaataaagacaaacattaaagaaatttcccctcttagacaacctccacatcttctcctttgtaaaaagacacttgtaagcacttccacacctcttaggcttgaggttattcctcaagtaaaggagttattggatgagggtttagtttgtaagagcttaaatccttgtgctttgttggtgcccaaaatagtggtcaaaggtgttcccatagaccctaagagaataaaggtcattcctgattggcccactccaccaagtataaag

SEQ ID NO: 61825 - DNA, 177 bp, Glycine max
  Peptide Sequence Number=SeqID_178603
atgagaaagaagaagattgcaagttacgggagtcgatttgatgaagaaatgagtaagataggaaggtttgaaggtttgggaatggagggacgtcgcaaggaggaaggggttgcgcaggggtttctggaaaacgtgctatttatagaccaggacgcatggccatctgttctagtgtaa

SEQ ID NO: 61826 - DNA, 360 bp, Glycine max
  Peptide Sequence Number=SeqID_178604
atggcagaatcgtcaaagaaacgtaagggttcatccgcctccgcttcggcttcaagagctcatcattccggagccaccaacgcatccacagcaccaattccaccctccatatcctcttccacattgttttcttccgaagaacagcagaaacggtactcaaaacttttctcatctcgtaccattatcgaccctaagttcatagatatggaattcttttctgctgaaagttttgattgcattcaggcatttcagaatttaggtctcatacctttcatgtcattacaattgcttgtttatcctgaattggttaaagctttttattgtaaccttgaaattcaagacaacactttgatttctgag

SEQ ID NO: 61827 - DNA, 936 bp, Glycine max
  Peptide Sequence Number=SeqID_178605
atgtgcttacaggctctaggatttccaatgccttattttgcacatgtttctttgattttagctcctgatcggagtaaattatcaaaacgacatggggcaacatcagtgggtcagtttcaaactctaataactgctcaatcacagttccgggagatgggatacctaccggaagcaatggtgaattacctagcattattaggttggggcgatgggactgaaaatgagttttttacacttgatcaacttgttgaaaaattcactatcgaacgtgttaacaaaagtggtgctatttttgactcaacaaagttaaggtggatgaatggtcagcatttaagagcacgtccatcagaggagttgaccaaacttattgcagagtactggaagacatctggcttactcacagtatcagatgggccctttattgatgaagcagttcacctacttaaggatgggattgacttgataaatgatgcagacaaggcccttgctaacttgctttcttatcctgtgcattctactttacagagttacaactttctacatgttgatggcagcgatgaagcagaatctgtcttgctagataatctttctgaatttgctgctagcctcttggctgcctatgatagtggtgatctggtagcagcacttgaagaaggccataccggctggcaaaagtgggtgaaaggctttggaaaatcgctaaagcgcaagggaaaatcgcttttcatgccgctccgacttctgttgaccggcaaactccatggacctgacatgggggcaagtgttgcattgctctatagagctgggactagcaatgtagtagctcctgaatctggctttgtgacactggatgaaagatttaaaatgcttaggcaaattgactgggaagcattgtccaaggaccaacctgtcaaagagactgctgctcctgtctaa

SEQ ID NO: 61828 - DNA, 334 bp, Glycine max
  Peptide Sequence Number=SeqID_178606
atggaagctgtcaacaacaatgaaggtcgcatgttttttctatatggatatggaggtacaggaaaaacatacatatggagaacattagcaaattcactgaaggcaaaaaatcaaattgtgattatggttgcttctagcggcatagcttctctgttattgccaggaggcaggactgctcattccaaatttaagatacctgtgccaatttttgaagactcaacatgcaacatacttcaaggaagtcaactagcagaattgttaaatcagacaaatctgataatttgggatgaagcacccatggcacacaaattttgcttccaagcacttgatcaat

SEQ ID NO: 61829 - DNA, 453 bp, Glycine max
  Peptide Sequence Number=SeqID_178607
atgttggttcttcttctaaaatctgttacattcgttgtagtaacattatggagtctactaacacgtttgatcttcaacacaattgcttacacaattgtgttgttactccaaggtctcaaaggatctggtgaaggctcacttggaatttttcaacaagttgcagatggcataagggggtgcttcgagttcatccttcagattacaattagctcaataaattctataatctctaacgtgtttgatattctcaaagagagcattactgggtcagtggctgcttcaggatccgtggctgcagaacttgcagagaagctcaagacttcacttaaagagtctttgaaacaggtgccacagctatttgaagaactctcaaatatgatgtcagagatggtgaaagaattgtgggacaactacaagggtgctgtgggatacgttacagagaatgttgcttga

SEQ ID NO: 61830 - DNA, 270 bp, Glycine max
  Peptide Sequence Number=SeqID_178608
atggctatttataggaaaaggccatttagtgcaggggaagctcacccaggagagatggagctcgcccaggcgagctggagctcacccaggggaagggttttaggggttggaaaactgaggaaagaagggcaaaacgtagaaaaggggaaagaagagaagaaaaaaaaaaagcaaagtcgaggcgctgccgactcgaactgtggatcatttcttacatcatttctcttgctagccttgtaccctgtgcaacagtcaattagtttttcttaa

SEQ ID NO: 61831 - DNA, 237 bp, Glycine max
  Peptide Sequence Number=SeqID_178609
atgtctcatcctactcaatcaagtgagttaaactctcttagacattatgatgtggacatggcaaggactaagggcaaggaatctttagaaggaattggaggacatatgacaagggctagaacaaagaaggccaaggaagctcttcaacaagtgttaaccatgctatttgaattcaggcctaagttacaagtggagaagtttcggattgttaattgcactatgtttcaagaagagtag

SEQ ID NO: 61832 - DNA, 348 bp, Glycine max
  Peptide Sequence Number=SeqID_178610
atgaaggatgagaacgggcttccaacgacgacgacaaccgcggccacgaagaaggaaagcatggattcgagtctgtttaggaaagggaggaaggaagaagaagcattgcacgccagtggacttccatacacagtggctctttcagtgatattgactgctgccggagttctcattgctacccttggagatttttcctttgacctttttgggtatagcatggcctttgtttccatttttttcctgggtaacaatatgctcaatggtataaaagtggaaaattcggttgcaccgtcgctaagagccaatgtctcaattgttggcacactagggtgctttactcagccttga

SEQ ID NO: 61833 - DNA, 150 bp, Glycine max
  Peptide Sequence Number=SeqID_178611
atggatgactttaatgagcctggatctcttgctccaataggattgtatctcggtggcaccaaatatatggtcatccaggctgaatccggtgctgtcattcgagggaagaagattttagttaatcatgaaataaaatcacagtctacttag

SEQ ID NO: 61834 - DNA, 447 bp, Glycine max
  Peptide Sequence Number=SeqID_178612
atgctgaaatttacagcggtccaacttgttgatgatgaagccgtgaaagactcacaagcatttgatgctactgaggatcaaactcacccatacttgagtacccttacagtagagcctacatcatcaatccaaccaaatgaacttgagtttacaatagaccctggcttacctaacaaaggactcagcccctatagtgaggatgaagacaaagttctacacaatcaactccaggaggaagatgataaggaagaagttgagcctgtttcaccaatcacaaccataccaccatactacataccaccacacatgcaaaattttgaagaatccaattttcaagattttgcatacgaccaaagcttggattgcgaaaaagtccaacatccgatggggactctctttgaagggatgtgttttctgacaaaacaagaagtacaacatgctttatag

SEQ ID NO: 61835 - DNA, 948 bp, Glycine max
  Peptide Sequence Number=SeqID_178613
atggctaagagtagtgcagaggcagaatatacaacaagcgctgaaggggtcagtgttgtgaaagccactgagttggagagcatatcatctcatatgggttcacttgcattgacagatgaagcatcgattggattcaatcaacatgtgaagcaccaaaatacacaacaggcagaatccgaaactagtttggtatatgagggaggcaacagttctccactgccaaagagaacaatagttactcaagatcatctgcagcaattcaaaaactttttgaggcaaccagctacacaatcttggatagtgggattgtcatgtcctacaacgacgtcaatccattcaacttcagctccaatgctgaattctataactcattgttctaattcctgtatagatagtggttcacatgtggctgcagaaccttatgggaacctgaatgttaatcctcatcctataactcaaagggatgttaaatcaccaaataattccctgaaagacaccaatacaatgtcaattgatcaggtggcaagggaagtccaagattgtaattcactaattgatgcagagttgacgcttaagcaaagtgacccatcaaaggagcaacaaggatgtatgttaaaggatataagtatttcaaaatgtacctcttgctgtgatgaaatgttaagtaaaggggaagagtctacaactgttaccaacatacagcctcaggccttcctaacaattgcctatgaccctgaattgtttttcaaagtcaatggaaagctttatcaatggcttggcaagataggtagtggtggaagcaatgaggtgtcgcaatgcgcccttttgcgggcgagcgagggcgaggctcacgggtgcgctttccaaaggaggaaagatgcgcggagtcgccaccaacatttatttgtggaaaacgtcggaaaaaccgaaggaaaccagtcaaaatga

SEQ ID NO: 61836 - DNA, 372 bp, Glycine max
  Peptide Sequence Number=SeqID_178614
atgaggggtttgaatcaattaggggtagtagttgagaccatctacgaggaagaatgcgagttttcttcctctaaatcctctccttcttccccttcaccatcattttcctcttcttctgcatctctccactccagagtaaaggcctggtctctgaaaatcagccacgaaacaaatgtcttgatacgagttcaaggaatatgttttcatctacgcaaggtgaagtggctatggcctgtgtctgtgaaacaacaaagagagtgggaacgcgttgcgtacacctcacatcctcctcctctacataagcgccctcgcatcccattctttgcagactcaacaagcattccactcacacctcatcgtttctctctctag

SEQ ID NO: 61837 - DNA, 177 bp, Glycine max
  Peptide Sequence Number=SeqID_178615
atgatatccgctggtggtttcattggaatttgggttgctttgaccatctatatgggtcttagggcatttgctggcttcttgaggaccttgggagttcctaaggagctcatgactgcacatggcagacaccgtagttatagcttcatattaggcctaggtttcagtggtgtttgctga

SEQ ID NO: 61838 - DNA, 267 bp, Glycine max
  Peptide Sequence Number=SeqID_178616
atgaaagttgtagtagggaaatattactcgagtactactactcactcaaggtgccaacggcatgctagagatccaaggataggcagtggaccaattgtatgggaaggagatagacaattgtgtcacacatccttgattgcaagtctggtagtttctattgtggatcctcaacctggtcaagctatcattgattgttgtgttgtccctggtagaaaaagcatctacatggcctctcatttaagtggccaaggcttgaggacacattga

SEQ ID NO: 61839 - DNA, 180 bp, Glycine max
  Peptide Sequence Number=SeqID_178617
atgaagcttgctaaagttgctcttagacctggggttggcatcatggtcaatggaattctccgaaaggtagttgtgctgaaggagaaggaaagtcttcctttccccaaagtgaagggtgatgattgtgctcaagcacgtgctttggcaactctgtactcacatccagttgtgagtgtttga

SEQ ID NO: 61840 - DNA, 327 bp, Glycine max
  Peptide Sequence Number=SeqID_178618
gtcaagggaaaggaaaaagaggaaaaagattcctccaagaagattgttaagaaagaaaatcattttgcaacaaaagatgatataaaaaaagcactccttcttaaacaatctttctaccttcccctatcaagggaaacatcccttagcactgccatacctcttgagcttgaggttattcctcatgtaaaggagttgttggatgagggtttggagctcatatgggacaccataggtttgtcgtactttttggtaggaataatgaacatgaaaatacagaaaaaggtgttgatggaagaagcccagagtttcaagaacctctggatttga

SEQ ID NO: 61841 - DNA, 324 bp, Glycine max
  Peptide Sequence Number=SeqID_178619
atggtaaaaacacgacggaggtggcggcgattggctaaatggcggcgacagacgcaaacagcaatagcacagagatgtcgcacggaaattagggagaatgtaaaagctttccagggactactcacacgttccatttggagttctatagtgtcctctattccctgcatgaggcagataggtcaagtggatgattccatacttgctgacgttcaacaaaagtttggactcaacactagacaggacgatcagctagatgcaatctgggaaaaggctgctaaagaagaacgagtggatgcagaagcaaaagtttctcaagctgagtaa

SEQ ID NO: 61842 - DNA, 288 bp, Glycine max
  Peptide Sequence Number=SeqID_178620
atgcaacaacaacaaggtttattaaggtttcttcctcaattttcttcttcttcttcttcttcttctttttctccttcagcacccagaaagcatcacagagtcaactttgcaaatgctaagtacctgacagggatgaggtgtattagggtggcgcctcctattggctacacacaaggtaatgcttcttgtactaagaaaacacctgaaaagaaggtgtcaatcaaagtgacatctcttgctacagggcactcaaggcggcgcctcctgcatcctacatggcaaaaataa

SEQ ID NO: 61843 - DNA, 1179 bp, Glycine max
  Peptide Sequence Number=SeqID_178621
atgaatattagtaaaacaatccaaaacaaagccttattgcaaaatatcacattgaacccagattctgcttgcaaaattgttactctgatagcaaaatcaaattcaaaatcaacatctaaaagggaaatgaaacaacaaaatggaacggaagcattccttcagcatgtcaacggccgcttccatgcatttgagaaggcccatacaatggatccaacatcaagtgggcgtggtgttcgtcagttcaagacttacctattgcacaaactggaaaaggaaggggagcttacagaaaaacttgttcaaagaagtgatgctagggagctgcagacctactaccaacatttctatgaaaagaaaatccgggatggagaatttaatcaaagaccggaggagatggctaagaatgttcagattgccactgtattgtatgaagtgctaaagactatggtatctccacaaaatattgaggagaagacaagaaggtacgctgaggatgttgagcataagaggggacaatatgaacactataacatacttccattatatgctgttggtgttaaaccagcaatcatggaaattcccgagatcaaagcagcaattgctgctttatgtagagtggataatcttccaatgccaataattcgggcaagacctgatgcttctcatgatgattctacaatgcctacggataggcttaaaaaagtgaatgatatacttgattggattgcctcagtttttgggtttcagctccatgtagaaactgtagagaagctgatggctaaagttttcaaaaattatgagtcgtggtgccattatgtgcgctgtgaatccaatcttaggtttctagaagattatgacttgaaacaaatagaattgatatatattgcactttatcttctaatttggggagaagcttcaaatattcgctttatgcctgaatgtctttgctatattttccatcatatgtgccatgaagtctataagattttagataagaatcctgctcgtgtgactgggagcaaagacttagtagaaggacgagatgatgaatattttctgagggaagttataactcctatatatcaagttttaatgaaggaagcaaagaggaacaacaaaggcaaggcaagtcattccaattggagaaattatgatgatcttaacgaatacttttggtaa

SEQ ID NO: 61844 - DNA, 225 bp, Glycine max
  Peptide Sequence Number=SeqID_178622
atgtctttgaaatcaagtgctcccttcccatttttgctatcattgcctttcgctcatgctctctcggtctcttatgtagctttctctcacactgacccaactccaccacaagttagagaagccacagatctaaccaaaaaagttgtagatctagcatccaaagttgcagatccgttgtcccctcccacctccttgaccatgggtattgtgaacgtcgtcgccatg

SEQ ID NO: 61845 - DNA, 540 bp, Glycine max
  Peptide Sequence Number=SeqID_178623
atggatcatgcagctgatgaggtccatgaacaacctgaagaagcagctactgatgatgtagttcctgatgccgaggtttttccaggtgggccccatgacaaatcaattctgattgactatgctcatcatgttgcaatgaatgtttggaatggagaggaacgtcctgagttgaagttatcttcccatggaaagaaggttgagaaatttggtaggcctgctccagagattgaaggcttagtcgttgccacaggattaagtcctccgatcacatgttccttggacactggcaaacggggacttatattagcttttgcggagaggtggcataaggaaactagtagtttccatcttcctgtaggagaggtaactatcaccctcaatgatgtggcatcattgcttcatctacccatcacatgcaccttccatagctttgaggctcttcatatggacgaagccatgttgctgttagttgaattgcttgaagttagtgctgatgaagcaagagttgagacagtacaatgccatggggcatatatttga

SEQ ID NO: 61846 - DNA, 1206 bp, Glycine max
  Peptide Sequence Number=SeqID_178624
atggagacgatctcttttcataaatctgtaacctgcgatgacattggtaggcttaccaatagtctaacagtcaccaagaggcttgcacttaaaaagcaaacacaaaagccttcgtccattactgaacgccttagggcactcagtgagactgagagtgaggatgataagccttttgtcttcagaaaacgcaaagttgcaccacgttcaaatgagacctatgcgcctcaagtgaagaagagatggaagataagtcagggtagacgctacaagggttaccttgataagtccgagattggttcaacaaggaacccagagagaggctctcacaaaaaacacatgtattttctcaaaatgccaaaagtttattttcttgaaaatgagttcaatacatatagtatagttgagcaacaatcaagattcttggtagtgacgctgggccttcatccttcttcacttgagccttatcaaggtgagcaatcctccattcctgatgatgcttccaacaacccttttccagttgatattccacaaacttccattgccgatatggacgatgtagttcggtttgaagcacgtctatctctcatacaccttgatcgcttcaaccatcaaggttcccatgctgtagaccccaacctcacagttgaagacattgcaagcttatgttttccgatgcaacttcaccccatggtatccaagccttcttttatcacagatctatgcaaaaatgtctataagatcccttctagggcctacagagaaaaggtgagcaatgacaaagatatcattggatggtttcgcaagattgacgcccaacacatcaatccatcctctgatgatttcctgccaccttttcgtgtcaaggctgccccccttggacttaaaaaagaagaaaggtacttaacaagggatgttgttacgaagattattgcattgaattctggtgttgagtttgatcaaagtgatgccatgctcttttattttaaagacatgcaagaaggagataatgagttttatcaacgcttaatccatgatactcctcattttcactctttgtttgtctttgacttgcccaagtactctgaagttgtaatgagaagagccattgtcactacttgggcaaggattcctacacttaaagagcgttcattctctactgaccagaacccttgggttctaggtcaaggaatggtggctaaactttag

SEQ ID NO: 61847 - DNA, 243 bp, Glycine max
  Peptide Sequence Number=SeqID_178625
atggccagcaccagtggcacaaagggtggtccttttgagatgggtaggcagccatcaaagaggatggtgagggctcctaccaggaatgtggacttgggaaatgaagggggtgttgtggacagtgagattgttccttcttcacttgctgtgcttgtgcctattctcagagcagcccttgagattgacgaggagaatcccagagttgcctatctttgtgagtattttttcattgggttgttttga

SEQ ID NO: 61848 - DNA, 3405 bp, Glycine max
  Peptide Sequence Number=SeqID_178626
atggggatgtctatagataactaccagtggcatgagttctttccagaaaatgagactcacaatatatgtattgtcattgcaatatgggctccaattattctggtttattttatggatgctcaaatttggtatgctatttatgccactctatttggtggcattattggagccttcagccatttgggagaggatgagacatatgaacggcaaaatattgcatacttttctcaggtttggaatgagtttataaattctatgagagaggaggacctcatcagtgacagggatagagatttgcttcttgtcccatacagttcaagtgatgtttctgtcattcagtggcctccattcttgcttgctagcaagattcctatagctgttgacatggcaaaagattataagaaggagacggatgatgatttagttagaaagattaagagcgatgggtatatgtattcagcagttgttgaatgctatgagactctcaaggacatcataatgagccttctgcttgatgaagatgatagaagggttgtgaggcggatatgcggtaaagtaaaagagtgcatacatgaagaaaaatttgtcaaggaattcaatctgagtggcttaccttcactcagtgagaagttagagaaattcctaactctactgcgatctgaagatggcaaactagaatcccagatagtcaatgtcctgcaagatattgtagaaattatcatacaggatgttatgtttgatggccatttgttgctgcaaacacctcaccaatatcatgtagagagagggcagaagtttgtcaacatcgacacttcttttacacataatagatcagtgatggagaaggttattaggcttcatttgcttttaacagtcaaggaatcagccataaatgttccccaaaatatagaagcccgccgccgtattacattctttgcaaactccttatttatgaatatgccaaaggctcccaaagttcgggacatgttgtccttcagtgttctgacaccatatttcaaagaagatgttttatattctgatgaggaactcaataaggaaaatgaagatggaatatcaattttattctacctaaccaagatatatcctgatgaatgggccaatttcgatgaacgactaaaaagtgaagatcttgaagaagataaggaggagttcactcgacggtgggcatcttacagaggacaaacactctatcgaacaggaatgatgtactattggcaagctttgatccttcagtacttcatagaatctgcgggagacaatgcgctctctgaaggcttccggacaatggattcctatgacaaaaagaagaagcttctcgaagaagcacaagctatggccgatttaaagttcacctatgttgtttcttgtcaagtgtatggttctcagaagaagtccaaaaatactagagacagaaactgctatactaacattctcaatctgatgttaacgcattcagcccttcgtgttgcttacattgatgaaacagaagaaacaaaggatggaaaatctcaaaaagtttattactctgttcttgtcaagggaggggataagtacgatgaggaaatatatcgtatcaagctacccggtcctccaactgaaattggtgaagggaaacctgaaaaccaaaatcatgctattgtatttactcgtggagaagccttgcagaccatagatatgaatcaggataactattatgaagaagctttcaaaatgagaaatgtactggaagaattccggagaggacgtagtggacaacggaaacccagcatattgggtataagggagcatatatttactggaagtgtttcttcacttgcttggtttatgtcaaaccaggagaccagtttcgtgaccattggccaacgaattttggcaaatcctttaagggttcggtttcattatggccatcctgatatatttgacagactcttccacataacaagaggtggcataagcaaagcatcaaaagttataaacttaagtgaggacatatttgcaggtaaggggcgtgacgtgggcatgaatcaaatatcactctttgaggccaaggttgcaaatggaaatggagaacaaacacttagccgtgatgtttatcgacttggacgacgatttgacttctacagaatgttgtcattctacttcacaacagttgggttctacttcagtagcatgataactgtgttgactgtgtatgtgttcttatatggacgtttatatatggttttgagtggagttgagagagaaattcttcaaagtccaaacatacatcagagcaaagcccttgaagaggccttggcaactcagtctgttgttcagttgggcttactgcttgtgctgcccatggttatggaaatcggcttggagaagggatttcgcactgccttgggtgattttatcatcatgcaacttcagctagcctctgtgttctttactttccagcttggaacaaaagctcattattatggaagaacactcttacatgggggatctaaatacagatcaactggtcgtggatttgttgtcttccatgcgaagtttgctgataactacaggatgtactcacgaagtcattttgtgaagggcctagagatactcatactattgattgtttatgaagtctatgggagctcatatcgcagctcacatctttatttattcatcacaatctcaatgtggtttttggccacttcctggctgtttgctcctttcttgtttaatccttctggatttgattggcaaaaaacagtggatgattggacagattggaagcgatggatgggaaatcgtggtggtattggtatttcatctgataaaagctgggaatcttggtgggatgaagaaaatgaacacctgaaatactcaaatctcagggggaaaataattgagatagttcttgcatttcgcttctttatgtaccaatatggaattgtctaccacatggatattactcatcataacaaagatttgctggtatttgggctttcttgggcagttttagtaataatactaattgtattgaaggcacttctttttcttggcttcttgtcagtcatgactgtattatttgtggtatgtggacttaccatagcagatttgtttgctgccattatcgccttcatgccatctggatgggcaattattctgattgcacaagcatgcaaggtatgcttgaaaggagctaaactatgggactcagtgaaagaactatccagagcttatgaatatgtaatgggattaataatcttcttgccaacagccattttgtcatggttcccatttgtgtcagagttccaaacccggttgctattcaatcaagcatttagtagaggtctccaaatttcaatgattcttgctggaaagaaggatacttataaatctgattga

SEQ ID NO: 61849 - DNA, 297 bp, Glycine max
  Peptide Sequence Number=SeqID_178627
atgatgaatccaactcagtttcaggccaaagaagagaaggttcacgcagctaatgactcgcttagcgagcgcacagccagcccacctagcgaggtcgttgtctcttctcacgctcagcgtgcccactctcgcttagcgaaaattcacttactctcgcttagcaagcaatgctcgctaagtgagccgtgctcgctaagtgagccttcagaagctgaaaggtctggagagacaacaagcagtagagacacgagttttggagcaacagaggtgcttagtccagaaaatatagagacttag

SEQ ID NO: 61850 - DNA, 327 bp, Glycine max
  Peptide Sequence Number=SeqID_178628
atgaaagaaaggattgcgagcttgttctccatcgaatccttgaggtggattatgaggatttcgctccgatcaaaacgttcctctccgtatggtggttggtggcaagcaacggtggctcatggtggccaccggtggtcgtgggtggtggagaagaagatctcacttaatgagcttatctcgctaagcgagaatccacttttggcgctaagcgtgagtttttgcactaagcgcaattcctctcgggttgggattgcacttagcgtgagtgtgataggcaagaagtcaagttatttttcaaatccaaatggtcaaatcatgaagaattag

SEQ ID NO: 61851 - DNA, 930 bp, Glycine max
  Peptide Sequence Number=SeqID_178629
atgggctacgtgggagtacgtgagctcagttggaggtgggcaacaggggatggtgggtttatgcgcgatttgtggatgtggaaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtgtggtggctggccagctgtgaatcttgaagctaggggagcttctggtaatcgattaccaggggatgtaatcgattaccaggcttcaaaagggaactggaagactgtggaggcctctggtaatcgattaccagtctgtttaatcgattacacagaggaatgggtcactggtaatcgattaccaggtatgtgtaatcgattacacagtgcctttttcaggttttcatgtcctgaagctatcgtgatggcggcgcagctaatccatgatcgagtggagatggagtgcctagatggaacttgggagaccctcgaaggcaacacgaggtgccgatttcggggcacgattcgatttacggctacttcattggtgcatccagatgaacccgtgtgcacgcttcagcgtactgtggagtggatactacccacgcctacaccatatcgtctagtggagccagtccaagtgatcgaggtaacgtcatctgaggaagaccctgaggaggatcttgaggagctacctcctgagcctgctgtggatgctcttgactttctagagggtgatgaggatccccttcctgaggtggattctcccgaggacgtcatgtcggcatctgaggcagactctacagaggataggtgggtgtatctaggactgactgttaggtttactcttttgtttttgtatgggtag

SEQ ID NO: 61852 - DNA, 420 bp, Glycine max
  Peptide Sequence Number=SeqID_178630
atgcccgggttgggtcgggattggtcaagcttggttttgggcaatagcaccccacctgacgtccccaaggattatggggtacccatcacatgtggtactaggtggcggtcgggcgatggtgcacaacaagtttttccacatccacaaatcgcgcataaacccaccatcccctgttgcccacctccaactgagctcacgtactcccacgtagcccatatcctcgtttctctcaacaccgggtccccatcaatcctcccaagcttccccaacatccagagacgcgcttcacgactccgaaaatgccctcctttcgcgatttggagcagaaatgggcaccaaaggttgaagctttgttgggcaacaatggtggatgagagaaaagaagaagaaggctgcgtgagagagagggagagcttctga

SEQ ID NO: 61853 - DNA, 726 bp, Glycine max
  Peptide Sequence Number=SeqID_178631
atggattcttcaaattggagatgggactttaggctaggcaaacgatggatatggcaacattacaaggatttggagtttctacaatccagggctattttagcatcaactaatgaaattgttgaccacatcaacgattatgtattatctttgatcccagaggaatacctaagctcagattcaattgaaaaatctgatacaatagaaagtgaagggtttagcataataactatcgaatttctaaactctttatcaacctctggtcttccaaatcctaagattaagcttaaggttggctcaccaataatgttgttaagaaacttagatcaaaatgaaggactatgtaatggtactagactaattatcacaaggcttgccaaccatataattgaagctaaaatcatgtcaggcaaaggtcaaggcaacactgtgtacattcctagattgtcaatgtctccatcacaatcaccttggcctttcaaactcattagaaggcaattcccaataattgtctcttatgcaatgaccataaataaatcacaaggacaatcatttgcaagtgttggactatatctgcctacgacagtattcagtcatggccagttgtatgtagcactttctagggtgcaaaacaaaaatggacaaaaagtaatgatacatgataaagataaaaaacccttgagtacaacaactaatgtagttttcaaggaggagttccagaacttataa

SEQ ID NO: 61854 - DNA, 606 bp, Glycine max
  Peptide Sequence Number=SeqID_178632
atggtgaggagtatgattgatgctaccagtggtggagcccttggtgatatgactcctgctgaggctaggaatttgattgagaaaatggcttccaactcccaaaaattcagtgcaagaaatgatgctattgtccttagaggagtccatgaggtggccacagattcatcttcatttgctgaaaataaaaagcttgagggaaaacttaatgccttggtcaacctagtaactcagcttgccatgaatcagaaatctgcatctgcacctgttgcaagagtctggggtctatgttcttctacagatcttctttgcagcaatctagagtcaatgagcaacctgaagcttatgctgcaaacatttataatagaccccctcagcagcaaaagcaacaacaacagaataattatgacctttcaagcaacagatacaatccagaatgcttgtggtccaagcaggccatattttcctcctccaatgcagcagcaacaacaacaacaacaaagacaacaagcaactaaggcccttcctcaaccttccttagaagagttagtgaggcaaatgaccatccagaatatgcaatttcagcatgagacaagtgcctccatttag

SEQ ID NO: 61855 - DNA, 336 bp, Glycine max
  Peptide Sequence Number=SeqID_178633
atgaagggagagagtgagaagaataaggagagggtggggatggggaaaggtggagttttaagtgttgtgttaataacagaactccgtgacaatggttttgataagtggcaacaacaaaagccttacccttgcatatgtaaagaggctgtttccggattcgaatccatgaccaacaagtcaccaaggcacaactttaccgctgcaccagggctcgccctcattctcgtaccccattgcccagaggctcttcgctatgcgaaggtatgggggagggatattgtacgcagccttacccttgcatatgcaaagaggctgtttccggattcgaacccatga

SEQ ID NO: 61856 - DNA, 429 bp, Glycine max
  Peptide Sequence Number=SeqID_178634
atgcctcttacaaagtggcaagtactggagaggaactggcttgctctagcatacgtgcctcttacaaagtggcaagtactagaggcgaatcgacttgcttttgcatacgtgcctcttacaaagcgacatatcgtaggtggcatgtactgggggcttggtagtatgcgcttgcatatatgtcacccatcgtgggtggcatatactggagtcatggcagtatgctcatgcgcacatgttgtggatggcatgtactggaggcttggtagtggcaagtactggagtcaccgtggtgattcgctcttacatgtgtgtcaatcaacgtgggtggcacacattggagtcataatgctgaaagaagggcttaccaagggcagaccttggattttaagaacctcaaaggtgcgacaatggatgctcttgtctggataa

SEQ ID NO: 61857 - DNA, 1612 bp, Glycine max
  Peptide Sequence Number=SeqID_178635
gtcgatgtggcttgccaagcccccgagcctggacaagtgttgcctaagtttcttttgtcaagttgtccgtgatggatgtgtctttggcgtgtcaggtaagagtgcattgaggacagacgttacatctgtctactgcaataggcgtgttcagcgcacgcgtaacactcttggcacctctttagctcttgccagttaccgaagagtttgccttccctttaaatggagtggaaatttgattttggatcaatgttcattgtcttcttgcttccttgctttcttgatcttgtgctttctagcttttggtttcccttcttcttcctccaacttccaaaggaagggtgagggcctcacgttaaataggtgggggcatttctcacctcgtggaggggtgcgaccttccgttgttgctggggagcctatcctagttattgtgatgctccccccttctactttcgggggtgtgaggagagttagtggcggtggagatgtgagggcatctccccatgtgcaacatagcctaagtgctaggtcaccgttgtccaccttggctgttgctagctatgagtgggttagggatgaagtatggaaatataagtctttcctgacctcattggtgagtgtcattgcactccagtgccaggtgaagtgtccttttaccctttaccacttttcagtgtgctttgctggagcacttgaatgtggtcccttcccaacttcactagaacagttgggcgataatgcaggccttcgaatttttgtgtcctttcttcaacatccggccgagtgtgctggggttgacaaagaaattttggagcagctgctggccttgtcggatgcacgggccactttgtctcttccttcggcgagcgatcctctcgctgccttggatgatgagtgcctaaccttgccctcgcttgtgtctgaggtcggtattatgggtgactttgcttggagaccacttgtgaagcaagtcggaccagcagttgggaccatgaagtcgtctactattgcttcgtctcctggagaaaggagccaacttgttggtgaggttagtcctattgttgttgctactgaggtcacccccaaccctccttcctctattttggcaaagaggaagagggatgatgctgctgggtcatctggtcacaagaagtcaaaagcctttatgagtcttcgtgccctgggacaggttgcagggttgctacccactgttgctcctgctgttgttgaagttgttgtgccagccactcaggctgattctattgtggcatcgtcgtccactgttgcggcaccttttgttaagtgctgtgatgttgactcactgtggggtactacttacaagccagagcagaagaccccagttgactttgtgtttacctttaacaagaatcttatcaggagaatggactacgacaccaagagatggtgtagaaggtggtgtccttggaggtgcagatcaccaagtggagggccactgctcgaactctttagcgagtggagcgccctaaggtcaaaccgccaactatctgccaaagttgttggtgtattggccaaattgttgtgcacccggttagatggtgatgagctgtttagacattgcaaggacttgtag

SEQ ID NO: 61858 - DNA, 579 bp, Glycine max
  Peptide Sequence Number=SeqID_178636
atgggggagaagcttgccacccagctcgcccaggcgagcaaggttgcttcctccagaagcaatagccttctggaggaatcttctggagggcccaagtgggcctggttgctatttgcacccccttttttactaagtgcacccccctttctattttttgctttcgaagaagttacggaaactcacggattgcgcaaaaacacctcttttcgacttccgccacattacggaattccacagatcgcgcaagcctacttccttttaatttctgagacgtctcgatacttcatttattgtgcaacaaaggacgccaagtatctcaaagcggctaaccaaagtgatgcaagctcaattggagcttgtaggcctaggatcttcttcatcaatggattcctttgcttcttgaaagatgaatggcagcggaatggagaaaggaatagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 61859 - DNA, 960 bp, Glycine max
  Peptide Sequence Number=SeqID_178637
atgagttttagggagtgcaataatgtagaaaacaagaatctatgtcttcaaaccccaacttttattgagtggctcaaaccatcatcatcttcctctcaaactagttcaatttcatcatcacctccttcttattccttgattcagcatgaacaacttgtacaagatcaaacgatccagtttttgccctttaaggaagatcaacatattggagtgcaaaaggaaggtttagaagtaaaagaagagaagaaggtggaacaggtgacggtggctttgcacattggattgcctaacacgagaggccatgaacctgatgatgatcatgatgctgatgaaaaaaagcttttccatgttaaggaagaagaagaacccttgaagaaaagcttccagggcaattgctctttcaaccaggagagaagattttggattccaactcctgcacagatccttgttggaccgatgcagtttgcttgctccatatgcagcaagagcttcaatagatataacaatatgcagatgcatatgtgggggcacggatccgaatttaggaaaggaccagagtcacttaaaggaacacaaccagctgcaatgctaaggctaccatgttactgttgtgcccagggttgcaagaacaacatcaatcacccaagagcaaagcccttgaaggatttcagaaccctccaaacccactacaaaagaaagcacggtgcaaaaccatttatgtgccgaaagtgttcgaaatcctttgcagttaaaggggattggaggactcacgagaagaactgtggaaagttgtggtactgcacttgtggttcagattttaagcacaaaaggtcccttaaagatcatattagatcctttggaaaaggtcactctccacatccttctcttgaaggcttcgtcgaggatgagaaggaatgtgttacaggttctgatgatgaagatgatgttgctcatgcatga

SEQ ID NO: 61860 - DNA, 168 bp, Glycine max
  Peptide Sequence Number=SeqID_178638
atggacaactaccttaaaggaataattaacaagtcagtgttatttttcaatgtatttgcattagcattactcaacaacatcaatattttaatgttccttgtattcaacagtgctttgaaaggacttgatgatactccacaacctaaatccaaggctggtgctagatag

SEQ ID NO: 61861 - DNA, 2418 bp, Glycine max
  Peptide Sequence Number=SeqID_178639
atggcttgtcttgccccctcacacccaccccaaaccctcacaccaaaccaattctcactcacccacttctcctccctctgcaaacacggccgaatccgcgaagccgtgaactccctcacccaaatgcactccctcaacctccatgtgggccccgccatctatggcaccctcctccagggctgcgtctacgagcgagccctccctctcgctcttcagctccacgctgatgtcatcaaaaggggccccacatttgccttaaacgacttcgtcatttccaagctcgtcatcctctacgccaaatgcggcgcctccgaacccgccacgcgcctcttccgcgactcgccgagcccgaacgtgttctcctgggcagccattatcggcctccacacccgaacgggcttctgcgaagaagcccttttcggttacatcaaaatgcagcaagacgggttgccaccagacaattttgttctccccaatgttctgaaggcgtgcggggttcttaagtgggttaggtttgggaaaggggttcacgcgtttgttgtgaagacgattggattgaaggaatgtgtttatgtagctactagtctggttgatatgtatgggaaatgtggggccgtggaggatgcggggaaggtgtttgatgaaatgtctgagagaaacgacgtcacgtggaactccatggttgtgacctacgcccagaacgggatgaaccaggaggcaattcgggtgtttcgggagatgaggctgcagggagtggaggtgactttagttgccttgtcggggtttttcacggcgtgcgcgaattcggaggcagttggagaaggaagacaagggcatggacttgctgttgtgggagggttggagttggataatgttttggggagctcgattatgaacttctactttaaggttgggctgattgaggaggctgaggtggtttttcgaaacatggcagtcaaggatgtggtgacgtggaacttggttgtggcagggtatgcacagtttgggatggttgagaaggcgctcgagatgtgttgtgtgatgagagaagagggtttgaggtttgactgtgtgacgttgtctgctttgttggctgttgctgctgatacaagggatttagtattgggtatgaaagcgcacgcgtattgcgttaagaatgattttgagggcgatgtggttgtttcgagtgggatcattgatatgtacgcgaagtgtgggaggatggattgtgcgagaagagttttcagctgtgtgagaaagaaggatattgtgttgtggaatacgatgttggctgcttgtgctgagcaaggtctgagtggcgaggccttgaagttgttctttcagatgcagctggagagtgtgcctccgaatgtagtttcgtggaattctctgatttttggtttctttaaaaatggtcaggttgctgaggctagaaacatgtttgcagaaatgtgctcctctggtgtgatgcctaatttgatcacatggacgacgatgatgtctggtttggttcagaatggttttggttctggtgctatgatggttttcagggaaatgcaggatgtgggaatcagacctaatagcatgagcataacttctgctctctcgggttgcacaagtatggcattgttgaagcatggaagggcgattcatgggtatgttatgaggcgtgatctgtctcaatctattcatatcataacttctataatggatatgtatgctaaatgtggaagtttggatggtgcaaagtgtgttttcaaaatgtgttcaacaaaggagttgtatgtgtataatgcaatgatatctgcatatgcatcacatggtcaagctcgagaagcccttgtgctttttaaacaaatggagaaagaaggaatagtgcctgatcacataacccttactagtgtgttgtcagcatgcagccatgggggattgatgaaggaaggcataaaggttttcaaatatatggtctctgaactccaaatgaaaccgagtgaggaacattatggttgtttggtcaaacttcttgccaacgatggccagttggatgaagctcttaggacaattttgacgatgccaagccatccagatgcacatatattaggatctctgcttacggcttgtggacaaaataatgatattgaacttgcagattatatagcaaaatggttgttgaaattagacccagataattcagggaattatgtggctctttcgaatgtatatgcagctgtaggaaaatgggataaagtgtctaatttaaggggtttaatgaaagaaaagggtctaagaaagattcctgggtgtagctggattgaagttggacaagaacttcatgtatttattgctagcgatagatcacaccccaagacggaggagatttatgtgacattggatttgttgggatttgaaatgcattaa

SEQ ID NO: 61862 - DNA, 740 bp, Glycine max
  Peptide Sequence Number=SeqID_178640
atgggtcagacgctgagttgcgtgcaacagcacgaggaccatggtgtgctcttccctgcacttgcaagtggagaattggaggttgttgaggccatggtggaggaagaccccactgtgttggaacacaccattggctgtgacaggctttctcctctgcatgtcgctgctgccaatggtcggatcgaggttgttcttgatttttgttgtcttgcctctttggatttgaatggtggtgttgttctttccatgttgttggataggtctttcaatgttgacgtattgaatcgacataaacagaccccgttgatgttggctgtgatgcatggaaagactggttgtgttgagaagcttattcatgccggagcgaatatattgatgtttgattctatacgtcgaagaacttgcttgcactacgctgcttattatgggcatatagactgccttaaggccattctttctgctgctcattccacacctgttgctgattcttggggatttgcaagatttgtcaacataagagatggaaacggtgccacccctctgcatcttgcagctcgccatagacggtcggaatgtcttcatgcccttttagacaatggtgctcttgtttgtgcttcaaccggtggatatggttaccctggaagcacgccacttcatatggctgcacgtggtggttctttggactgtgtccggatgctgcttgcttggggagcggatagacttcaattagattcttctgg

SEQ ID NO: 61863 - DNA, 342 bp, Glycine max
  Peptide Sequence Number=SeqID_178641
atgacctctactagccaacaacagcctggccaaggttcctatccgaggtcgcctaaaaccgcctttgtccagtggggcttaaacaaaatttatgagaaggaagattatgaaatttatgggcagcaagctgaatattctacaaaactcttttttgatatggaaattgatgaatttaatacacttgaaatttcttttgctatggaatttgagaaagacatgaatcttaatagcaacaatcataaaaatgaagtagatttatttctcatgaagagtttggagaagaaaaaacttggcccagtttcaccagttgatgaagagaactctgatattgagtttgattag

SEQ ID NO: 61864 - DNA, 240 bp, Glycine max
  Peptide Sequence Number=SeqID_178642
atggtgggaagacgaaggtggtggttggaagaagacattgttaggacgccacagttgtgcaagaatgacgatttaggatttcaaaaagacgacgtcgaagaaaagaagtcatcaccgcctctgctagttttggatgttgttgatgtttcaatacttggtgtcgattgcaggggagaaggaaaggatgttggtgtaggaggatgcgaggttgtggaatatggggttttgtatacgttatga

SEQ ID NO: 61865 - DNA, 900 bp, Glycine max
  Peptide Sequence Number=SeqID_178643
atgatccagctagcaacttcaattagaaggagagaccagtcatcaaaattcagacttctcaagcaatcatcattcttgaagtatccagctttggatgatgaacaagatgtacttgcttctcagcttcgttttctttccgcgaatctcatttttgatgcatttgcaatttgcaagcattgctcagacaaacataactcaagggtcttcatccatatggatgtgttttctttaggtccatatgtaccctggctgcgtaaagatgatggatcaaagaaacaagtagaaactgaaaaactcactagtatccaaattctcaatatctcattgcatcttatattcaatgaaggatcttcagtgtttacaatcaagcaatatagacatttgtcacctttattcttggaaggtgtatatgatcaactagctggtcaaatgtctctaattggttgcagaatggtttcaaatgtcagcaccaatgttggacatggcctagattgtctcgtggatgttaaggttcagtaccctcctttaactggaagatggctgaaaaatccttctgttgaaatgactattactagccaaaggcatgaaaatgaccctcttcattttaatgctgtgactcttcagacagacattattccatacttaaagcatcacgatgatgtggccttcagaaaactctgtgatggagttcttaggatgctgacttcatgtgctcttgtaggaatcatcttaagccaactcagttacatgaacagaaacgtggcttccattcctcacatatctcttgtcatggttgctgaacaaattcttggttatggtgctgagttgtttggggatactgagatacttgttgaatcatctcatgatcttcatgataataaacacatgttgatcccatag

SEQ ID NO: 61866 - DNA, 225 bp, Glycine max
  Peptide Sequence Number=SeqID_178644
atgcctattaagaggaggattgatacattcgttatctctatagattggttggaggacttcttggtgaaggctggagtggttgctgaagcttggccaaaaggggagtatgcagaaacaaatcttagagtagctgtggaagaagtggaagcagctaatgtagcagaggcaagtgttcttgatcagattaaggtcttatctatgacaactagtccttgtcattcatga

SEQ ID NO: 61867 - DNA, 747 bp, Glycine max
  Peptide Sequence Number=SeqID_178645
atgtcgaacacgcaaaatgacccattcaataaattgctgggtgcaccagcaatattgcttgttgcacctagcatatcccaaagtgaagctgtatcaggtatttctagggattccatgcacaagaggcgtgccactggtggcaagaagaaggcctggagaaagaagagaaagtatgagcttgggcgtcaggccgcaaacaccaagttatcaagcaacaaaactatccggaggattcgtgttcgaggtggcaatgttaaatggagggcattgaggttggataccggcaattactcatggggtagtgaagcagttactcgcaagactcgtattctagatgttgtttacaatgcctcaaacaatgagcttgtgcgaactcagaccctggtcaagaatgctattgttcaggttgatgctgctcctttcaagcagtggtaccttcagcactatggtgttgaaattggtagaaaaaagaaagtggcatccaagaaggactctactgaggagggtgaggctgctgctgaagaaactaagaaaagtaaccatgtccagagaaaacttgagaaacgccagaaagatcggaaacttgactcccacattgaagagcaatttggtggtggccgattgttggcctgtatttcttctcgtcctggacaatgtggcagggctgatgggtacattctggaaggtaaggagctggagttttacatgaagaaactccagaggaagaagggaaagggtgctgcttaa

SEQ ID NO: 61868 - DNA, 216 bp, Glycine max
  Peptide Sequence Number=SeqID_178646
atggcttccggggcttccgggacacctgattgcttctggaggaagcaacccagctcgcctgggcgagctgggcgacaacctcctcccttttttcctataaaaaggcaaaaggggactgttctaagggtccctgattccccttggctatgcatttcagctattttgggtgaaaaaatgatttccgtgaagaaaatccaagccgaggtgcttccgtaa

SEQ ID NO: 61869 - DNA, 276 bp, Glycine max
  Peptide Sequence Number=SeqID_178647
atggagataacaacaacaacagtcagtttattgttgaagaagcaccctcacaaggatgtcaagcttcatatgagaggactatccttactagaaggacagaatgaagataaagaattcgctgcccttaagtttggagaaagtagctacagaagagaagaaaagaaaagctcattcaaagctcataaggtgcaaatggctgagtatgatgacttagataatgattctagaggaaccatggatgatgaaatggtcctcatgtccagaaagttcaagtga

SEQ ID NO: 61870 - DNA, 303 bp, Glycine max
  Peptide Sequence Number=SeqID_178648
atggtattattatcatgtgaaagaagcttgttgatcgatatacaaaaccagaatttacaggctattaatcatattaagaggaagtatgagttggagaatatggaaattgtgaacaaggaaaaagaaaaggttcgatatgatttcctggctgacaaagccattgcagaaattgaggcaaagtgtggccaaaaaattgaagaatgcaaagaagaacaaaggcagcagttgatgcgcattgaagatgaacacacattgctcgtaagcatagaaaaagtcttgaatttgaaattattggctgcttag

SEQ ID NO: 61871 - DNA, 588 bp, Glycine max
  Peptide Sequence Number=SeqID_178649
atgactaatagagtctttggaggttatttatatgcaaaaaactttactgtctggagaaaggctggaaaaggtggagaactgacacatgatgaaaccacaatcattgctggagcgcttgaactctctgagaagacatccagtgatgccatgactcccataactgatatattttccattgatattaatgcaaagcttgatagggatttgatgaatctaatattggagaaagggcatagcagagttcctgtctattatgagcagcctacaaatattattggacttgttctggtcaagaatttattgacaattgacccagaagaagaaatacccgtgaaaaatgtgaccatccaaagaattccaagggttccagaaacgttgccactttatgatattttgaatgagttccaaaagagccatagccacatggctgttgttgtcagacattgtgagaagacaaggcaacagtcttccaacaataatgccgatgataataaggaattgggagatttacttaaagaactcagggaagctctgagggaggagcaaacggctgcattggatagaattgaagcagaatatagggagtag

SEQ ID NO: 61872 - DNA, 177 bp, Glycine max
  Peptide Sequence Number=SeqID_178650
atgggaaaaagggacaatagaatacagattggggatatggggaagtgtggggtgggaaagttatggacaatggcaacgatgacattcatgttggtggtgatgatggtggtcatgaccacgatcataatggtggtgatggcaacgatggcggtggttgtgataacgatcttgacataa

SEQ ID NO: 61873 - DNA, 2670 bp, Glycine max
  Peptide Sequence Number=SeqID_178651
atggagtcaattcagcaaaattataatgatgcttccatggagcttgcatctaatagtcctccaggttcgcctgatataagtgacgtagttggagcgccgcagttggatcctcgagttggtgaagaataccaggtggaggtccttgatatcataaaagaatcagaacggcttcgacttcttatgaatactgctgattcagaagttatgtgtgataactcgctttcctttgtaattggtttgcctatctcagtcacatggatgcataatgcagtggaggatagtagatgtggaggaaatcttgcagacgttgatggtatgatcaatgcaattgaacttgcaaaagaaactaattttaaaaagaacattatatcagacagcgaggaagaattgaaactaattgcatttcggtttgtgatgacaggaaatgaatcttcaggtcaaccgggtaaaagcaaaaattatgtattgtttcctggcatattgagtaactcctggagtgaagctgatgcaaaaagttttctccttggtttgtttatttttgggaagagttttattaagataaaaaaattcttagagaacaaagggatgggggaaatactgtcattttactatggaaagttttacaaatctgaagaatatcatagatggtcagactgcagaaagataaaagggagaaaatgtattgtaggacagaaacttcttactggacagaggcagcatgaactattgtctcgcttgattccccatgtctcagaagaatctaaagatactttgttgcaggtttgtcagtcatatgtggagggcagaacttctctagaagaatacattttatctatgaagtctactgttggacttggcgttcttgtagaagcagtaggtattggaaaggaaaaggaaaaccttacaagccttgccgtggaacttgggaagaacaatcgggtgtttccagtaccaacttgtaaagcttggtcttctcttggaccaaatgatataatcaaatatttgacaggaggattgcgacttagcaaagccaaaagtaatgatctcttctgggaagctgtttggccccgcttactggcaagaggttggcactctgaacaaccaaagaatcaatgctatgtccactccaaagaatatctggtttttcttatccctggtgttaagaagtttttgaagagaaaacttgtgaagggtgatcattactttgattctgttagtgatgtcttgagcaaagtagtagctgaacctaatcttcttgagcttgaagaagagactaaagttggtagctgcaatgatgaagagccagaaaagggattgagtaaggatgaccaatctgattatcgtcatcaatgttacctcaagccccgagcttctactacagatcatataaaattcatggttattgataccagtttggtgcacagagggaagtcatctgatttaatggaaattaaatctgcacctgttaagtcagtgggtagagttgagggaaatgctgctggtataacaaataaaggggccaaacttacaaggaaagtaaaccatggcaaggatatggctgaaaacgtcgataaaaagatgacagttattgataccagtatgctttatgaaggaaaattatcgaaggtgagagaagtgagatgtcttccggttgaattaggacatgcttataagatgactgttctcccaagagaaagtaaggatagctcctttgatgaagattcaccaagcatgatgacacgtgagaaaaggaatattagtaagccagataataatgcaaacaaaatggtagaaagccagaaaaatcagaagacctgtgtgactgatgataatcagataaagaggactataaagcatcaattctgtcggagggcaagatcagatcatggtaatcctatggttcttcccattaaaaggagaagattgactgcttgtgccaaggcagagacaagccgcgccattgagaattcatcaggaggcttggaatctaaaaaagtggcattctctcagtcatcgagatttccagattcccaccaaattgtttgtgattcagttagttctcagccgaatggaagttcgattgcctatctagctgatagaagtgtggaagtgaataacgaggaaatcattctcaatgaaatttgtcaatccaggagcaattcttgttttaaagtcgagaaatgtgaatcacagtcagcggtcaccttcagcacaccccaggttccattgaagtccgaagatggtgaaatggtggcgacagtggaggaagatgggctgtgcgaaaaagcaaatgatccatgtttgtcaactgatactcagggggtagttgagaagccacaaaaagcctcttgtgatgttggttctatggaagagcagcctaatacaaatcctaggagacagagcacaagaaatagaccattgacggttaaagcattggagtctctgggaaatgaattcttgcacgtacagaggagacagaaaaagaaagatatcctgccacacatagatgctttcagcccttgccgcaaggctcgtacaagcaaaacaaacctgcatagtcatagttcagatcatgggactgcagttttagcaaaagaaaagcatttcaatggagatcataaagtggaaattgtagagttagtggaatatttccaagccacttcgctataa

SEQ ID NO: 61874 - DNA, 159 bp, Glycine max
  Peptide Sequence Number=SeqID_178652
atgccgcctagtcatagaaagggcgaaaagaaaagcgtcgacggtgccgttgcctactggcaatttaagctcagcgatctcgtgctcactaaggttaaggggttccctacttggcctgcgacggctcccggaggagctgtggagaaggtcagagactag

SEQ ID NO: 61875 - DNA, 624 bp, Glycine max
  Peptide Sequence Number=SeqID_178653
atggtggacaccgaacttttcgccacctgcgtgaatcacctcgaggcaaccatggccaaaatcgttgtagcccaaacttccattacttccaaacttgatgccattattcggatattgaataccatggtacccaaacaaccctctccatcttctgcctctacgaagtcaccacccatgccgcctctacttcccaagacaaccaacccaacttcttcctctgctaagccaccaccaacagcagaaaccacgccgcctccaccaacagcaaaaaccacgttgcctccccttcccatggcaacttcccaccttcccgttaacaagcacctcgcactctcctccgaatccctcccggccgccagtcatcggtcccacacaaagtcctctagtcgtggcatccttccgtctgacatccacttctccctttttgttgtgtgtgctgccacggtcagggacacaaatctcaatcaccccttcctcctcctcttcgccattttcattgctgccaaagggctctgtctccgcaatcatcttcaggcactaattcttacacccattttcatttgggatccaggttctattttctacacccaacaccttgaggacaaggtgtttttgatgggctag

SEQ ID NO: 61876 - DNA, 332 bp, Glycine max
  Peptide Sequence Number=SeqID_178654
atggatgcttcgacagggacaccaccctgtccttcccgaagtatatgcgcttggagagcttcagcccatcgtcgaccactttggagaaatcctcaggccatcgcagagagaagaaaattgcagttttgcaaatcatctactggtttctttgctgatggcgaaaatgcatattcctttgggtcctcgggtttctactctctgttcttcgacaatgacaacattctccgtcttctttacgatggtcttgaagtttctgccattactggccacatccatggctggcatcttggaaagctcattaggacgcagtgcatgctcgacggagtagtgaa

SEQ ID NO: 61877 - DNA, 321 bp, Glycine max
  Peptide Sequence Number=SeqID_178655
atggaaatatatctcattgtcttgtgcaataaacttcttggcaaaaatctttgttcagatttgacacttaatcatcagtgtagccgtgcagctgaagtgcataatctatctgaaaggacacacttgaaaaactttgtaagattatggaatgatgattatgtcaatgggaggtggtttatatatgcctccaatgatgttactagtaacagagagattggctgtgatataaacaaagacatatgcactcaaaaacataaatcaaaaacaaaagagacaagcctggattctggaaggcaacgggaagagacaaggctatcatga

SEQ ID NO: 61878 - DNA, 171 bp, Glycine max
  Peptide Sequence Number=SeqID_178656
atggccttctcaatatcaccacctttgctcccaatcctgactactactgttttgtggcatcggttaatgggaaagaaggttcttgtggtctcaagtgatgttcatattaaagacttttacctacagttagaaaatgtaatttttcttgtagtgagattgcaatgcaagtga

SEQ ID NO: 61879 - DNA, 522 bp, Glycine max
  Peptide Sequence Number=SeqID_178657
atgggaagcttcattgagaagcaaggaaggctcatgagaacccttagaccttctcctgcatctctggcccaatcttcttggagtcttctatccaatgcccttgggggggcatatgcaaaattagatatgctggagaaggctgaagagctcaaggagcatgctcggaggaggggtgccaagcctaatggaaaaaccttggaaatctttatggattactatttgcaaaaaggaaactttaagtcaacagtggattgtctagacgaagcaatatcaatgggtagatggaatgaagaatttctagagatcttgaagaagtctatggaatctccaggggtggaggtatttgaatccttgaccagaacttatgcagctacgggtaggatcagttcagctatgctacgacgattgaagatggagaatgtgcagtcaggcatgggacgagtgagagctgcatgtggtgccattgggcaaggttgtgcacataaggctccatgggtctacgctacagactacatgccttga

SEQ ID NO: 61880 - DNA, 585 bp, Glycine max
  Peptide Sequence Number=SeqID_178658
atggctaagaggaacatgatcaagactgtcagggaccatgctatacatctcgacctgcttgcaaaggctcgaggaattactgctgctaaaaattattttgttaatctcccagaatctgctaagaatcatctatgtcatggtgctattctaaactgttactgcaaggaaccgatgattgaaaaggcagaaggttttatggaaaagatgaaggagcttagccttcctttaagttccatgccttacaatagtcttataatgctctatacaaaagtagggcaacctgaaaaggtttcatcactcatacaagaaatgaagactagcaatatcatgctggattcatacacatataatgtttggatgagagctcttgctgccgttaatgatatttctagtgttgaaagggttcatgatgagatgaagtggcactcacggaattggagaagagaaatgctttcaaagatcttactgcttaccacatttcctaaaactgcaaacataagctacctgaacatgattcgggtgttggttaactcgaaagatgatggaagcttgcttgagaagcttttatggaggctggatctttga

SEQ ID NO: 61881 - DNA, 152 bp, Glycine max
  Peptide Sequence Number=SeqID_178659
gccacaccacttcgacagtgacatgcacgtcagtagctacagcaagagggaggtcaacaccacacacgcatgacggacgacgggatgtgagacacaaaccgataggcaagacgctcaacaaaaaagaagcttttcgggcacgcgcgttttag

SEQ ID NO: 61882 - DNA, 1533 bp, Glycine max
  Peptide Sequence Number=SeqID_178660
atgtcagcaaacagttctttgcatgtggaattatcgaggaagacttcgtttttgggattgagattatgggttttgattgggataggtgttggtgtttttatagttgtgattctttgtgtattatctgtatgggtgatgtttcggagaaagtctaaaagatctctggacaagtactctttgtcacaaataccacatgtctcaaaggacatcatagttgacatggttggggtgcagatatctcatgatcaatcagaaagtgtagctattcctgttcatgacaaaccaagtgagaacaactcgaacaagttgttttctcatttgcacaagagcaaatctggcgacgccgataatatcagtcagtgcagctcggtttatcatcacgagagaggatttagttcaatgtcgggggaagaaggaagctccgggactgttaagaagcagtctgcattgtcatttggaggaatggtaacggcatctcctctagttggcttgccagaaatttctcatcttgggtggggccactggttcacacttagagatctggaacttgctactaatcgcttctcaccagagaatgtgattggcgagggtggatatggggttgtttacaggggaaaattgatcaatggatccgaggtggcagtgaagaaaattcttaacaacttgggacaagctgagaaagaattcagggtggaagtagaggctattggccatgtcagacataaaaatcttgtgcgcttacttggttattgcgtagaaggagttcacaggttgctggtgtatgaatatgtaaacaatggtaacttagaacaatggctacatggggctatgagccaacaagggacacttacctgggaagctcgaatgaaagttataactggaacagccaaagcgctagcttacttacatgaagcaatagaaccgaaagttgttcaccgggatataaagtctagcaacatattgattgatactgagttcaatgcaaaggtttctgactttggtttggccaaacttttggattcaggagaaagtcacattactactagagtaatgggaacatttggttatgtggcaccggaatatgctaatacaggtttgttaaatgagaggagtgacatttacagctttggtgttctcctgctagaagcagttactggaaaggatcctgtagactactcacgtcctgctaatgaggtgaatcttgttgaatggctcaagatgatggtggggacaaggagggctgaggaagttgtggactcaaggcttgaagtgaaaccatcaatacgtgctttaaagcgtgctcttctagttgctcttagatgtgttgatcccgaagcagaaaagaggcccaaaatgagtcaagttgtgaggatgcttgaagctgacgaatatccattccgagaggatcgaagaaatagaaagagccgcactgcaagtatggaaattgaatctctgaaggatatttctggtccatctgatgctgaaaagttgaagggttctgaaggccatgaaccagagacaactcaagggtag

SEQ ID NO: 61883 - DNA, 516 bp, Glycine max
  Peptide Sequence Number=SeqID_178661
atgtctattcgaacaaatcccatgaaagcagtgcctacattgttgaagcgcctggtgacggtagaaaaacatgtgaatttgaatgatttgaagtctgagttgactaagataaaggacctgttttcaaaggtgaagaagaatgaagaagaactccttgacacattagcggatgtgaagagagcagtagcacacccttcgatcccagaacctgaggacttggaaatgattaagtatcacgtcatcacattcttccttttcttcccttcttccccttttccaacgaaaatcaccaccaccgctgatcacctcgtgccatcaccacgtcgtccaacccttctccccttcttccccttatccaactcaaaacaacccaccccacgccaccaacacaaaacaactcaccttattaatacatcttctctcttaatcgacaacgacaacaacaacaaaatcatcaacaacacaagcgaactcaatcgcgtcaagaaagttggagcgaatctacgaggacactag

SEQ ID NO: 61884 - DNA, 357 bp, Glycine max
  Peptide Sequence Number=SeqID_178662
atgtgtaatctagaagacatgaatagtgcgtgtctcatgaaacttggctggtatattcaaaatggcaataagaaattgaggtgtgatgttatgagaggtaagcatgtgggaagagcttcctctaaagaatatttggaatcaaaatcaaatgattattttatttacatggttcttgagaaaatttggctagaattagagatgcaagaggtctggtctatggacaatggaaatgttattaatatgcaaagtgataagtggattactgaagacttgaggcttaaggatgtggttcctaatatccatgtccaggttcagaattggaccatgagtcaatttactgacattgatggtacctag

SEQ ID NO: 61885 - DNA, 150 bp, Glycine max
  Peptide Sequence Number=SeqID_178663
atgcactggatgtccaccatcatcttaggaagtttcaggaataactgggaaacgtattttaacgatgctagaccattggagccagagagattaaaggcgcttcgcatccactgggcacaatattatctccgacttagagatcaaacttag

SEQ ID NO: 61886 - DNA, 213 bp, Glycine max
  Peptide Sequence Number=SeqID_178664
atgttattgcttagggctgttcttgtgtcctccactatcaagtgcgaagcttctggtgactgggaagcacgttattctgttgttttccagatcggttcattcgccaaaagaaaaaaagaagaagtagagatgagagtcgtcatcacggaaagagcaggacggacgaaatcagtgtcctatctttgctttcctcttatctccgatgagaggtaa

SEQ ID NO: 61887 - DNA, 920 bp, Glycine max
  Peptide Sequence Number=SeqID_178665
gtgtcacctttaccgtatcttacctcataaactcatgtgggttgtccccagaactggcttacaaactctccaacggggtcagtttaaaaacccccaatggcccaaatgctgttcttgacactctcaaggactatggattctccaaaactgaggttgcaaaacttgtggagaagcatcccagggtgcttgttgcaaatgcagagaagacccttttgcctaaactgcagttcttccactctattggggtttccaacactgacatgtctaagatgataattaaaaaccccttaatcttgcggaggagcctggcaaaattccttgtccctctatgcaggatgatcaggcgtgtggttcatgatgatctggaagttgttaaagttttgagaaaatccccatttgctttcacatatgctgacatggtgaatggcttggttccaaacattgaggttttgaggcagtctggtgtgcctcaaggttcgatctctctgctgatggtccattttcccagtgtagcatatgggaagcattccagatttgtggaagctgtcaagagagttaagaaatttgggtttgatcctttgaaaacagcatttgtcatggctatccaagtgctttataatatgcgaaaactggcattggaattgagatttgagatttatgagaggtggggctggaaccgggaaatggctcttcaagcgtttgtgaagtatcccaattttatcaagttgtctgatgagatggttacaaagaaaatgaatttcctagtgaaagacatgggtttgtcaccagaatatattgctgcatatcctactgttctaggctacaacttggagaagaggattgtccctagactctcagaagatttgcctctcttaccagatgtctacaaaggtttgattcatcatgagaatgtaatataa

SEQ ID NO: 61888 - DNA, 633 bp, Glycine max
  Peptide Sequence Number=SeqID_178666
atggcatccagggttgttacactggtggtatcaaagttggtcatgtcgtttaggaacaaacatatatggagcaggatggtgagacctcctaagactccttatcctcttccacctccatctggcagtgctcagattgctcatgcttttaagatgatggcggcccgattggctgttgaggcaaaccgaattgttattcctcaagagtttcaaggtcttactgagtttaggaggagcgatcctcctcagctcaagggagactctgatttatatgaaactgaccattggattagagaaggcagagttttggtggcatggaacccaacagatgatgaaagctcatggggaatccctaacttgggtgaacttcaaggaatgctttttcggcaagttactactaaggcttggagatgtagaaagtttgtagaaggtttaaggtttgaggagaagaatgtggagcgcttggagtgtagtaaccagggcatcaagtgctacatttgtggtagaccacactatgcttctcaatgtgcacaaaaggaggtcatttactacaagcgtcaaaagctcaggcacattgccaggaattttcaagttgttgtggagactacacctacaaggagtgcgatcagggtttag

SEQ ID NO: 61889 - DNA, 288 bp, Glycine max
  Peptide Sequence Number=SeqID_178667
atgtcacctccgcgttcttgcatcgacgctacacctcccattctcctcctcctcgcgactatcactcttatttttgttttagttctcggtcacgaaaggtcatttgttgtcagatggaaggatgaactagagcctacttggcatctgctacactttagtggcaacatacactctgtcacatataatcaagatctagtgagtccagctctacttgctagatggacagaacttatagagttctatgggctcactgaaaatcataaggtgaccttgacccactatggataa

SEQ ID NO: 61890 - DNA, 510 bp, Glycine max
  Peptide Sequence Number=SeqID_178668
atgggtgactcggacaaatgtgggttagtttatgaggggttgacaaccgtccacaacgttcctttgggcaatgatcaagtgaaggtcggtgttaaggacgctcgagatgttgatgatcgtgttctgaataaacagggagctaagggaccggcaaaatctgtagatatgccagatccggacattgatcccttgtgtatgactgagacaagtatgcaagcgaggaatgtcgatgtgtatggattcctcgagccacaatccatacaaaaatctgggcaatcacaatttgaatcagaagattatattaagaaatggatgcagaattcacaaagagatgtgtacctaggagcctacttgaatggtgcacattggcaaatgatcgttattttgcctaaggacaatgttctcagctggttttgttccttgcacaatagtcccaacaactacccgttgtatttttgctttgaagggactcaacgacagacaagtaaatccaaggctgctgctagatga

SEQ ID NO: 61891 - DNA, 531 bp, Glycine max
  Peptide Sequence Number=SeqID_178669
atgggtgggatcgcagtggatccttccaaggtgggaacaattttggaatgggaaagtcttaagatgactacaaagattaggagttttgttgggttgcttggatactataaaagactcataaaggtattttcgaaaacaatgacaccattcactcaacttacctgtaaggaccaaccgtttgcatggaccgaagagtgtgagaagagttttctaaagttgaagcagaggttgaccacttctcctatccttgtattacctgatctcgataaacctttaggtgtttactgtgatgcatctcatcaaggagtagggtgtgtgttgatgcaaagtaagaaggttatgacttatgcctcacatcaattgaagattcatgagaagaactaccctagccatgatttggagttagtggcagtagtgtttgctctaaagatatggagacattatctttatggaaccaagtttgacatgttcggtgatcacaagagtttcaagtacttgtttgatcataaagagctcaacattaggcaatga

SEQ ID NO: 61892 - DNA, 597 bp, Glycine max
  Peptide Sequence Number=SeqID_178670
atgtctattcgaacaaatcccatgaaagcagtgcctacattgttgaagcgcctggtgacggtagaaaaacaagcgaatttgaatgatttgaagtctgagttgactaagataaaggacctgttttggatggtgaagaagaatgaagaagaactccttgacacgttaactgttgtggatttgctgccagtcggtgatatagaagcatctgggtcatcaggagaaacatttcaggatgtgaagctcaagcagagagaagaagtgaacagaacactcccttcgagcccagaacttgaggacttgcaaatgtttaagcgagattcacccgaacatcatattgaagtggagagtgaggaattcctgaaagagttgaagcatcaaaaggatttgtggtacctcagcctccatgggatgtcaagaatatctgagctgccactctcaattgtagaacttgagagactagaaattctagatctcaaggcctatcacaatctagccaatgatattgcatcatcaagaaagttcaaacatttggatttgtctcggtgctacttgttggagagaatgccaaaggggattgagaagcttactaagcttcag

SEQ ID NO: 61893 - DNA, 420 bp, Glycine max
  Peptide Sequence Number=SeqID_178671
atgaagctttggtccaccaatgaggttcgcgccaagtccaagttctggtattttctgaggaaattgaaaaaggagaagaagagcaacgaccaagtgcttgctatcaaccaagacacaatcaaaatggccttttgtaataaggttggaaatgtctcgaggcagagtgttgctcacagcacacaagcacctgtttcatccatgcttaattatattcgctgcatgtcttcaagcaagcttttcaatggaggcctttcatatggagttgatgatcagtctcttaaggatgcattttctggctttggagatgtggtagatggtaaattcggcttactttcattgttgtcacatggtgtccaatttcagccacccgtcagcctcactttaccatatgttcttcagtttcctttgatgtcattataa

SEQ ID NO: 61894 - DNA, 543 bp, Glycine max
  Peptide Sequence Number=SeqID_178672
atgatgcttaaattgaagaacatacatgttgcaagaaacattacgggaaacgaaaaagagtatatatacctggatgactggatgcggtttatgcgagaagatgaagctgcagatattccttccttaagtgcagaggcagtgaaggaacacccagatgtgtcatacaatgtaactgcaccccttggactacatgaactatttgtggcacaagtagagaacagagatagtaagttagttggtcaagatatatgtggggtgattgaacatgtattgattcttgttggcttgagaagttctactgtttcattcacacaaaaagttcatagaactttggttggttcaacaacatcaatttgtgtctatggcttttattgctttggaaaagttttacttgagttggtgacaaaaattgttgatccttcaatggttgttgataaggatttcttagaggaaatatgggctacatccattgttgcgaagtcttgcctaaaagttgtgacatcagagttcttccgatgtaacagttactccagcaccctctag

SEQ ID NO: 61895 - DNA, 210 bp, Glycine max
  Peptide Sequence Number=SeqID_178673
atggtccagcagtggccagttatgagtgtcgaggagtttctacagaaggtggcctggccaggagtccaaccttctcctttgggaggggtactagaggcatctcctcaacctgagcctgagccatctacactagtgtttgacctgcctctttctcaggatccatcatctgcaccagcactggacctgaatgagcatacacaggatcattga

SEQ ID NO: 61896 - DNA, 583 bp, Glycine max
  Peptide Sequence Number=SeqID_178674
acagaagcctggggaaggaaaagcttcaaaacttgcaaaaagggtgattgcttgtcttgatgtgagaacaaatgataagggggaccttgttgtaaccaaaggagaccagtatgatgtaagagaacatacaaaagagaatgaggtaagaaatcttggcaagccagttgatcttgctggacagtactataaagatggagctgatgaggtcagctttctaaatattactggatttcgcgacttccctcttggtgatttaccgatgctgcaggtattgcgatacacatcagaaaatgtttttgtacccttaacagttgggggaggaattagagatttcacagattcaactgggagtttggaagttgcttctgaatactttaggtctggggctgataagatttccattggaagtgatgcagtttatgctgccgaagaatatttaaaaaccggagtaaagactgggaagaccagcttggagcagatatcaagagtttatgggaatcagattcttgtagaggcagggcatatatttcgacatttgttaatctctcttcttcagggagatgttaaagaacctcattcctga

SEQ ID NO: 61897 - DNA, 654 bp, Glycine max
  Peptide Sequence Number=SeqID_178675
atgcaggtcatggagccaggtgcctttcctctacctatgagatctgcacttccccgggatcctacagtgcattcctcaacacactttcatcaattgcctgacacaaaagggtatctttccctgccccagaataggccatacaatacaaccatcaattctcagttaccattttcaggctatactgtatacaatcaatctccggcagacatgaagtacaatcttctgcaaaatagaaatgaattccttataaatggattccctcctgccacagctagagatgcatttggctttggaaatcttggctcttccatttatagttctggaagctttctgtctaatccatctcctggtcatatgatgccttcaagtaacttcaatgagattttaccttctcagtataatgatggatgtaaccatggtagcttttctcattgggattttggagccgagccaagatctttgattatcccagagagaacccagtcacagtatgttactcctggatattctgacctttatcattctcagactcgggttttggaagaacttcagcaaccagtcccgactgagttgattttgttgaacaactgggggcttcgttttcttaaggtttcatgggaatggggacccccctttgatgatgagaaggcgtga

SEQ ID NO: 61898 - DNA, 180 bp, Glycine max
  Peptide Sequence Number=SeqID_178676
atggtggcactgattgttctgcaattcaacctggtggaagctgctacttcccaaactctgtcagagaccatgcttcttatgccttcaataagtattatcagaagaatcccgttcttaatagctgcaattttggtggagctgctgtcatcactagcactaacccaaattggaaagaaatga

SEQ ID NO: 61899 - DNA, 429 bp, Glycine max
  Peptide Sequence Number=SeqID_178677
atggcggaaccggaagcggagtcttttcggatgctccggaacctgacccgaatcgtgatccaaatctccaccctctcctccgccgcatcctttgtgcccatcctcaagccccaatgctgcgacctcgctcgccgaataaggttcctcgctgccctcttccaggaactgcacgacgacatcgtttcgagccgcgcggttcacttcctcgcgctcgaagacgcgctcttcaaggccatggaactgctccgattcgccacacgcgccagccaggtcttcacgatactggatagagagcaagttatgttcggattcactgatgttgctgttcggtttgaacatgcattaagcatgatctcctttggcgagcttgatgtttctgaagaaattaaggagcaggagattgagtacattctaaatgttcagaaataa

SEQ ID NO: 61900 - DNA, 369 bp, Glycine max
  Peptide Sequence Number=SeqID_178678
atgcagggaaataagaatcctgatcttgtcaatgatcctgcgcatgctcattcaggtccaatgctggtgcagatgatggatcctgagaaagaggcaggattaggaagaactagagttgctggagctggagggaaaggagaggtagaaggagttgatgtagaaggagctaaggtaaggggagttgaagtagatggtgcctcagatcctctagccctagatttgcgggttccccaaaaagtgactgaagggtcatccagggattcaaaggtcagagaatcagatgtgactcctcgggccttgcataaagcaataataagggctggaatatctagcctcgaggagtcatgctgtgcgatcagagaaatctga

SEQ ID NO: 61901 - DNA, 240 bp, Glycine max
  Peptide Sequence Number=SeqID_178679
atgaggggagttgtatgcatagttgtgaaaactaatccagtcattgacccagtcgaggtagtgggtcaatgggtcagtggtccaactagttggcgcgacgagttccctcgtagtgcagcgatggcaatgacaacagcttgcagtgtggcactggtcgagtcgagcgtgaagatgaagagaagggaagagagtcttgagttgtcaagcatgaagatgagcgtgaagaagagaagtggttga

SEQ ID NO: 61902 - DNA, 1197 bp, Glycine max
  Peptide Sequence Number=SeqID_178680
atggctgagaagagtgtgacttttggggtggtgatggtgacatatgatcgatcttgcataaagaaatggcttgaagcagggcatagaacatgtcccatgactcaacagattctttccacctccatcctcatacccaaccatgctttatatggcctgatatcaagttggtgtgaggcaaatggagtggaaccgcctaaaaggtcaggaaatttatggctctgtaagacaacatcagatggctcttctgaattcatagatcttgatatcttagtgagcaaactttcttccaatgatatcgaggaacttcgatgtgcagtagaaataggtatatggaaggatgaaggggcgagccctggtgcagcggtaaagttgtgccttggtgacttgttggtcatgggttcgaatccggaaacagcctctttgcatatgcaaggttccaagtatgatggcacctacaactggtggcctggtgaactccattgtgggtttaatgcagagacagcgggtgctataccccaccttgttgatctcctctatgcacctgatgctggcacccaagagcatgtagttactgctctcctgaacttgtctatcaatgtggataataaagagcgcatcatggcttcagaggctgtgccaggcatccttcatgtgctagaaaatggtagtatggaagctcaggaaaatgcagcagccacctttttcagcctctctggggtggatgagaacagagtggcaattggtgcgtctggagcaatcccagcattagttactctattttgtgagggaagtcaaagagggaaggtggatgccgcaaaagcactattcaatctgtgtttatcccaagggaacaaaggacgagcaattagggctggtattgtccctaagttgatagaaatgctaacagaacctgatggggatatgagggatgaggcaatgacaataatggctgtagtggctaaccattctgatggacaagcagcaattggatctatgaatgttgtatccactttggtggaattagtcagtaacagatctcctgggaacaaagagaatgcaacttcagtgttgcttctcctatgtaatggagaccctttttatttgtccattgtcagttcacttgggttggtcaatcctctcttggacctggcaggaaatggttcagaagggccaagcggaaagcttcccagcttctag

SEQ ID NO: 61903 - DNA, 438 bp, Glycine max
  Peptide Sequence Number=SeqID_178681
atgacattggacatcatagtcaaccctcagtggccggaggtggagggtgcaagagtaatggttggttgtggtggaggtggttggacgtatggaggcagcctttgttgcattaacaagttcatgttgaaaagcaccgagtcattaaaagacttgaaggatgactcaagagaaccttttctccatagtttcttccaagttggcctgttgaaggtgctcctcagacacactagttggagcaactatggtcagaggggttatctctcatggagtattggaagttctgattgttctccattggagcttgtaggcctaggatcttcttcatcaatggatttctttgcttcttggaagatgaatgacagcggaatgaagaagaaagagagaggggagatgccacttcaaggagaagatgagtctagaagaagctcaccaccatag

SEQ ID NO: 61904 - DNA, 330 bp, Glycine max
  Peptide Sequence Number=SeqID_178682
atggcgtcatcaggaagttctttttgggagaaaaatgctaaggatagtgaaggagtggacacaaacacaactacttctcaagctaaaaagagaactaagaagaaaatgggcacttcttcatccaaagttgctcttgttccacggtatccacctcctactctcattgctcctaaggcaacaagtgcaatggcccatgtgaccagaagggcaacacctaagaagcaacaaccattatgcattgtagatcgcttaagggaactcagtgagactaaggatgacgaagatggcttggtatttaagaaaagaagagttgcacccccttcggattag

SEQ ID NO: 61905 - DNA, 324 bp, Glycine max
  Peptide Sequence Number=SeqID_178683
atgttgtgcggaatccaccacttcttcgaggaccccaaggtggtggtgcctgaacccattcgcaagttctggagaactgccaaagtctataggaatgaattcattggaggatacttcattgaaaaggttcttggtataatagtgaagctgactattgagacgattgcccaagccatttgctgtgagcatagaggcacaaagtttatgaacagtcagggcaataaactagaagaccacattggaaacttcctatggggacccaattgggccaacatgccaaagaaatatggcactctgctgagcaaggcgaagatttttcaatag

SEQ ID NO: 61906 - DNA, 348 bp, Glycine max
  Peptide Sequence Number=SeqID_178684
atgactattgctcaacatctacaagcttcctccaaggtttgcaagctaaaaggtgagttgaagaaagttgagatctcccttgactctgcccttaatgccaacattactttggctagggagaacttaaatttaaaggaatgtatttccacccttgaaaaggaattgaaggcagctttggccaaaacggagaaggaaaaagatttcgagagggaaaagaagcaacaaattaagcaaaaagcttacaatgaaatttatagggctcatgaatctggcttcaaccaatgcctctatcaagtgatgtgtttctgtgagattttggataactctatttttgacattgataagtga

SEQ ID NO: 61907 - DNA, 465 bp, Glycine max
  Peptide Sequence Number=SeqID_178685
atgacgagattcttcaacataacaataagttcgattgctaggaataaccatttttttgattcagcaaagaagttcttgtttcctctatattggcaacaagtgccatgtcgatatggtgagcatctgaagagccttttgaccaaagaggagcttagtgatctagcatacctcgagacactccctcaacaacttcttgccaaagcaatagtcactcttcttaagtctattaatcttgttagggatcttaaggctcttcaaaactacattcttctaaatgtcagcaacaccattctagcggcttctattaaccaaatcttgcgcgtagggacctttcgactagtgcagttcccctctcccaaagagccaaaggagaaagacagttgcaaaggcaaaagacaaaactgtgatcacaagaataggtctgcggaaccctccagtcataaggaggccaaaaagatgaagtga

SEQ ID NO: 61908 - DNA, 216 bp, Glycine max
  Peptide Sequence Number=SeqID_178686
atgatgcagaaaataacagcaactgggtgttcagtcactgccctgattgctgcctttgttgcccttgacaaaagccatgctttggatgcggcagtttcagcattagccgtatttggtgttgctggtgagctgggaatgaagatggctaaagatgcacgctacgggcttgatgaagctgccttgaattctcctgttaatgtcaccagtttgtattga

SEQ ID NO: 61909 - DNA, 198 bp, Glycine max
  Peptide Sequence Number=SeqID_178687
atgccccaaccacatgggatcaacatgggcttaaaggagcactcaaaccgagtatctttacccccaaggcctagactccgaagaatccatttgggcctcaccttcctgattcaggtacacacaggaacacatcaattctacaacaaactcgcaacagaacaccaattgattcatcaaatacgctcagtccgcgattaa

SEQ ID NO: 61910 - DNA, 948 bp, Glycine max
  Peptide Sequence Number=SeqID_178688
atgttgtcaacaacattgaagttcaaaactgcattttcagcctatagtgaaagagatccacactatacttatgcaccttcacacgaggattgggaaaaagtgcaaaaggtttgtacacttttagaagtttttaatgtagctacacatataatctcaggcagtgagtatcctactgctaatttatatcttctagaagtttggagggttaaacaagtaatagacaatgcattagaggatacaacttttttcatgagagaaatggcaggttcaatgaaggtaaagtttgacaaatattggggagaatgtaatatgttgatgtccattgcaagtgttttggatcctaggtgcaagttccatgttgttaacatatgttttccattgatatataagtctgaagaaatttcaaaggagaatatagagaaggtacgaaactcacttcaacaattatatgatgagtatgtgactttcagtatcaatgaatcatccttaaatgaaatgaatgatactgtcataaattcttcaactacctctgcatctaaatcttctattgtcactggatttgatcaaataatgaacattgtgcgtgcaaatgaagccatccctccaatgaaatcaggattagaggattatcttaaggagaatgtttatattcctgaaactagtaactcttcttttagtgtgttagagtggtggaggaacaatagcctaaaatacaaggttttatcaaagatggcgggtgacatactagctattccaatatcaacagtagcttcagagtctacatttagtgctgggggtagggtaattgatgagtatcgttctaaactaaatgaagaatctattgaagcgctcatttgcgggggggattggcttcgtcataattataatttgaagaaaaattcaaaggtgaatgaaaagcttgaagaaatcatcttgaagataacttga

SEQ ID NO: 61911 - DNA, 201 bp, Glycine max
  Peptide Sequence Number=SeqID_178689
atggaagacaatcgtcatcatcatcatcaggaacttggtttgcctagacagttcttgggggtcaataataaccctaacacaaatgagcaatattggagtggtggtggtggtgccacttctacttggactgatctttctgctttcagttcttcttccactactagtttaggttgctttgtatgggaaggtttactaaagtga

SEQ ID NO: 61912 - DNA, 279 bp, Glycine max
  Peptide Sequence Number=SeqID_178690
atgaacagagcaatcaatgctttgcaattaaagcgaaaagtcacaaagcctacaggaggaggaggagacattattattgtaactcgtttctggagtgatcataggcaccaaacgagtcttcaaacaaacactgatgatttgctcaggctattaggaacatctgacattcacgtgtcggagtttgtctggagattgcggtgcatggacggaggaattgctttactttataacaacaaacgaagcagaattaaattattgcatttgcatggcatgaattag

SEQ ID NO: 61913 - DNA, 333 bp, Glycine max
  Peptide Sequence Number=SeqID_178691
atgatgaagtgtttttctccattacgatcccgcacgagttgccgtgtcaatctagcttcgttgtccaacgacgacaaccaccgcactatggttcattcctccgcagattcacggcctttcaaatgcggcaaatcacggtggcaatcggccctttcaatcatcaaggaggatcatgtttgcatggctgaagatcaccaaaacatcattgatcggaaattagacaagaaatctttggttgcaattctccctcccatcgacgattacttaacgaacaggcccgaaaagcccaagcgggttctaatggtggcaccgttctccttctccatgttttga

SEQ ID NO: 61914 - DNA, 120 bp, Glycine max
  Peptide Sequence Number=SeqID_178692
atgacatcaagaaggtctctcttttttatcacacgtgccgatggtgtgccacaaacatctgcaaaccatattgggaatacttccatctctctagacgagtctccaagacaagtgaattga

SEQ ID NO: 61915 - DNA, 1004 bp, Glycine max
  Peptide Sequence Number=SeqID_178693
atgatgatgacaataacgatcacaatactaattgtgggtggtggtgatggtggtgacgacaatgatagtgacagttgggtcaatgttagtgtcggtggtggtgaacctgatggtgatgagattgataatgatgatgggttgacaacaatattgcaacactttgccgacaaaaatgcaaaacacttcacctccgacagcaacaacatcgttctccgaatcctctcaattctcttactagctctcatctcactatgggccaactacgaggcatccaaaaccttccacatcaccgtggtaaacgacgccaaggactcccccgcgggacgccgtttcgccctctcctatgtctcaaacgacgaagcctctcgcatactcctcaacacaagctcctacgtagaacactttctttatccaaatagtaataacaatgatagcaattaccccaagaagcacatagatagtgtcacactccagctacctcgccggaatctcaacgtcaccgacatcgttgccgtctacaccgccgccggaaatcacctccaacgaggtggaggaaaatgttttagttatgtcattgagattagccctacgttactagaagaccaaaggtacgataagatagctatagtgggtgcaatcctacgtggcatggctaaggtttggatatgggaaggggccccacaagggcttgttgatggcatggcggagtatgtggcggagatggctggattccgccgtggtatggtctccggtggcggtgagatgccacaatgtagggagggtggtggcggttggtggtgggaggataaggaccctagccatgtggcacgtttgttgcattattgtgagaaattcaagaaggggttcatccaacggttgaatgaagccatgagggacacgtggcatgaccgtgtggtggatgaggtgttggggatgcccgttatggagctttgtggtcgtttgtataatgataataatgcttcttgggttggctccatctccat

SEQ ID NO: 61916 - DNA, 240 bp, Glycine max
  Peptide Sequence Number=SeqID_178694
atggagaggctgtgcaaacaatccttttttatgtctatgccaaaccatgcaatgtcaccaatctatgaagcacggggacacatgttaggtggcattccctgtttacggtactgcacaaggatagcgacggggatgggatggatacggccagggaacgtcgttgacttattgggtacgactaatcaagatggggatgacaacttcatttgtggggatgtattagggacgtcggtgttttag

SEQ ID NO: 61917 - DNA, 312 bp, Glycine max
  Peptide Sequence Number=SeqID_178695
atgtcgtcgtatacctttgatccccaaactcgcatgatgtgtttgtgtagtgtagaggctccattggtgacatcatggactgaggataatccagtgagacatttttatggttgtggttcatataaggtagaaaaagggtgttcattttttgagtggcacgattcacttgtcaatagtcgtgagaagagaatcattgtagcattgatgaagaaggttgatgaattgaaggtcagggaaaaaggtttgcaaaacaagatcagtgatatgaagatgaagggaaaatttttagggattggattggttttgtcttag

SEQ ID NO: 61918 - DNA, 2388 bp, Glycine max
  Peptide Sequence Number=SeqID_178696
atggtgaagaaggtgttggttcttaattctgaggttagtagtttggtttttgatgagattgcgtttggatattgtgagaagagggactttaaagatttgcttagtttctttgttgaggtgaagtgtgcccctagtgtgacggctgctaatagagttgtgaattcgttgtgtagcagttatggcgtagaaagggccggggaagacgagaaatgcattgagttgtttgtcagttatgctattgaaaagctttgtgccgcattggggatactgcctgatatttcgactttcagagtccttattgcgggctattgtaagtttaggcggtttgatgaagtgaaaagtttgattcatgagatggagaaccgtggattgattaagcttgctttgatggagaatacgatttccatggcttttctgattttgggcttggaccctttgagtgtgaagttgaaacgagacaatgatgggggactttcgaaaacagagttctttgatgaggttggaaatggactttatttggatacagatgttgatgacgatggtaacctgaaaaatgcattggttttggttgaagaaatgctttgttggggacaagaattgctatttcctgaattttcaaatttagtgagacaactttgttcatctctttcacaaatcaagtcaatgaccaagcttttggagcaaatgccaaagtctgcccataaactcgacccagaaactctcaatttggttgtacaggcatacagcaagaaaggcttgctttccaaagcaaaaattatactagatggaatgcttcaaaacgaatttcatgtcaagaatgagacatatactgccatattaatgcctttatgtaagaaaggaaacatgaaggactttagttattattgggatgttgcttgtagaaataaatggttaccaggtcttactgacactgcacttgtagttttaaaacaactgcaaccttgtttcaacttggatcatactgattataatcatcttataaggggtttatgcaacgagggaatattttctctagcctttacagtattggatgatatgctggatagatgtttggcaccttgtttggatgtttcagtcttgttaatccctcaattgtgcaaggctcatagatatcacaaagctattgctttaaaagatatcattttaaaagagcagccttcattttctcatgctgcagattgtgcattgatatgcggattttgcaatatggggagcacggggaaagctgacactctgttccatgatataaaagtgggggagctactgggtgttgcaataagaaaagattgggagctatccctcacaagttacaagaatttagtacgattggtttgtaggaaaggtagagtccagttcgcactgagcttaaagaaccttttgcttgcacaatgtccacttgatgggcttatcatatataacattcttatgttctatcttttgaaagatggaaacagtttggatgttaataagatactaactgaaatggaagagaagaaagttgtacttgatgaagttggtcataattttgttgtatatggtttcttgcaatgtagagatttatctagttctctgcattatctaactaccatgatttcaaagggacttaaaccaagtaaccgcggcttgaggaaggtaataagcaagctgtgtgatgctgggaatctgaaaaaagccctggagttgagtcaagaaatgagattaagaggctggatgcatgattcttccattcaaacatctattgttgaaagccttcttctgtgtggtaatatacaaggagcagaaacctttttggacaggatgggagaggaatctctaaatcctgataatatcaattatgattaccttatcaagcgtttttgccagcatggaagattgaacaaggcagttcatcttatgaacacaatgctgaagaagcataacattccagtttccaccagttatgattttatcattcatggattctgtgcacaaaataaactggacatagctttgaatttttattctgagatgttgagttggaatctcaaaccaagaattgatacagtggaaatgcttctccatagattctgccaagatgggaagacagaactagcagaacaattccttgtggacatgagtcatggaggtgaaactccaaccagaaaaatgtattgccctgtaattaagagttatcacatgaaaaagaatcttaggaaggcatcagagctcctgcaagccatgcaggaaaatggctatcagcctgactttgaaacacattggtctctcataagcaacttaaacagtgccaaagcaaaggacactgataatgcgagcacgggatttttatcaagacttctttttaaaagtggctttcttcaaaagaaatga

SEQ ID NO: 61919 - DNA, 198 bp, Glycine max
  Peptide Sequence Number=SeqID_178697
atgggagtagatatcccaaatgacgtcttccactacaacacaaaaacttcaccagcagttgccatttgggatgaagcttcctacgcctacgtggctaaaataatttcctgccatacggaaaaaagtcatgctttgtgtcttcctgggaaacatgaaaacactttgatggtatttttcaagaattggcaagtgagctaa

SEQ ID NO: 61920 - DNA, 689 bp, Glycine max
  Peptide Sequence Number=SeqID_178698
tgcttgttaaatcaggttatggattggcaagaaaacttaaaagccatgggtttcattggggtgatctttcatccaaaccattgcatcaaccttcccctttccctaatattgacaagtgtgatttggagtgtagagggtcacaaaccctagcttgtgactttcacaaagtcctcttaaggactcattccttctttccctatttcatgcttgttgcctttgaaggtggaagcatttttagggcattcttcttgctttgttcatgccctatgctgtggatcttaaactatgaaatgaagcttagggtcatgatcttcatctccttttgtggcctcagaatgaaggacatggaaaacacttcaagggcagttttgccgaagttctacttggagaacctcaaccttgaggcctatgaggtagtggcttcagtagggtccagagttttcttcaccactatgcctaaagtgatggttgaagggtttctcaaggagtatttgaatgctgatgctgttatagccacagaattgcacacttctggttgttacttcactggtttgctctctaagtctggtttgcttgtgaagcatagtgccctcatggactattttggagatacaaagcctgaccttgggattggcaacacaagtcttcatgatcagctttttatttctctttgcaaggtatctctgtag

SEQ ID NO: 61921 - DNA, 810 bp, Glycine max
  Peptide Sequence Number=SeqID_178699
atgacacaggaggcttatgtggtgatcaatgaagagggcaaagtgatgccaagaaacaaatatccaaagcccttaatatttcatgatggaaggctagcatttttgcctactccttccgcaacccttcttatgttcatgtggcttccccttggatttctgatggccatttacagaatttttctgggggttttcctttgttgcaaatttacattggcgttaggaatatggagtggactaattctgaatttcaatgacaagaaccaacaaagatcagagtcaaacaaaggggtgctctatgtgtgtagccacaggactctcatggatccaatttttcttagcataacgctggggaggcgtttgactgctgtcacatacagcttaagcaaggtgtctgaattgatagcccctattaggacaatgagactcacaagggacagagaacaagacggggaaactatgaaaaggttgctttgtgaaggggatttggtggtgttccctgaaggaacaacttgtagggagccatatttactaaggttcagttctttgtttgctgaacttgctgatgagattgtgcctgtggctatgaatgctcatgtgaccatatatgacattcaagtccttggaaaggttcctagagaactcacatgtgctggaggtaggtctagtcatgaagtggcaaattacatacagaggcagttggctgatgctttagggtttgagtgcaccaaccttacaaggagggataaatatatgatgctggctggcaatgaaggggttgttcaagaaaagaaggggagaagattctgctaa

SEQ ID NO: 61922 - DNA, 829 bp, Glycine max
  Peptide Sequence Number=SeqID_178700
atggtttatacttctatcccatcatatattgatccagccaactggcagcaacagcaaccaaatcaccagcagcaaggcaacaacactgctgccagctcccaccttattctgccaccaccaatacaaccgccgccgcctccgccatcgcaacctcatggactcagcggtagcactaccgccgggtccatcaggcccggttcgatggcagatagagcgaggatggccaacatacaggaagctccacaaaagtgtccaagatgtgaatccaccaacacgaagttttgctacttcaacaactacagcctctctcagccccgtcacttctgcaaggcctgcagaaggtactggacacgtggcgggaccttgaggaatgtccccgtaggcggcggctgccggaggaacaagaggagcagaggaagctccagcagcaacaccaggtcgccggcaaactccgatcgccaaaccgcgagtgccggctccgcttcaaccaccagtggctcctcttctgctgacttggtggccagcctcggtggcggcaccggggtgccaccgtctcttaggttcatggctccattgcatcaacttggggaccaccaccaccttggtggtggtggaggagaaatagggttaagctatggcttgaactatggcgcaatttctggtccaatgggaggaataggagacttgaatttccatataggaggcactttgagtgggggtggttctatgttatctggtttggaccaatggagggttccacaaactcaccaatttcccttcttgtctggtttggaagctacttcatcacatgggttgtacccttttgaag

SEQ ID NO: 61923 - DNA, 336 bp, Glycine max
  Peptide Sequence Number=SeqID_178701
atgaagaagaaggccgcaggaactggaagaagaaggatgcgtgtggtggcggtggccgtagaaataggaagaagaaggatgcacgtggtggtggtggccataggtacagggacaggagaaagaagaaggtcgtacggacattgtagctttatttatattattagggtgaaagacatttttgttattacatcctacgcgtttggtgctccagcaaaaatgatgggtgcaccaagtgcacccagtattttatcatattgccaattttgccccttacacaatcttaagaaatacttttttccgtatgagtttacgaaagaacttcttccacttacgtaa

SEQ ID NO: 61924 - DNA, 288 bp, Glycine max
  Peptide Sequence Number=SeqID_178702
atggttatgcccatactagggtctagagactatgtcagtgatagagaaaggttttgcatgtataaggctttcaaagatagattcaaccccaaagtgaagaagaatcatgttccttttggtatgctcttcactcatatcatgcgagatgttgaagttgatgtgtctagaatgacattatctgctagagaaacacaacttaaaggtatgacctttacaaagatgggaatcgctgataatttcccagaatatgctcagaagcatattaagaaaaaaggtcaagaaggatga

SEQ ID NO: 61925 - DNA, 234 bp, Glycine max
  Peptide Sequence Number=SeqID_178703
atgatgggagaacttaagttctttttagggcttcaaatcaagcaggacaacaaagcaccaaggaagaatgaagcagttgtgtttccaggaatcaacaacgaaaaggatgcgaagaacgtgctgccaaaagattccttcatccttgaacgatgggtgaacttccaaagtttagaaaaagagggctttcttgtcaaaggtatctttgatcgcgttaggtggacaaactttctatga

SEQ ID NO: 61926 - DNA, 318 bp, Glycine max
  Peptide Sequence Number=SeqID_178704
atggattacctcacttctactttgggagaaaccaataccatccaactccccgatctacctgaaagagtcacatttgacttcaagcatgggttcctatacatgtttgagaacatgtttagtggtgctgcccatgaagaccctatgcaacacctgaggaagttcatcaagttgaccaacacggaaggcatgggactagctatgttcactactagagaatggcatcactacatggaatcagtgcacaagtaccttcttaaggaggttttctctcctgtggagatgaatcagtacatcaaggacattgggaactttgtgtag

SEQ ID NO: 61927 - DNA, 174 bp, Glycine max
  Peptide Sequence Number=SeqID_178705
atggatcctgtagaaagggaaactctcgaggaagccatgcttcaatctgttattgaaacatctcttgtagaagcaaaccttggtgcagaccttgaaagtccaagcttcaaagactgggagcaatcagattatagccctgagcttataatgaagttgtctacttacaaggagtag

SEQ ID NO: 61928 - DNA, 354 bp, Glycine max
  Peptide Sequence Number=SeqID_178706
atggcaccgcttgctacaccttctccacatgcacccacaaccgtcctccaccgccgctgtcatcgtgaagcaatccacctccccgaggttaacgtgacatcacacaccaccacgcgcaatgcatcctcagccaccggagttgcaaccaagaaccatcaaactagcaactcgaatcatttgagcttttcttccacccatttgaacttcaaccgctcatgcttttcagatttgtttcgtctttgtactctcgattacagcttaacccccttactgggtttagttcctttggatcgatatgcttttgcttgttcatcttttagagtattcagtccctatgagcatagtttttcttaa

SEQ ID NO: 61929 - DNA, 519 bp, Glycine max
  Peptide Sequence Number=SeqID_178707
atggaacaggctacgaaggttcatcttgtgtctttggaaggtttgtgtgtgcctaagaagcatggtggcttgggactttatgatatgagaagagccaatcaagtttctatgttgaaaaataattggaagctgataaataataggactgacaaatgggtccaattgatgtgttctagtttaggagaaataaggatatttttagacactgtttcatggaagatcatggtgtggctagccttattcgtcaaaggtgtaaggacattaaggatagttatgaagtcttcaaaagacaacccagatagtttgatggggattcataataactctaatgcgatcacctggagtcctcctctccataattttgttaaggttaatacaaatgttgcagtggtctttgatagaagagtagctacatatggagaggtcattagggtcctaacaatggtttcattgtgggtttctctgcccggttgggattatgctccatcatccaagctaagctcaatgggatttatatag

SEQ ID NO: 61930 - DNA, 504 bp, Glycine max
  Peptide Sequence Number=SeqID_178708
atgcatatcccacaccttaccagattctacgatgcaaccatagttttggaaaaacacctccgctaccttgccctctctgacaacgagctcaccaatgaaatcactccggagcttggaaacctcttcgccctcctcgagctctacattggctactataatgcctactccagtagcatcctgcccaagattgaaaacctcttcaacctcgtgaatacgctctctgattctctcacttctgagctaggaaacttgaaaagcctcaagccaatggacctttccaataacatgctctacgaagagctttgggagaacaacttcatcgaaagcattcctcagagtttgggaaaaaatggaagaaagggagaaggagaaagggttggacgatgcggtggtggtggtcaacaacggtggtggcacaatgtggtcggcggtggtggtgcggtggtggtggttgccattggagaaggggaagaaggtgatgacgtggtgctgaagtgtcagtga

SEQ ID NO: 61931 - DNA, 315 bp, Glycine max
  Peptide Sequence Number=SeqID_178709
atggtgacatccttcttggaggatctcatatctatgagttgccttagatctatgatgttctggctcttaaatggtagtgagatcaatatgtcaatagggattgcccattcacagtgttgcgaaaaaagatggggcagtgaggacgaggacttgctgaggttaatttgtcgatatgaattgcttgtttacggtgtcgcaaaagacgatgagatggcaaggacaaagactccacaagttgtggtgaataatggtgacgttcttcttgaaggatctcagatctacaagttgtttatttatgacacaatttcttattga

SEQ ID NO: 61932 - DNA, 504 bp, Glycine max
  Peptide Sequence Number=SeqID_178710
atgaacgctttggatgtgaaggacgaagtgggcgtgctaagtgatgaggaaatactacagaggaagaagcttttggaggaatatttgacaattagcactagacttgactcgcttctacaccaacaatctatatctagatggctaaaagaatgggaccaaaactctaggttcttccattctttagtcagagggagaagaagggtaaatgtaatgaaggacctatctattggaggaaggtgggaagatgatcttactctagtgaaggaggaggtaaagaactttttccaatcaagatttttagaagaagatttgaatagaccaactttggatggggtgcatttcaattctttagaatcaaaagatcttgccttgttggatgagtcttttgatgagttggaggatgattttgtcaagttagtggtggaatcccatacttttggaaaattgccaaaggggaaaaatgcatttttcattactcttattccgaagagggataacccttaa

SEQ ID NO: 61933 - DNA, 513 bp, Glycine max
  Peptide Sequence Number=SeqID_178711
atgcctaagaaggtgaaggataaggttgtgagattaaaaagagcatttcgtgaggaggtagggaaaatagctaggaacacaaaatcatcaatttggtggaaggacatgctcaagtttagtgtgggtatagatgagggggggggggggggggctagttcgaatgtaacacatcttggaaggtgggagatggaaaatagtgcgtatagggtcctgaagagctatactgaggtggaagatcccgatcccattttcaagatcttgtggcaaacatcaattccatcgtctattttatttatggcatggaggctatttggtatagaagtctcaagtggattggtattcaatcgatatagcactgccatccaaaagagcactttaaacaattttgtcctggatttatttggcgagatacaacagagaggtggagagccctttggttctcaattgtttggagtctctggtgttagaatatctttaatctttattctttatacggaagctaaaaattcatag

SEQ ID NO: 61934 - DNA, 918 bp, Glycine max
  Peptide Sequence Number=SeqID_178712
atggatgtgttgcgaataagttttgatgagctcaatgacaaagataagaaaatatttctagatattgcttgcttcttcgctgattatgacgaggattatgttaaggaaattatagatttttgcagatttcatcctgaaaatggcttacgagttcttgttgataaatcactcataagtattgaatttggaaagatttatatgcatggcttgttgagagatttgcgtaggtatattgttcgagaagaatcacctaaagagccaagaaaatggaataggttgtgggattacaaagatctccacaaagttatgttagataataagccgcacaagctcattgagatgtcccttcctgagagtaacatgaaacaattatgggaagacaaaaagattgagatagaagaaggtccagttattatttattttgcctcctgctattgttcactgcatcctctacacaatttgagacatttagataactctcactccaaaaatctaatcaagataccaaatttgggtgaggctataaatcttgagcgtctaaatctcaaaggatgtacactactcaggaagattgatgcatccattggtcttctaagaaagcttgcatttttgaatttgaaagactgcacaagtctcatcaagttacaattttttggagaggctctatatcttgaaacgttaaatctggaaggatgtacacaactaaggaagatagatccatccattggtcttctaagaaagcttactattttaaatttaaaagattgcaaaaatctattatttgatgaaccaagggatgatgagctttcagagaagctttgtatacgtgaagctcctactcaatcccaatcaacatcctccattttgaaaaaggttgttttcgaggcctttacatttggtgtatgccaaagcacataa

SEQ ID NO: 61935 - DNA, 1647 bp, Glycine max
  Peptide Sequence Number=SeqID_178713
atgagggtcgaggagcatactaccaactcaagaatccaaacaggtgatgtgtatcataggtcaacacaacatgtcacccctctcaggacatatgccaatgtggtagcctcaacagcaacagacgccggacagaggaagcaatttcaaccccgatataccaaccaaaggcactcacaatcgacagtccaactcgaagtacaatgggaggaaaagaaatggcttacagaagcatgggtgggaaggctaaagaaactaactgcttttgaaagcgtagaggaagatttaccatgggaattaggagtggataggacaaggccaggttacagagtgatatgggctcagtgctggggaattcccctagaggtgtgggacatagggagtatatggaagatagtagttgcggttggggagcttgtcgaagttgacgatgatgttgaggatttcagaagactagacagggcacgagttctcatcagaactccatggagcccgttttttcaccacacagtgcaagtaacgattggaggggagatccacatggtgtctatcattgaagaagcttcagctgatgcaagaacgcgcgctaatcgatttcgcatggcaatggagttgtcggaggacatacactccgatgacctcgataccgacgctgagtttgattcggtgccggcaggtcaccctttcttttgccagccaaacaaccccgacgacgaaggaatgcagagcctccccggagacggaagggacaacaccgataatacccatcgcgcgctgttacccgacatcccaagatcaaacggaagtccgatgggtaataccctacagacatctggcctcgaaaaccgtgagcgacctgaacctgggaaagcaaaggtgcctccacttgcgccacaaatccctgcatacccgcatgcacaattagggaaagtcaacaaagacgaggctggaaagaggaaagaagcaaagaccaggggtgtctcttcagaagtggaagagagagcagttttcgctgataaggaaagagacgttgaaggccaaaaggatgatgaccaacacagaaatatagggccaaaaaatatctcagcagctttgccacgtaagagtcacataaggggtattgaagaaaataaaaagttgggccatcttaaccaaaaaccagcaggcccaatacctcaggaaagtagtaggaagggctcaatgcagtcagtaattgtgtgtgacatacagcaacctccttgtgggccaacaaatcaaatgggcctccctaatcagatcagcgccaacagcaaacaacaggaaaataacacccatgttattcataattccagttgcagcaacgaatgtaaagtttttgttagaagaaaggtgtggaatcagaaacagggccaacagaggggtcatcaactcccccagggcaagtctccaactttggacatggcctcaacatctacaggccatggaaagcagcctgataacaacagtacagacaaggcagaaaactctaagggaacctctgaaaatacaagacaagtggcatcatctcaatgggaggtagcaaaaatactgggggtaatcaacaactcagtccatgaagctatcatcaacaagatagatgaaatggagaaaagagacacaaaggaggcttag

SEQ ID NO: 61936 - DNA, 768 bp, Glycine max
  Peptide Sequence Number=SeqID_178714
atggcgttgggacctctttcacaaacaggaggagttatgggcaaaagtaatcaactcaaacagcaaaacctagtaatcaaacgggaaaccgcttggaaggtgggtggaggtgaaaagtttagattctgggagaatccttggactgataatggtatgccactaatggagaaattcccaaggttgtacctcatatcaagccaacaaaacacacgcattatgcaaatggggtgcatcaacaacagtggatgggaatggaagctcacttggaggagggatctatttgactccaaagtagaaatggcggacatttttattggggatatttcaaagcagcaagttcagcctcataggaaagatacctggatatggaagcatgatcaaagcgggagctactcaacaaaaagtgggtatgacctaataaggagagagctaacgggggcagaccatgactctgatttcacggacctatggaagctaaaaatctcaagtaaagcggctatgtttgcatggaggataatcttgaatagactaccaacaaggatgaaccttagaagacggcaagtgatggtaaatgactcgatgtgtccactatgtggattgcgggaagagaaggctgctcatttatttttcagctgcagcaagtccctacctctatggtgggagtcgttctcctgggtcaacctggcaacaacattgctgcaaaaccctagtgaccactacctgcagcattcagcagggacagcggaaggaaagctgcttacaagatga

SEQ ID NO: 61937 - DNA, 663 bp, Glycine max
  Peptide Sequence Number=SeqID_178715
atggatttaaacagatcagccagagctcaggaattgatttccttcaacaatggcttctttgcttccttgttcctctgcttcttattgtgtgatacttgcgctgagcgcacatgtccagttgaatcaagtggtcataagctaaacacaggatgcgcgcttgctcatgacagctgtcttctaataacgtactgtaccaacccttgtgcttgccaaggctgcttaaacggaccaaaatatgcagagacaattgttgagactaaacaacaaattgaatcccataatccaattgcatttgctcccaagattgttcagcctaccactgatatttcttcacatatggatgatgaaaatctgacaacaccatcatcggcaaggcacaaaagtggttgcaattacaaaaggtcaatgtgtctgaaaaaatattgtgaatgttatcaggctaatgttggatgctctagtggatgccaatgtgagggatgtaatgtccatggcaagaaagaagattatgttgcatttgaacatacttcgagtaaagaaagggtgagcagtattgttgaagaaggatcagcccacacttttcacaataaactggaaatggtggctagcaagactgtttatgattcactgcctctcacctataacgccatcattgcaatgctctga

SEQ ID NO: 61938 - DNA, 516 bp, Glycine max
  Peptide Sequence Number=SeqID_178716
atgggggagggatgttgtacgcagccttacccttgcatatgcaaggaggctgtttccggattcgaacccatgaccaacaagtcaccaaggcacaactttaccgctgcaccaggaaaatcttggaagatcattaagagtttcttgaaaaggcaagaaccattccagttttgggtttccaccccctggccaaagttgcatccaaacacaggaatattttccattcccctggcagttgacattaagctccttgggtcccttaacagagatgatttaaagaaaatttgtggggataattttcctgaatggatatcttttcctgtatatgagcaggtgaaatggctaaacaagcagctgtccaaactttggccatttgtggcagatgcagcaacattggtgattagagaatctgttgaaccgatattggaagagtacagaccagctggaatttcttcattgaagttcagcaagctgtcccttggaaatgttgctccaaaaattgaagaggaatctgtgtaa

SEQ ID NO: 61939 - DNA, 321 bp, Glycine max
  Peptide Sequence Number=SeqID_178717
atgccattaacgaagaacaagaaagcttatcttgatggtgaaaacagcacgcagcgaaagagacgtcctcaaagtcgacaatggcggtggcacgatagaaaccgacaaagaggaagcaagaagacgaaggaagaaggtgagaagggagacggtgtcgtagcactcaggcgaggaaggaacattaatgcgagagagggtccaaaacaaatgtttaacactcacagcacaaaatgccgcgagtcacaggttcctcggagtaaattcaaaaagcttaaacttgccacgtgtctcagttcttcttcggattttgaaagctgttga

SEQ ID NO: 61940 - DNA, 636 bp, Glycine max
  Peptide Sequence Number=SeqID_178718
atggattgctcaaatcctgccattacaaaagcaatgtctgagggagttcggcttcatactgttccgaggatgcctcggattctacttgctgcttgtggatgtattgatgcgctcaaattcagactactttgtcaagagttttcaggatgggcaaaaattagtgttgttttcacaaaatcatcgttacgttttattgatacagaatcattatttcctaaaggtctaaatgtttatcgaagtaattctgccaatgaacttcttcaatgggctgatatcatggtcattgctccactatcggcacacacccttgccaagattgtgggagggatttgtgacgatctactgacaagaattgtacaagcatgggaccgcaagaagccattttatgttgcaccatcgatgcacctttttatgtggaaaaatcctttcacagaaaggcatctcaagtgcatagaagaagaacatgacattacaatcatcacacgcaaagaaaggggcagcatgacagtcatcgaaccccaagaagatgaagataaaggggaggaatgtgagattggtgcaatggttgaaccttctgaaatttcttacactgtgaagatcgctcatgaaatcattttgacatattatccatgttga

SEQ ID NO: 61941 - DNA, 627 bp, Glycine max
  Peptide Sequence Number=SeqID_178719
atggattgctcagattctgccagtgttaaagcaaagtctgaggcaaaacttggtgttccgaggaagcctcgagttctacttgcagcttgtggatgcgttgctgctgtaaaatttgggcttctttgtcattgttttatagaatgggcagacataagagctgttgtcacacaatcatcgttgcgttttattgatagagcatcaattcccaatggtgtatttgtttattatgatgagtatgaatggtatagttggaagagaatggacattgagcttcttgaatgggctgatatcatggtcattgctccgttatcggcacatacccttgccaagattgcaggaggatactgtgacaatctactgacaggtactgtgagaggatgggacccgagaaagaagccaatatttgttgcaccatcgatgaaccctttcatgtggaaaaatccttcgacagaaaagcattgcaaaaagtgcattgatgagcttggcatttctctcatcccacctatttcacagaggtcaggtgaaggggaatatagtactggtgcaatggctgaaccttctgacatttcccgcaatgttatgatctcttattcgaagtttcagaaaaagaatgttggtggggtttag

SEQ ID NO: 61942 - DNA, 222 bp, Glycine max
  Peptide Sequence Number=SeqID_178720
atgaggtacaagtgggacaagcgccaacctttcccaaaagggactaggtacgagcgttgcacacccctaacgaccaatcacactacgattcttgaggaagctttcaacttggagcctagtttgttaaatggacggacgaccactaagcaggagcaagacttggaggacaccaataggagcaacataggaactatgaagaagacaaaagaagatatagagtag

SEQ ID NO: 61943 - DNA, 1062 bp, Glycine max
  Peptide Sequence Number=SeqID_178721
atggttttccttagaattatgcttccagaggaggaagaggaaaccaaagtggcttttggtagaggaaactcaggaggaagaggaagtataaagccattagtggcaaaagggtatactcaggtggaagaacaagactacctggacactttctctccagtagttaaactaaccatagtgagatttttattggctttagctgctattaataagtggcatctcaaacaactagatgtgaacaatgttttcttacatggtaatttaaatgaagaagtctacatggtcatccctcagggtatgcaagtagctagaccatggctagtttacaagcttcaaaggtctctatatggcctgaaacaggctagtagagcatggtttgcaagattatcatcttttctgatttcccatggatacaagcaatgtacttctgaccattcttttttcattaagcatggttgcaacacaattgttattttgctggtttatgttggtgacattgtcttgtcaggcaatgatttgtctaaaattcaaagaattacaaatctacttgacaatgctttcaaaattaaggacttaggagactttaggtactttctggggtttgaggtagctagaagctctattggtataaatctatatcaaagaaagtatgcactggacattctcaataatgttgacatgcttggttctaagccagtttctacaccttgtgattacaccaccaagcatcaacactcagggtcacctatttcagcagaagatattgcgggagggttgtgtgacgatcttctgacaacgattgtgcgagcatgggactacaggaagccactttttgttgcaccatccatgagcacttgtatatggagaaactctttcacagaagagcatttaggtgaaattgatgggcttggcatcatgctcatcccacctgtacctgttaatggggatcttgagcgcgcaatggtggaacctgctaccattatctcaagagtgaaagcttcttataagaagcaaaagatggagcagaaagagggtagtagtagtactagtagtggtcaggtttag

SEQ ID NO: 61944 - DNA, 825 bp, Glycine max
  Peptide Sequence Number=SeqID_178722
atggaccgagtctctaaacaacagatcggacaaaacgtcgaggtatatctggatgacatggttgtcaagtctcaaaccatagcccaacatgtggcagacctggaagaagtctttgcggaactctgcaaatatgacatgcgcctagaccttgaaaaatgtactttcgggatgcacaacccgaccaacgtccaagaagtccacaaattgaatggtaggctagcatccttgtccaggttcctcctgaagttctccaaaaaggcgaaaccattttacaaactgctcaagaaaattgtgcccttcctatggttcgagacttgtgaacaagctttcttggctttcaagaaaaccatagccgcaccgccagttttgagtcaacccactccaggaatacccttactcctgtatctctcagtaactaacaaagttgttagctcaaccctcatacaagatgaagggaatcattatctccctatctatttcactaaccacatactccaagacgtcgagcagtgctatcagatgattgaaaaggtggcactagcactcattacctctgcccgacgacttaggccctactttcagagtcatcaagtggtagttaaaatgaactatcctatcaagcagaactttcagagttcgacatccagtaaaaacctcgtggcccatgaagacacaatggttgactctctagtagaatttgttggaaatgacataaccaccccagaccggtggaacctttactttgactatgcattccacgtagagtatgggacgctcgttgcaagtttgaagctagcaagagaagtcagagctaagaagttgtga

SEQ ID NO: 61945 - DNA, 240 bp, Glycine max
  Peptide Sequence Number=SeqID_178723
atgattgaaggcatcgagctgacgctgaaatcactgctgggtgcggtgcgcaagttcggcgtggaagtggtgggcgaaactaatgtgccgttcaacccggatgtgcatcaggcgatgtcgatgatggagtctgaagaagtggcgccaaaccacgtgctgatggtgatgcagcgcggttacaccctcaacggtcgcctgctgcgtccggcgatggttgcggtatcgaaagccaaaggctaa

SEQ ID NO: 61946 - DNA, 285 bp, Glycine max
  Peptide Sequence Number=SeqID_178724
atggtattggaaatagaagcaggggagatcagagcaatagttgtcttcaacgaaagatcaaaacttgatcctaactcatcaattaacccagatctaaacgagaaagtcacaatgtggctctttgtgaggttagtgagtaagacatccactgatgcacacggttgggtcgggcaaactaggggtggaaatgagccgagctgcttgtcaagggtctttggcttagcctatgtaaggtttggctcggctcggcttgtttactttaaaggccaagctcaagctttttaa

SEQ ID NO: 61947 - DNA, 234 bp, Glycine max
  Peptide Sequence Number=SeqID_178725
atgacgaagcttcatagagtaagaagagaggatcatagagctttgggagacaggttctcagagacagggctcaagagaaggaagagagtgaaagagcttcgagtgttcgaccgcaacaacatggaatatagctttgacaacaacggtgggcagaagaagagcatgagacataactccaacaacgtaaatgagaaggcgatagagcttcatgagaaggtgcgagagaggcaatga

SEQ ID NO: 61948 - DNA, 615 bp, Glycine max
  Peptide Sequence Number=SeqID_178726
atggaacaagaaatgataagtcaggagaagcagaaagaggtcacagatatcgcagaaataggagatattaccaaaatgaaaacaaagctaattgaaagtactggaattatgacagatctttctccagctgtagttgtagtttatcatggtgataaaaacccaatttatgaatttggaaaattagatacaggcaaaggattaaaagaacttgcacaaatgggagatcctaataagcttcaaaacagtttaaaacttttacctaatgtaaaagaagttcatgttgctggaaacatacaaattgatccaggacaaaaagcctctgcaagttttgagatgaacaaaggagataagctagcctatgtagttatgtttggtgtttcaaatgattggttttattccaataaagaagttattgattctaaagtagaaggagatttgatttccaaaacaactttacttgatttaggaactgggattgatcaatatccgggagcaggaaataaccaagttttatttgggggattttcacaacgagaaagcaaaaacatctctaaagtcggaaatatatatcctattcctgctatgcaaaatgttttgaaaattaatattgagtaa

SEQ ID NO: 61949 - DNA, 361 bp, Glycine max
  Peptide Sequence Number=SeqID_178727
atggacgaatttacaattgatgaggcctatggcttcaatgataaagaaaacgatggaacagtaggtgaacgtttatttgcaatcactcttatcaaagataaaacaaaaggctatttggtagatgtgtatgcagggattgaaacggtgcaagcaaatgaagtatatactaagttcgatgtcattaacgcatatattcaccatatagacgacgaggaaacaaagtatggcttacctcgtgtcaaaaaaatattatttgatgaagctcctgatcgatatacatttcgtatagggttccccgactttccaccttgcccttttggaaataaattcgaagcccttggatgggataaagaacatcaag

SEQ ID NO: 61950 - DNA, 252 bp, Glycine max
  Peptide Sequence Number=SeqID_178728
atgcaagattgttcacaaagtgtagctcccattgtgaaaggtgatttcttgataaataactttgaatgggaactcatgaagaatattttgtatacttcagctataggaagtcttatgtatcctcagcgagcattcgccaagcgcgacactcagtggctaagcgcgagcaagaatcccaaagaagatgagctgtcaggttcgctgaccgcaccgctccaggtcatcaagcaaccgcttcaactcatccgctaa

SEQ ID NO: 61951 - DNA, 234 bp, Glycine max
  Peptide Sequence Number=SeqID_178729
atgaattataagccatggtatgtatgtgaagatcacgttttgtttctcaggtcactaggacaggcagcactagatatctctgcattcattctagttaaggcaaatgaggaagttgaagaaagagcaaaaagagttgcttcagcagcacgaagatggaaggaatacttaaggagggttgttgataagcctcccacatttaaacttccagaggcaagccttagcaaggacaagtga

SEQ ID NO: 61952 - DNA, 1002 bp, Glycine max
  Peptide Sequence Number=SeqID_178730
atgaaagaaacccccagtaccgatatcatggatgtgttgcgaatcatttttgatggattggagacaatggaaaaagaaatatttttagatattgcttgtttcttttcaagtgatcaattccggggttatgacgggtggtttgaaacttctaagaaaattctaggctatcgaggattttatcccgaaattggtatgaaggttcttgttgaaaaatcactcataagttatcatagggggaaaatttgtatgcatgacttgttgaaagagttgggcaagactattgttcgagaaaagacacccaaggaacctagaaagtggagtaggttatgggactacaaggatctccaaaaagttatgatagaaaataaggaagccaaaaatcttgaagcgatagttattgatattgaaaaatatcaagaagagtttctacaacgaacaatgacagtagatgctctatcaaaactgattcatcttaaattactcatgtttaagaatgtgaatttttcaggaatcctcaattatctttctaatgaaatgacgtatttatattggaaaaactatcctttcatgtctttgccatcaagctttcatccggatcaacttgtagaattgattctaccttatagcaatatcaaagaattgtggaaagacacaaggtatctacccaatttggaaattctagatctcaaatactcccaaaatcttattgagatgccagacttaagtggagtcccacatcttagggatctcgatctcgaaggatgtacaaaaattgtacgcatcgatccatccattggtactctaagagagcttgttcgtctgaatttgaggaattgtaaaaatcttttccttaatctgaatatcatttttgggcttagttctcttgtggtccttaatctctcaggctgttacagaaaccaagggagacagaacatatggaaaaaattgatgaaaatagaagttccatccaattatcaacatcctctgtataccaaatgctaa

SEQ ID NO: 61953 - DNA, 414 bp, Glycine max
  Peptide Sequence Number=SeqID_178731
atggctggaaatgggatttctgaaagcaataaggttaagacttatatgaatgctattgaggagcagtttgttagctccgataagtccatggccagcaccctaatgaaaaagctttcaagcatgaagcatgataatattaaagaagaagagagattgaagcatgaggcacctaaaagtgctcatatggtgactcataataaaggaaatggaaaaagaggaaatggcattcctagactccataagactgtccaaatgaagcaaaatggaacaaagatgaatttctttttctataagaaggtgggacatatgaagaaggattgtctcaaatacaagaaatggcttgaaaagaaaggattacgcattctagtaaaaacaaaagtcatattattacatgcatcttttagagagttttga

SEQ ID NO: 61954 - DNA, 3138 bp, Glycine max
  Peptide Sequence Number=SeqID_178732
atggcagcagaaatggttgctggtgctcttgtttctactttcgttgagaagacaattgacagtttggcttctcgttttgtggactactttcgtggaagaaaactcaataagaagctgctgagcaaaatcaaggtgaagctactagccatcgatgttcttgctgatgatgctgaacttaagcagttcagagatgctcgtgtcagagattggctttttaaggccaaagatgtagtgtttgaagcagaggatctcttggctgatatagactatgaactctccaaatgccaagtagaagctgaatcccagcccattcttaaccaggtgagcaatttcttcagaccttcttctttgagctcttttgacaaggaaattgaatcaaggatggaacaaatccttgaagacctggatgatcttgaaagccgaggtggttatctaggtttgacaaggactagtggtgttggggttggatcaggatcgggtagtaaagtgttagagaaattgccatcaacatcttcggtggtagaaagtgatatttatggcagagatgatgacaaaaaattgatcttggactggatcacttctgacactgatgaaaagctatcaatactttctatcgtgggcatgggcgggttgggtaagaccacgcttgcccaacttgtatacaatgacccaagaatagtgagtaagtttgatgtcaaagcttggatctgtgtttcagaggaatttgatgttttcaacgtatcaagagcaattcttgacacgattactgattcgactgatgatggtagagagctagaaatagttcagagaagactaaaagaaaaattggcagataaaaaatttctcctcgttttggatgacgtttggaacgaaagcaggcctaaatgggaagctgtgctgaatgctcttgtttgtggagctcagggaagtaggatccttgtcacaacacgcagtgaggaagttgcttctgccatgaggtcaaaagaacacaagctggagcaattacaagaagattattgctggcaattgttcgcaaaacatgcattcagagatgataatcttccacgagatccaggatgcccagtgattggtaggaagattgttaaaaaatgtaaaggacttcctctggccttgaagtcaatgggaagtctattacacaacaaaccatttgcctgggaatgggaaagcgtgttccaaagtgaaatatgggaattaaaggacagtggtattgttcctgctttagcattgagctatcaccaccttcctctccatctcaagacatgctttgcttactgtgctttattccccaaggattatgagtttcacagggagtgtttaattcagttgtggatggctgaaaatttcctaaactgccatcaaggcagtaagagtccagaagaagttggccagctgtacttcaatgatttactatcaaggtccttctttcaacaattaagcgaatatagagaagtatttgtcatgcatgaccttctaaatgatttggcaaaatatgtttgtggggacagctatttcaggttgagagttgatcaagcaaaatgtacacaaaaaacaacccgtcatttttcagtttcaatgattaccgaacgatattttgatgagtttggaacttcatgtgatactaaaaaattgcgtacatttatgccaacaagccactggccttggaattgcaagatgtcgatacatgaattgttctccaagttaaagttcttacgcgtcttatctctgtctcactgtttagacattgaagagctgcctgactctgtttgcaattttaaacatcttcgttcgttagacctttcccatactggcattaaaaaactacctgaatccacatgttcactctacaacttacaaatactgaagctgaatagttgtgaatctttgaaggagctgccctcgaatttgcatgaactcaccaatttgggtgttttatctttgtcttcatgtcattaccttacagaagtgcccaactctataggcgatcttaaacatcttcgttctttagacctttcccatactggcattaaaaaactacctgaatccacatgttcactctacaacttgcaaatactgaagctggatgattgtagatctttgaaggagctgccctcgaatttgcataaactcgccaatttgggtgttttgtctttgtcttcatgtcattaccttacagaagtgcccaactctgtaggcaatcttaaacatcttcgttctttagacctttccagtactcacataacaaaactacctgactcaacatgttcactctccaacttgcaaatactgaagctgaatagttgtgaatatttgaaggagctgccctcgaatttgcatgaactcaccaatttgcatcgccttgaatttgtaaatactgaaattataaaggtgccaccacatctgggaaagttgaagaatcttcaagtatccatgagttcgtttcatgttggtaaaagtagcaagttcactattcagcaattaggagagctcaatcttgttcataaaggattatcatttagggagctgcagaatattgagaatccctcagatgcattagctgcagatttgaaaaataaaacacgccttgtggaactagagtttgaatggaattcgcaccggaaccctgatgattctgccaaagaaagggatgtaattgtaattgagaatctacaaccttccaaacacctggagaagttgtcaatcaggaactatggtggtaaacaattccctaattggttatccaataattctttatcaaatgtggtgtccttagagttgagaaactgtcaatcttgccaacatttgccttcccttggacttttgccatttctcaagaaacttgagatttcaagtcttgatgggatagtgagcattggtgctgattttcatgggaatagctcctcttcatttccatcgttggaaacattgaagttctcctctatgaaagcatgggaaaaatgggaatgtgaagctgtgagaggtgcttttccatgtcttcaatatcttgatataagcaaatgtccaaagctgaaaggtgacctcccagagcaacttcttcctttaaaggagctagaaattagtgagtgcaaacaacttgaggcttcagctcccagggctcta

SEQ ID NO: 61955 - DNA, 393 bp, Glycine max
  Peptide Sequence Number=SeqID_178733
atgatgatatggagtcctaatgttaatgggagctacacttcaaagtcagcttattcttggttgctccatcaaaggaggaggattttcttcattgcttcagagattgtattctccctaagtggttttggagaaggttgggttttgagaagcttgatttctttcatcacacttgtcatgtgcagtggcttcaaacatataccaagggtgagaaccatagctggttcattgttggattgtggtgtgtttggcatgctaggaatgatatttgtttcaaccataagcgaaggtccttgtaggaaatccataagtcaacttccattatgctgctcttattttcatcatctaggatcagttgaacgatcagcagaatgttcaattgaagcatatgcatag

SEQ ID NO: 61956 - DNA, 801 bp, Glycine max
  Peptide Sequence Number=SeqID_178734
atgagtgataatggatttgactctcaaaagacttttccgctagatttcttcccagcactcaggacccttcgtctcagtggctttcgtaatctactgatgattacacaggatcagacccataatcatcttgaagttctggcattcggtaagtgccctcagttagaatcattgcctggaagcatgcatatgctgcttccatctctgaaggagctagtaataaaagattgtccaagagttgagtcgttccctgaaggaggtttgccatcaaatctaaaaaagattgaactctataaatgctcatccggactcataagatgctcctccggactcatggcctcactgaaaggggctttgggagacaatccctctctggaaagcttggggataggaaagctggatgcggaatcttttcctgatgaaggtttactgccactctctcttattaatctaagcatatatggttttccaaatctaaaaaaactggactacaaggggctctgtcagctctcctctctcaagaaattgattcttgatggctgccccaacctccaacagctaccagaggagggtcttcccaattccatttcaaatctttggattattaactgccccaacctccaacagctaccagaggagggtctttccaattccatttcaaatctttttatcatagcctgccccaacctcgagcagcgttgccagaacccaggaggccaagactggccaaagattgcccacattccaactgtacgatgtacatcttattttagggatagaagagatgcttgtgtaataatgtga

SEQ ID NO: 61957 - DNA, 150 bp, Glycine max
  Peptide Sequence Number=SeqID_178735
atgacagtagcaagcgcctgcaagttccaagacccatccctaaacagatcatttatccttagaggcttatcacccaaaccaaatggaagagtcccctgctccaatacgcaagtgaaagccacttttcaaagcatccttggcttttattaa

SEQ ID NO: 61958 - DNA, 1164 bp, Glycine max
  Peptide Sequence Number=SeqID_178736
atggtctcacgaaaacgccaagccgtgcctgcacaaggaggagaatccacctgggattcttctcggttcacttctgagatcgcttggcacaggtaccaagataacgttcacctccggaacattctaccggagaggaacgtggagctggcccccggtatgtttgatgattttcttagggagctccagaggaggcagtggcaccgggtactgaccaaactcccggagaagcaaattgatgttgccctggtcaaggagttctactccaacatttatgacccagaggatggatcccataaatactgcagggtgcgaggacatgttatcaggtttgacgctgagacgatcaatgacttcctcgacaccccagtgatcttggctgatggagaggactattcggtgtactcccagtacctacatacgtacccagaccatcaggccatcacaacagccctgtgcatacctgggggtggatttgttctaaacgctgatggcgccccctggaagctattgaggaaggatctgacgacgctcgcacagacctggagcgtactctcttattttaaccttgcccctacttctcacacttctgatttgaatgttgacagagcgcgactgatatacgggttggtgatgaagatggacatggacctgggcagtttcattttcgatcagatcacccagatcgcccagtccaacacctccagacttgggttcccagcgttgatcacagcactttgtgacgctcagggggtcgtctctgacaccttgacctttgagtcattgagtcctgtgattaacttggcttacataaagaagaactgttggaatcccgcagatccatccatcacatttccaggggcccgtcgtactcgtgccagagccaccgcaccagatgccctacctccttcacagccaccatcccaggctgtgcatcatcaacagacatccactttagctccgctagacacacatagccaaatgctccagtccttatatcagggacaacagatcatcatacaggacttgcatcgactgtctcttcacctgaagatggacccaccactcacgaccccagaggcctatgttcagcagccttttggagtccaagacaccatggttggagctgaggaggacatcattgcggacctggcagctactgactaa

SEQ ID NO: 61959 - DNA, 624 bp, Glycine max
  Peptide Sequence Number=SeqID_178737
atggattgctctgatccagcaagtaaaaaggcaaaagctgaggcagggtgtgctattacaaggaagcctcggattctacttggtgcttgtggaagtgttggtgctgtgaaatttgggcatgtttgtcgttgttttgcagaatgggcagaagtaagggcggtggtcacaaaatcatccttgtgttttattgatgaacaaacatttcccaaggatgttgttgtattttgtgataagcatgagtggcttacatggaaaaagctaggtgatcctgtgatgcatattgagcttcttagatgggctgaaataatggtcattgctccattgtcagcaaatactcttggcaagatagctggagggttgtgtgacaatcttctgacatgtattgtgagagcatgggactacagcaagccactgtttgttgcaccatccatgaactctattgtatggagaaaccctttcaccgaacggcattgcaccgagattgatgagcttggcatcactctcatccctcctgttacacatacaacagctagtggggattttgagcatggcgcaatggctgaaccttcaaccatttcctcgactgtgagagttttttatgtgttaaagatgcagaaaaagtag

SEQ ID NO: 61960 - DNA, 333 bp, Glycine max
  Peptide Sequence Number=SeqID_178738
atggagaaggagggaagagatgactttagagagggtttcccctatttgagaagctcaggctttaagggagggttgtgtgataatctgctaacatgtattgtgagagcatgggactaccgcaaagcactttttgttgcatcatccatgaacatttctatggggagaagaaacccttcgagagaacagcatcgcattggcattgatgagcttggcatcactctcatcccacctagtggggaatctgaggttcgcgcaatggctgatccttccacgttctaccatttactcaattgtaagactttattattggcaaaagatgagggaaaggaataa

SEQ ID NO: 61961 - DNA, 360 bp, Glycine max
  Peptide Sequence Number=SeqID_178739
atgaacgtcccctccctaacagcacgatcccaccaccatcaaacaccacaacaagcccagtgttaccatacagcaagaattttcttcacacggactcattattcatcaaagacctggtatactgttcttggaaattatgcctttgcttttgaggaagtcatccgcagcaagggttatagagttgtagtgggagttattcagcttgattcctccttgatcttctccggtcataacatcctcagcatctatggtgggagtttggagcgtctcctggatgatagttttgaggtgctcaggcttattggtgttagccaggttggagagcaagtctattttgatattgctctccttgggatgtag

SEQ ID NO: 61962 - DNA, 1950 bp, Glycine max
  Peptide Sequence Number=SeqID_178740
atggtggacgtggacgacgacgtcgaggaggttcaaaggatggacagggcacgggtgcttatcaaaacaccgtggaggccagtaatacagcacactgtcaacatacacgtccaaggggaggaactagaaactgacgaaagcgacgccggaacgccgttgaaggaaacgatatgcaggatggagagggaagatgactcgcagttcacggtggtgccgggaaacaccgacacgttgacaacaaccaccccaatctcatcgtcgggaacaaagatccacgagctcgcgcttttacccgatggaccaaaaggaaatgcaaatcacgcttttacccgtcgggaacaaccacttcaacctcattgtaggattccaagcagacaagggacagagctgactactcaacagctacccacgaggatcagcccgcgcaccatcgcttggtcccagttgaccgagaaggcaatacacacaaaaacggagacacgtgaccctgagggagagtttaaaactggattgggctttgttacccacaccctcactgcaacaacagaacaacatatctctagcccacaaacaaacaaagctgacccaactagtgcatggcaggtatactcgcgaaaaaggtggtacaaaaagcaactcgacttgggctgtgcagctggtgtaattttagacacagccacggctctaatattatcaagcccacaacaacaccatcaggagaacaaagataagtgtggtactaaccaagacgaaataaatgcccacctagatgacgcatcagcacaagatgcagctgaggatgcaaactcagccaacattcaaaagcaagaggcaacagctttatggaacatggcaaaagaattgggggagaagtaccccatgaacattatcacatacaatgtcagagggctagggaggggagtcaaatggccaacaattagaagaatggtcaacaaacagcacatagacatgatctatatccaggagacaaaaaaggaggtaattgagaaattcatgtatcaagcattgtggggggattctgaagttagttgggaagcacatcctgcatctaactcagcagggaagtggcttaaggaggcacagcaagttcatgttatcaacatctattcaccatgtgatattcagaataagagagttctatgggacagtaaagattggatgggggaaaacaacatcagggagttcaatgaatggattgaagagctggaggtagaggaagtgccatgggtgagaagaaaattcacatggttcagaccgaatggagctgctaggagcaagttggacagattcctgggtcccaaacctttcagtatccttgactgttggctcttggacaacccattcaagaaaactgttcaggaatcttggacctctaaccagcaacgaggttggagaggaagattgaggatgagtaacaagttggaagaggacacaattgatagacacttatctcctcaagaagtgttgatcaggaagcagcttcaggaagaattgtgggtagcggctcaatcacatgagtccctactaagacagaaggcgagatctagatggattaaagaagagtcaaagaggcagtcagattattcttcctgcaccgatttcaagaatctaatcaagatagaccccggttggatggtgacggatccacaacttctgaatgactacagacctatctcactgataggttgtatatacaagatagtggtcaagctgctggctaacagattgaagaaagtcatgtcactcatcatagatggaaagcaatctgcattcatagagggaagacatttgttacacagtgcgttgatagcaaatgaggtggttaaggaagccaagagaagtcaaaagtcatgcattgttttcaaagttgactacaagaaggcatatgatgatgcatggctcccagtaggagttgcggcagatctttag

SEQ ID NO: 61963 - DNA, 658 bp, Glycine max
  Peptide Sequence Number=SeqID_178741
atggctccgaacagggggagaggaagcacagatgggctggttgcacaatcagtggagttcgaggatatggttgcacagttcattcagttttgtagagcagagcactgcgacgtggtgatggtggttgtgggatctattcatggtatcagtctcttcactcatgatagtaaggttgctagggtgttgcatcttttctacaggttggttgtccagccaaatacatctagagctcacacatttgcggaagaattcctagcatgtggtggcatagaaactcttcttgttctgctccagagggaagctaaagctggagatagttgtgttctggaatcattgtcaatgaatcctgaacctcaaaaatctgagattgatagtggtaatgaaatgacaaaaggaagtcaggaggatgatgggtcaaaggacaaaagtgaagccatcatacaagacaatgaccaaggttttctatctgttgatagtggtagtagccctgatcctagttctcctgatgttaacagtgacaggatatttgcctctgaaattccttctgccaagaatttgggaggcataagtctatccattagtgcagacagtgctagaaaaaatgtttacaatgttgataaaagtgatggcattgttgttgggatcataggtctcttag

SEQ ID NO: 61964 - DNA, 180 bp, Glycine max
  Peptide Sequence Number=SeqID_178742
atggaggaatggcctgagtggattctggaagtcctgatctcaaactatgaggtgggttcaagtaaattatccgattcaacaaccattggagacatagaagaccttattcataatttccttagtatcatgctagagcattcaatgcgccaaaaggatggatggaaggttgatatttgttag

SEQ ID NO: 61965 - DNA, 903 bp, Glycine max
  Peptide Sequence Number=SeqID_178743
atgcagactcaaattattgctgcggctgctgctggtgttgcagctgagggtttgtcaccaaaagattctaaggctgaagctgagaatgctgcccagttgtctgtggctttagtagagaatgccattgtgattcttatgcttgttgaagatcatttacgactacagaacaaacaatcctcttctgcgcgtgctccaaacagttcgccatctccgctttctgttgtgtatgcaaccaataatcactcaaatccattgtcgacaattgatgaatcaacagaagttgtggatgatcgcagatcactagatagtgactccgggggagtccctctaaatgtcctttcttcaatggctgatggaagtggtcagatccctacttcagtgatggaaaggcttgctgcagcagcagcagctgagccttacgaatctgtttcttgtgcttttgtgtcatatgggtcctgtgctaaggatttagctgatggctggaaatataggagccgtttgtggtatggtgtcagcctttctccaagtcaagctccatttggtggtggtgggagtggatgggatttttggaagtctgctcttgagaaagatgccaatggaaactggattgagcttcctttggtgaagaagtcggtggcaatgctccaagcattattgctagatgagtctgggcttggtggtggccttggtataggtggagggtcaggtacaggaatgggagggatggctgctctgtaccagctattagacagtgaccagccattcttgtgcatgcttcgaatggttcttctatcgatgagagaagatgatgatggcgaagatcatatgctgatgagaaatacaagttttgaggatgcagtgtctgaaggaagaaaaccacggtcagcacttttgtggaggtaa

SEQ ID NO: 61966 - DNA, 333 bp, Glycine max
  Peptide Sequence Number=SeqID_178744
cccctgatcttgagagtattttggcagacttcatgacataccaagctagctctaaagggtcatgttatggaatgcaacagcagggaactcagtttcaaaggaaccagttttctacaggctatcaatgggagtcattctggcaaccaaattatcacgataaaacagaaggagttcttaatctggatgatctgttaatgcaattcaaagatacagtagagtcaatgcaacaagcctttagaagaattgcaactaagattagtaagttggtggatgacatggctagtgctgcggccaaacaagaggaagagcgtgcaaagattgaaactgataaag

SEQ ID NO: 61967 - DNA, 354 bp, Glycine max
  Peptide Sequence Number=SeqID_178745
atggcgaggagcatgctcgagagtaaaatacttccaaaggaatttttgatagaaggagtgacttgtatagtttatctttccaaccagtctccaacaataagtttatgggaaaaaacaccacaagaagcatggagtggaaagaaccccgacatttcacatccaagagtctttggaagcatttcccatgagcacgtactagatgagaaaataagcaagttggatgacaaaagtaagaagtacatcttcattagttatgactcaaattccaaaggctacaggctctacaatcctaattcggggaatacaatcatcactcaagatgtcaatttcaacgaagaaggagaatgggattag

SEQ ID NO: 61968 - DNA, 333 bp, Glycine max
  Peptide Sequence Number=SeqID_178746
ttaagtcatctgattttgtttgctcatgcaaaatatagaggagagagaataggtgcaaattttgctttctgcggagcagatccatctgctcaacattcacagcatgggcggacagctttgcatacagctgttatgattgacgatgttaaattggttaaggttattcttgctgctggtgttgatgtgaacattcgtaatgtgcacaatggcattcctcttcacatagccttagctaggggtgctaagtcatgtgttgaactacttctatgtattggggcagattgcaatttgcaggatgatgatggtaacactgctctccatatagcagcatga

SEQ ID NO: 61969 - DNA, 270 bp, Glycine max
  Peptide Sequence Number=SeqID_178747
atggctactccatctgcctcgcctcctcctcctcctgcagtagcattagcgtctccgtgtaccttgaaatggacacgcaaagccacatggctacgatccttggccactagaccacctggggcagagagaccagtggtccacgtcgatcttgtgaccgacaaggtcgacggtccccacaagaagaaattaggaacatatttagggattgtcgctcatgataaggtggaatttgatatccctgaaacttctgattgtaggacaaagaagaag

SEQ ID NO: 61970 - DNA, 414 bp, Glycine max
  Peptide Sequence Number=SeqID_178748
atggcaacgagttccaacacaggccagaagcttaaggagtggccccaacctgcattcttcaattatgagcttctcgtagtggtcgctgttgctagccagggagatcagctaggtgacaacgacagagcaatcctccaaggtacctgtgtggaggatcaactcgtttgtagtgatcaaagggaggtcgccgatgtagtctccaccaccataactggtggagacctgaaggagctaggagatgtcgccaatggagttctcgagaagcaaggagaccttgcggaacccgactctggggttaagggtgaagacgcacttcatgagggtgttgtcatggaaattgagggccaaggtgagggccttgtcgaggatgtcttttgttttgtcaatgaaacggcacgtcgggggagatgttga

SEQ ID NO: 61971 - DNA, 1177 bp, Glycine max
  Peptide Sequence Number=SeqID_178749
atgcctactttcaacaacgcccggttcgacattggtgctagaaatgatgttgaaactcttctagaaccgattctagaatcgattttaaaatccttttatgtaatagtgctttgtcttgtgggaagattcttgatggaaagatatattcatgctcaaatcatgatagagaggatgtcaaagggttctgaagggtgggatttgacttttgataagaatcttctcatccttagcatcatcaaggatgaagagattccaagcctagttcctctatacaaagttccattttggttgactagagttcatgttgatgtcaggaaacctctcaaacatataaagaagattgagaaggaaggtcttgtgaggggaggggtaaagggaaaagtgagaagaaaaaatgaagagtctactgagagggaggaagaggaaaaatgtgaaaaggagcggggagatgaaaagacaagagagagggaggaggaaaaaagtgaccgttactatgtatacagtaacggtcgaaaatctggagaagaaaatgcgaaggacacgtttgcagacatttcctacatcccagtaaacagtcctatgaaggtttcaaataatgatgttggttcgcaatttccacaattttctagccaaattgggctagacgagatcgtcattgacgaaatagaagggtctccgacaaaaaagaagcctagagtagcctttgcagttgaagaagatacacacctcattagttcatggctcaacatctcaaccgatccaattgttggtgttggtcaaggaaaagaagcgttttggttgagagtcacaaaaaattataacaaatttcgagggtcattacaacaagcagtatcattgaagaaaagtggttgcacggaaaatgatgtcatgcttaatgcatataccatttggaaggaagacgaaggaactaattttggtttggaacatgcttggcgactcttgaaagataaaccaaaatggaagagcaaggggaatgaagtaggaacatctaccaatcctgttgatctgactggtgtagaggaagcaacgagggaaagtaatgttgtcaatgccaaactagcaaccttaagggagaaagaattggaaaatgattattacgacattctaatgaaggatattgttggatcaagtggcctcgaaataattaagaaggggg

SEQ ID NO: 61972 - DNA, 372 bp, Glycine max
  Peptide Sequence Number=SeqID_178750
atggatggttccgattccagtgttgagacagggaaacaagaaaaagatcgcagctggctaatgtcatctcttcatcaaatttatagtcggagatacctccttagaagaagtgctctggagttatttatggtggaccgttcaaacttcttctttgattttgggaatggcgaagggcgaagaaatgcatatcgcgcaattgttcaagcacgaccaccccatttaaacaatatatatttggctactcagaggcctgaacaacttttgaagagaattcaactcatggaacgctgggctaggtgggagatcagcaattttgaatatctaatgcaactcaatacactggctgggcgtagttataatgatattacccag

SEQ ID NO: 61973 - DNA, 261 bp, Glycine max
  Peptide Sequence Number=SeqID_178751
atggctaggagactccaagaagattgcgccagagatgcaagagaaggtcctagggttttcatgagccttaggtggcatctccaatcacctttcctccttctccattccactgtcattgatcttcaagaagcaaggagtccattgatgaagaagatccaaggcctacaagctctacatggagctacatcaagacttgacagcatctctaataaagccactaagaataaaagatttagaactgaaggggttaatagtggataa

SEQ ID NO: 61974 - DNA, 2079 bp, Glycine max
  Peptide Sequence Number=SeqID_178752
atggatttacttattttcaagagtcttacaaagataattaatgccaaaagaatttacacaagatataaccatagcaaggaaagttgccagaaaaatctgacggtggccagaaaggtcgttggaaaatatgagtcacctgagacgttgctgaaaagtccagctgttttgtattatcttgttagggtcgaaccgttcactacccttgcaatccaactgcaaggtggaaaatttgaccatgcagatcgaatgttttctgatatttctgctacttggaatggagttcttgaggacatgagtgatgtaaaggaattggttcctgagctattttacctacctgaggtcctcacaaatgaaaattcaattgattttggtacaacacaaatgggaggaaagcttgatactgtaaaacttcctgcttgggctgaaaatcctgttgattttattcataagcaccggaaggctctagagagcgagtacgtatctgctcatttgcatgagtggattgacctcatatttgggtataagcaacgaggcaaggaagctgttacagcaaataatgttttcttttatactacctatgaagggacagtggatcttgataaaatctctgacccagtacaacagcgtgccatacaagatcagattgcttattttggacaaacaccatcccaacttctgactgttcctcacttgaagaaaatgccattagcagaagttctgcatttgcagacaatattccgcaacccaaaagaagtcaaaccatatgctgttccattcccagaacgctgcaatcttcctgcagctgccattcatgcatcttcagatacggttgtggttgttgatacaaatgcaccagcagctcatgtagcacaacacaagtggcaacccaatacacctgatgggcagggtactcctttcctctttcaacatagaaaagctatattagcctctgctggtggtacaattatgcgcatgttcaaagcaccggctgcatctggtggggagtggcaattcccccaagcagtagcatttgctgtctctggaattagaagccaagctattgtttctataacaagcaacaaagaagttattactggtgggcatgctgataatagcattaggctaatatcctcagatggagctaaaacattagaaacagcttatgggcactgtgctcctgtaacttgcctcggtctttcacctgatagtaactacctagttacaggatcccgagacacaacagtattactctggagaatacatagggcactttcatctcactcaagtgtcgtatcagaacattccactgggacaggcacatcgtcttcaaccagtaatagttcattgcacttaatagaaaaagaccggagacgtcgaatcgagggtcctatacaggtacttcgggggcaccacagtgaaatactcagttgttgtgttaactcagatcttgggatagttgtttcctgctcccattcatcagatgttctcttgcactctataagaaggggacgtttaattagaaggctcgatggtgtggaggcccatactgtttgcctttcctctgaaggggttgtaatgacctggaatgaatcacagcatactttcagtacttttacactcaatggtactccgattgcaagtgcacaattatctttcttttgcagtattggttgcatggaaatttctgttgatgggacaagtgctttgattggcattaattcccttgaaaatggtagagcctataatagcagtccggattcacagtcgaataagtcaggtgttgttgattttgattcagaatcagaagaaacttttgataactcccgaatagatgtaccatcgccatcaatttgcttcctggatatgcacactctggaggtatttcatgtgttgaagctgggtgaagggcaagatatcacagctctggctctaaacaaggataacacaaatcttttggtttcaactttggataaacaattgataatcttcactgacccagctttaagcttgaaagtggtcgatcaaatgctcaagcttggctgggaaggtgatgggcttcagcctctcataaaatcatag

SEQ ID NO: 61975 - DNA, 1722 bp, Glycine max
  Peptide Sequence Number=SeqID_178753
gatttatttgtggccgggattgacacaacatcaagcattgtggagtggattgtggcagaactattacgcaacccacataaattggcaaaagtaagaacagagatatttgaagtgattggcaaagatggaacacttgaagaacaacacatcttaaagttgccatttttacgagcagtggtgaaggaagctcttcgtttgcacccaccaggtccatttttagtaccccacaagtgtgatgaaattgtaagcatatgtggcttcaaattgcctaaaaatgcacaaatcttggtcaatgtgtgggccataggaagagatccaaccatttgggagaatccagaaatgtttatgcctgaaagatttttggagtgtgagattgattttaaaggtcatgactttgaactcattccttttgggacaggcaaaaggatatgtcctggattgccattagctcataggtcaatgcatttagtggtggcatcccttgtgcataactttgaatggaagctagctgacgggacaatcccacattcagtccatgcacttgaccatcacaaatattctattgtgtttatgcacccatcacccaaatggaggaaacttagaagagtttgtgcaacaaaaatattctccccacaagcacttgactccactcaaatccttcgccaacaaaaggttcataaattattggattttgtagaagaaagatgcaagaaaggtgaggttttggatattggtgaggctatctttacaacaacccttaattccatttcaaccactttgttctctatggatttgtctaattctacatctgaagagtctcaagagaacaagaacattattcgggctatgatggaggaagctggaaggcctaatgttgcagacttcttccccattcttcgtccacttgaccctcagcgatcttttgcaaggatgagcaattattttaagaagatgtttaagattattgatggaattactgaagaaagaatgtgttcaagacttttggaaactgactccaaggtgtacaaggatgtactggattcacttatcaacattgaagaaaccggttatcaactgagtcacaatgagatgttacatttatttctggatttacttgttgctgggattgacacaacatcaaacacagtggaatggattatggcggagctactacgcaacccagataaaatggaaaaagcaagaaaagagttatctcaaacaattgacaaagatgcaataattgaagaatcacacatcttaaagttgccatttttacaagcagtggtgaaggaaactcttcgcttgcatcctcctgctccatttttagtaccccataagtgtgatgaaatggtaagcatatctagcttcaatgtgcctaaaaatgcacaagtcttggtcaatgtgtgggctatgggacgagacccagctatttgggaaaatccagaaatgtttatgcctgaaagatttttggagcgtgagattgattttaaaggtcatgattttgaattcataccttttggggcaggtaaaaggatatgcccaggattaccgttcgctcacagaacaatgcatttaatggtggcatctcttgtgcataactttgaatggaaactagctgatgggttaatgccagaacacatgaacatgaaggagcaatatgggttgaccttaaagaaggctcaaccacttctagttcaagcgattgcaatcacgcacatttaa

SEQ ID NO: 61976 - DNA, 669 bp, Glycine max
  Peptide Sequence Number=SeqID_178754
atgacacctttattaagtgttggtgtggcagccactggtgctcccatggtactacctccttgctttatgtctttggtggcttctccttttgtggttttggcagcggttgtgtcgccttcttcgtcctctcacgtctcgcttgatcacttgtacacctctagtgaggctgactcactgtggggtgcaacctataagctggagcagaagaccccggttggctttgtgtcagcctttgacaacaagcttattaggtcgattggggtgcagaatgctactgactctaccaaagtgtttctccgaaggagttttgcaattctagaagagaatagactacgacaccaagaggctatgcagaaggaccatgatggtcttgtaaagagtagaatgatgtggggtcatctcaggtcttgccaaccagtgagggggggtaggacgcttgacctgttgagtttctcctctgatgggtatgaggagttagtcgaggcatcaaagtgcttagcggataggaggaatctggaagggaatctgtcacgcaggcatgcacttagtgcgtcatcagctcgctcagcgagtcgtttgtcaccttccaggtttagcgcgagtttggcgttgagcgaaagttcacttactcgtgctaagcgcgagaatggcactatgcgcgacgtcaag

SEQ ID NO: 61977 - DNA, 168 bp, Glycine max
  Peptide Sequence Number=SeqID_178755
atgtgggttctgtggggttcgagcgacgacgatataggttttccggggaatctgtgggttcgaccaacgacaatgtgggtgtcgacggagcggtttccggcagatttcgggcgggaggagaaaaagaacagcgatttcaggcaggaggatgacaaagagaagaggtag

SEQ ID NO: 61978 - DNA, 1932 bp, Glycine max
  Peptide Sequence Number=SeqID_178756
atgactcagctgtttcgagcgaaaaggttgccagatcgaaagaatggcaggcattgcaggatcttaaattgcttttttcaaaagaggcaagcgaaagctgatatttactcttattctgtatttcatgttcttgatgttattgtgtccaacacaaatgatgtggggcctttgagccttgagaattttagaaaaaataatctgtctgcttcatggagagttgctggattaaggacttcaaatgctatgaatcagctcaaccaaccagcagacaatgttagagaagagaagcaaaatgggaaggaaggaagattttcaggtggtatcatattatcggttgatcgtgctcagtggactggcagtcctgctcagctatcaagaaggcaattaatagagaaaaggaaggaaaaacgtgctgctgagttggtaaaacaggatgatgaagtaattgtaaaacttgaagattcagctattgaacactcaaaatctgttgattcagcagttctaggtaaatacaacatttggaggaaagaaaatgagaatgaaaatgctgattctacagtacggttgattcgagaccaaatcattatggctaaggtttacttgagtattgcaaagatgaagaacaagcttcaactgtaccaagaactggaatctcagcttaaagaaagtcaacgtgctttaggtgaggcaacttctgatgctgacatgcatcacagtgatcatgaaaaaatgaaaactatgggccaagttctttctaaggcaaaagagcaactgtatgactgcgagttggttactgggaaattgagggcaatgctacaaacagctgatgagcaggttagaggattgaagaaacaaagcacattccttagtcagttggctgccaaaaccataccagatggaattcactgcctatctatgcgccttaccatagattactacctacttccccttgaaaagagaaaattccctagaagtgagaatttggagaatcctagtctctatcattatgccctgttctcggacaatgtcttggctgcatctgttgttgtcaactcaaccattgtgaatgcaaaggatccttcgaagcatgtgtttcaccttgttactgataaactaaattttggagccatgaacatgtggtttttgttgaatcctcctggaaaagctacaatcaatgttgaaaatgttgatgaatttaagtggttgaactcatcctactgcccagtcttgaggcagcttgaatctgcaacaatgaaagagtattatttcaaggcaggccatccaactactactggtgcttcaaatctcaagtacagaaatcccaaatatctgtcaatgctcaaccacttgagattctatcttccacaagtttatccaaagttggataagattctttttctggatgatgacattgttgtccagaaggatttgactggattatgggctgtgaatcttaatggaaaagtaaatggtgctgttttaacatgcggagagagttttcaccgatttgacaagtaccttaacttttcaaatccgcatattgcgaaaaattttgatccaaatgcttgtggttgggcatacgggatgaacatgtttgatttgaaggtgtggaaaaagaaggacatcactggcatatatcacaagtggcagaatttgaacgaagacagggtgctgtggaagctggggacattgcctccagggctgatgacattctatggattaacacatccgctaaataaatcatggcacgtactcggtctgggctacaatccaagtgtagatcgttcggagatcgatactgcggcagtcatacactacaatggtaatatgaagccgtggttagagatagccatgacaaagtatcggtcttactggaccaaatatgtcaaatttaatcatccctatcttcagaattgtaagctacgtgaatga

SEQ ID NO: 61979 - DNA, 720 bp, Glycine max
  Peptide Sequence Number=SeqID_178757
atgggtagaggaaaggttgagctgaagaggattgagaacaaaatcaatcgccaagttaccttctccaaaagaaggaatggtttggtgaagaaagccaaagagctctcagtgctgtgtgatgcagaggttgcccttgtcattttctcagctcgtggcaagcccttcacctttccagacgatgctgaaagtattatgaaaacctatgatcgataccggaagtactactctcatcaacatggcaatattgaacttgaaaatcaggactggtaccaagaaatgttaaagctaaatgaaaagtgtgagtctcttcaaaggacacaaaggcttctgcacggggaagatcttggaccactgagcataaaagagttactaattcttgaagagcaacttgaaaaagctttatcacaagctaggcagaggaagacacaactgatgattaaacaaatggaagagcttcgtcaaaaggaacgccatcttgaagacctgaataaagaacttagactcaagcctccttttcagcttgagccttatggatttaatctcaaagcaagcctgtggggctctacttcctctgctgatggcgatgggagctttcccttgcagccttccttaacctaccctgaacctttcttgcaaatagggtattctgttcaaggtgagccatccattgtcccaaagagcatggccagtgagactaattttcagggatggttcctttga

SEQ ID NO: 61980 - DNA, 150 bp, Glycine max
  Peptide Sequence Number=SeqID_178758
atgactcgcgtgaggggaccaaagcttttgatgctccgccagccactccgtaaggtactgatcgaaaccccccaggatagattaggcatcgaacaaagcagcgctttctacttgttccgggctaggttaaggacgacgacctattggtag

SEQ ID NO: 61981 - DNA, 290 bp, Glycine max
  Peptide Sequence Number=SeqID_178759
atgtctcctgctatggtggaaatggagaaatttgatcatatagaggaaaggctgagggtcattgaaggaggtggaaattatgcatttcctaacatggcagagttgtgcctagtgcccgacgtggtcattcctccgaagttcaaggtgccaaatttcgataagtacaaggggactacttgccccaagaatcacctgaaggtgtactgtaggaaaatgagggcatacgcgaaagatgaaaaattgttgatgcatttcttccaggaaagtcttactggggtagccatcacctg

SEQ ID NO: 61982 - DNA, 192 bp, Glycine max
  Peptide Sequence Number=SeqID_178760
atgaagattgagtcagggttggaagatgaagccagtccgtctaatgtgcaaccacaacactctcctccaccaccgtcattgtctgacaccctcaaccagccaccagtcacgcgtcgagccaccgcgcttgtaataactcaatgtatgaaggggctttcatcatgccacaagattattatgtcagatttgtaa

SEQ ID NO: 61983 - DNA, 135 bp, Glycine max
  Peptide Sequence Number=SeqID_178761
atggccaacatcatgttgcagatcacaagaacatcagatgaggttttaaacaccgttcatgccaaggagcagacttgcggtgaagttagtaggttgttttccatgaggtggaaggacatgcttgaatgttactag

SEQ ID NO: 61984 - DNA, 213 bp, Glycine max
  Peptide Sequence Number=SeqID_178762
atggtgaacaacattttcacactatctaggcacaaggaaaacatggtgcagcccaaaccaagtgctggccttaaggggaaacctcaccaacatgctctcactcatcatgccttcttgtatttcaacaaacaaaagcttgggccccctaggcctaagtcatgttttggcatttatcctaattctcgcaagctgtccgcatccaaaaaatggtaa

SEQ ID NO: 61985 - DNA, 237 bp, Glycine max
  Peptide Sequence Number=SeqID_178763
atgggtgccaagtacctcgaagcggaaccgattgggaaaataacaaaaaaaccgtattttcccctcaccggaggctccgtactagataacggaggatgcatgaacagcactaggcaatcaattcatggggctccgaataagatgttggaggatgcacggacagcgctaggtaatcaatccgcactcgatggtggaggaagcatgaatgccaatcaattcatgggactccggacttga

SEQ ID NO: 61986 - DNA, 198 bp, Glycine max
  Peptide Sequence Number=SeqID_178764
atggttacttccatgcttcaacttgactcgatgaaccttttcgtaaaagcacgagcttggttcaaccccataacccagggaatggcaattttgatcgccaatacttcatcaacaattcacagggatgaaagactcgggaatatgcatgctatgcatggaaaatgggaaaacgcaagggtcacacatgagcaaacatga

SEQ ID NO: 61987 - DNA, 285 bp, Glycine max
  Peptide Sequence Number=SeqID_178765
atgctttacggtgccctcatcgaacttgatggagctagagtaatgggtgaagtagaggagatacaagagacgatgaaggccgacatggaggccattaaagagaaaatggccacaatgatggaggccatgatgagcgtgaagaagataatggaagccaatgcggttgcaattgccgctaccagcgttgttgctaaggtgaacccgacgcccccatccggcatccctgaatcatccaacctcagatatggtaggcaaagatttgggaagtatgggcggcccccatga

SEQ ID NO: 61988 - DNA, 501 bp, Glycine max
  Peptide Sequence Number=SeqID_178766
gctaaggcatgcagccctcagatggcgaggacgtatagtcctctaaaagcgatggcgtgtagccttctaaaggtgaggacgtatagtcctctaatgaccaaggcgtgtagccctctgaaggtgagggcgcgtagccctcagaaggtgaggacctatagccctcggttggcgaggacgtgtagtcctctgatggcgagtacgtgttgtcctctgacagcgaggatgtgtagccctctaaaggtgagggcgcatggccctcaaaaggtgaggacgtgtagtcctttgaaggtgagggcgcgtagccctctaatggcgaggacgtgtagtcctctgaaggtgagggcgtgtagccctctgaaggtgaggtcgcatagccctatgaatgtgaggacgtgtagccctctaatggcgaggatgtatagtcctctaaaggcgagggcgtgtagccctctaaaggtgaggacacgtagtcctctgaaggtgacggcgcgtagcccttag

SEQ ID NO: 61989 - DNA, 537 bp, Glycine max
  Peptide Sequence Number=SeqID_178767
atgatgcttcacacaatgaagaagtttctaacctatccatttactccgtttccaatatctctctcttccaatcttggcaggggatcaacttcggttctaacattcagcacccaccctgatagtgttctggataagactcaacacccgactgagaaagctacagagaatgtgatgtctaattcgtttgtggaagggtatgcttcaaggtcggatgaaaaaggatttgaaggggctagtgaaggaaaacaatccacatcaaaagttgagatggataagttcatccatgaaaatcacccaggttcaaggaagtatttacaaaatacaaggctaagacaagaaagagggcttcgaaccattgggcgaatcgagctggcatatggtcgaatcgaagtcaaggcaacaagatttctggacttagcgcaatttctgacaaaacttcacaaaattagttcgacttcgagcaatatggataaccgttctaaggagcagttatgtgcatgcaaggtgtacgtagcaggacacttggcattaggatag

SEQ ID NO: 61990 - DNA, 810 bp, Glycine max
  Peptide Sequence Number=SeqID_178768
atgtggaacaaagcttgtcgtgacccatctctttggtgcaagcttgatctatccagactcaactcttactttttcaacatacccaataatcaaccaggagcatgcaagcgttcaaatgcaaaaatgactcaattcataaaatatgttctaagtctgagtaatggtacaacctgcttagtatttaactacaatgttcacttaacggatgagcagttcatcataactgctgaaaggaccccaaatctgaaacgactagttctaccaaagacagttgagttttcaagagtagatgtgcatgtggcaatgaagtcgtgggagggccttgagtccattaacatcacctccaatatccccagtcattacatatttcctgcaattggcaaatactgcaagaacatcatagagatgaaatttggttacggttgcctctttgaagaaaagcatgttgaagcactgattaaatgtgcccctaacttggaggggttgagcatccggtccaaaatgacaaagatggaggctttgtgcggtgtgttcactttcttggaacatttggaggcggtgaatatattgcatagcttcattatagatgcatcatatcgtggattaggtgatgtggatatttgttatctacaaaaccatttgccgccatcgagtctgggaaagcttatatactgtgaaggaggatcatgccttaggtgcaagaatgggaacagcattactactggcagaattttccaaattgcaagcattattatgcgtgcctcagaggatttgtggcgggaagacgagataacctctcttgcacgttaa

SEQ ID NO: 61991 - DNA, 426 bp, Glycine max
  Peptide Sequence Number=SeqID_178769
atgacactcgcgcaaaccaaatcacacgagacagatcaacgctgccgggagaagcgtgaaaatagggtgttgatcccagttctcacgtttagttgtgtaaatggatccgtttcagaagagaggaaacaaacaaaattaggttgggaattagtgcctttggtggtcaccatgttccttcttagaaggcaaacccagaatcaccatgagaatgattcctcatatcaagatacaaaggtggctgaactcaagacagctcttgggcccctctctggtcgtcaattaaagtattgcacagatgcatgtctaaggagatatttagaagcaaggaactggaatgttgataaaaccaagaaaatgctggaggaaacacttgagtggagggcaacttataggccagaggaaatccgttgggttagtttgatttaa

SEQ ID NO: 61992 - DNA, 186 bp, Glycine max
  Peptide Sequence Number=SeqID_178770
atggctgaccaaggattggaagggagccagccggtggatctacagaagcatccttctgggatcgtgcctacccttcaaaatattgtgtccacagtcaatttggactgtaagttggacctcaaaacaattgcacttcaagctcgtaatgcagagtacaatcccaaggcaagtttcatttgtttgtag

SEQ ID NO: 61993 - DNA, 291 bp, Glycine max
  Peptide Sequence Number=SeqID_178771
atgagcatcgctgttgccgctaccagcgctgttgctaaggtgaacccgatgcccccatctgatctcaaccaaatgaatcatccaacgtcagatatggtaggcaaaaatttgagaagtacggacggccccatgatttacaaattcaaaatgagcacgccttcccaccatatggcttgcctcccaactatacaccacccaatgtggcgtacactcccaatgaggatgtcaataactccgctcccatactcattgagagctgacaacctcatgtacatgtctctcaactcatga

SEQ ID NO: 61994 - DNA, 522 bp, Glycine max
  Peptide Sequence Number=SeqID_178772
atggggggtgctttgaccttgttggatgtccctagtgggggaaatagagcagttaaagagtctaagcatctcttggggggatggcttaggatctttagtttatccatggtcattgcacttgatggttggtcaagcccggcaagtgcactagatcgcgcaagtatttacatcaagtacctacaaggaagaaccaacagaggatttagcatctgtggtgtaaaaataaaatctgatggatctacagataaagaagctggaagtgagggaggtattgtagaagaagaaggtgttattgcctctgatgctgaagtggaaggggcctcagatctcttacccctggacttcttgccagatagggagctttctttacaacaaagagaagagaaaaatgaaggattgaagaaatctcatccttcttccagattcttcctcgcactcaactgcaagagtggtgcgctcagcggatggctcgctaagccggaagattggcttagcaagaagctaaaaatcagcacttcataa

SEQ ID NO: 61995 - DNA, 312 bp, Glycine max
  Peptide Sequence Number=SeqID_178773
atggcatcatcaagtacactgaccatggatagattaaagatcctaagacatccccctcaagagatgcttagactctctaaccactctattttcctcactagggacatccaacaagggatacccgacaaggtcaatgcaccccccatgtacatacacaacttgcatcatcacaatgtaatttcaacatcatcagcatctcgtctcgacatcactctcaacatgaatgttattttattctcaatggcattatcaataacaacaacatcttctcatattaacataatcatcaataacatcatcaactcatattga

SEQ ID NO: 61996 - DNA, 102 bp, Glycine max
  Peptide Sequence Number=SeqID_178774
atggagccacagtgtgcaatcaagaaagatgccactgaacttctctttgtgtatgctgtaagagataatatcatcgatcctgtcaaagatgaggaattatga

SEQ ID NO: 61997 - DNA, 3906 bp, Glycine max
  Peptide Sequence Number=SeqID_178775
ggatgcgctaagggtattgaggagcctcttttgaatggtgatgcaaatgttcctaatgaaaaagtggccaagggtggggacactgttacccctttctcacatgctggagttttcagcgttcttactttctcttgggtgggtcctcttgtggctgttggcaacaagaaaaccttggaccttgaggatgttcctcaactagacaccaaagatagtgtagttggcgcttttccgagtttcagggataaacttgaagctgattgtgatgcaaatgcaattaatagtatcaccacacttaagctagtgaagaatttagcaaagtcagcttggaaggagattctcttcacagcttttcttgcattgttgaacaccctggcttcatatgttggtccttatcttattgatgtttttgttcagtaccttgatggacgacggcagtatgaaaaccagggctatgtgctggtttttgtgtttttctttgcgaagattgtagagtgcctttcccaaaggcattggttctttaggttgcagcaaattggaattcgaatgcgagcgctgcttgtcaccatgatctataacaaggccctcaccctttcttgtcagtcaaagcaaggccacacctctggggaaataatcaatttcatgactgttgatgctgaaagagttggtaacttcagttggtacatgcatgatttgtggatggtggcgctgcaagtcgtgttggccttgttgattttgtataagagccttggccttgcttcaattgctgctcttgttgcaaccgttgttgttatgttggcaaatgttcccttgggatcattgcaggagaagtttcaaaataagttgatggagtcaaaagatacaagaatgaaggccacatccgagattttgaggaacatgaggatcctcaaactacaaggatgggaaatgaagtttctatcaaaagtaatcgagctcaggaaaactgagcaaggctggttaaagaaatatgtttatactgcagccatgaccacatttgtgttctggggtgcccccacatttatatctgtggttacttttggtacttgtatgctgatagggatcccccttgaatcaggaaagatcttgtccgcacttgcaacattccggattcttcaagagcccatttataatcttcctgatacaatttcaatgatagcacagactaaagtttctcttgataggatttcatcattcctttgtcttgatgacttacggtctgatgttgtagagaagcttcccaggggcagttctgatacagcaattgaagtaattgatggaaccttttcttgggatttatcttcccctaacccaaagttgcaaaatataaatatcaaagtttttcatgggatgagggttgcggtttgtggtactgttggatcgggcaagtctactttgctttcttgtgtactgggagaagtaccaaagatatcaggcattcttaaggtttgcggaacaaaggcctatgttgctcagtctccatggatacagagtggtaagatagaggataatatattgtttggtgaacgcatggatagggaaaggtatgagaaggtacttgaagcctgctccctaaagaaggatctggagattttgtcatttggggatcagactgtcataggagaacgtggaataaacttgagtggtggacagaaacaaagaatacaaattgcacgtgctctttaccaagatgctgatatatatctatttgacgatccttttagtgctgtggatgctcacacaggttctcacctcttcaaggaatgcttgctgggccttttaagttcaaagacagtggtttatgtcactcatcaagtggagttcttacctgctgctgaccttatattggtcatgaaagatggtaaaattactcaatgtggaaagtataccgatctgcttaatagtgggactgatttcatggaacttgttggtgcacacaaaaaagctttgtctacactagattcattggatgaagtggcaaaatctaatgaaataagtaccttggaacaagacgttaatgtctctagcccgcatgtttttaaggaaaaagaggcaagcagagaagaaccaaaaggccagcttgttcaagaagaagaaagagagaaaggtaaagttgggtttctggtgtattggaattatatcacaacagcatatggaggagctctggtacctttcatattgttggcccagattctttttgaagctcttcaaattgggagcaattattggatggcttgggcaacacccatctcaacagatgtggaaccacctgttggaggaacgacacttatagtagtctatgttgttctggccgttggaagttctttctgcgtccttgtcagatcaatgcttcttgtcacagttggttacaagacagctaccatactattcaataaaatgcacttctgcattttccgtgctccaatgtcatttttcgattccactccaagtgggcgagtccttaacagagcttcaactgaccaaagtacagtggatactgacattccttatcaaattggctcatttgccttctctatgatccagcttctgggaattatagcagtgatgtctcaggttgcatggcaagttttcattgtctttatacctgtgatagcagtcagcatctggtatcagcaatattatataccgtcagctcgagaactatcacgtttagttggagtctgcaaagccccaatcattcaacactttgctgaaacaatttctggtacttcaaccattagaagttttgatcagcagtcaagatttcaggaaacaaatatgaaactgactgatgggtattctcggccaaagttcaatattgctggtgccatggaatggttgtgcttccgcttagatatgttgtcttctatcacatttgcattttccttaatattcttaatttctattccaacgggaatcatagatccaggcattgctggtttagctgttacatatggacttaatttgaacatgatacaagcttgggtgatatggaatctctgtaatttggagaataaaattatatcagtagaaagaatacttcaatatactagtattccttgcgagcctccccttgttgtagaagacaatcggccagatccttcttggcccttgtatggtgaggttgacatacaagatttgcaggttcgttatgctccacatcttccacttgtgttgcgtggtcttacatgcaaatttcatggaggaatgaaaactggcattgttgggagaacaggaagtggtaaatccactctcattcagacacttttccgaattgtagagcctacttctgggcaagttatgattgacaacatcaacatctcttcaattggacttcatgatttgaggtctagactaagcattattcctcaggatccaacaatgtttgaagggacagtgagaaataatctggaccccctggaagagtacactgatgaacaaatctgggaggccttggataagtgtcaacttggagatgaagttagaaagaaagaaggaaagcttgactccacagttagtgagaatggtgagaattggagcatggggcagaggcagttggtctgccttggtagagtgctgcttaaaaaaagcaaggttttggtccttgatgaagccactgcatcagtcgacacagctacggataatttgattcagcaaactcttaggcaacatttttctgactctacagttattaccattgcgcatcgaataacttctgttcttgacagtgatatggttctgcttcttagccaagacattgctgcaggacttattgaggagtatgacactccaacaactttgctagaaaataagtcgtcttcttttgctcaacttgttgcagagtataccatgaggtccaaatccagttttgagaaatctgttgatcactga

SEQ ID NO: 61998 - DNA, 456 bp, Glycine max
  Peptide Sequence Number=SeqID_178776
atggttaacgaaaccgggatcgtagttttaccgagacagctctgggtttctgcgggaaaggaaaagactacaatgcgagggcaacaagttgttgccaaatgcaacactgaggcgaaatattgtagcttagctcagattactatagaaatctcatggattcagacactcttaactgaactcaaagttcctttcaacactcctattgtcttttgtgacaatcaaagtgcagttgccattgctcacaatccaatcttccatgcaagaaaaaagcatttggagcttgatcttttcgttgttcgtgagaaggttttgaccaagaagcttatagttcagcatgtccctactcttgatcaatgggcagaggcacttaccaagccactatctctcgccagatttgtttttctaagggccaaacttaatataattgaggcttcttcaaagtctcaaccaccttga

SEQ ID NO: 61999 - DNA, 255 bp, Glycine max
  Peptide Sequence Number=SeqID_178777
atgaagatagttgaaactgtcacaactttgaggaacaagcaagtggttctaaggaactatgtcactggttttcccaaagaatctttagacatgaagatagttgaaactatcacaactttgaagcttcctaaagatcctaatgaggttctcctaaaaaatttgtacctgtcttatgatgcttacatgcaaatcctcatgacaaaagaccgtcttgtccaagttggtccctacgcccttggccgtatggtgtattaa

SEQ ID NO: 62000 - DNA, 378 bp, Glycine max
  Peptide Sequence Number=SeqID_178778
atgtttggtctgatcattgcaggtagccttggcacacaaaggaaaccgattggaagctccatggtaaaccaccaaattggaagaagaaatcaagaggagaacgacgagtattttagacatctaatactaaaaatcaaaagcagaaaaatacctcagttatctccattcacaaaggagaagttagaatacttatataaatttttctcttcaaaaatgtcagttaacactccctcttccttagcccaaaaagataacaaaatggttaaagttgcagatggttccttctttgcaatatctggtgttggttcagttctttcattggaatcaggaaaggcaattggcagtgctaaggaagtttatgactgctatttcgtttaa

SEQ ID NO: 62001 - DNA, 411 bp, Glycine max
  Peptide Sequence Number=SeqID_178779
atggtgttttcaaaagaatcaaccaaatacttctcttttgtgggcattagaccaacgattgttgcaacatcgagaagtgttggtgcaacaggatcacatgacagttcatgcatgataaatgttaactcattggcaagtgtagatcagtttggttttcacacaaccctcgcactaagtgcgattgctgcgcttagtgagtatggaagtattctcgctcaatgcgtgtctcacgctaagcgtgccttcactttaaaattatccatacttcctggcgctaagcgtgcattgtccgctaagcctatgcatcacgctaagcgcctgagacacgctaagcgagcagattcagatcttcaatttgcttcttgggctttactttgtttttctgcaccaattattcaccaagcatcctaa

SEQ ID NO: 62002 - DNA, 357 bp, Glycine max
  Peptide Sequence Number=SeqID_178780
atggcgatttccaaactcataaatgatgaaaagggtttcattctctgccaaaaccgcgagccaagttggaagattctgcttcggttgaagggttcctctcggtgtggggtttcaacggagaacaatggtggtttgtggtggctaatggtggttgtgggtgatggagaaaaattttgggacgttggaaatggttttagaagaaaggaggagaaggaaatggcatttttccaaaactacatggacttcaaagctcaaaacgcacaaatgactaatgctctcaggaatggaaacgtggcacacactccagacgttttctcagagatcctaacggtcagatcatcgacaattgttttgtga

SEQ ID NO: 62003 - DNA, 240 bp, Glycine max
  Peptide Sequence Number=SeqID_178781
atgaagaaagcaacttcctttccttccctcagccttgatgctctgttttcttctcacccatgttgtatgtgtcctcttgtttcccttcctcttccagttttaaagacttttgggcttcttagattacgaatgcacgctcaacgagcatgtctcactgagagagttagtgactgggcgcttaacggatgtggacgcgagaagcgacaaaggcttcattgggcgggctggctgggcgcttag

SEQ ID NO: 62004 - DNA, 1611 bp, Glycine max
  Peptide Sequence Number=SeqID_178782
atggaaaaggtggcagagaacagatgttggagttgtggattaacatgccagtccaaccgtgatcttcagaatcatttgcatgatttagttgactttaatgagataaagactttgtggaatgatgataggtatctgatacctttcatggaagatgattcactgttgtacagttttggtgattgtgacgaagaaggtgaagatgaacaaattactccaattgatgaagatcttataaaggatctaatgaacattgaagagagtatccatgacgatcaagatgttgtgaataaaatggtagttgatgatgacaaacatgagattgcttctgtctctaatgatcatttgaacaaggctagttcttcaaaggaacttattaatgggaaggacttgtgctgtgataaggatccagaaggacatttgatggttaattctcaaaatcacattgcaaagcatattaagaagatcaatgaaagttattttggctcttacagttcatttggtatccatcgagagatgttaagtgacaaggtgagaatggatgcttatggccaagcaattttgaagaatccgtctctactaaatagtgctgtggttatggatgtaggttgtggaactggaattctcagatgttacatgaaacaatgtgctctatggctctatgcagtgtgcctattttcagcaaaagctggtgcttcaagggttattgcagtcgaggctagtgccaagatggcagcagtagcatctcagattgcaaaagataatggtcttttgctgagtaaaagccaaaatggagttgatggcttccaaaagggagtcatagaagtggttcatggtatggttgaagagattgataaaacagttgaagttcaacctcacagtgttgatgtactgctaagtgaatggatgggatattgcctgctgtatgaatccatgcttggttcagtactttatgcacgagaccggtggttgaagcctggcggtgccattcttcctgacacagcaactatttttgttgcaggatttggaaaaggagccacaagtcttcctttttgggaaaatgtgtgtgattttgacatgtcttgcattgggaaggagcttgtcatagatgctgcccgaattcctatagttgatgttgtggactctcaagatttagttacctgttctgctattcttcagtcctttgacttggcaaccatgaagcctaatgaagtggatttcactgcaactgctactttggaattgaaaccaagttattcaggaacatgctgctggtgttatggggttgtcctatggtttgatactggatttacaagcagattttgccaagaaacaccagctgtgttatccacatccccttacatgccaagaacacattggtcacagacaatcttaacctttcgagaacctattgcaatgggatttggaaaaggaaacaggggtaaaccagaagcaatcggcactgaggtgtatcctgctacgaagattgatttacgtgtcagcattgtgcgttctactgagcatcgcagcattgatatatctttagaagctgctggtgttgaacctgatggtcagaaacgtagttggcctgctcagctttttaatctgcagtag

SEQ ID NO: 62005 - DNA, 270 bp, Glycine max
  Peptide Sequence Number=SeqID_178783
atgttttgcgagaatgttccaaccatatgggatcagcataggcttaaaggagcactcaaacccggtgacccccaagacactctgaagagtccgtcagggcctctccctcctgattcagttattcctccgattgctccgatagaattctcaaacgtcaaagagacggagaagagattgaaacctccacttgtactgtcttcatgcgattcctttttctccctccacgaatattatcttgaaaatcccaacggtgaaagtgtgcgaaattga

SEQ ID NO: 62006 - DNA, 522 bp, Glycine max
  Peptide Sequence Number=SeqID_178784
atgaaacgactgatcctgctcaccgcctgcaccctggcgctggccgcctgcagcaaccccgaggaagaacgcaaggcgcaggaagccgccgcagccgccgtgcaggcgcagaaggaggccaaggccgaagacgtggccaagcagtacgacatggccgtggccgcgcaggactgggagcgcgcgcgcctgcatggtgcctcgctgctggaccagtacaaggacaccgcggccgccgagcgcatcgccgcaggcttcgacgaggtcaaggccaagggcgatgccgcgcgcgacctgcgccgcatgcaggcgctgtggcagtacaaccagatcccggtgggcaacaagggcaaccagcggcgccaagccggtgcagctggtgttccgcgatcatccggagtggaagcggcatgcgtatctggtgctgcaggccggcgatttccgttgcccgcagtgctcggtgaaagtaaccgtggacgacggcaagccgatttccatggcggcgtggcgtccgaagaccgatga

SEQ ID NO: 62007 - DNA, 219 bp, Glycine max
  Peptide Sequence Number=SeqID_178785
atgccacttcaaggagaagatgagtcaagaacaagctcaccaccacaaaaagccatggataagagcttaaagataggagaagatgagtggagggagaaagagagaaggagcacgaaattttatgcctcaaatgagctatggttcagcccactaaaccaagatcaagtcgaagattcttcactaagtgtgcttaggtgtcatgaggcatgtaaagcatga

SEQ ID NO: 62008 - DNA, 321 bp, Glycine max
  Peptide Sequence Number=SeqID_178786
atgatgaaacaccaatggaagagaagatgcaacagaaggcaaaggagaagaggagaggggaggcaccatccattagggaataagccatggaagaaggagcttcaccaccaagaatgtgccttggataataagcttgaagaggatgctttaatggaggaaaagaaagagagaaggggggagcacaaaattgaaggaataaaagagggagacaagtggaactttgaagtgtgtctcataagaatttcattcatcaaagttacaacacgtgttacacatgcttctatttataaactaggtagcttccttgagaagctttcttga

SEQ ID NO: 62009 - DNA, 315 bp, Glycine max
  Peptide Sequence Number=SeqID_178787
gtttataaactccctaatgagaaagaggttgtttatggggcattagacaaatggacagcttgggaaacagagttcctagtgattgcaatgtgtaaggctttaaaaatcttaaggaaaatgggtcattgggttcgtgtaattcaaacagtaaaaaaactaagtactagtgcttttcttcgtgtttgtggaggtcttcttcaagctaagggtcaatatcttgggaaaatgagattcaacttttcatgcaaggttagaatccaagttattgaaggctttgatgaaatgatttttgaagttcacaagattttagcttga

SEQ ID NO: 62010 - DNA, 261 bp, Glycine max
  Peptide Sequence Number=SeqID_178788
atggagtgtgatggaaaaactgcgatggagttcaatcgtacgcaacgcgcaagtgatgatgaagacctgtataagcagtattatatcgatgctaacgaagatgtaacctcatatctggtggtagttcacattctctgcattccaaagagaaacttcattgcaaccaatagccacataaacaagaggcctagcattttccaaatcacgctacgtctcatagccccacaccttctcttccacttgccacctgtccttcattaa

SEQ ID NO: 62011 - DNA, 951 bp, Glycine max
  Peptide Sequence Number=SeqID_178789
atggattctaaaattgttgaatactcggttaaacctgttcggagtcaatttggtcttgattacataacctcctacaaaagcaaccttggaaagctcaaaatcgaggttcaaaacctggaggccaccaaaaatagtgtgcaaaaatctgttgatgaggctaaaagaaatggagaaaagattgtagataatgtccaaatttggctaaagaaagtggatgccattatttctgagggaaagaaacttattgacaataatgatgtccatgcaaaagataaatattgtatgagatgcttccaaaatttatggtctaggcaccaacagaacaagaaatccaaaaagacgatgcaagatattcatgaagtcttagcaagaggaaattttgataaaatttctaaaccatcaacgctgaaagaaattcaactagtgttgaaagatcctgaaatctacatgattgggttgtatgggattgatggtgtgggcaaaacaacacttgccaaagagttagcttggcaagttgaaaaagatggttcatttgatgttgtagttatggctgaggtaacagattctctagatgtggaaaatattcaaggccaaattgctaatgcgttgtgtctgaatttcgaagaaaagacgaaagaaggaagagcggaacaattgcgtcaacggataaacaagcagaagaacatgcttattgttcttgatgatatttgccgagttgatttggcagaactggggattccttatggtgatgaccacatgggatgcaaattattgttgacgactaaaaatcttaatctgcttaaacgacagatgggtactcaaaaggattttagacttgaggttttatctgatgacgatagttggaagttgtttaagaatattgcagttgttatagcaaaggctttgagaaacaaagatgtctctacttggatggatgctttaaaccaatga

SEQ ID NO: 62012 - DNA, 396 bp, Glycine max
  Peptide Sequence Number=SeqID_178790
atggttaatcatctcaaggttgttaacgatagtttgcagctacgttccactattgaagatgtgcagacagaaaaggttaagtttcagcttagactgggtccaagcaaacctatttataatgcgttcaaagccattcaggagtctcctaattggcagacacttagtgatgcttgcaaacgtctagttgaaagccaaataaaggaggcggttcttaatggagtttctcttgaagatgataaaagagaaagttttaacaaaattgaacaggagctagaaaagttatcacaaaggtttgggggaaatgttctggatgcaacaaagaagtttgaaaagctaatcactgataagaaggaaattgaaggattacttgctactgctcttgggttggctgcatag

SEQ ID NO: 62013 - DNA, 534 bp, Glycine max
  Peptide Sequence Number=SeqID_178791
atgtatatggggaattgcaatatccaatgggaggttgaaggagaaaaaagcctaaccaacaatgcgagtctaagtgagctaaggaatttgaatcagctaagaagtttggacttatcaatccaagatgcttcagttttacctacagatatttatatatttggaaagttacaaacatacatcatatttattggcaacatttggaaatggtcttcattatggtctggggatgctcatgaaacttcaagacacttaagcttgccaactctgaatacaaatattcttttaaaccgtgggaattgcataggccaagatggagattgggtaataaagaactgtctcagttgtggaaatgggcagatcaaaatccggtcactatttacatttcccaaacatttctaccactttcatgcatctccccattctgaaggaaaggggaaaaacccttttagcagccttgattacagccagaacttattttggtctatcataacgcactatgttccagtttgttacatcagcatccttggatggtga

SEQ ID NO: 62014 - DNA, 780 bp, Glycine max
  Peptide Sequence Number=SeqID_178792
atgccggaagcatcggtctccaatgtgaaggacagggagaaatctgacaaaacccaaacaagggctgtgggccaaaatattgcgcaacaccctggtgtatatggtgattgggaggtttgtgggtataatgcgaatatgaaagtaggcactgactccatccttgcgaaccaaatgatgaatttgggggatttgagccattgcactcccaacactaggttcgcaccatatagcagcaggacatggaggtcaacaatgaaagtgacgtcttggacatgtattggaatagcttcacagagaagttgtgggtactacccttatcaactaagatcatcaccttctgtgctgcaatgtgtcctaaaagacgcaaagtctcaggaactaaatggctcaaaagctaactctttaaaagacaatctcttgataggtaatgaagggagtggcttctacgacgtgggtagcaaaggggaggaggatgacgccagaaacagcgaaggaggagtcaaggtggtggaagatggaattgggccaggcctgaacttcacggtgaatctccggggccaaggtccttatactgggaaggggcaaaacgagtctgaagagcttggagaaatatcagccaagactgagtttgtgaatgagttcatccagcttaagggtcatggtgtgaaagaccaaaatggaaatatggtagacaagattgccagctcagcttccaacggttcagacatagtccttgaggtacctaggtgtggtcaccttcctcatggaccttcctcttga

SEQ ID NO: 62015 - DNA, 363 bp, Glycine max
  Peptide Sequence Number=SeqID_178793
atgtctcatgttggtggggattatgataattccaatggaggtagatgctctcgttggaagttcacactatcggggaaagttctaataacgaaccctcccatcatcttggtaactccaaagttattattgacaatgcgtctagtgttcttgttaacgacatcgttgctaatgttgccatggttagccctaatgccagggaggtcgagtcatctctgtctttgtcagggaagggctgtggaggagcaagtaagatccatgccgcaacccttaagttcgggggttagtgggaaacaaaaagaaccagacagtggtttggaaccctacccatttatctacaaacatccgcaacctccatggaagtag

SEQ ID NO: 62016 - DNA, 501 bp, Glycine max
  Peptide Sequence Number=SeqID_178794
atgatattcataaggactcacgtgtcttccgacagcgatagcagcatctctagcggttcccctgagattccttcagttattcatccgactgctccgatagagttcccaaacgttagagagacggagaagagattgaaacctccacttgtactgtcttcatgcgattcctttttctccctccaagaatattatctcgcaaatcccaacggtggaagtgtgcgcaatttaatttcgaacaacatatccaaatttcttgaaaatccaacggttaacgaaactggtatcgtcattgtactgagaccgttttgggtttctgcgggaaaggaaaaggctacaatgcgaaagaattgggctgcaaatgtagtgctcaaatttcaagacgatccaacggtgaatgagtccgagatcgtcatttttctgagacaggttaggtggcctgcgggaaaaagagagggttttgggagaagagagaagaaacgaaattgtgaggcaggaggctga

SEQ ID NO: 62017 - DNA, 1041 bp, Glycine max
  Peptide Sequence Number=SeqID_178795
atggattggtactatgggaacggcattaatgattatctggttcccagagatcaggatttattggacaggcatccttcaccagactattggtcaaactggggaataagtgcaactgaaggttttaattcacctaaaaatctttttatcatggatttctttgaagaaagattcaataatcaaattgagcttgaaccatctctgcatgataaagatcattctagcagttcaagtacagcattttcatgcgatcagcctaattaccagcttcaagatctaccgagattcgaaccgatgaatgacactttcttggattctgtacctgaaggtcttccatgtgttgacgttgaaaacctagacaaatccatcaacatttctcctgaaaaccaatgcagcagtacacctggtatattgcagaaagatataccagcttcaaagtctgtttctagcaactcagaatcaaagaattgcctggatatagaggcaccactgaccaaggtcttggacatatttgagcagtgtagcagagatgatggcatgtgtgagcagtcatcatcacttgaggaattcatactgaaggatcttgagatggtaattggacagttcaccgagaggacccgtatttgcttccgagatgctctgtaccgtcttgctagaaacactgaagaacaacctgtaatgctggaccagaatgaagatcttaacatacagaaggcaataccacatacagatcacaatgaaacaatgaggtctcaggacaagaaaccaatggaatcagaaaccaacaatattgacagaataattgcaaatctcatgttcaagagcatggagttcaacatacatcattctccaattacatcatcaacaaactccgttcaacaagttattggaagtaataatggtccacgtggaaacaactcaaaagccatgaatatggaagacaaatcttgctactcccacccacaaaaattactagtagatgccgagattcccaggtttggactaagtaatcaaccaagggacacaggttcatatatcacatga

SEQ ID NO: 62018 - DNA, 459 bp, Glycine max
  Peptide Sequence Number=SeqID_178796
atggtcggccggcgttgtgcgaagaccgtacagtggaagcctaaggttcatcgccgtcagcttggtcgttctcatgagatgcatttacccacaatctctactcactcctcaccccattcaaacccaaacaaccacttcactctctctcccacctctttcttcggcaccaggatcaccctcctacgtgccacctcatcgtctcgttccctcctcaacaccaattgccatgcgacatcagccaccgtgtcgtttagcctccctaccccgtggtcggcgagggctataaagtcatatgcaatgggggaattggaagcgaggaagctcaagaatccaaacacgggaattgaggcacttctcatagggaatttggttgaagtcagtaaagaaggtacatggaaattgataggaacaaataaggaacaaggacctgtctccacaaagcatgaaggagaggattga

SEQ ID NO: 62019 - DNA, 399 bp, Glycine max
  Peptide Sequence Number=SeqID_178797
atggagttcatctgctttggtgtcgtcagacccaccgccatcagtgccatagtcgatcttctggcacttcctctcattgaaaatcttggtcttcttgtgcttcctcaaatctttgaggacatcgaatcactctctttttcacctttgttttcaaacaccgaaacattaaaaccctcaaatggacaaaccctcaacacaattgaacaaggaacaacgtgcaaagaagtatacattagaagtaatcaaatggaagaaaagcaggagaacataccttcaagtaacactcacaaaaggaaaagcttaagtgccctcgaaaccgcaaaaatggaggagagcgtgcacggggtaagaagtaaagtaagagttcttcctcagctagctagggtataccaaaagtga

SEQ ID NO: 62020 - DNA, 288 bp, Glycine max
  Peptide Sequence Number=SeqID_178798
atggagaacaatgagcctccatggtgtcttgagccatttgcagttggaacactagcaatactggcttacaaagaggacatgatcaatacaaggataagaaacctatttggatatacccttttcttcataagcactttgtcgatcttaattttggatttagcaacatctggtaaaggaggacttggaacttttgttggtggaactaggttacaggcttacagctacaaggacagtgacccccaaaggtgctcatcacttatcctgtcccaccaacctgatccaatttga

SEQ ID NO: 62021 - DNA, 1524 bp, Glycine max
  Peptide Sequence Number=SeqID_178799
atgacgaatttccgttggtgtgggccttactctgggccattgggggcccagtggcagaagagctttcaagaaactataagtaggcgtgaaggctggctagtgactcacacagtcacagtgattgagatggagattaagttcataatggcttggctacacccttggtggtgcactatcaatgctaccagccatctcaaagaaaataaggatgcaattgagctggtgcagaaagcatttgatgaaatccttcttccagagcctgaagacctcttttctgatgatcaattcaaatctgaaggcattgattcaggtgaggtacacttagaaaagagtgaagttgagagaaaaaggaatacttcaacatccacagaatctccaacagcacagaggatggggaccaaacctgaccaaagagcaccaagaagctggagcaatctgaagaagttaatcctcttgaaaaggtttgtgaatgcattagagaaggtaagaaacatcaaccccaaaagaccaagacgttttccttctgatgctaacttagaaatagaaaaagtttttctcaagcaccaaacagcgggagagaagaataatgctgaggaatggatgcttgactatgcacttcaaaaggttgtttctaaacttgcacctgctcaaagacaaaaagtgacacttctagtaaaagcttttgaaacaattctgccatttcaagttgctgaaaatagtccacggttttctccaacaatggaacctcaagcaaatccagttcaaccccttgacaattcctcaaatcacagcgaggaagaaacatcattttctcatgatagcagtatggaactgacagaaaatactagtgatgatccaatgccagaactgcacaatcatactacgctcaaagaaagatgtcttgagtctcttgactttcttggaaccaagacagtcaagaatatgcctgcctttggagctactgaagaagacttgagtggaaagcaaagtttagctggcagttatgataatgaggagaagatatcaagtgacagtgataatatttatcttggagagatcaaagatactacctcaagttccttaaatgagccagttgaaattataagaagcagtcatgaggaggctccaaccaatgaaacagtcaatgatgttccagaagatttgctatctagtgtgaatacagaaaatccagatatcaaatctaagtcacctggaagagatgttgaaaccaagaatctgaatggtgataatggtgaaaaaatttccatgtccaaaagtttagtcctagaaggtttagttagatcactcagatctaatttgattggttcaggagcacctgtaaacgaaccaactgccaacgacagaaaagaaggaattgaaaatgttaaacaggaaactgagactcttgaagagttccctacaaaggaacaatatgaaactcatattagtgctgttgtagaacctgagacccctgtagagaaacagaataacacaggattgtggtacttggtgtataagcacatg

SEQ ID NO: 62022 - DNA, 279 bp, Glycine max
  Peptide Sequence Number=SeqID_178800
atgtattttctttgtttactgaaaaccttcaccgtgtatgatctgtcacagttagactgttgcgctagaattcttttgtccaaatggttacatgcttccatcacaatattccatccaattggaactccaatctgcatcccttccagagagttcattgatattggtcgcgttgcccccattgagaataaccatctacctgttgattatgcaaggaaggggcagaaagtagccattaagattgaagaggctaaggttgctggccttctaggatcggcatga

SEQ ID NO: 62023 - DNA, 114 bp, Glycine max
  Peptide Sequence Number=SeqID_178801
atggcaatagagaaacagcccgggcaacgagtccccacgcgtaagagagaaaagcagatctgggcgatgcagttagtggttatgaaggaaggatgtttggacggtacagattag

SEQ ID NO: 62024 - DNA, 412 bp, Glycine max
  Peptide Sequence Number=SeqID_178802
agaaccttctagaagagtacctacaaatcatttttctcaagagatccttggcaacgagggacgcagtttagaagattctagaaggaaacctaagcttatccctaagcacaacttcaaatatctccgcagcagagtctccataaaaagggggaatcatcgccaacattatatacaaaatcaccccatagctccacacatcaaccttctcatcgtactccctctccaacagaacctccagcgtcatgtagtacgtcgtccccaccatgccgctcatgctcctcccgtctttgaaacactacgccaaaccaaagtcgatgagattaagattgtccgccgaatcaaagacaatattgtcgggctaaatatcacggtgggcgacatcgaggcggtggcattattcgatggcttctag

SEQ ID NO: 62025 - DNA, 453 bp, Glycine max
  Peptide Sequence Number=SeqID_178803
atgttatatgtggctataactcgtacaagacaaagattgtggatatgtgagaatacagaagagtactctagacctatgtttgattattggagaaagaaaggtcttgtgcaatttaaagaactggatgattcacttgctcaagcaatgaaagttgcaagtagtcctgaagaatggaagtcacgtggcaaaaagctatactatcaaaataactatgagatggcaacgatgtgttttgaaagagcaggagactcttactgggacagaaagtctaaggcttctagtcttagggcaaatgcaaaccgtttgcgtgatttgaatcctgaggattcaaatgcaatgcttagggaagctgctgaaatttttgaaggcataggaatggcagaatctgctgcccagtgtttttttgatttaggggattataaaagagctggttgcagatcaaaacctgcttaa

SEQ ID NO: 62026 - DNA, 467 bp, Glycine max
  Peptide Sequence Number=SeqID_178804
atggaaagccctttctagctttgggaggttcatccgatattataagcatatggaatctagaaaagaaaaggctccaattagttgtaagagaggctcacgatagtgtgatcacttcactacattttgttgcaaatgaaccagtgccaatgagttcatcaacagacaactctgttaacataagaactattttgaagttgcacacattgatgtggaatccttgggataagaaagcaaaagctatgtctgatttcggtgatgatgagtataagtacatgctttgtgtagaggctgctgctattgaaaagcctatctctttgaatcttgttgagggatggaatggaagactagaactttcaactgtttcttctagttattgtagtggaaaattgatcccaaaagagttattcaaggaagctgaaagatcatcgttgtgttttgtgtcctgtatatgtattaaatgcacttga

SEQ ID NO: 62027 - DNA, 150 bp, Glycine max
  Peptide Sequence Number=SeqID_178805
atggccaaggtggtgctttccaagtctattcagttaggcttcttagcctggcatggttgggagttgtactttcaaaggaagcctacggttgcatatacccaactggccaactcccaatggggaccacttaccaaggtgccaaaaccttag

SEQ ID NO: 62028 - DNA, 576 bp, Glycine max
  Peptide Sequence Number=SeqID_178806
atggaaattgatttgatggaagtcctggttggaacaggatccagaaccatgacaattgttaaaatcaagtcactgaaggtctatgcttttggagtttatgttcatccatattccctctgtgagaaattggggccaaaatatgcatcaatttctgctgatgaattgaataaccatcatgacttctacaaggatcttctcagggaggatatcaatatgactgttagacttgttgcaaattgcaggggtatgaaaattaacagcgtgaaagatgcttttgaaaaatcacttcgagctcgattagtaaaggcaaatccatccacagactttagttgcctaaagacatttggttcatacttcacagagaatatctcaattcctttgggaacagtaattgagttcaaacgaacagttgatggacgtctgatcactaaaattagtgggaatcagataggaagtgttcacagcaaagatttgtgtcgggctttctttgacatgtacattggagatgtccctgtgtgtgaacaaactaaaaaggagattggcatgaatgctgcaaatattattaacaagtgctaa

SEQ ID NO: 62029 - DNA, 600 bp, Glycine max
  Peptide Sequence Number=SeqID_178807
atggagatttacaaggacaggaaatcaagacaattgtggctttcacaatggggctatgttgagaaggtgctagacaagttcaacatgagcaatgcaaagcttgtaagtattccattagcaaaacactttaagctttccatagatcaatgtccgaaaacatatgttgaggtggagtacatgtcaaaggttccctatgccagagcagttggttgtttgatgtgggcatgtttgttggaaatccattattcaatctcttgtggcaatgtcaacaactgcgaagtatatatggcagtagcagaggctagcaaggaagctatgtggttcgcagggctagtgaaggagttgggcattaagcaaggtggagttcaattgcattgtgatagccaaagtgctattgacttgacaaagaatcatgtgtatcctactaaaaccaagcatattgatgtgaggttccataagatcagggaattgatgacatctagtcagattttgctcaggaaggttcacacttcagagaatgcagctgatatgttaatcaaggcagtcataactgacaagttcaatcattgcttagacttgttaaacattgttgagggctag

SEQ ID NO: 62030 - DNA, 274 bp, Glycine max
  Peptide Sequence Number=SeqID_178808
atggcatacagtgtagaactactcatcaacatatattggtatgatcagacactttttgaggatgaaaacagaaacagaatgaccgagactaaggaacttttcgagtggatcctgaagcaaccatgttttgagaaaacatccttcatgttattcttaaacaagtttgacatatttgagaagaagatcctgaaagtcccacttaatgtaatgcgagtggttcaaagattaccaaccagtttcaacagggcaaacaagacattgagcatgcttatga

SEQ ID NO: 62031 - DNA, 249 bp, Glycine max
  Peptide Sequence Number=SeqID_178809
atgcgagacgcgcgagtcgttgtcacttggtggttgaacaaggagaggtgtggaagctttgtgcgcgtgacctcttcgactttgggacttggagttgtacgacaatgcactccttcccatgggaacgacatcgacgaggaagtgacaaacacgaagactgtgttaggcaataggagatgcgacaaggttttgggaaaagaaaacacaatgaggggttgggaatggaggcacaacgaagtgtgggaatga

SEQ ID NO: 62032 - DNA, 183 bp, Glycine max
  Peptide Sequence Number=SeqID_178810
atggccagatgccattttaatggacagctatgccccttcatttattatgcacgtttatttagaagttacaagcattatcatggccttaatcccaacatggaggattttgaggccaaaaaatgccatcttaagactgaagccaccaagaaattgaccaactacgactttaacaaggaaagataa

SEQ ID NO: 62033 - DNA, 516 bp, Glycine max
  Peptide Sequence Number=SeqID_178811
atggctaaagaaagagggtttccccaaggggagagactcaggctttggatttttgcactagagagctatgagattcgcgcgcactgggcatctccttgtgggccttcacgcgttgagcgaggattgcgcactgagcgagacatcgcactaagcttggaactgcctactaagcgagcattgtgcgctgagcctggattacgcactgagcgagctgcaagaggctccaactgggctgaggaggatggagaaggctggctggtggaggcaggtgggactgatgatggtgggcccgctggtgctagaattggaggtgcgtttggtactggtcggggtcgaacctgcctcggtcctggaaagataatggaaggatatgttgggttccaacagttcttcctgatgtatgctaagttgatcacgggactgagcgactcgaaggtgctggattgggctatctgtgtgatctggcctgatatcatgttgcccaagtcaatgtccatctgtgagaccaacccgtag

SEQ ID NO: 62034 - DNA, 876 bp, Glycine max
  Peptide Sequence Number=SeqID_178812
atggggcgaatacttttcttgattttcaattttcaggggggaggaagaaaagtgattttggaggttggctgtggagctggaaatactatctttcctgtcatagcatcaaatccagatgcttttgtttatgcatgtgatttctcaccacgagctattgagttggttaaggttggaagtctccttttcgtaaactctatgcccaatcatcatctgtttacacatgaagacttcaaggaatcccatgttagtgcttttgtctctgatttgacagctgatgatctgtgcaacgagattcttccatcttcagttgatattgttacaatgatatttatgttgtctgcagtgtccccagaaaagatgcctttagttttgcaaaatattagaaaagttatcaagccaaatggatatgtgttgttccgagactatgctactggagaccttgctcaggaaaggttctctagcaaggatcaaaagattagtgataacttttatgttagaggtgatggcactcgtgcttactatttttcaaatgagttcttgacaaatttattcaaagaaaatggttttgatgttcacaaacatcatgtatactgcaaacaagttgagaaccgctcaagggagttgataatgaatcggcgttgggtccaagctgtatttcgtgtatcagatagttccaactcctcttcatgtataggagccgaggccaatcatcttgacagtggtaatgacaataaagaaatcaagaaaaacagtttgaatggtggtttaaatgattctgcagttgacttgtctgagggtgtggcagttgacatgtttggagtcttaccttccaacgagtatgagttgttgttccagcttagaagcttgatgtactaa

SEQ ID NO: 62035 - DNA, 228 bp, Glycine max
  Peptide Sequence Number=SeqID_178813
atggatcggataaacgaatttcaacctaacgaattcaggtcggtggtggatcgatggggctcactgatggtggtagggagggcacatggtagcgtggcggtgccgaagtccctccgaggttccgcggcggtgcgtatttgggccttggtgatggtcgcgcggaagagagcgcaagagcgagaggactatggaaggagggttgaaaggaaaaaaaagagaaaattttag

SEQ ID NO: 62036 - DNA, 267 bp, Glycine max
  Peptide Sequence Number=SeqID_178814
cacccaggcccatttgggccctccagaagattcctccagaaggcggttgcttctggaggaagcaaccctgctcgcctgggcgagctgggcggcaaccacctcccctattttgctataaataggggaggaagtggagaagtgctcgtggttcaaatttctttcaaatttagtgcttgttgctatgctttcatccttgttgctgtgctttcatccttcaagtgcccttacccttatcttggacataaattcctgatattccaatgttag

SEQ ID NO: 62037 - DNA, 402 bp, Glycine max
  Peptide Sequence Number=SeqID_178815
atgcttgatgaaattataaactatgttcagtcattgcagcgccaagttgagtttctgtctatgaagttggcttctgttaacaccaggctggattttagtattgagagtctaatctcaaaagatatatttcaatcaaataattctttggcacacccaatattcctgatagattcctcagcaccacccttttatgggcaacaccctcagccaaacccagcagtccacaataacattcctaatggaactatgacccacaactcagtggacccattagatactggtttgtgccaaaaccttggcatgcatttaccacacctaaatgattttaatgaaggtggttctcaggctcaaatcaagtacccctatgaaaatcaagctctgatcaccattcattacggctga

SEQ ID NO: 62038 - DNA, 165 bp, Glycine max
  Peptide Sequence Number=SeqID_178816
atgactcaagggaaaaaggtgaagaaaaagaagagaaagatgaggagaaaacacaacaatagtgggagaagcgctcacaaagtttctagccaagagaaagtgcaaggaggatgtgttctatgtgaccttcatgccaccttgaaggcatttgacccattaagctaa

SEQ ID NO: 62039 - DNA, 180 bp, Glycine max
  Peptide Sequence Number=SeqID_178817
atggtgaagagagtgaagttgcggcgcaactaccaagatctgttggatctcatgccgccgaagtgccaccaaatcctctccaagaaggacatctttgtgctcctcttatggccccaaccattcgacctcgaccaccagggttttgtggaagtcctcgttgcaagtagcggtgaggtttga

SEQ ID NO: 62040 - DNA, 1266 bp, Glycine max
  Peptide Sequence Number=SeqID_178818
atggaaaaccaattctttctcaatgctggtgtgccccctcagctgcattttgagccttcaccacacggtcaccaaccttgtccaccaccctcttggcaatcatcactgtcttctgccatggatgttcaagtcaccgttttgaattgttcaactgagcagacccaggattgcttctacaacaccaccccaacatgggacaagtcaacggatcatggccttcagtttgattcagctctgagttcaatggtgtcctctcctgcagcctccaattccaacatatcaagtgagaattttgtcatcagggaattgataggaaaattgggaaacattggtggtggtggtggttcagatgagatctcacctcattctcagcctttggttggtgcatctttctacatcaattgcaataataatagcaccaacacttcatgttatagcacccctttgagttctcctccaaaggtgaacacgatcaagatccccacaatggtgaaccacttggtgaaggagggcatgcccccaagtttggagacaccaatgtccttgaattccactgtggctaaattctcagctgatcctggctttgctgagagggctgcaaagttttcatgctttggaagtcggagtttgaatggcaggaccacccaattgggactcaacaatgctgaattggctcagagatcttcattggtggaaaatgggaagcggctccctagagtctcaagtagtccatcactcaaagtgcttgaatctcaaatgggtactcaggagaacaaaaattctccattgcaagacctaatggaattggccaattctcaagaggaatccacaatctctgaacagaccccaaatggggacactggggtgaagccttccccttatgtgaattctaggaaaagaaaaggtccatccaaaggaaaagccaaagaaacttcagcctctattaacccccctatggctgctgaagctagtgaagactggaatgcgaaacgcagcaagcctaatgccggtgaggggaatgaaaatggccaagttaaggcagaggaagagtccaaagggggtaatagtaatgcaaatgatgagaaacagaacaagagtaactcaaaacctcctgaacctccaaaggattacattcatgttagagcaagaagaggtcaagccactgatagtcatagtcttgcagaaagagttcggagggagaaaatcagtgaaagaatgaagcttctccaagatcttgtcccaggtgcaataaggtgcatgggctga

SEQ ID NO: 62041 - DNA, 147 bp, Glycine max
  Peptide Sequence Number=SeqID_178819
atggcacttatgaacaccaaacaacttgctctcaaaccaaagcctaaattggacaagaatttattagaaaggtgcatggattgggcaaatatacccccatcgaagcacatctgttttaatagcgtttcagaggagaggctatcctaa

SEQ ID NO: 62042 - DNA, 281 bp, Glycine max
  Peptide Sequence Number=SeqID_178820
atggcggttcatggcggaaagtcaaaaatccgccataaaaatatggcggatggcgtagcggaaaatggcggatacagaaggaaggccgttcgttgccggagctcgtgccttgccggggctcgtcgcgaagtcagccttcgtcttcgtgtaaggggtgtcgcgggcggcggcggctgggtgtgcggactgtgggtgtcgcctgtcgcggcggcggctgggtgcggcggggtgagggaggacgcagaggtgcgggagggacgcaggggctattctaaatcaag

SEQ ID NO: 62043 - DNA, 612 bp, Glycine max
  Peptide Sequence Number=SeqID_178821
atggttggagttttgactgttttgatcaaaactctgtaccttaccttccaaactcttcttgtggtcaaaaagttcctcaaacttacaataacgactaccccttcagtgaaatctatggctccttacttgatgaatcatcaccacagattatggattcattctatagcacccttgatactccactcaatacccctccatttcttagtaagaacatctatacttggagacactattgattacatgaaagaacttctggagaagatcaacaatctgcggcaagaagtagaagtagattcaaacatggcaggcattttcaaagatgtaaaaccaaatgaaatcctagtgagaaattcacccaagtttgaggtggagaggagtgtggacacccgagtggaaatttgctgtgtagggaagccaggcttgatactatctactgtaaacactctgaaagcattaggcctagagattcaacaatgtgttattagctgtttcaatgatttcacaatgcaggcttcatgctcagaggaatcggagcaaaggacgatgctgagttttgaagacataaagcaagcgttgtttagaagtgcaggatatggaggaagatgtttatga

SEQ ID NO: 62044 - DNA, 129 bp, Glycine max
  Peptide Sequence Number=SeqID_178822
atggctaggattggcaagggtagtgttgaatttgaggatttgttaccagtgatcaccggtaaactgggtggtgagggtttgataaaggagctttgttacattgatagcaatagcaaatcagagaagtag

SEQ ID NO: 62045 - DNA, 450 bp, Glycine max
  Peptide Sequence Number=SeqID_178823
atgaacaaaggaaggaaaataagagctgacataagatcaaattccatcggaattgagttgtttttgactgtgctctcctcctcgacaaagtacctctcgcaaggggtggaggaagaatcagggtgttgccgtcgccatcagttgctcgcttgcgtggtgtttggtgcttgtgtggtgccgtcgtcgacttcgggtgagaccgtgagagaactcgcactggtgcgtggtgccgtcatcgctaagtgtcccaaccatgagtgtcaccaggttgttgactttgacaaagtgcttaaccccaacaacaaagatgatgttgtgctttcgagagtaagcgattcaataaggtggttggcaaggacggacgataaaggccaccatgaggtgaatccgatggagcaaattgaagtggtaacagaagggtggcagaaagcgaggataactagttcatga

SEQ ID NO: 62046 - DNA, 1107 bp, Glycine max
  Peptide Sequence Number=SeqID_178824
atggcttctcataagagaaaagcaacagctttagtgtcccaggctaggtatgatagatcaagatttgtatcccaaaatgcttgggaccgctatgcagacaatgtccttggccggaagatccttttagaaaggaatgaattctatgccaacctttatgaccctgaagataaatcaccaaagcaggtgagggtgcgagggcacctaattaaatttgatgctgacaccctcaacacctttttgaagacatcagtgatcatcgaggaaggggagagctttccctcttactctaggttctgcatgctaaggccagatcctcaaaagcttgcagcccgtctatgtatccttgggaggagatttgagctgaatgcaaatgggctacctctaaagattttgaggaagaatcttaccactctagcccagacctggagtgttctatctttttctaacttagccccgacatctcatatttcaaatattactttggatggggctaagttaatctacgggcttgtaatgaagatgaatatgaacttgggatccctcatctcaggtcagatttctctcatcgcacagcatgactcctcgaggctaggtttcccaacccttattactgctttatgcaaggcccgaggagtcacatctgattctctgacctttgagtccatgagcccaaccattaatttggcttatattaaaaagaattgctggaacctggatgacccttcagtcacttttccgggaactagcaaatctagggccagaagatttgaggcaccatctactttagctccccatacctcagctccttctacatcagctccagctatctctcatctccctccagcaccagcagctccagttcttctgaatccttcttttcaaagctctgagccattcttttttatgctgcaaagcctgcatcagggccaactcctgatcatgcagagcttgcaaaatgtggtccaccaacggccaattatgagcgttgaagaattattcaataggtggcctggccaagagtccaaccttctcctttgggagggggtgagagcctcaacaggatcagcaggagaacattctagaggttgtagagcctacacctcctga

SEQ ID NO: 62047 - DNA, 426 bp, Glycine max
  Peptide Sequence Number=SeqID_178825
atggataagcctgaagagagttcttccatgccagcacgcgctcaacgcgtatgcagctcgctaagcgaggcagttgtcttttctgcgctaggcgcaagattgacactaagccaaatatcacttactcacgctaagcgcgagaatggcgctaagcacaccttcgaggtttcacatccacacaaacaagtattattcctaggggcgaaacacgtgctgaaagacgtgacaaatcttgtgatcggtgtagagttgtgggagtgcgtcacagtagtttgcccaaatatgccagtgcaagtccagaccctcccctttcttgttcttcttcttcaactcaactattcttctccactcaactcaactcttcttcctagaattgacattcctattttgggttttggatttgtttccggaacaagcattccataa

SEQ ID NO: 62048 - DNA, 378 bp, Glycine max
  Peptide Sequence Number=SeqID_178826
atgtcaaagaagaattcgactaatccactgatgatgtacaataaggacaacacggatcgcgaggacaacctcccaaatttcatatctgaattggatctagattgcgaggacgaagttcaagacaatgagttggagcactgtgatgaagaaggggttgccaaaaaggacgaggttgaggataatgagctagagcactatgacagagaaggggctactggtgaggatgaactagaagatgatgatggaattttcggattgcccatatcagtacctgtatatttgtttacagatgatgcgttgaagcattgcatcgaagaagggtttgtccacgacaaagacaaagatggagatgatgcactcagatccgatgcactctag

SEQ ID NO: 62049 - DNA, 360 bp, Glycine max
  Peptide Sequence Number=SeqID_178827
atgtcgattatgattctttctctgcatatcgaagatctaacaaaagaaaagttttctttgcgacgcgctcttgaggcttctcgaactttagcagagtcactagctactgaaaattcaactctgactgataattataatcaacagaggagtgtcgtcgaccaattgaaatcagacatggagaatttacaagaagatatcaaagcccgactggttgagtttgaggctatcaagagtgaatatacaaatgcacaactagaatgtaatgcagctgatgagcgtgccaagttattggcatctgaagttattggtttagaggagaagatatattatacaattcattattgtcaaaatgaatggtga

SEQ ID NO: 62050 - DNA, 553 bp, Glycine max
  Peptide Sequence Number=SeqID_178828
ggacaagtctggaaatggaggagatgcgcgaggcggcggtgcggttgtactcgttgatcatgttctcgaggtcctcatcgatggtgacagagatgagggaatcgaggtcctcgttggggagctggtacttaagcgtgaagggtcttccgttcaggaaagttttcgagaggcgcgtggagagggggacgatgtgcccaccgtagctgcacatgagacggagcttggtggatgtcgacacaaagggcttgtcccaggagtcggtgttgcgggaacgaggcgaggattccacggagtcggggtagctgaggatggatatgagggcttcgagtatggatctgatgatttggtagagaatggatccgagggtttcaaatatgatgggtttgaggattttggaggtctaaatgggtatttgtttgaagatgttgtggattcaagcagtgtagaagatcctgtaatgataaatgacaagaatgacatcttggaggttgatttggccaatattgactgtgttgttgttgagaggctgaattttgtggatcttgaaagttga

SEQ ID NO: 62051 - DNA, 210 bp, Glycine max
  Peptide Sequence Number=SeqID_178829
atggtgcttagcgcggcaaggcgccatagggagatgacgtggtcgtacttgtcggagagggctctgaaggtgcgatggagggggcacttgacgtggtggaggttgctgattatggggagaaatggtggacctggtgggaggttttggaactttctggcttggaggagaagctttaagaggagaaagagaaaaaaacataggagaaagtag

SEQ ID NO: 62052 - DNA, 318 bp, Glycine max
  Peptide Sequence Number=SeqID_178830
atgggtggctgtgccatactattgcagtcatgggcttggtaccgcatgcctttttttgcaccaagagtcccacgacccaaaacaacttttccactagctaaaagatggagtggtggtagattagaatatagggccacaccttatggtgacttggtcggatataggtctcgtatagatcatatggagagccatgagtttggactacaagaagatatccctgttgatcccatgaatcttgatctacttcaccaaattgacatgcgagacaatcattacattgattggatggagtaccatgcggggtggattaatatctga

SEQ ID NO: 62053 - DNA, 192 bp, Glycine max
  Peptide Sequence Number=SeqID_178831
atgaaagataatcgtacatggctgaagtctaatcaagcacatgctaatgtttcatattggtcaagtgagtacattgggccaactggtgcacaactagatggagcagaaatggtagcaagtggtttagccacccattttatcccttgtagtggtaaaaatattgtatttaatacctgcttattttaccgataa

SEQ ID NO: 62054 - DNA, 903 bp, Glycine max
  Peptide Sequence Number=SeqID_178832
atgatgcctatgacagcaaaggaaatagctgagaagattggacttgcactacctccggagccagaggttggtccctcaggtgctcgtgtcagcacaaaggagagttgtgttgctccctcagggaacgatccagagacgggtgactcagacaaatgcgggctatacattgaagaaaatccttcccgcccggttgccctaggaagactttatgagagatccacagcagttcacaacatccctttgttgcatggccaagtcaaggtttgtgttgaagaggttaaagatgcggaggctctcgttcctatgctcactgacgaggttacctcaatgtggcaggcacttaacaccttccttgcttggccgacacatcttgtgaagagtttatcagaacaagcagttgtgtctccagcaaaacctccagaaagcccggatcatgaggtcgatgatcccttgtacctgatgacattgaccatcccacaactatttttgaagcctctccaggttatgtgggatgctaccatgttcggggtgtttaatcaaaacttctcgttgtacataaagcacaaagatctctttgaaattgcacacggtggtcaatgtctcagcatatctgttatacagttgtggattttgcatctgactgagacaagtctgcaagcggggaattccgatgtgtatggattcctcgatccacaatccattcaaagatctgggcaatcgcaatttgaatcgaaaagttacatcaagagttggatgcagagtttaaaacgagatgtctaccttggagcctacctgaatggtactacaataactcatattcgtctctactgcagcggacactggcaaatggtcgtcattctgcctaaggaaaacctagttggtctagttttgttctttacataa

SEQ ID NO: 62055 - DNA, 234 bp, Glycine max
  Peptide Sequence Number=SeqID_178833
atggctactccaccggccttgcctcctcctcctctacctcctcctcctgcagacgcatcaacgtctctgtctacattgaagcggacacacaaggcgacacagctacgatcgttggcctctagaccacctggggcagaaagatctgtggtcaacgtcgatcctgctaccggcaaggccgacggtccccacaagaagaaattcagaacatttttggggattgtcgctcgtgatacg

SEQ ID NO: 62056 - DNA, 393 bp, Glycine max
  Peptide Sequence Number=SeqID_178834
atggaagaaattgaaggtgcaaccagagatcagtataagcacctgagaagttatgctgctaagatactagacaaaaacaaaaacaacacagtcaaattaaaatgtgacttaactcctcatggtcttgtgtttgaacgtatttatgtatgccttgaggaaggatgttgggcattcatttcttaccaacaaaaggggttggttgaggtaatcaaggagcttggacataatgtagaacatgagttgtctaggaaacatttatatggtaattggagaaagaagtaccccggagcacatatgaaagaattaatgtggatggcagatcgagcaactattgtccctgattgggaaaagactatgaatcaaattaagacatatgatgcaaatgcatggtag

SEQ ID NO: 62057 - DNA, 111 bp, Glycine max
  Peptide Sequence Number=SeqID_178835
atgggtggtagttctaatgcagtgaggattcaagggctgacaagtccttgcatgccatacaatgatgccatcaagaatgtgaggaacaagaggaatgaatttctaatgtaa

SEQ ID NO: 62058 - DNA, 417 bp, Glycine max
  Peptide Sequence Number=SeqID_178836
atgtcctatattgacttcaagaagctaattaactccttcgggtacaaatcattcaagttcttatggtataggaaccccaggaaagcattgagcagagggttgaagccacttaattctgactttaacattttacaattggctgaagttgtttttggcttcgatgtgattgatgtgtatatgaaccagggggtgattgacacatcctcaaataagttgaatgatgttgaggatgacgatgttgttggtgaagttgaggttgaggtgcagggtgacgaacagactttggttgaggttcaggtggaggctgaggttcaagttgatgaacaaggtttggtggaggctgtaggggaggctgatgttcaagctaagatggaggttgaagttcaggttcatgaacagactttggtggaggtttag

SEQ ID NO: 62059 - DNA, 1821 bp, Glycine max
  Peptide Sequence Number=SeqID_178837
atggtgatgcacatagagcaccacgtgattttgaattcagaatatgttctctctcaattccaatccgaaattgagcattcggccggactgatacaccctataaattcgtcctcaaccaattttgcaaaacttttgagttcaactctccaagatactaacctttcattctctgatatcaagaccaaggtggctccgttattatttaaagcatttgagacggttcctaacttagcccaaatttcatacatagaaaagaaaggtttatttttctcatactacactgattatggtcaagttttggcaatgtactcaaactcatcatcactttccacttcttttgggggtgcctcaaatttaagcatatattatatccagcccgtaaatcgtgacactggagagttatatgggaaagccataatatctgaagtaccatctaatattatcaatacaagttggtttgtgaaagcagttaatagttcacttagttatgcctcattgggaaccaagtggaacaatgatcatgatcttctattcgttagttcatctagaataaaggggacacaagtgatctctctaggcattccagtaacaactatcactgatttcttcactccggttggggcgaatttgtctttggttaccaaagatggaaaaatgcttgtagaagggattcaaaatactcgtttgggcttctctaatgacatggtttatttccaatcagtgaatgcaaatggtgatcaaacaagttatgacggcgttgtttcatgcaaagatggagatgcagaagctgcctctattttgaatattcagggtgttgagtatttaattcgctgctccaccattgatataatggaaataaaatcggtgtatgttttggctgtcccacgaaaaggattggaccactttgttctggacattaagaaaaaaggattggcactattgacaacaatgattgtcatgatactcattgccatggtcagttttctatacataaatgttagatcattaaggcgagaaatgcatttgtgttggtcactcatcaaacaaaatgaagccacacaacaagctgagcgaaaatgtatgaacaagagccttgcttttgctagtgccagccatgatgttcgcgcttcgctggcgggccttactggtttgatagaaatgtcctttcatgaagtttctcctgattctgaattaggaaccaacttaagacaaatggattcttgtaccaaagatttactaggactattgaattctatacttgatgcaagtaaagttgaagctggcaaaatgctgcttgaggaagaggaatttgatgtatttcaactccttgaagatgtggttgatttataccattctgtggctatgaagaaaggagtagatattgtgttggacccttgcaatggttctgtactcagatattcgcgcacgaaaggcgacagaggaaaactcaaacaagttttgtgcaatttactgagcaatgctgttaaatttaccgaggaggggcacatagctgttcgagcatgggctcagaagccaagcttgcagagctcaatgattgctactcaccaatacgggtccagtagacttttgtcgcgcttgtgttgccgccaaaatgaagcacgtgatgacgtggaagacttgaacatccaacaagatccaaattgtatggattttactattgaagtggatgacactggcaaaggaattcctaaagagaagcacaagtctgtttttgaaaattatgtccaagtcaaagaaactactcttggccaagaaggaactggcttgggacttggtattgttcagtcactgagtaaatag

SEQ ID NO: 62060 - DNA, 846 bp, Glycine max
  Peptide Sequence Number=SeqID_178838
atggctcaagcatgctcttcacttggtgtcattttgagtcatgtcaaatctagacaacttcatcatctgttaacaccgggtaaagttcttcctgatgtttgtatggatcttaatcatttcaaggatgcctttgattgggcggaagccaataactctgggcgtataataccccgtgaaggagttgacacaggcttctttagatactggtctccagatattaaagtttttttaagagagctctcccatgctgaatctgaaaaggagtccttgttgaaaagtacatttcagagattaattgggcgtttttgtgaacatcacactaagtggaagcagttggtgtctacaactgcagaactggatgtcttgatcagtttagcaattgccggtgactactatgaaggaccaacatgcagacctacttttgtaggcacattatgtacaaaagaagctccttacctgcatgctaaaagtttgggacacccagtccgtaggagtgataccttaggcaagggtgactttgtacccaatgacataaccattggtggttcagatcatgctagctttattcttttaacaggtcctaagatgggtgggaagtcaactttttttcgtcaagtttgcttgactgtgattttggcccaggtaggagctactgcatcaatgctgcttctggtgagaccatctcctgatttgtctttcgtatttcaaatatttgacagggattcagtattagaacatcttgtgcggatggtgcagtgtcgcggattgttttctacccactatcatcgattagctgttgattatctcaaagatccaaaagtattaccagttttttatccggtgtaa

SEQ ID NO: 62061 - DNA, 366 bp, Glycine max
  Peptide Sequence Number=SeqID_178839
atgttcagccctcctgaaaattcaagccgaggcgcttccgtaacgtttccgtgggtgatttcgcgaagattttcaaccattcttcgacgttcttcattcgatcttcgtcgttctttggtctccaaccagttgtcgtctcttgtgacggacgcgtggggtgctaatacgttcctcgtgcgtaaatacaactcccgaaccttttcacttaatgttcgtagatcacgtcttttctggttttttcgacgttttcctcaaataaacgttggtggcgactccgcgcgtattcctttcttggaacacgcacccgcgagtcacgcgtcgccctcccgccgaagggtaggttgcgacagttggcgactccactag

SEQ ID NO: 62062 - DNA, 879 bp, Glycine max
  Peptide Sequence Number=SeqID_178840
ggttattgcattcttgttgtagaacagactgaaacacctgaacagaagaagggctctaaagataaggttgtaaggcgtgaaatatgttcagtggttacaaaaggtacattaacagatggggagttgctgtcagcaaaccctgaagctgcatatttgatggccctgacagagcatcacgaaaatcacccaactgaagtttcagagcatatctatggtgtttgtagagttgatgttgccacaagtagagtcatttttggacagtttaaggatgacttggagtgcagtgccttgtgctgtatcttatctgagatcaggcctgttgaaattgtgaaacctgcaaaactactcagtgctgaaacggagagagtactgctgaagcataccagaaaccctttattgaatgaattagttccaattgtggaattctgggatgctgacaaaactgtggataaattaaagagaatttatgggaaaactaatgatgttagtgttaatgataatgagttagattgcctgccggatgttttactggagctggtgaaaacaggtgacgacagtagaagtgcactttcagcactaggtggtgctctctattatctgagacaggcttttccagatgagagattgcttagatttgcacagtttaagttacttccttgttctggttttggtgatcttgcttcaaaaccctacttggttcttgacgcggctgccctggagaatcttgagatttttgagaatagcaggaatggagattcttcagggtatgtttgtcatatggttatctgcaccgtttcaattttagataagatgggtaatttatttgtatattttactgaaataatgatgcttcttgtagcacgctctatgcccaactaa

SEQ ID NO: 62063 - DNA, 417 bp, Glycine max
  Peptide Sequence Number=SeqID_178841
atgtgtaagaaagagcatgaatctttcaaagaatacgcccaaaggtggagggatctagcaactcaagtagcgcccctaatgatggagagggagatgataacaatgatagtagacacgttaccagtgttctactatgagaaaatggtgggttacatgccttcaagctttgcagatttagtgtttgctggtgaaaggatcgaagtgagtctgagaagaggaaaatttgattatcttgcttttatgaataggaagcctggggcaaatgaagagaataagaaggaggaaggaacctatgtcgtgactgccattcctacatggccaaatttcccaccagctcaacaatatcaatactcagccaatatcagcccttctcattacccaccaccctatcagccaagaacacctaatcatccatag

SEQ ID NO: 62064 - DNA, 861 bp, Glycine max
  Peptide Sequence Number=SeqID_178842
atggcagaggttgtcttgctagtcgatgatttgaaactactttctgcgattcctcgctgtagaatttgtcatgaagaagagtttgaaagcgtagaaaccttggaagcaccttgtgcttgttctggaaccgttaagtttgctcatagagattgcatacagagatggtgcaacgaaaaaggaaatacaacctgtgaaatatgtctccaggaggaagaagcgtcaaacgcaagaatagagattatggttgaaggagtggcaatggaaagcgattactccgaatgcagctctgccgctgacagaagcgggtcttgctgtcgatcacttgcaatagctcactataaggatgctgactatgatacatcaatgtctgaggaagatgacgaagatgagatacatcataatccgtctttatactttgcagttaaagagacatctaacggcactggcaatgttgcaattactgagatctctgaaagatttgcattgcgtgaagctcagaaatttcccttcctgaaggggcaagtgctgattacagtgcagtgttttgagtttttccatgcccaaattacctttatgtctcttaaaagagattttgatgccatacggtattatgtggttgcggttatcaattatcaactggatgccaagcgaaggcgaccaggggatgaaaattatgattcaagaactctctacttgcctcctgatttcttaaggagtttgtcatatgctcagaaacaatggtgggagttcaagtctaaacatatggacaaagttttgtttttcaagatgggtaaattttatgagctttttgagatggatgcacatgtaggtgagaaagagcttgacttgcagtatatgaag

SEQ ID NO: 62065 - DNA, 321 bp, Glycine max
  Peptide Sequence Number=SeqID_178843
atggagagaaaagagcgaaagataatggtgggtgtggatgagagcgaggagagcatgtttggacttttcttggtgtatcaccaaccttattgccgacacccccaacgttatactagtccttcaatgttgcatgcatggtattccagtcatgctatcttagctatggaacaacacggtaaggatttggctaattcagtaatggaaagagctgaagccatttgcaaggacttcaaaactaccgcaaatatgaaaatggagagagtagttgggtgcggagatgccaaggatgcgatatgcattcgatttacatttaaaagttga

SEQ ID NO: 62066 - DNA, 600 bp, Glycine max
  Peptide Sequence Number=SeqID_178844
atgggaaaccaaatagcaagagatgcaactgggaaaatcgtttactggaatggttcggttcaagaattcgacgagccactaacggtggcagagctcatgctggagcacccgcagcaagtagtgcttgatttccattccgctgtgaaggagaaaaggccaacgccactgccagcagacgaaaagctagagatgaagaaaacctatgtgatggttccggtgaagagagggaagcctgtgttgttgagcagcgaagatagtcgccgcattctcttcaccgttaactcctctctgcattccaatcatttcgtttcttcttcggggtttcttccttggcttgcacggttgttccacgctaagggagaggttgttgcagtgttgcagaggaaggaagaggtggagaaggagaacacggaagaaaggtatggtttttctgagtttttgccagaaatgttagaagggtcgatgccagagtatatgagtagacagttatcggggaaagggtggaagcctagcttggacactattaaggagaagaaagttaagacaaaactgtctccctggttattgttcctcagaggtttttctgctgcaaagatttaa

SEQ ID NO: 62067 - DNA, 393 bp, Glycine max
  Peptide Sequence Number=SeqID_178845
atgtccgattctctcaccgatcttgcgccaaatacaaattcgttacatcctaacccagggttccgacgagcatggtggacggtccgacgagtccaggcaatggtagccatgagagtggcgagcatagccctcgctctaacgtgcgcgagtaggacagaagtcttccctgtggcccttgatgcatgctttgagaatctcaagagattaaatgatgaactgtctgaaaaatatctctggttgcttattgccagatcaacctttcagacacatgtattgagatggatggattacattcagcacaagcaagaatttgtaggtttatttgagaaaatattgttgcagaagcctggatttgagcccccggtgagacatcattccattgttgccttttga

SEQ ID NO: 62068 - DNA, 816 bp, Glycine max
  Peptide Sequence Number=SeqID_178846
atgggtgatgaacctcgtgctggttctttctggacggaggaaattaatgaggcggttccgacccccatgagaaggaaaaggaaatacaggacaaagaaaaaggaatatcaaggatggggatcaacttcccttatttggtttctcgaatccatcggtagagatacgagcaccaagatagctcaaagtgaggttgcaaatattgtaatggagtatgttaagcagcacaacctctttcacaagacgaaaaagaagcgaattgagtgtgatgagaggcttcattcgctgtttgggaggaagaccattagccggttgaaaatcaatgacctgctagagtcacactttaaggagaactgtgaggagtcctctgatggcgttttctttgactcagaagatgatgagaatgccttgacagcttgtgaaaccccgagaacagcaccttccgagaggaagagccaaccaaagaaaccagtttttgaaaaaccaaggagctgttttgctgccattgttcctgccaacatcaagcttgtttatatgaagaggagtctagttatggaccttttaaaggaccctgaaacttttgagactaaagttgttggaagcttcataagaatcagatgtgaccctaatgattaccttcagaaaaactcacaccagcttttgcaagtcacaggtacgaagaagagttctgaagtaaatggggaaattcaccttcaagtttctggtttcattaaagatatcaggattcaaatgctttcagatgataatttctctgagctttatttagcaaaaattgtggactctgttaatgagggttaa

SEQ ID NO: 62069 - DNA, 1444 bp, Glycine max
  Peptide Sequence Number=SeqID_178847
atgtcttcaaccttctcacccctcctcaatctcattgcagtcttcctcctcctcttcttggtccggcacacgtgcgaggcacgtgacccgttcgcgtgcgacccgaaaaatggcgccacggagaacatgccgttttgcaaggcttcactggcgataccagagagggtgaaggatctggttggaaggttgacgctgcaagagaaggttaggcttctggtgaacaatgccgcggcggttccaaggcttgggatgaaagggtacgagtggtggtcggaggcactccacggagtttcaaatgtgggtcccggagttaagtttaatgcacagtttcccggtgctactagcttccctcaagtcatcaccaccgctgcttccttcaatgcttctctctgggaggccatcggacaggtagtgtcggatgaggcaagggccatgtacaacggtggaacagcagggctcacgtattggagcccaaacgtgaacattttcagggacccaaggtggggccgtggacaggaaactcccggtgaggacccagtgttagccggtacatatgctgctagttacgtcaggggactacagggaacggacggtaaccggttgaaggttgctgcttgttgcaaacacttcacggcttatgacctcgataattggaatggcatggatcgattccactttaatgcacaagacatagaggaaacattcgacgtgccattcaggatgtgtgtgagcgaagggaaagtagccagtgtcatgtgttcttacaatcaagtcaatggggtccctacctgtgccgaccccaacctcctcaagaaaacagttcgtggcctgtggcaacttgatgggtacatagtatcagactgtgattctgttggggtgttttatgataaccaacattacacaccaacgccagaagaagctgctgctgatgccattaaagcaggctacgaagctgatgtgaacggtgctttggtgaatacactgacggtccaaatgaggttaggcatgtttgatggagagccatcggcccatgcatatggcaaattgggcccaaaagatgtgtgcaaaccggcccatcaagaactcgcccttgaagctgccagacaaggaattgtgcttcttaagaacactggtcctgttttgccactctccccacagcgtcaccataccgtggctgtcattggacccaattctaaagccaccgttacaatgattggaaattatgctggtgttgcatgtggatacaccaatcccttacaagggataggaagatatgccaagactattcatcagttgggttgtgaaaatgtagcttgtaaaaatgacaagttgtttgggtctgctataaacgcggcccgtcaagcagatgcaacggttttggtgatgggcctggaccagtccattgaagctgaaacggtggacaggactggcttgcttttgcctg

SEQ ID NO: 62070 - DNA, 324 bp, Glycine max
  Peptide Sequence Number=SeqID_178848
atgcagaatggcggtaaagctaaaggcaataatcatcagcagagcagcggcggtggtggtcaatgccagtttcaaatcgggcgcaaaaccattagcagacgcaaacgtttaacaatatacttatcagtaagttgcgataagcccaggagtaccattttcatggcaaccattaaagatgtggcgaaacgcgccggggtctcaaccaccacggtttcgcatgtcatcaacaaaacgcgttttgtcgcggaagagacgcgtaacgccgtatgggaagcgattaaagcgctgcactattcaccgagcgcggtggcccgcagcctgaag

SEQ ID NO: 62071 - DNA, 198 bp, Glycine max
  Peptide Sequence Number=SeqID_178849
atgaacacaacaagggaaaggtttagcagtggggctgaacttagaactgtggtccaggcagaagtagctaatccaaaaagtcctcaaagggggacaacaaacaaaaccactcaattggataagtctgccaccactgatcatttgagcaaagacacaagcaacaataaaggtcatggcaatgccaatcatgccacataa

SEQ ID NO: 62072 - DNA, 198 bp, Glycine max
  Peptide Sequence Number=SeqID_178850
atgataagaattgttgcatataataaatgcaaactatcagtatcttgtgcacctaggttgcagtggtcgcatgatatacttgatgaacgaaatattattgaaaaatcaaacagctataaaaggaaattcttgatccaactggcatctatgctcttagctctcatcacattccttcctaaattcaactctatggaatga

SEQ ID NO: 62073 - DNA, 342 bp, Glycine max
  Peptide Sequence Number=SeqID_178851
atgaagctaaaggcagaaaacggaacagaaacgaaattgcaattagaagcagaaaatggaaaatgcattcacgtgaacagatccttctttgaaggtttatgcaagtttgctcattacagcaagtttgacgagtgtggcagattaagaaatagagatttggttagttctgccaatgtaatgtgtgttttaagttttgaccgtgatgaggatcacattgcagcaggaggagtttcaaagaaaatcaagattttcgacctcaatgctatttcaagcgattctgttgacatccagtacccagtagttgagatatcaaataaatcaaagcttagttgtgtcaaataa

SEQ ID NO: 62074 - DNA, 1323 bp, Glycine max
  Peptide Sequence Number=SeqID_178852
atgaagcttgcttctacatcattctcgcatttcttgttgtcggctcagcttcttcgattcatcgtggcgctgtgggagatgaggaagcccaaaagcccaccatctccttcaagcaactctaccacacccgccactgctgggagccatactcgattcgggttcagactcgcgatcggggtcgacggtgagattctcccaaagacattgcaaagaatgatcttaatctgcgaccacgtgttcattgacatccaggctctgatttgcaggttcgacaacatcaacggtcgcgtgagccacgtgtcgctgagaggcagcgagttcttccatctcttgccgcacgtcgtgtttctgaaggcttccacggatgaacccatttttattgatgtggaggaggtgaggaagtggtgttgcgtggtcgtcacacacaagaaggatggctgcgaggttgatcccactggtgttggggactgctttcttggcaggttttcggcggggattgtcaagggtttggccatgcccgatgctgctctgttggggaacttctttgggtccattgttgtggcgcaattgggaccaccgaagcttgacttcaacttgattcagaatgtgcatcatcatgttttcactggcagtaccaagagcccggagttctattgtggcgtggttttacattggaacaatttgttcatcagtgctttggaaacacacatgattttggaaaaggcaggaaaatgctttaaaccttatttggataaacttctcagcgatggtattgtagttaaaggtaaagcttatggcatttgtagtattagagtagatggaaatgatgctcttgttgtttatagtgcactacacactactagagaaatcgctataagagaaaaaaggccagttttaatgagagggaaaaagggagcaaaacagatttggagggaaaagaagagaagaggagatgctggtggcgaggcaagagacgtgcgatggaagagtgattgctcatgtagacatggattgcttctacgttcaagtggaatagagaaagcaaccaaatttaagaggcttgccctctgcagtcatacaatacaaatcctacaaatgttcgggctaaacacaaggaagtctgcctacacaaagatagttggtaggaacattttcaggcagaggcttgaggctggggatcgtgaagcggatattgagcaatgtcggggttgtaacaatcaagctattcatctggagtctagaactatattttctcctgggtttcacttgtccaaaaattttggtggagttgacaaaggaatagaatctattgtgtatagttaa

SEQ ID NO: 62075 - DNA, 297 bp, Glycine max
  Peptide Sequence Number=SeqID_178853
atggaaatttggaagctcaacgtccctaaaaaaaatcagcatttcctttggagggcacttagaggatgtgttccaaccagaaacaagcttatcatgaaagttgcaacttgcccgtctaatgatcctttacatgggattggaggtcccatggcaaggtcaaagactaagaggatgaagcaagcattgcaaggcctaattctaaagatcaaagagaaagaagaccaatgtgaactaagggttgcacccaattgggtcactttcctacaaattgatgaagatgctttgaggccaacttga

SEQ ID NO: 62076 - DNA, 156 bp, Glycine max
  Peptide Sequence Number=SeqID_178854
atgaaaggtgatggagaaaaagcttgtaatgctggaaatggctttggaagaaggaaaggagaagaaatggcatttttcctaagctacctggactacaaggctcaaaacgcacaagtgagcaatactctcggaacggaaacgtcgcgcacattctag

SEQ ID NO: 62077 - DNA, 106 bp, Glycine max
  Peptide Sequence Number=SeqID_178855
atgccaacgtcatcacgtcggctcggcgactcctcaccggaatcttactccctgcaccctgctgctgtcattctactcccacgaacaatgttcgcaatcatcacag

SEQ ID NO: 62078 - DNA, 405 bp, Glycine max
  Peptide Sequence Number=SeqID_178856
atgggagggcaaggcgaaaaagcaaaggtgcgacttccaaaaaggagaacacgtgggagtcaccaccaacgtttattcgaggaaaacgttagaaaaaaaaccaaaaaaagaaaaaatggcacttgggacaatggcagcttgctcaggcgagttggagctcgcccaggcaagctaaggcttactcctgaagtaactggctcacctaggcgacctggttccttcaccctgaagtcatttgggggcccaggcgagccaaaggctagcctggacgagctaaggtccaagaaactcaatgaaaagacccttttgcccctcatttttggtatctttcgcattcttgatcaaaacattgaacgatctttcatcttgtacggtaactggtgtcaaacaatgcaattcgggtag

SEQ ID NO: 62079 - DNA, 123 bp, Glycine max
  Peptide Sequence Number=SeqID_178857
atggaactaatgattgtagctagaaaaatagttccaaaattacaactggaacatggattgtctgttgatagagtttatacagggtcatttatgacttctcttgatatggcaggttctgattag

SEQ ID NO: 62080 - DNA, 312 bp, Glycine max
  Peptide Sequence Number=SeqID_178858
atggcacacacacaaccaggacctattgatggcttgttgttacacttacaacacaatcatatttccaataaagtgtgggaaggcgaagaagtaatgctaggcctcaagattgacggagtagctggtgccaatactagtgatgtatgtgttgcttgtcaagtcttattaggggacattccacctactaagtatatcacgggaaaaatttatttaacctggttgcaacaaaattttcaagaactttctcttaatgctgatgatgttgtgattgcacaacatgctatagctcatatcatgatgctcataggctaa

SEQ ID NO: 62081 - DNA, 549 bp, Glycine max
  Peptide Sequence Number=SeqID_178859
atgacaaaactcaaagaagagcctcttgggacctgttgtgctccttatcttttgacacttctttcccttggttcaccttcagagattttaatgatcttcttttcaactgatgagaggattggtacaaatggccatctaaattggcctttgcaaggttttcatgaggctatcatagatttcaatctccatgaccttccaatggagggttaccagtttacttgggctaaacaacatggagaattcaatgccattgaagaatggttggataaaggactagcaactcttgaatggtttgatttattctccaactccaagcttattaatggcttggcagcaaagtctgatcattcacccataaccatccacctccatgggactaatcgtagaagcttcaaaagacaatttagatttgagaattcttggcttcttgagctagacatggtcaatattgttgatcttgcatggcaaccacaacaaacgagtgactttattcaaataagatttcaataccaggaccaaattgatatatgtaagcatgaattggagtag

SEQ ID NO: 62082 - DNA, 357 bp, Glycine max
  Peptide Sequence Number=SeqID_178860
atggaaaactgtgtcttccaccaccaccttaggagcatgatcactcttccacaaccaccatcaacaccattgttccccaaagttatgagggtgagagcgagcgcgggaaggaggcactgcgagttcagcagccagaacgcgccccttgagccacggtcccttgtggggaagtttctgagcggcgtgttgcagaaccgccgccagctgttccacgtggttgccaaagaagagttgaagatgctgagtgatgacagagactctgctcttgctcgcatgcatctcagtcagcactctgatgaagccttgcttcacagatgttcgtttgttagtttttgtcagcggaagagattcaaatga

SEQ ID NO: 62083 - DNA, 309 bp, Glycine max
  Peptide Sequence Number=SeqID_178861
atgcaacgcaaatttgacatccctgaatgtgaggttgccaaaaagaaggtgatgtcaatagtcgcaatgaagtatggtcttgatccagctacatgggcgaaatttgcaaaaagccgccaaacccctaattggcaggtgtcgcaacctacccttttgtgggcgagcgaggcgaggctcacaggtgcgtcttccataggaggaaaatgcgtggagtcgccaccaacgtttattgaaaggaaaatgttagaaaaaccaaaggaaaccggtcatgaagaatattccagattcgggagttatctttacgtttga

SEQ ID NO: 62084 - DNA, 948 bp, Glycine max
  Peptide Sequence Number=SeqID_178862
atgtctactttagtccttggaagcttgacactgggagatggtaaaatcattgtgggttggaccttgtttgctactaactcaatagtggagaattttccacttatttacaacaagattgtatcagcatgcaactcggtaaaattattaaccggagtagccacaagagggatcattatatgtgatgccttatactcagtttctgtcttaacccaaatagcttgtgttattgcggccagtgtgtatggggctgtgtttatctctgaggatctagaactaattgaaacaggacatttgttcactccaagcattgtgatcagcccaaatgatgcaaaatcggtgattaagtacgcaaaaagtgctcaaataccatttgccaacatcaactttcaacaaacatttgttggaataaagccatcaccagcggctgcatattacacttcaagaggtccttcagcaagctacttggggatcttgaagcctaatgtaatggcacctggctccaatgttttggctgcttttgttccaaataaacattcagccaaaattggcacaaatgtgtttttgtcaagtgactacaatttgttgtctggaacatccatggcatgtcctcatgcatctggtgttgttgctcttttgaaagcagcacaccctgattggagtgtagctgctataagatctgcattggttacaactgcaaatccccttgataatactccaaatccagtaagggataatggaaacccatttcaatatgcttctcctcttgctatgggagctggtgagattgaacctaatagaacacttgatcctagtctcatatatgatgccacctctcagaactatgttaacctcctttgtgctttgggatacacaaacaacaaaatgttaaccctcatatatgatgccattgtatctaaatcatcaccacttgatccaactgccatatga

SEQ ID NO: 62085 - DNA, 3516 bp, Glycine max
  Peptide Sequence Number=SeqID_178863
atggctcttgaagctccaagggagcctcggcgacccaaaactcattgggaccatgtcttagaagagatggtctggttatcaaaggattttgagtcagagaggaaatggaaattagctcaggcaaaaaaagtagctttaagagccagcaaaggcatgttagatcaggctacaagaggtgaaaagaagatgaagctgtatcttgtacaggaagaggagcagcggttaagaaaggttgcacttaatatttctaaggatgttaagaaattctggacaaaaatagaaaaactggttctttacaaacatcaaatggaactcgatgagaagaagaaaaaggcacttgacaaacagcttgagtttctattagggcaaaccgagaggtactcaacaatgttggctgaaaatcttgtagatccttataaatcagcagagaataattctgcagagcaccacatgagtattcaatgcaaagatgtacatgatgttattaatgaacctaaggaagctgatgttgtagagtatcaatcagatgcagctgacaatgatgaagaatatgatgtacaatatgatgatgaatcggaggatgatgagcgaacaattgagcaagatgaggctcttataactaaagaagaaaggcaagaggaattggccgctttgcgtgatgaaatggatcttccaattgaggagttacttaaacgttatgctggggataaaggagaatctgtaatgaaagaaagtagtccagagcatagtgaagatggtgggaaaatagttagagctggtgatggtaagaaaggactagcatcagaaaacggagatgatcttttatctgtaagcaaaattggcacaagcaactccagcatagtctctggtcgacgttgtgatgaaagtaatggtgatgttgctacaccaacaaacaatttatctcaatgtgagaatggtcaatctgaaaatctaaaagaggttcccagtagttttggtggacaatgcgacatccatgagggagagaggggtgataagcaagtggtgttagaagtaggtctcttatctgaagatggtgactttttgcttggcatagaagataaggatgatgaaacaaccttatctgaggaggaacaactggaaagagttgatgcaattgatcccaaggacgagattgcattgttacaaaaggagagtgtcatgcctgttgaggaattgcttgcaagatataaaagggacccaagtgacgatgaagatggggaatatgaatctgattatgcttctgctttatcagagaacaattcggattctccagtccatgaggatgctgggcagaaggatcctgccattcctatggatgaagatatcaagtctggtgagcacctggctgccatacagtcccaggaagaacagtgggaatcacctcatgaaaatttagaaaaaagagaaagtgaggatataattgctgatgcagcagctgctgcaagatcagcacaacccactggaaacaccttctccacaactagtgtgcgtacaaagttcccttttcttctcaagtactctcttcgtgagtatcaacatattggattggattggcttgtcacgatgtatgaaaaaagactgaatggaattttggcagatgaaatggggcttggaaaaacaattatgactatttctttgcttgcacatcttgcttgtgataaagggatttggggcccacatttaattgttgtaccaactagtgtaatgcttaactgggagactgaatttctgaaatggtgtcctgcctttaaaattttgacttattttggaagtgcaaaggagcgaaaacttaaaaggcaaggatggttaaaacctaactcctttcatgtatgcataacaacttatagattagttattcaggactccaaagttttcaagcgcaaaaagtggaaatacttgatcttagatgaagctcatctcattaaaaactggaagtcacaaaggtggcagacactcttgaatttcaattcaaaacgacggattctcttgactggtacgccactacagaatgatctcatggaactgtggtctctcatgcatttcttaatgccccatgttttccagtcgcatcaagagtttaaggattggtttagtaatcctatatcagggatggtagagggtgaagaaaaagttaataaggaggttgttgatcgccttcataatgtacttcgtccattcttacttcgtcgacttaagcgagatgtggagaagcaacttccaatgaagcatgaacatgtcatatattgtagactatcaaagaggcagcggaatctgtatgaagatttcattgctagttcagagacccaagccacacttgcaagtgccaatttttttgggatgattagtattatcatgcaacttcgtaaggtttgcaatcatcctgatctatttgagggtcgtcctattgtcagttcttttgatatgcgtggtattgatattcagttaagttcttctgtttgctccatgcttttgcctagtcccttttcaacggtggacctaagaggtttgggtcttttattcactcatcttgactatagcatggctgcttgggaaagtgatgaagtacaaactattgagacccctgtgactttaatcatggaacgtactgatatggccgaactagaagtaattaggccacataaatgtcaaaaaaagttgcaaggaacaaacatttttgaagagatccaatgggcgatctgggaagagaggctaaaacagacgaaggaacatgcagcagctattgcatggtggaactccttgagatgtaaaaaaagacccatctactcgacaactctaagggatcttgttgccttaagacatcctgtaaatgatattcatcaggtgaaagcaaaccctgtttcatacttgtactcatcaaagctagctgacattgttctctccccggttgaacgatttcagaagatgactgatgtggttgaaagcttcatgtttgcaattccagctgcacgggcaccctctcctgtatgttggtgcagtacaagtgagactagtgtgtttctgcacccatcttacaagcagaaatgctctgaagttctgttaccgctgctgtcaccaatcaggcctgcaattgtccgccggcaagtgtatttccctgacaggcgtcttatacaatttgactgtgggaaactgcaagaactagcaattttgttgaggagattaaaatcagaaggtcaccgagctttgatattcacccagatgacaaagatgcttgacatattagaggcattcattaatttgtatgggtatacatacatgcgcttagatggatcaacccaaccggaggagagacagaccttaatgcagcgctttaacaccaaccccaaatattttcttttcatcttgtcaactcgtagtgggggtgttggtatcaatttagttggagctgacacagttattttttatgatagtgactggaatcctgctatggatcaacaggcacaagatcggtgccacagaattggtcagacacgcgaa

SEQ ID NO: 62086 - DNA, 208 bp, Glycine max
  Peptide Sequence Number=SeqID_178864
atgaaacggaggggaatgagttttatagggaagagggacgtgcctgggggcccaccactagtggacgcgcctaacaggctaccactactggtaacgtctggtaggccaccactagtggtcacgcctagcaggccaccacttccacccctgtcccatcgtcctgtcaagtcatgtcacgtgtcgcgttctggtggaatgcgcccctcag

SEQ ID NO: 62087 - DNA, 609 bp, Glycine max
  Peptide Sequence Number=SeqID_178865
atgcacgctccagttctagttctcaaggactctttgaaacgagagtctggatctaaggtccgctatgctattattcaggcggcaaaggctgttgctgatgtagtccgaacaacattgggacctaggtccatgctaaaaatgcttcttgatgctcaaggaggaattgtggttaccaatgatgggaatgctatcttacgtgaattagaccttgctcatcctgctgcaaagtctatgattgagttaagtcgcacccaagatgaagaagtcggagatggaacgacatctgtcatcattcttgctggtgagatgcttcatgtcgccgatgcattcattgacaaaattcaccctacagttatttgccgagcatataacaaagctttggaggatgctattgctgtccttgacaaaattgcaatgcctattgatgctcaggatcgaggtataatgctggggctagtaaaaagctgcataggtaccaaattcacaggtcaatttggggatttaattgctgtgagtatccctctttctcttctgctaggtttcctaattgatattattctgttcttttatataattgttgagctgtttgttctggcatatggagcttga

SEQ ID NO: 62088 - DNA, 243 bp, Glycine max
  Peptide Sequence Number=SeqID_178866
atggtggataggttggctgtggagctggaaatactatctttcctgtcatatcatcaaatccaaatgcttttgtttatacgtgtgattgctcaccacgagctattgagttggttaagagggtggaatggagagggattgagtgaaaggcaaagttgttcaattatccattccgttccattgcttaatcccaattttcttctcccaaattggggaacacttgatggaacaaattttggatcataa

SEQ ID NO: 62089 - DNA, 894 bp, Glycine max
  Peptide Sequence Number=SeqID_178867
atgcctactgtttggttgtcattggaagttctgaaaacttctacagccgagttagcaggtgttatccctgtggtcaagacatctattagtggtattcgtgttattggtcatctttgtgctggaaacaagaatgggcttctcttgccccataccaccacagaccaaggacttcagtttgaaaataattgtgaagttggagtcttctctaaactcaccaatgcttactgtttggttgcgattggaggttctgaaagcttctacagtgtatttgaagctgagttagcagatgttatccctgtggtcaagacatccattggtggtactcgtatcattggtcgtctttgtgctggaaacaagaatgggcttctcttgccccataccaccacagaccaagagcttcaacaattgagaaacagtctacctgatcaagttgttgttcagcgaatagatgaaagattatctgctctgggaaattgtatcgcatgtaatgaccatgtggccctcacacacactgatcttgacagggagactgaagagatgattgcagatgttcttggagtagaagttttcaggcagaccattgctggtaatattcttgttggtagttactgtgccttctccaacagaggtggcttggttcaccctcatacttccatagaagacttggatgaactttctacacttcttcaggttcctttggtggctgggaccgtgaaccggggtagtgaagtaatagcggctggaatgacagttaatgattggaccgcattttgtggttccgacaccaccgcaacggagctatctgtgattgagagtgttttcaagctgagagaagcacagcctagtgcaattgtggatgagatgaggaaatccctcattgatacctatgtctga

SEQ ID NO: 62090 - DNA, 471 bp, Glycine max
  Peptide Sequence Number=SeqID_178868
atgttacagatcctgttctgttcctatctttttgggaagattgtcaccctcacgcacctcgcttaccgtatctttactactacacgccaccactttcctccatcaaaccctctgcaccagatcatcattccttcttcccaactccctcccgacaaccctctggccaccgttcactgccgctgcagacgatttacggcggcaacgtttctgattttttttttccggtctcaagcgccgccaacccaacaaccccaaatcatagattcaacaaaaactgaaaaatgtccagagattaccaaacccaaatttcatcagggttttgaaatcgcgcaaaatgaagttggtgccgcagtggccgacggagatggcgacagtgagaggaagagtcgccgcaaagaggaggaagtgaagtcaatggtaaaggaaagaacgagagaaacgatagggtggagaagaggtcggggtgggtga

SEQ ID NO: 62091 - DNA, 2250 bp, Glycine max
  Peptide Sequence Number=SeqID_178869
atggatgctctgtgtttacacagtagcatttgtgggatagctccgtctccgtccattctcattactgcaactgcacgcgccaatgattacgcgtcacactctcgggtgaaagcggtggggagctcctccttgttttccatattctcttttagataccctttgaagtccttttggccacgaccaacggggaatgccaccggctacaacgacgccgttttggcagagaatgcaacggccgagacagaacaaccagaaggcgaaggagagggacaaaatgggaactgggtttttaagatttttcatataaggtctgtttggagaggggaacagaggagcgatgataacgatgaagaggaagctgtaaccaatggtcaaacggatgaagaggaagaagagtgtgatgattgtagggttgattatgatgatgacgaagaagaagaagaaaatgaagaggtttcgttcgatagagactcgttttcaagaatgcttcggaggccagggaaactcttcaaacactatggtctgcgttttgtaacttcatccatagagaaaaaggaattagctatggcagctgaaaaaaatcagatatctcaaaaagaagaaactaatgagaaggatgtggatgaaacaaaagaggaaaagaataatggtggatacatgataagtgcatctgctgtatacgagattgctgcttctgctgcctcttatcttcatgctcagacaaggagcatactttcattaacatcttctgatgctgcggaaggtgaaggctcaattgaagcaatcaatgaaagctttaacggcgataagattagaaacacggaggaggcaaatttgaaggcaactacggattcggtaacagcagttgttgctgcaaatgagcaagtaaagcaggcttttgcagatgatttgaactcaacaagctcttcaccttgtgaatggttcgtatgtgatgatgaccagacctctacaagatattttgtgatccagggctccgagtcgtttgcatcctggcaagcaaatctactatttgagccagttcaatttgaggggttagacgtccatgtacatagaggtatatacgaggctgcaaaagggacatatcaacagatgttgccagaaattcgtgctcacctaaaatctcatggttcacgtgcaactttccgtttcactggtcattcccttggggggagcttggcattacttgtaaatcttatgctaccgataaggaaggaagcgctattctcctctctgcttcctgtcataacctttggggcaccatccatcatgtgtggaggtgacactctacttgacatgcttggattgccacggagccatgttcaggcaatcacattgcacagagatatagtaccacgagcattttcttgccagtaccctaaccatcttgtagaactactaaaggctgttaatggtaacttccgcaatcatccttgccttaataaccagaagctattatatgcaccgatgggagaactgctgatcctccagccagatgagaatttttcaccaagtcatcatctcctgccctcaggcagtggactatatattttgagtggttctttatcagaatctagtgacacattaaaacaaatttacaaagctcaaatggttttcttgaacacaccacacccacttgagatattaagtgatcgatctgcctatggatttggaggaaccattcagagagatcatgacatgaattcctacttaaaatgtgtgagaaccgtgattcgccaagaacttaaccagattcgcaaggcaaggagagagcaaaggcaaaagtctcgcaaaacgcagcctacaacgcaagttcgcaaccctaacgcgaagctcctcgtcgctcccaaggcctccgccgtctccgtcgcgccagagtccagacatagcgtcgtgaacattttcctcacaaagcgtagaagtatggagggtcaccagtttttcaggatgtccattgaacagaatcataatcagaagcacttatatctcccattggcatcacagctctacagctctattggttcaatgttctatctcagtaaaatcgaacacaaattgcccctgcctccttctcgttttgttcttcctattcgagaagctatacacatggagcttgagaaacttttcttagataaggttatagcaaacttgggcctctgcatttctgtctatgatatcagatccattgatggtgggtttatcttccctggtgatggggctccaacctatacg

SEQ ID NO: 62092 - DNA, 291 bp, Glycine max
  Peptide Sequence Number=SeqID_178870
atggcttttattggagaagcggtggtgagaggttacgttagggtttggaactttcgagaaacagttttagttgaaagggtatattgggaagaggataaaaatatagtgggggcacggaaacgtgtgctatggcgaggaatgtgcaatgttctgatctttgaaaagtggctttgtgctcggaatctggaactaaaaccaacgaatgactttgtccattttggtggtgttaccatgcgtgatgattcgttttacatccgatatgacgttatttccggtgaccaccagatttga

SEQ ID NO: 62093 - DNA, 792 bp, Glycine max
  Peptide Sequence Number=SeqID_178871
atggaaacccaacctgaatgcgctgtcatcaacattccaaacataataaaaacagaacaagaagcaaaaccccttcaacaacatgcgtccgagtccccaaagaacaagagcggtggtggcatgcgctttcttagggttgcactcttcaagatgcgagggcgttccgcaaaaccaaccatggcgcttcaggtaaataataataatgacgatattgatgacgggtccaagagcacatgggggaggtttgtgggttccatgaggccattgcaccttcaaagcacccaatctccacgctcatcacctgatttgccatcttctgaatataaaaaggattgtggcggttatgtttctgattttgtggcggatgagcaggagccttattcgccttccccacctattagctgttacgcttcagccgttgggttgagcgagcttgttcaaaatgatgaggaaaatgagtataagcaggaggtgattgtggaggactcccacgttgatggagatggagattggatgattgatgccaaggctgaggatttcattgctcagttctaccaagaaatgaagttgcaacgtttagattccgtggatcgccgttacgtcgagagaagccaaagtgtttctacgaggaaaacatgctccccatctaagtcaccaagaacgacctcacatcccttgtgggcgactttcctagtttgcgccggcgccgccaacatggggagtgttccatttgcagcgcaacaaagacaacgtttagcgtgggatcaccgcgttttggaatgcaaattctga

SEQ ID NO: 62094 - DNA, 501 bp, Glycine max
  Peptide Sequence Number=SeqID_178872
atgtctgatgagacctggccaccgaaactatttggtttcccactaacagagcaggaggacagaaaattcagatgccactactgcaaacgagtattcgggaactcgcaggccttaggaggccatcaaaatgcccacaagaaagagcgtcagagggcgaggcgtttccaaatccacactcatagacgcgccattgcagcagcagcatcgatatcttcacatgcaataataacatcagtaccctccatttacttacgaggacaccctcctactcctacttctcttctacccatcttcgatcctcatcgtcaacccaataacactaagcacttcccatcacgccctactttcattccttcttcttccaactaccaccttactaattacactcaatgctttccttttcggctttatgcctcacccactcatgtactgcaatcctctactcctaaggtccctcatttttctgctgagggggaagttgatgtccatctcaaattataa

SEQ ID NO: 62095 - DNA, 1050 bp, Glycine max
  Peptide Sequence Number=SeqID_178873
atggtaagggctccttgttgtgagaaagtgggattgaagaagggaaggtggacagaggaggaagatgatattttgaccaagtacattcaggccaatggagaaggattgttgagatgtgggaagagttgcaggctaaggtggattaactatctgagagccgatctcaaaagagggaacatttcttttgaggaggaaagtatcattctgaagttgcatgcttcgtttggcaacaggtggtcgttgatagcaagtcacttgcccggaagaacagacaacgagataaaaaactactggaactctcacttgagcagaaaaatttacacatttcatgggacaacttcgacttctaaagacatcatcattaccctacctcctaggcgcaaacgtggtaggtccagccgctgggccatgaagaagaacaaacaacaacaaattcacactactcacaataacgaagtagcagttcctctccctccaaccccgccactaattgagaccgagaaatatttgtccaccaatataatgttaatggaggaacaatttgatgggtcgtcgactgctagtacaataacccatcaacatgaaaataacattaatactactcaagaagaagaagaagaacaaaacgtaggtgttgaagaaggtgagaaagaagaaataataaatgaagacatatggggaccgtgtgatgaggaagttattaacgggggagaggtagtgttgaattttgatgatatcatggacaattgttactttcaggaagcaagtggggtttggaccatttctgatcatgaacaaagggagagcaatgataatattaatgtggcggggaatgaaaaaggtgttgacgacacgtgtaccaacatagtgatgtctagtggggatgatgatcagttgcattcttcctctttcatggcttcgggcttggatcaaaacctcctcacttggctgtgggaagatgaagactgggagacggatcttcagagccttggagagattcatagtgacaaattaaaagctatggttgattggtttctctcttcaagttaa

SEQ ID NO: 62096 - DNA, 474 bp, Glycine max
  Peptide Sequence Number=SeqID_178874
atggctagttcattgcctttgctgtcttccttgttcattttcttccttgcatctactgtttttgctatcaataatatcactcatgccacttcagttgaaaaagacttagttccatgcacaatgtgcgctgagtgtgagaacccatgccaacccctgctgccacctcctcctccacctctaccgtcaccgcctccaccgccaccatcggtcattaatattgaatgccctccaccaccaaagacaccatgtccagataattgtgaagaagtgccacaaggacaaggaccagtgccccggccaccgtacccaccggtattgtactttccaccgggaactccgtatccaaactatgtgccatataatatgaacactagcggtggaatgatgaggccttactcgatctatttcacaaagtccttctccttgattatttatgtggcatgtctttgccttacttattacttgttcatttag

SEQ ID NO: 62097 - DNA, 3276 bp, Glycine max
  Peptide Sequence Number=SeqID_178875
atggatcacaagtcttggctttgggggaaaaaagccacactgaagacaaatttagtcactgacaaaacaaatctcacttcaaaagaaaatggagaggtacaggctcctctaactgataaagaaaaattggagaaagacttaaaaagattaaatgataagcttgcttttacactttctgaatgtaattctaaagatgagcagatcaagaaacaaacgaaaattgtacaagaagcagtggcagattcctttgaaggatgggagaaagcagaagctgaaatattgtctatgaagcaacatattgatgaatcaatacaacagcagttagtttataaagaaagagtggcccaattggatggtgctctcaaagaatgtatgcaacagttacgttttgtaagagaagaacaagagcaaaggattcatgatgctgtcatgaaggcttctaaagaatttgaagaagcacgcatagttttggaggagcagctatcagagaccagtaaagggcttgctaaatctggggttgaaagttctcgtcttaataaatctattattgctaaagaaaatttgattgaagatctgaaaagacaattggctcatgcagaggctgatcataatgcattgatgattagattagagtccattgagaaagataatgcatccttgaagtatgaagctcaagtgcttgaaaaggaacttgcaattagaaatgaggaaagagaatttaatcgtcgagcagctgatgcttctcataagcagcacttacagagtgtaaaaaaaattgccaacttagaatcagaatgtcaaagactgcgtattctggttcgaaaacggttaccaagtcaagcttccctggcaaaaatgaaaaatgaagttgaaatgttggaacatgattcacttgaaatgagaaggaaaaacttgaactcaaccagtgtagtggttgaatcttcactagacagttctcctgagactaccattagaagaatcactgctttgactgatcaactatgtactgtggaagaagaaaacaagactttgaaagaatcgctaaataggaaaacaaatgaagtccaattctcaagagtaatgcttgctcgcacagcttctaaactgatgcgacttgagtcggagattgaatctagaggtcatgtgaacatggagctgcctaaaagtaatcctgcattgcaagatatatctttgtcatcaatgtctgacattggcagtgatgacaaggttagctgtgccgactcctgggcttctgcattgatttcagaattggagcactttagaagtgtaaaacagaaggaatcaatgtcatgcaaaagtgttggaccttcagatataagcctaatggatgacttccttgaaatggaaaaattagcagtggtctctgttgaaaaagcccccaaaatttcttgtgcttctttagaagaaaataatgaaatagatggcctgccagaggctagaccgaatgggattagctctgaagtgataagtaaggagatcattcctgtctctgatcatttgtcagagttctctacatcaaatcaggaatcatgttccattgacatattaaatggtgatattcctggttggcttttggatgtagtaaaagcgatattggaacaaaactgtgtcactcataagaactttgatgacatatgtgaggatattagattggctttgagctatctaaataatgcagatcaatgccggtttgattcaagcaaaggtcatccatttgatggatctaagcctctccattttagtcagctcacttcatggaaacctttgaataattctgtggtagatccatgtggtgaagtaaatgatgctgagattttatcaataaagggaactaaacagaaatctcaaagagatctgagccagtcaattggtaagataattgagcttattgaagggattagcatgcctgctgaggattatgataattcagattccttgtacaaaagagatggaaatatccgtgcacataagaatcaaggaattcctacagactacatggtccgtgttttccagtggaaaacgtctgaactcagtaatgtcttgcagcaatttctccatgtgtgttatgatttactcaatgacaaggctgatcatgaaaaatttgccacagaactaacgacatctttgaattggattatgaatcactgcttttcacttcaggatgtttctagtatgagggatgccattaaaaaacaatttgatttggatgagacactaagtgaaaatgaagctgaaacagggatgtttgcagacgcagataagttgcatcttcccatagaacagttatcatgtttgcctgtgctaactaattcagattgtcatgatgttccaactaaagatatgcaatatgttgataaggaagaaattaaaaatattgaagatgaagtaatcagttctgaatctgagaaagaagggaggctccaatcagctataaatcaacttcaggaatcagagaaaactattggcagcttgagattggaattgcaaaccttgaaagaattgaatcgaatgcttgaggagcaagtacaaaatcatgcattcataaatgcagatcttgacactcagctaacagaaactgaattaaaagaagctaatcacaaggttttggcattagaagtggaagtggagaacaaaaatcaatattgtgaagaattagagaccagatgcattgaacttcagctccagcttgaaagattggcacactcatatcatcaaatttatcttcacagcatgacaaagaagtggtcagacaatgatgcttatcagaaagatgagccactgcaaactgactgggagataactgctgcatcagaaaagttggcagagtgtcaagaaaccatccttaaccttgggaagcagttgaaggcattagctgcaccaaaggatgcgtccctttttgacaatgccattgctgctcaacgtcatacagttacagacacaaatactgtccccctaaaagacatgaaagtgaaaaatcgatcttctctatttgatcagatgttggctgatgatgatactaaagctaaggttagcaaagcaagtgaaagaggctccagtcccaccagcattccaggtttcaaacagccactggaaaagattttacttttgaatgaacttaaaggccaggatgacagtgccagtgttgattctatggccattgtaccagccaagaaatccggtggtcgaaatttttggagaaggctatttgggagaaagaaatccaagaagaaaacacagttttcattgaacacgtga

SEQ ID NO: 62098 - DNA, 1041 bp, Glycine max
  Peptide Sequence Number=SeqID_178876
atgaaggtcggcggcgtggtgttatacggcggagttccacgtggcagcgtcgtgcctctgcttctcagccgccgcagagtttctcttcgcgcctcttcttcttcttactcctccatttctgaccacgtttctttcgtgaaggatgtagctgcgactcagcctcctcagcatctttcacaactcctcagcattttgaaaaccagaggtgaatctattatctctccgggtgccaggcaaggattaattcctcttgctataccactgtcgaaaagtagctctggtaatgtaactgcactgctgcggtggccgacggctccacctgagatggaaatgccagtggtggaagtcagaaactatggagtatggcttttagctaagagtgtagaccaatttatacaccgaatgttagttgaggaagatgcaaagaatggtcaagagagaaatgaagaagtattttatgcttcaggtgatgctggggagaaactttacagaaagggtgattttgcagagtctggaatctctaacctagatgtctatcttttgaaaaaggttggtctatttccagatatcatagagcgcaaagtggcacggcattttgaggaaggagatcttgtttcggcattagtaactggggaattttataccaagaaggagcattttccaggatttgctcgaccttttgtgttcaattctgaggttttgttgagagttggacgtaaagtagaagctaaagatgctgccagaggagctttgaaatcaccatggtggacccttggctgcaagtatcaggacgtggctaatatagcacaatgggaagatgagcaaattgagtacattaaagagaaagtgactgaagagggaaggcaagaagatcttaaaaaggggaaggcccctgcacaggttgtactagatgaagctgctttcttgttggatttggcttctatagagggagaatgggatgagtatttggagcggattgccaaatgttacgaggaagcaggacttcaagatgtcgctaaattcatactttatagagattaa

SEQ ID NO: 62099 - DNA, 1629 bp, Glycine max
  Peptide Sequence Number=SeqID_178877
atgcagtcaaataaagtggaggattcaagtcccgctggtaaagatgtgttactggttattgattctttgaagaaacaagttgctgcagaacgggttgtttctgtaaagaaaagaatagaggaaaacagacagaagctggttggtgtcactaaccatgtctgcacaatgtcaatggagagaaggaacttcagcattactgatacgaatagaagtctggacctacttacaaagaggcaaaaagatgcaattgatatgcacaacggtgttcatgcgagtaatggtgatgtggagagcaatggctatcatgacgatagccatggttccacagcagttcttctagggtctaatgttgctgtaaagaatgctgttcgtcctatcaagttacctgaagtaaaaaaattgcctccttacactacatggatttttttggacagaaatcaaagaatgaccgaggatcagtcagttgtaggccggagacgaatttattatgatcagaatggtggagaagcacttatttgcagtgacagtgaagaggaaactatggacgatgaagaggagaaaagacaatttatagaatcagaagattatatacttcgcatgactgtcaaagagtttggtttaactgacattgttctggagtcgttggctcagtgtttttctagaaacactagtgaaattaaggcaaagtatgaaactctcagtattcaagacaatgctggtggctgttccaaggctggggattctgaagagaattctcaaagtggcaattcttttctggaaaaggatcttgaagcagctcttgactcttttgacaacctcttttgtcgacgatgccttgtttttgattgtagattacatggatgttcacaagatcttgtcttccctgctgagaagcaacctacatggaaccctcctgatactgaaaatgcatcctgtgggccaaattgtttccgatcggtacttaagtcggaaagatttgccaaaacatcctctgcccaggctgatgaacagaagtcctctggtggtgctttatctaggaaaaaatcttctgctaagaggcggataaaatgtagccaaagtgaaagtgcttcatctaatgcaaaaaacatatcagagagtagtgactcagagaatggtcctggacaagatgctgtctcagcctcacactcagcacctcctaaaactaaacctgtggggaaaggtggaattggtaaaaggaacagtaagcgagtggcagaacgagtcctagtatgcatgcagaagcggcagaagaaaacaatggtttctgattctgattccattagtgaagctcttgaccgttcatcgaatgatatggtcactgacccacatgccatgagcagtgaagacaacacgaggaaagaagagtttgtagatgacaatgtttgtaaaccagaaatcactgataataaatcttggaaagctcttgaaaagggacttttagagaaaggaatggagatttttggtagaaacagttgcttaatagctagaaatctcttaaatggcctaaagacgtgttgggatgttttccaatacataaattgtgaagatggaaagatgtctggtcctcctggggatgttgcaaattccctcatggacggctattccaag

SEQ ID NO: 62100 - DNA, 876 bp, Glycine max
  Peptide Sequence Number=SeqID_178878
atggcgacgagaaatcgaactctagagttcagaaaacacagagacgccgtgaaaagcgtgcgcgctcctctctcctcctcagcatctagtcctgtcatcgaaatggttacaacttcgcttcttccttctaatcgatcctcctatgctcctctaagcacccaggaacatgctccatccacttctagggatgcgtttactgtggggttgccgccatcttgggtggatgattctgaagaaatagctacaaatatacaacgtgctagggttagaatttctgagttaaccaaagctcatgcgaaggctttgatgccttcctttggggatggcaaagaggatcagcgtcatattgagactctcacccaggaaattacttctctcctcagaaagtctgaagtgaggctcaaaagactttctgccgctgctggatcttctgaggattctaatgttagaaaaaatgttcagcgttcccatgctacagatcttcagaacctgtcaatggatctccggcgaaaacagtcagcatatttgaaacatttgcagcagcaacaagagggttatgatggggttgacttggagatgaactttaatgggagcaaatttgtatcccataatgatgaattcagtgatgtggttgtcaaatcagtccatgaacttgctcaaatcatgaaggatctctctgtccttgtgatagaccagggaacaattgtggatagaattgactacaacattcagagtgtttctacatccgttgaagagggtcttaagcagttgcaaaaggtttggggatttgtttttgaagtgccatgggctaaaatgattggctccttattgagaggcaaattggggatggcactggacagcatcccttcgtgctaa

SEQ ID NO: 62101 - DNA, 519 bp, Glycine max
  Peptide Sequence Number=SeqID_178879
atggaagacgagactctgagttttgtcctctccactccctcaagaagctaccaatccaggctcaagtcacacttcgcagagctcttcatcgatcttgatgaggtcaatggggacgaggagttgaggacagcttatccatgccctttttgcgctgagaattttgatcttcttgagctatgttgccatgttgacttggaccatccaatagaagccaagtctgggggtgaacgagatggacactggcaatctttttctactgggttatctcccacaacctctaaggcagcaagcgatccatggctgtcattcttatgtggtccatctgctgttgatgaatgtgaaaatgtgcagccagattcttcaagtgaagtaagcattgaagaaatacactcaaatgataatgtgttagaaagagatgttcaaccgtctttatctgacaaagaccaaatagagaaagcacagcacagtaaatttgtacagggacttttgatgtctactatccttgatcctgacttctga

SEQ ID NO: 62102 - DNA, 3456 bp, Glycine max
  Peptide Sequence Number=SeqID_178880
atggtgaatacggcgtcgtccccttcttcctctccggtgaccattacggtgtcgtccggaggacgacgccgcagcatgggtctaaccagtcctgttccacgcgcctccgtctccgccaacaaccccgcttcccctctcagggtttccggcggccgcggcggcggcgcgtctaaagacggcggcatcgaagaaaccaacaccgaatacgtgtcgtacacagtccacatccctccgacgccggaccgcaggccgctgacagcctcggaggacggtggaaagaacagcacgagcttcatctccggcacgatcttcacaggagggtacaactccgtgacgcgcggccacgtcatggagtgctcgatggacagcgatgcgcaggcgaaaacgacatcgttgacggtttgcggaatgatgggctgtgacgaggaagcgatgaaaggaaggctgtgtggtggtggaccgtgcgagtgcgggttcaagatctgcagagagtgttactcggagtgtggagggaagtgccctggctgcaaagcgccttataagtatgtgagcgatgatgatgaggaagaagaagacgacgttgaggggtctgagggtgaggatcagcctctgcctttgccttcgatggctgagtttaagttggataagaggctttctgttgtgaaatcgttcaagacgcagaaccatcctcctgattttgaccacacgaggtggctatttgagaccaaggggacctatggctatggaaacgctgtgtggcctaaagatgggtgtggtgctaatgggtttgaaccccctccggagtttggagagaaggcgaggagacccttgactaggaaggttggagtttcagctgctattatcagtccttataggttgcttattctgctgcgtcttgttgccttgggtttatttcttacgtggagggttagacaccccaaccatgaagcgatttggctgtgggctatgtccataacttgcgagctatggtttgcattttcttggattcttgatcagcttcctaagctctgtccagtgaacagagtcactgatctctctgttctgaaagagcggtttgagtctccgaacctgcgaaacccgaaagggaggtctgatctaccaggaattgacgtgtttgtttccacagcagaccctgaaaaggaacctcctcttgtaaccgccaacaccattctctcgatccttgcagttgattatccagtggagaaggttgcgtgttacttgtctgatgatggtggagctctgttgacatttgaagctcttgctgagactgctagctttgctagaatttgggttcctttctgtcggaagcatcacatagagccgcgaaatcctgaaacgtattttgggcagaagcgtgattttctcaagaacaaggtccggttggactttgtgagagagaggagaagggtgaagagggaatatgatgagttcaaagtgaggataaactcattgcctgaatccataaggagaaggtctgatgcttacaatgctcacgaggagttgcgagctaagaagaaacagatggaagcaggttccaatgtctctgaacctattaaggttcctaaagctacatggatgtccgatggttctcattggccaggaacttgggcatcgggtgatcaagaccactcaagaggggaccatgctggtataattcaggcaatgttagctccaccaaatgcagaaccagaatttggtgcagaagctgatggggataacttgattgacacaacagatgttgatattaggcttcccatgcttgtttatgtgtctcgtgagaagaggccaggatatgatcacaacaagaaagcaggagcaatgaatgctcttgttcggaccagtgccatcatgtccaatggaccattcattctgaatcttgactgtgatcactacatctacaactccttggctatgagagaaggtatgtgctttatgcttgacaggggtggtgataggatatgctacgttcagttccctcaaagatttgagggcatcgaccccagtgacagatatgcaaaccacaacacagtgttctttgatgtgagcatgagagctcttgatggcttacaaggccccatgtacgtgggaacgggttgcatattccgaagaacagctctttatggatttagtcctccaagagccacagaacaccatggctggttaggcaggaggaaaatcaagttgtttttgagaaagccaaaggtgtcaaaaaaggaagaggatgaaatttgtgtgccaataaatggtggttacaatgacgatgatgcagacatagagtccttgcttcttcccagaaggttcgggaactctacttctcttgctgcatccattcctgtggcggaataccagggaaggttgcttcaagatttgcaaggaaagggaacacaaggaaggccagcaggttctcttgccgtgcctcgcgagccattggatgcagccactgttgctgaggcaataagtgtgatatcttgtttctacgaggataaaactgaatggggcaaacgagtggggtggatatatggttcagttacagaagatgtggtcactggttacagaatgcacaatagagggtggagatcagtgtactgtgtgacccaaagggatgctttcagaggaacagctccaatcaacttgacagataggctccaccaagtgcttcgatgggcaacaggttctgttgagattttcttgtcaaggaacaatgcattgttggcaagtcctagaatgaagttcctgcagagggtggcatatttcaacgtgggaatgtaccctttcacttcaatctttctgattgtctattgctttctaccagcagtgtccctattttcggggcagtttatagtccagtcccttagtgcaacctttctagtcttcttgcttggcatcacaatcacactgtgcttgcttgcactcctcgagatcaagtggtcaggaatcactctacatgattggtggcgaaatgagcagttctggttgattggtggaacaagtgcacaccctgctgctgttttacaagggttgttgaaggtcatagcaggagtggacatatcattcactttgacctcaaagtcagccaccccagaagatggagatgatgagtttgctgatctttatgaggtgaagtggagctttctaatggtccctccaatcactattatgatggtgaattccattgctattgctgtgggggtagccaggactttgtacagtccatttccacaatggagcagactagtaggaggggtgtttttcagcttctgggttttgtgccatctttacccctttgcaaagggcctcatgggaaggagagggaaggttcctaccatcatctatgtttggtctggattgctctccattattatctctttgctttgggtgtacataaaccctccttcaggaagaacacaagattacatgaatttccaattcccttga

SEQ ID NO: 62103 - DNA, 264 bp, Glycine max
  Peptide Sequence Number=SeqID_178881
atgtctcgtgttccttatgcaagtgttgtatgtagtctcatgtatgctatggtatgcactagatcggacctagcacaagcagacaatgttttgagtaaatatatgggtgatccgggggaggaacattggtctgtgactgggtacgcattcacgattggtaacactcttgctagttggaaggcaacatttcaacctacattggatttatccactacaaaggcacaatacatggctctagaagaagcattaaaggaaggaatctga

SEQ ID NO: 62104 - DNA, 438 bp, Glycine max
  Peptide Sequence Number=SeqID_178882
atgacgctatcttccaaccgagttcaagtagtactcgttggtccggttgtagtcaagtctgagagggagtctgacttcctttctagccaactcccagttggtggtgtcgccactataggtggcgcaatccaccctgacgctggcatcactgccactattcttccaaacattagaggggacaaggctaagtctcctttgccaaatcccatcacaaatgttattaacttggactcagaggctactgttgttcaagtcatagccctttgtccaattattcatccttcttctttttctcccaaaaaacccaaaaaggagtaccctcatataacgcttccaagttactccttggtttatgggcgtatggctaagtttgattaccaatccatcaagaaggcacaagtcgagaagaccaaggctgataagggcaaaggcaaataa

SEQ ID NO: 62105 - DNA, 252 bp, Glycine max
  Peptide Sequence Number=SeqID_178883
atgcaacagggacatgcatacatccctatagttaggttccctgaccccaactatgtggcaagcaacggtggctcgtggtggccaccggtggtcgtgagtggtggagaagaaggtgttaggtttgggtgggcgtttagagaggaggagaatcccaatggtcagactgtggggacatgtgttaggaatctacaatcaaaatttgaagacgatccaacgtttaacaaatccaagatcgtggttttacctgaatag

SEQ ID NO: 62106 - DNA, 327 bp, Glycine max
  Peptide Sequence Number=SeqID_178884
atgactattgttgggctttggttcaaattggagaaactcttcatgacaaaatcaatctacaacaagttacttatgaaattatgtttgcttggcctccgaatgaggaaaggaaatgacttcattacacttgaagaagccaagtctagtctgtattctagagagcttcgactaaaggcatctgagaatggggatgaagtctctacatccatattatcagtgaatgattatgctaaaaggcagaagaagaagaaattcaaagtcaagaagagcaaagttgatcctaaggacatatgcaattactttaaagaactagttcattggcagtga

SEQ ID NO: 62107 - DNA, 1968 bp, Glycine max
  Peptide Sequence Number=SeqID_178885
atgctggctgaagtcaaacagaggggtgcagctgcagctgcagctggacaagctatctcagcatttgagaatgagctacgccctattgatcgatatgccattcgttttatggaactgtgggatccaattatagataaaacagccttggaatctgaagtcaggattgaggacacagaatgggagttggatcgcattgaaaagtacaaggaggagatggaagccgaaattgatgaagatgaggaacctcttgtatatgaaagctgggatgctgattatgcaactacggcatatcgacagcatgtagaggccttggctcaacatcagttaatggaggaactcgaatatgaagctagacagaaagaagccgaggaaacttgtgattctaaaaagactcaaacaccaggggattcgaagcccaaatctaaaaagaaacccaagaaggcaaagttcaaatctctaaagaaaggatctttaacctctggcttgagacctgtcaaagaagagtcacaagcagagcctatgaacatagatgatgaggatgtcactggtgtagattttctgtctccaaattcaaccaagcagaaaaaacgtaagaagtctaaattaactactgatggtgaagaagaaaagagacttaagaagtctaaaaagtccaagagggatcctcctgacatttatgcttccgatttagaatccaactcattagttgtgcaggatgaacatgcagaatcaaagacttgtgaaagtctggttgatttagaacagaaaacagcaagcaggagtaagataggaggaaaaatatccatcactcctatgcctgtaaaacgggaggatgcaatattatgtgctgttgttcatgaatatggtcctaactggagtttggttagtgaaacgctttatggcatgagtggtggtgggtcatacaggggaagatatcgtcatcctgtccattgctgtgagaggttcggagaactattccaaaagtatgtcttgctgtcactggacaatgcaaatcatgagaagatcaacagtccaggctctggaaaggctcttcttaaagttacagaggataacattcggatgctgttagatgttgcttctgagcaggtggcatcacatgttgaccgcaggcgaaatccattacccacctgcaatggtctctatttcgatcagagtttctatacttccattggccagccttcacaaaattccttgaagaaatcctctaaaaggatgacatttacaaatttagcccagagcaagaagttagtagcagctgcacttgatgatatcacaactaggcaagtgaatgacaaagtcattctctctaaccaaggtgaagacatgccagtaagtgcagatcagctggatataacactggagttcacaaaagaggatagcgacgtcctatcttcatttccatctgttataaatttatcaataattgggactgaaccaacaccatctttaaataagcaaacaggagaagatgatcttaaagttggtttgttcattgctgagaatcgtttcagggaggcagcaagagtttgtgaagaagacagctctggatgggcatcatctgcattcccaaccaacgatgcaaggtctcgagctggatccaggatacaatcctccggaaagcagaagtcttccatgtccgactcttctaagccttctaggtcaaagtccaaaaaagcttcaatggatcctagtgaaatgcatcaccatcaggctgattctaaattccagtcaatgccatcactcaaagatctgagaattgatctcacttcattaactactgatgaagttggaattgatagtatgggtagcattttctcctttgacttgaatggggaaagttcattggaaatggagagtgttggaatgatcccacatgattatgttgctggtttaatctcagaccttgatgattgtacagcattccctgaatatactgacattagataa

SEQ ID NO: 62108 - DNA, 279 bp, Glycine max
  Peptide Sequence Number=SeqID_178886
atggttgttggttgtaggcttgattccccaacttgttcagcaacaatgtcaccaacatcatcaccaagtttgtgtatgtcaaatgagctcaaccaagatgacaacaacctcaaatacttcagtagccctaaagccatttccatggtgctagtagggtgctctcgctgccttatgtatgtgatggtcaatgaggataacctcaagtgccctaaaatcaaaagcattgctttgattcattttgttgatgccaacaacaatcccaccataaagaagggatag

SEQ ID NO: 62109 - DNA, 373 bp, Glycine max
  Peptide Sequence Number=SeqID_178887
atgtcttcagtcatttcatgctttgaaaaggcgacaatgccttcgtttacgctttcgaagacgacaatgttttcatctcaaagacttcaatgtcttttatccttgtgcttcataggactcaacgtcctctgttttactgcttggacttccgctagtggccggttggatgcacctaggcccactagaaagcttagggatgaagtaaccagctcgcttgggggtcctgaggttcctaaggtccagaggtccagagaaaagaggaaagaagagaaaaagaagctaaaacgtcgtcaaatcgtgactacaatcgatttctacatcgttcttcattcgttctttggtcattcttcattcgttctttgttcttcaccca

SEQ ID NO: 62110 - DNA, 303 bp, Glycine max
  Peptide Sequence Number=SeqID_178888
atggtgggttacacaccttcaagctttgcgaatttggtcttcaccggcgaaatgatcaaagtgggtctggaaaaaggcaaatctgatcatcctgctttgatgaatgcgaaaattggggcaaatgaagaggatgagaatgagggagaaacccttgctatgactacaattcctatacggtcaaaattcccatcatcccaacaatgtcattactcagccaataacagtccctctaacccaatcatccacaaagcatgcccgccgcacatccagtgcctaaacaccaaccaaaaaggaattttgtag

SEQ ID NO: 62111 - DNA, 573 bp, Glycine max
  Peptide Sequence Number=SeqID_178889
atgatttcctttttcccccttttcatatcaagatgccccaagagctgcaagaatcgatttcgtggctgtcattgtgctaagagtcaatgcagaagccgtcaatgtccatgttttgctgcagatagggaatgtgatccagatgtttgtaggaattgttgggtcagttgtggcgatggtacacttgggattcctagccaaagaggggacaattatgaatgtagaaacatgaagcttcttctcaaacaacagcaaagggttcttcttggaaggtctgatgtatccggctggggagccttcttaaagtttgttcttgatgcttaccgaaagggtgataaattgaagtttgcgaaccattctcctgacccaaattgttatgcaaaggttattatggttgctggagatcatagggtaggcatttttgccaaggaacggatttgtgccggggaggagctgttctatgattatcgttatgagccagatagggctcctgcgtgggctcggaagccagaggcatctggatcaaaaaaagaggatggggctccttcaagtggtcgtgcaaagaagcttgcttaa

SEQ ID NO: 62112 - DNA, 426 bp, Glycine max
  Peptide Sequence Number=SeqID_178890
atgacgcgtatgggaggcagagttgtccagaggtcgtgccttactcgtggagatgatggcttagcaaatattcagagaattccaaagacagagatgactctgattaaggaattagagcaacaaccaaaccaaattgctggccacaaagaactcgctcacaaaagtctccttcagagcgatgcactctatcagtatatacttgaaaccagtgtgtacccaagagagcatgagagcttgaaggagctaagagagttgacggaaaaacacccttggaacctgatggctacaccacctgacgaaggacaacttctaggcatgctacttaagcttatcaatgccaagaacaccatggaaataggcgtcttcactggttactccttgctttccactgccctcgccctcccttctgacggaaaggtcccttaa

SEQ ID NO: 62113 - DNA, 1008 bp, Glycine max
  Peptide Sequence Number=SeqID_178891
caacctgcaataaatactttgagagaagtggaggcattcttgactcaaaacccgacagagatcgtcaccattgtaattgaggattatgtgcatactccgaaggggttgactaatctattcagaaatgctggacttgataaatattggtttcctgtgtctgatatgcctaaaaagggagaagattggcccactgtaacagagatggttcaagtgaatcaccgacttcttgttttcacttcggatgcttcaaaggaagctgaagaaggaatagcttatcagtggtcttacatggttgagaatgagtctggagatcctggagttgaagggggttcttgcccgcatagaaaagaatcaaagccgctaaattctagaagtgcatcacttttcttgcagaattactttccaacagatccagttgaagctgactcatgcaaagagcattcggttccacttgttgatatggtgaacacatgttacaaagctgcagggaatgtgttgcctaacttcctagcagttaatttttacatgaggagtgatggtggtggtgtttttgatatcgtggataaaatgaatggccattcattgtgtggctgtaatacaatctctgcttgccaggagggagcaccttttggatcttgcaagaacattgctgtacctaatacaagtccagtgaccaacacagctggaagctttacaggatctgttcagttctccagatcagcttcaccagtccattctccaaattgctggtgctataatcaaggatcagtgaggtcatctgaggtagatggtaaccaagaaaggctaagaacgcatccagagcagttcaggatttgtaccaaggtaacattagtcaacgacagaataggaaatttgcaatataggatcaggatggctgaaagctcctggtcattgttacgggcttacggtttcttgcaattgtataatgatgattcttatcacctgcctttccctttccacttctgtattgatgttgaaacaatatag

SEQ ID NO: 62114 - DNA, 942 bp, Glycine max
  Peptide Sequence Number=SeqID_178892
atggtgactcctatgctggcggatcaatatcaattcatcatggcttatgcatactggaaagctggcaaacatcaagaacaagctgtgtcagatggctttctggactatcttagaggaattgactgttctgatgttgagttctatgctattcccaaaggatcagttgtttttcttaaggtgcccctattgagaattgaaggtccaattgccgttgttcaattgctggaaacaccttttgtctatctaattaattttgcatcattagtttctactaatgctgcaaggcatcgttttgttgctggaaaaccaaaaactctacttgagtttggactacgaagggctcaggggcctgatggtggagtgggtgcatcaaagtacagttacattgggggatttgatgcaacaaggtattatcgatttaacaactttcattctgtggttcgtggttaccctatgagtttgtacattgtaattgagaaagggcaaagtgcctggtatatcctggttgtggttccaaaaattctgcgatcgaattcactacgtggcaattttgctgagaccaatcaaagtgagctggccgcattcacatatgcattggcatttcctgataactttctagccctagtagacgctgatgatgtcatgagaagtggaatccctaacttttgtgtagttgcattagctctcagtgatttaggatacaaagcaattggcattagactggattctggtgaccttggatatttgtcttgtgagatcaggaagttgttttgctccattgagaaggaatttggattgcccggtttcgggaagatgaatatcacaactagtaatgaccttaatgaggaaaaattagatgctttaaacaaacaggtcaattcttttggaaattgtagctattttgctgtcaattcaagtaattcaaaatgcaagaatcactag

SEQ ID NO: 62115 - DNA, 1590 bp, Glycine max
  Peptide Sequence Number=SeqID_178893
atgaatagttccaccagtgccgctgcagcaatgaacgaccagctctccaaccccacctccatcttcggcctccgcctatgggtggttctcggcgtctgcgttggcgccgccatcgtcctcatcctcttcctcatctccgtctggttagccttcaagcgctccaaaaccaaccccgtttccatccccgacgtctccaaggagatccaagaaatcaggctcgaccacgcgcccaacctcaaccccactctccaacccgaacctcctttatccgaacctgaccccgttcctcccaccgaagaggaaaccacccccctcggctaccaccgaatccagttcgagattggcaagaaccaccgaatctcttaccccgaacgtcccttggttcgctccagctccaatgaccccagcagctgcgaggttcaggttcccaccgtcattccagaagtttctcacttaggttggggccactggtacactctcagggagcttgaagattccactaacgccttcgcccctgagaatgttattggcgaaggtggatacggaattgtttatcacggtatcctcaacgacaatactaatgttgctattaaaaatttgctcaataataggtctcttcacttacttctctcttttctttcttcaatatcaaccatgttttacctaataataataattcataacgctaggggccaagctgagaaggagttcaaggttgaagtggaagctataggacgtgttcgccacaagaatttagtcaggttgcttggttattgtgctgaaggagctcatagaatgcttgtttatgagtacgtggacaatggtaatttagagcagtggctgcatggggatgttgggccttgcagtcctctaacttgggaaattcgaatgaacattattctgggaacggctaaaggattaacttatcttcacgaggggttagaaccaaaagttgttcaccgtgatattaaatcaagcaacattttgctcagtaagaagtggaatgcgaaggtttcagactttggcctcgcaaaactccttggctctgacagcagctatatcacaacccgtgtcatgggtacatttggatatgttgctcctgaatacgcgagtactggcatgttgaatgaacggagtgatgtttatagttttggaattcttattatggaactaattacaggaaggaatccggttgattatagtcggcctccagaagaggtgaatttggtagactggctcaagaagatggttagcaacagaaatccagagggggtgcttgatcccaagcttcctgagaaaccaacttcaagagcactaaaacgagctcttcttgtagctttacgctgcactgatcctaatgcacaaaagcggcctaaaatggggcatgtgatacacatgcttgaagctgaagattccccttacaaagaggatcgcagagctaaaagggatgcaggacattcacctaatgatagagtaggggatgggttgaaagaggaggtaactgtgtctgtgtcagttgatgatggtaagcttgaaaatgggatgtgtgccaatgagacaagatcgaaccctcaaatagaaaagcaataa

SEQ ID NO: 62116 - DNA, 189 bp, Glycine max
  Peptide Sequence Number=SeqID_178894
atgtctaaccgtgaacctgaggaaagggttacactgcctccttttatagtaggtcaaccaattccatatttaaagtacggtaacatagttttgttttgtccctctgacatgttaagtgacgaggtgcatcatcttcttgcatgtcgtcacgttgtcaattgtcaaagaatgtcacagctcacaagttag

SEQ ID NO: 62117 - DNA, 3150 bp, Glycine max
  misc_feature (458)..(458): n is a, c, g, or t
  Peptide Sequence Number=SeqID_178895
atggcggcagaggcggctttgttcttttctgtggcatcagtggtggaggacgtgcttcagcagcacggtcctcgcctcaaagatcttgatttggaatctaggaaagccgaagaagctgttatcctgaaatggaaagttctttactttgcagcatcaagaagatacgaagctgcggggtggttgagaaaaatggttggagttgttgcagccaaagatttaccagcagaaccctctgaggaagagtttaggcttggtttgaggagtgggattattctctgtaatgttattaataaagttcaatccggggcggtacccaagtttattcgtctttttaaggttgtggagagtcctgttgattctgcattgatccctgatggggcaccattaacggcatatcagtattttgaaaacgtgaggaattttctggtggctgtccaagaaattggaattcctatctntgaggcatctgatctggaacaaggaggaaaatcatctaggattgtcaattgcgtgttggccctgaaatcctacagtgaatggaaaatgagcgggtcaaatggtgtgtggaaatttggtggaaatctcaaaccaactgtgtctgcaaaatcttttgtgagaaaaaattcggatccatttactaattccttgtcaaggacttcgtcgctcaatgataaatctattgctgctcttaattctgatgttgagaatattaaaatgtctggttcccactctttgagtatgcttgttcgggcaattttatcagataagaagccagatgaagtttcaacgttggttgaatctgttttaaacaaagttgtagaggagtttgagcaacgaattgcaagccaaggtgaacagacaaaagtaacttcaagagatcctgtttctcagagcaacgggtctgccatggcagataaaaagggggagaagaagattcatgtggcaacgaaaaaagaggattacattcataaaaatcaagttgctactatggtaacaacaaaaaaagagggccacagtcataaaaatcaagttgctgatgaggaatcacaaaggcaacttatgaagcagaaaatgctcttcgaccagcagcaaagagaaattcaggagctaaggcatactcttcactccacaaaagatggtatgcagttcatgcaaatgaaatttcatgaggagttctccaatcttggcatgcacattcatggcttagctaatgctgcttctggatatcatagagttcttgaagaaaatcgcaaactatacaatcaagtccaggatcttaagggaagtattagggtgtactgtcgtgtaagacccttctttcctggacaagcaaaccatttgagtgcagtggaaaatatagaagatggaactatcacagttaatattccttcaaagaatgggaagggacgcaggtccttcaactttaacaaaatctttggaccatctgcaacccaagccgaggtcttcctagatatgcagccactcgttaggtctgctcttgatggttttaatgtttgcatatttgcatatggccaaacaggatcaggaaaaacctacactatgactggaccaaaagagatcacagagaaaagccaaggtgtaaattacagggctctaagtgatttgtttcttatagcagatcaaaggagggacactttccactatgacgtttctgttcaaatgattgagatttacaatgagcaagtcagggatctgctggtcactgatggaacaaacaaaagatatccttttaccaaaattcgaagtagttctcaaaaaggactcagtgtgccagatgcaagccttgttcctgtatcatctactattgatgttattgaactaatgaaccttgggcaaaggaaccgtgcagttggagcaacagcccttaatgaccgcagtagccgatctcatagttgcttgactgttcatgttcagggaagagatttgacatctggagctatccttcgtggttgcatgcatttggttgacttggcaggaagtgagagggtggataaatctgaggccacaggagatagactaaaagaagcacagcatattaacaaatctctttcagctttgggagatgtcattgcttcccttgctcagaaaaactcacacgtaccttacagaaatagtaaactcacacaactactccaagattcacttggaggacaggccaagacactaatgtttgttcacataagtccagagagtgatgctattggagaaacaattagtaccttaaaatttgctgaaagagttgccacagttgaacttggtgcttctcgagtaaacaaagatagtgcagatgttaaagagctcaaagaacagattgccagcctcaaggcagcactggcaagaaaggaaggagaatcagaacattctttttccagcagctctgaaaaatacagaacaaaagctagtgagctatcaccttatcatataaaccagcgagatcctgacactgtggatcagcttggttgccggcaaccaatggttgaggttggcaacatagaacagcttcagagtaataccacagtgaggcacaaaactcagagctttgatttcgatgagatatcagcaaattcaccaccatggcccccagtgaacaatagtcttgcacaaaactatggggaggatgacaaagaaagtggttctggtgaatgggttgacaaggtcatggtcaacaagcaagatgtaaacaaaactgagaacctcttggggtgttggcaagcagcaaacaatgggaacttatctgaggccttttatcagaaatatatagaagattctcccaaaatgtactcggaacaatcctatactatgttcatgggagccaaccagtttaacattgcgggttctgatgacatcatggatgagcttgatgctgcaaccagtgattcctcagaacctgacttactttggcaatttaatcattccaaacttagcagcgtgaccaatggaattggatcaaagactatgagatctatctcaaaggcagcaaaaaacagccctgagttgagcaagaatgctgttcattcttctcctctaggtccttcaccttcattgaaaaactcaaatggtgtcccacatcgatcaggaaggcatccggctccagttgacgtgaaacgtagaactgggaatagaaaataa

SEQ ID NO: 62118 - DNA, 151 bp, Glycine max
  Peptide Sequence Number=SeqID_178896
agcatcagcaaaactggttgcaagtcggatgaaggcgagtttatgaagggattgcacatgttgacctcactgaggagtgataatgtagaaggagatggagaagtccttgaatggtcaactagagtttctattgtgaaagggattgctaaag

SEQ ID NO: 62119 - DNA, 1047 bp, Glycine max
  Peptide Sequence Number=SeqID_178897
atggaggacaaaaggaccgcaatcacaaataaccaagcaaggaagaaaatccacccattaattagaagcttaagcattggcggcgaaggtgggattgcggggcttgttgtgttcggtggagccttggccattgcgggtttcatggcagttgcttcttttgcgagcaacaaaaataaggcaaaggacactcatgatgatcaccaaccacctaagcctaaacctaaaccccaacaattgttattggaggaacacatttgtaagagtgaagaagatcatgacacaacccaaagtctcacctctcttattcaacacggggattccacatgctgttgggcatccaatatgagcaaaacccaagttagtgattcttccgagtcgttatccgttcaatccttgattttggaggagaaaaatgagcttaaagcaagaagtgtagaggagagcccaaccgactttcaccatcaggaaattgtgttttctgactcttcgcacccagaaagcgcggcatcgtcgaacgaaggtggggttgcggaagaatgcatgatgtcattgcttaacagccccagtggccaggatgaagaacctcaagatgactcaacatcctcggaaacagaaacagtaaccgaggacgatgacattaaggatgatgacgacgacgatgatgagatgctgtccgatgatgtttcagagattggcgaacaagatggctcaaaagtggcaacagggactacctccatggagccagtttggcctgaggagctgatacagcatgcaaagcaaaaattcaaaggagacagccatgtttgctccgattctgaagtggatggctccgatgacttggacgaggctatgatgactgtggcaaaccaagcaactatgaaccaaaatctaaacttctttatggtgcccaataatcaaccattaaccacctgggtttttcccttcctgttgctagcgctgctgttgatcttagttctactcactcgtcgcccacaagaatcattttatgtcctagacgagggtactacagtagtgaagcgaatttag

SEQ ID NO: 62120 - DNA, 747 bp, Glycine max
  Peptide Sequence Number=SeqID_178898
atggcactttccaccaaatcagcttttcagaggcataagcagtggctgcaacatgctaaaacacgtagtgcaagacataaaataatgaagtttctgagggagcaagctgcacgctctgctgctgatatcactacggaagcagtcaatgactttgtcattgattctgacggggatagtgaatctgaagaagtgtcaaaaggttccagtggctctaaatatacgtggggtaaaatgtttgtgaatggagccgaaatatcaacttcgggaagaagtgagactgtcctccaaagtaacaatggaagtgcttggatccctaaggtcaatggaaaacataataagcatgtgcagcatgaaagtttcaacggcaaaggggagatgctactgcagggaaaccttgtcgcaaagatgattcaagttaacattccaagatataaggaagtcctgccaggtttagaaagttggcaagcccagaaaattgcttcttggcacaatatggaagggcactccatccaatggttatctgtagtatgtatagaccgaaaaggcatgatggctgaggtcactacagcattggccactgcaggcatagccatatgttcttgtgtggctgagattgatggaggaaggggaatggctgttatggtcactgcttgctctaaagtagatctgatattgggtgttttgggatggtctaccggttgcagctggccaagcttgatggaagaccgtggcgttctcgaatgctag

SEQ ID NO: 62121 - DNA, 255 bp, Glycine max
  Peptide Sequence Number=SeqID_178899
atggagggttgccacccaaatcacgaaaagtataatgttgctagagatataaagtttagttgggaaagagtgaagggagaacggaaggaagaaaaatcgcttaaagaaaaatataatgttgctacatcaacgttcttccaaagcccagaggaggaggtagtttggtgcttaaagagcttgcaagatcagattcaaataatcaaccataagtttatgaagaaactaagattatacgccagattgagagaatggtaa

SEQ ID NO: 62122 - DNA, 1155 bp, Glycine max
  Peptide Sequence Number=SeqID_178900
atggcctctgcatcctccttatctgtttctctagaatgcgtgaacgcgtgcaagctgtggagaggggatggaaatggaagattcgactgtagtcttctatcgtccgcgtggaaagctccgagggttctcactggctttcttgccagcactgctcatcctcatcagtgttcggacttgtcgaatgggcgcaacggacgaaggaaccggtataattttgggtgtgaaacctttagtgtagatggttcatgtcgtgatgaaccaattgatatcgtactttttgaaggatgctctagatctatgttgtctcaaaatgctcctaggagatggcaattgtgttgttctttggccccggatgctgtcactgatttttctgcggaaagtttgtgggaggatcttacacctgttatctcatacctgtctcctaaagaactggagttagtctacaatgcttttatgttggcgtttaaagctcatgatggtcagaaaagacgcagtggtgaacccttcatcattcacccagtcgaggttgcacgtattctgggagaacttgaacttgactgggagtcgattgctgctggattacttcatgatacagttgaggatacaaatgtcgttacttttgagaggatagaggaggaatttggtgctactgtgcgacacattgtggaaggagagaccaaggtgtcgaaactgggaaagttgaagtataagaatgaaaatgattctgtgcaagatgtgaaagcagaagatcttcggcaaatgtttctggctatgactgaggaggttcgtgttataattgtcaaattggcagataggttgcataacatgcgcacgctatcacatatgcctcctcataaacagactagcattgcgatggagacattgcagtcagaactagaaaatctatcatttatgtacacaaatgcggaagactatgctaaggtgaagagaagagtagcagagctatacaaagaacatgagaaagaacttctggaggcaaacaaaatgttgatgaagaaaatccaagatgatcaattcttagaccttctaactgttaaaacagaagttcgtgctgtatgtaaagagccttacagtatctataaagctgttctcaaatcaaaaagttcaatcaatgagattaaccaaattgcacag

SEQ ID NO: 62123 - DNA, 573 bp, Glycine max
  Peptide Sequence Number=SeqID_178901
atggaggtcaatgtggctggcctcaaccaaataaatcatccaaccttggatatggtaggtcaggaaggtaaggaattgggaagtacgggcggcccccattttctgcaagttcaaaacaagcatgccttccttccatatggcttgcctcccaactacacaccacccaatgtggtggacactcccgatgagaatgtcaataactccaatcccacactcactgagagccaacaacctcagtctgatcatgcatatgtttctcaacccatgagggaggcacatgaaataccccaccacaatctagccaacttcaagcctaaccttggatatgccactgaggggcaagcagttgatggtgtacccttgccaaaaactttggaggaacctcaatttcgctcacaaccacaacccttgcattttgtggcggggagagtccctcctgctatggtggaaaaagggaaattggatcatataaaggaaaggctcaaggccattgaagaaggcagagatcatgcttttgctaacatggtagagttatacctagtgcctgacgtcgtcatccctctgaagttcaag

SEQ ID NO: 62124 - DNA, 1110 bp, Glycine max
  Peptide Sequence Number=SeqID_178902
atggataagcagcagctggttgacattgccaataccgcgatgccgtttggcaaatacaaagggcggatgctgatcgatgtgccggaagagtatctgctgtggtttgcgcgtaaaaatgagtttcccgcaaaaaaactgggtgagctgatgcagctgacgctggcgatcaaaatcgaaggcttacagggcttagttaaaccgctcaagcgcacgctgggcaatgaacgagcacaccatcagctggacctgatggaagatcatcagcggcaggacaataatccccactgcgctggccgggaacaggatgttggccattggtacaccgtttgccaggctctttttcgagccgcaaaacagcaccacaatctcatccgcacggctaaagccaaacagccgggaagcgccaaggttgatggccagtgcgacgaacagaatcagcaggctgccagccagaatccacagcagggtatcaatgccgacgcgatgccagatgccgttaaccaccgcctcactgaacgccgaatagaccaccagcagaatcgaggtttgatcggttttgccaatcaggctgcgatgcttctccacccagccaccaatccagcggcgtgccaggtggcccagcacaaagggcaccagcagctgcagcatgattttaccaatctgctccagaccattgcctggagcatcgctgtgcacattcatcaccaggttaaccagcagcggcgaaataaagacgcccagcagactggaggcggaggcagcacacaccgccgcggcaacgttaccgcccgccatggaggtgaaagcaatcgcggactgcaccgtcgccggcaggatacacaggtagaggaaaccggtgtagatctccgcgccgacgttgaccggatgccaccacaccagcagcaggccaaggatcgggaaaatcacgaaggtactgcacataatccacagatgcagccgccagtggctgctgccggcgatgatcttctcgcgcgacagtttggcaccgtgcatgaagaacagcagggcgatggccgcagtggtcaggtattcgaagaaatcgacaaacccgcctttggccggaaagaagcttggccagcagcacggtga

SEQ ID NO: 62125 - DNA, 2934 bp, Glycine max
  Peptide Sequence Number=SeqID_178903
atgatgttctctaagctttcattacttcgtctaattctatgttcactcttaagcctccattcctcccaacttttcacgtctacctcttttgcctttgctgccatcactgctgaaaaccaagagagggaagcagctgctctacttgagtggagagtgagtcttgacaaccaaagccaagcttctttgtcatcatggtccagtggtgtaagtccttgcacgtggaaaggaatcgtttgtgatgattccaactctgtgaccgctataaatgtggcaaatcttgggctaaaaggtactcttcacagtctcaaattttcatcttttcccaagctgctaactctggatattagtaacaacagttttaatggaatcattcctcagcaaatttctaacttgtctagagtttctcagttgaaaatggatgctaatctttttagtggttcaatccccatttccatgatgaagttggctagcttgtctttgctagacttaacaggcaataaactttctggtaccattccatcaattagaaacttgacaaatttagaacatcttaagctcgcaaacaatagtctctctggtcccatcccaccctacataggagagttggtgaatttgaaagttcttgattttgaaagtaatagaatttcgggatcaattccttcaaatattggaaatttgacaaagctcggcatttttttcttagcccataacatgatctctggatccgttcccacctccattggaaacttgatcaatctagagtcgctggacctttctaggaacactatttccggagttattccttctacccttggaaatttgacaaagctcaattttttattagtgtttaataacaaacttcatggtacattaccaccagcactgaataactttaccaaactccaaagcttacaactatctacaaatcgtttcaccggtcctttgccacaacaaatttgcataggtgggtcactgagaaaatttgctgctaatggtaattctttcaccggttcagttccaaaaagcctgaaaaattgctccagtcttaccagagtaaacctatcaggaaaccggttgagcggaaatatctcagatgcttttggtgtgcatccaaagttagacttcgttgacctgagtaacaataatttttatggtcacatttcaccaaactgggctaagtgtcctagtctcacaagccttaagatatccaacaacaatttatctggtggtataccaccagaactaggctgggcacccatgttacaggaacttgtcttgttttcaaatcatctaacaggaaaaattccaaaagaacttgggaacttgacctctttgtttgatctatcaataggtgacaatgaactttttggcaacattcctaccgaaataggtgctttgtcccgccttgaaaatttggagcttgcagcaaataatttaggtggcccaattccaaaacaggtgggatctttacacaaattacttcacttgaacttgagcaacaacaaattcacagaaagcattccttcgtttaaccaattgcaatctcttcaagatcttgaccttggtaggaatttgttaaatggaaaaataccagcagaacttgcaactttgcaaagattggaaacactaaacctctcacacaacaatctctctggaaccattcctgattttaagaatagcttggcaaatgttgacatatctaacaaccaattggagggttcaattcctagcattccagcctttcttaatgcttcatttgatgcattgaaaaataataaaggcttgtgtggaaatgcctccggtttggtgccttgccacaccctacctcatggtaaaatgaaaagaaatgtcatcatccaggcattactccctgctttgggggctctatttctattattattgatgattggaatttcgttgtgtatttattatcgaagagcaacaaaggccaaaaaggaggaggctaaagaagaacaaaccaaggattatttttccatttggagttatgatggaaaattagtgtatgaaagtatcattgaagccacagaggggtttgatgacaaatatctcattggagaaggtgggtctgcatctgtttataaggcaagtttatccactgggcaaattgttgctgtgaaaaaactacatgctgtacccgacgaggaaacactcaacataagagcttttacaagtgaggttcaagccttggcagaaatcaagcatcgtaacattgtgaagttaattggatattgtttacatccctgcttctcctttttggtttatgagttcctagagggaggtagcttggataaattactaaacgatgatacgcatgcaacactgtttgattgggaaaggagggtgaaggttgttaaaggtgtggcaaatgctttgtaccatatgcatcatggttgctttcctcctattgttcatcgagacatatcaagcaagaatgttcttatagatttggattatgaagcccgagtctctgactttggaacagctaaaattctgaagcctgattcacaaaatttaagctcgtttgcaggcacctatgggtatgctgcaccagagcttgcttatactatggaagcgaatgagaaatgtgatgtcttcagtttcggagttctttgtttggaaataatgatggggaagcatccaggcgatctcatttcttcatttttttcatcccctggaatgtcatcggcgtctaatttgctgttaaaggatgtgttggaccaacgactacctcaaccagtgaatccagttgacaaggaggtgatcttgatagcaaaaataacatttgcttgcttaagtgaaagtccacgttttcgcccaagcatggaacaagtgtataacgagtttgtgatgccaacatcatcttcagtgaatttattctccatggtcacacttagtcaactcgttgataattga

SEQ ID NO: 62126 - DNA, 1089 bp, Glycine max
  Peptide Sequence Number=SeqID_178904
atggactcacatctccccgaccacttcaagtgtccaatttccctcgaaataatgtcggaccctgtcattctctcttcgggtcacaccttcgaccgttcctccatccaacgttggctcgacgcgggtcaccgaacatgtccaattaccaaactacccctccccgaccaccccgccctcatccccaaccacgcgctgcgaagcttaatctccaactacgcattcctctcacctctccaccataccgtttcccaacccgaagccctaatttcaaccctcgcctccaattcttcgtcttccgattccaaaattgaggctcttaagcacctcacgcgcttatccaagcgcgactcggcgttccggcggaggctggcggagtccggcgccgtccccgccgtgatcgccgccgtggacgacccgagcctccaggagagggcgctcccgctcctcctcaacctcaccctcgacgacgactccaaggtcggcctcgtcgccgaaggcgtggtcgcgcgcgtggtggaggtgctcctccacgcgccgacgccggactgccgcgccgttgcggccaccatcgtcacgagcctcgcggtcgtcgaggtgaataaggccaccatcggcgcgtttccggcggcgatcgcggcgctcgtggcgatcctccgcgacggcaaggggcgggagaggaaggaggccgccaccgctctctacgcgctctgctcttttccggataaccggagaagagccgtcaattgcggcgccgtgccgattctcctccaaaacgtcgaaattggacttgaacgctgtgttgaggtaattggatttttggcaaaatgcaaagaagggagagaacaaatggaatgttatgacggttgcgttcagattctggttaacgttttgaggaatggtagctcgagggggattcaatatgcactctttgcactcacttcgctttgctcttataaccaggaaatggttctggtggctctggaagaaggggttctagaagcttctcttgggtttgtggaagatgataatgagaaagtgaggaggaacgcgtgtaatttgattaaggttttgcgtttcaaccacaatcgg

SEQ ID NO: 62127 - DNA, 1668 bp, Glycine max
  Peptide Sequence Number=SeqID_178905
atggcattcaatagcttgtactttcttatgctctgtgtttcccttgtgctatccttcctgacatccatttccatagctgataataaccatgcagtcgttccaccagaaaccatatgctactcaaccttagatccttcttactgcaaatctgtacttgcaaatcaatacggtagcatatatgactattgccgcatttctgttcgaaagtccttgtctcagtctcgtaagttcttgaacaacatgtattcatatcttcaaaatccctcttcttactctcaatccacaattcgtgctcttgaagattgtcaattccttgctgaactaaaccttgagtacttatcaacaacccatgacactgttgataaagccagcgctgttcttcccacctctcaagcagaagatgttcacacattgcttagtgctgttttgacaaaccaacaaacttgtctagatggcctacaaacttcagctccagatccaagagtgaagaatgatctttctttacaactcgcggaaaatgcaaagcttgacagtgtctccctttatttgttcaccaaggcttgggattctgagaacaaaacttcaacgtcatggcaaaaccagaatgatcgtttacccttgaagatgtcaaacaaagtacgtgccatttatgattccgctagaggtcaggggagaaaactacttcaaacaatggatgataatgaaagcgtactggtgagtgatattgtgctggttagtaaggatggaagtggaaactttaccactatcaatgatgccatagctgctgcaccaaataacacagctgctaccgatggttacttcattatttttatctctgagggtgtatatcaagagtatgtatctatagccaaaaacaagaagttcttgatgctaattggagatggaatcaatcggacaatcatcactggcgatcacaacgttgttgatggctttacaactttcaactctgccacatttgctgtggtagcacaaggatttgtagcaatgaacataacattccgcaacattgctgggccaagcaagcaccaagcagttgcagtaagaaatggagcggatatgtccaccttctatagttgtagctttgaagggtaccaagacactttgtacacgcattctctgaggcagttttaccgtgaatgtgacatatatggcacagttgacttcatatttggaaatgcagctgttgttttgcaaaactgcaacatgtatccccgcctcccaatgagtggacaattcaatgccatcacagcacaaggtcgaactgatccaaatcaaaacactggcatttccatacaaaatgcaaccataaaatcagcacaggatttggctcccgtggttggtactgtggaaacatatcttgggaggccatggaaggagtactcaaggactgtttatatgcagtctttcatggatagtttgatcgctccttctggctggcatgagtggaatggaaattttgcactcagcactttgtactacgcagagtatgataacacaggtcctggttcaaatacgggcaaccgaatcaactggccgggctatcatgttattaatgctactgatgcagctagttttactgtgtctaacttcttgaatggggatgattgggtgcctcaaactagcgttccatatcagacatctttgtaa

SEQ ID NO: 62128 - DNA, 1503 bp, Glycine max
  Peptide Sequence Number=SeqID_178906
atgaggaccttttccctcttttcttgtctttttttctttctttctgtcttttccaccactctgttccaccctggtcattccctccaccaccaccctcactctgccacacacaactacagagatgctctcaccaaatccatcatcttctttgagggccagcggtcagggaagctcccttctaaccagaggatgtcttggaggagagactctggtctctctgatggctcagccatgcatgttgatttggttggagggtactatgatgctggggacaatgtcaagtttggttttcccatggccttcaccaccaccatgctttcgtggagtgttattgagtttggtggggtcatgaaaggtgagttgcagaatgccagagaggccattcgttgggcgacagattatcttctcaaagctactgcacatccagacatcatttatgttcaggtgggagatgctgtgaaggaccacgcttgttgggagagacccgaggacatggataccccaaggagtgtctttaaagtagataaaaacaaccctggttctgatgtggctgcagaaactgctgctgctcttgcagctgcttctctggtttttaaaaaagttgatcccacctactccaaaacattggttaggagagctatccgtgttttccagtttgccgataaatataggggaccctacagcaatggcttgaagcccgttgtgtgccccttctattgttcttactctggttatcaggatgagctgttgtggggtgctacttggcttcacaaggctactaagaacccaatgtacctaaactacattaaggttaatggacagacccttggggcaccagattctgacaatacctttggatgggataacaagcatgttggagcaaggatactgctttctaaggaatttcttgttcggaaggtgcaaacactacatgactacaagggtcacgcggacaattttatctgttctgttatccctggctcctcttcttcccaattcaccccaggtggtcttctattcaagatgggtgatagcaacatgcaatatgtaacatccacctcattcatactcttagcttatgctaaatacttgaccaaagcccatgtggttgtgaactgtggtggaaccatagtaactccaaagagactccgagctatagcccaaaaacaggtggattacttgctgggagacaaccccttgaagatgtcttatatggtggggtatggtccacggtacccgcaaaggatacaccacaggggctcatcgctgccgtccgttgctgttcaccctggcaagatccaatgctcagcaggattcagtgtgatgaactcgcaatcacccaacccaaacattctaatgggtgcagttgttggagggccggatctgcacgatgggttcccagatgaacggtcagattatgagcaatcagaaccagctacttatattaacgcaccacttgtaggagcacttgcttatctcgcacactcctttgggcaactctag

SEQ ID NO: 62129 - DNA, 1689 bp, Glycine max
  Peptide Sequence Number=SeqID_178907
atggctttcaagaacttgtccgttcttactctctgtgtttcccttgtgctttccttctttgcaccgaattccatagctgctaacaaccgtgcagtggttcctccagaaaccatttgcaactccaccgtaaacccttccttctgcaaaaccgtgcttgctaatcaaaatggcagcatcgttgactacggtcgaatttctgtccgaaagtccttgtcccagtcccgcaaattcttgaactcagtaaattcacttcttcaagacagatcctctttgtctctacccacaattcgagcccttgaagattgtcaattcctcgctgaactaaactttgaatacttaacaaacgcacttgacactgttgataaagctagcgatgttcttcccaccgctcaagccgaagatcagcaaacccttcttagtgctgttttgacaaacgaagaaacttgtttagaaggcttgcagcagagcacagcttctgatcaaagagtgaagagtgatcttatctcatcactctctgatgacaagaagcttcacagtgtttcccttgacttgttcacgaagggttgggtggccgagaagaaaatctcaacatcatggcaagtcaatgggagacatttggatttccacaatggtcgtttaccattgaagatgtcaaaccgtgtacgggccatttatgattctgcaagaggtcacgggagaaaattactacaagataacagccaaagtgtgttggttagtgacattgtggttgttagtcaggatggaagcgggaactttaccactatcaacgatgccatagcagttgcgccaaataacacagttgctaatgatggttactttttaatttttatcactcagggtgtgtatcaagaatatatatccatagcaaaaaacaaaaagaatttgatgatgattggagatgggatcaatcaaacgattatcactggtaatcacaatgttgtcgataacttcacaacattcaactcagcaacatttgctgtggtagcacaaggatttgtagctgttaacataacattccaaaacactgctgggccaagcaagcatcaagcagttgcagtgagaaacggagctgatatgtccaccttctacagctgcagctttgaaggatatcaagacaccttgtacacgcattctcttagacagttttaccgtgaatgtgacatctatggcaccgttgacttcatatttggaaatgctgctgttgttctccaaacatgtaacctatatcctcgccttcccatgagtggacaattcaatgctatcacagcacaaggcagaacagacccaaaccaaaacacaggcacttccatacataacgccactataaagcctgctgatgatttggctccttcagttggtaccgtgcaaacgtacctagggagaccatggaaagagtactcaagaacggtttatatgcagtcttttatgaatagtttcataaatccttctggttggcatgaatggagtggggattttgccctaagcaccttgtactatgcagagtataataacacgggaccgggttcaaacaccgcaaaccgagtgacgtggcctggttatcatgttatcaatgctactgatgcggctaattttactgtgtctaacttcttggatggagatagttggctgcctcaaactggagttccatacgtgactggattgatatag

SEQ ID NO: 62130 - DNA, 432 bp, Glycine max
  Peptide Sequence Number=SeqID_178908
atggagaaaatagagcagaaaacggtgagtacgaatggaataaacatgcacgtggcatccattgggtcaggcccagtggtactgttcctccacggcttcccggagctctggtacacgtggcgccaccagcttctgtccctctccgctgcgggctaccgggccatcgcccctgacctccgcggctacggcgacaccgacgctccgcccgacgcttcctcacactccatcctccacatcgtcgccgacctcgtcgggcttctcgacgctttgggaatcgagtttcagaaacctggggaggttgaagaggagtttgcacgtgctggtgctgccagaattataaagacatttcttgcatcccgcgatccacaaccacctcgtgtgcctaaggagataggatttggaggttcacctaaccttcgtattgctgactga

SEQ ID NO: 62131 - DNA, 309 bp, Glycine max
  Peptide Sequence Number=SeqID_178909
atgtcggagtacaaaggagggggcaatgggaattgggctctgagggacttcaagtgtgtaatggcctcgtcgacgtggcccaattgggtgaggactcggatcatggaagtgagggaagggtgtggaatgtggtgcattttggcggtggcgaggatgcgggttgtgacttgtgatgcttcttcgtcgtttgatccatgggaggttcgggttgtgactagactcgcaatgcaagaggtaaaaacagaggttcgttggtacttggaactgcttttggaggtttctaattttggtacagttactgttaactaa

SEQ ID NO: 62132 - DNA, 1319 bp, Glycine max
  Peptide Sequence Number=SeqID_178910
tgaacaagacaacgaggtttcttcctagttttcaagctgatgatatccaaaccttactcagcgccatcttaaccaaccagcaaacatgcttggacggtctcaaagacacagcttcagcttggagcgtgagaaacggtctcagtgttccactctccaacgacaccaaattatacagtgtctctctcgctctcttcatcaagggttgggttcccagaaccaaagccaaagcaatgcaccctaccaagaaacaacttggattcaaaaacgggcgtttgccgcttaagatgtcaagcagaacccgcgcgatctacgagtccgtgagtaggaggaagctccttcaggccaaggtgggcgacgaggttgtggtgagggatattgtgacagtgagccaagatggaagtgggaacttcaccactatcaatgatgccattgccgcggctcctaacaaatctgtctccacagatggctacttcctcatctatgtaactgccggtgtgtatgaggaaaatgtgtccattgataagaagaagacgtatttgatgatggtcggggatggtatcaacaagacaattatcacaggcaatcgtagtgtcgttgatggctggacaaccttcagctccgcaacacttgctgtggtagggcaaggattcgtgggtgtgaacatgaccatccgcaacaccgccggggcagtgaagcaccaagcagttgcacttcgaagcggagcagatttgtccacgttttacagttgcagctttgagggataccaagacacactatacgtacattccttgagacaattctacagcgaatgcgacatcttcggcacggtggatttcatcttcggaaacgccaaggttgtcttccaaaattgcaacatgtaccctcgtctccccatgagtggtcaattcaacgctatcaccgcacagggaagaacagacccgaatcaagacacaggtatctcaatccataatagtaccataagagcagctgatgatttggcttctagcaacggtgttgcaacgtatctgggaaggccatggaaggagtattctagaacggtttatatgcaaactttcatggacagtgtgatccacgctaaggggtggcgtgaatgggacggtgattttgcattaagcactttgtattacgcagaatacagcaacagtgggccagggtctggaaccgataatagagtgacgtggcctggttatcatgtgattaatgccaccgatgcatctaactttactgtgtccaatttcttgcttggggatgattggttaccacagacaggagtgagttataccaataatttgatatag

SEQ ID NO: 62133 - DNA, 2046 bp, Glycine max
  Peptide Sequence Number=SeqID_178911
atgctctcatccaaacctccgcgccggaaagttgttccggcgaacggcgatgactccgccgacaaactcgaccagctcctcctctcctctgccatctccaacaacgaggacctaggcccgttcatccgcaaggccttcacctccggcaagccggaaacgctccaccaccacctccgccacttcgcgcggtcgaaggagtcagagatcgaagaggtgtgcaaggctcactaccaggacttcatcctcgccgtcgacgacctccgatccctcctctccgacgtcgattcactcaagtcctccctctccgactccaactcgcgcctccagcacgtcgcgcgccctctcctctcctcgctcgatgccttcgtcgagacgcgcaacgtctccaagaacgtcaacctcgccatcgactccgtccgcacgtgcgtcaagctcatggaggtctgcacacgcgccaaccgccaccttgccgacgacaacttctacatggcgctcaagtgcgtcgacgcgatcgagcgcgagtacttggaccaaacggcgtcgtccacgctgaggcggatgctggaaaagaagattccggagattcggtcctacatcgagaggaaggtgaacaaggagttcggtgactggttggtggagatccgtgtcgtgagtcgcaatttaggtcaattggcgataggtcaagcctcggcggcgaggcagagagaagaagacctaagaattaagcagcgccaagcggaggaacagagtaggctcagcgtgagggactgtatttatgcattggaggaagaggatgaagacggaatcatcgccggcgggatcggagaagacggcggtggagccgccgggtttgatttgacttctctgtgtagagcgtatcatattcaccagactttagggttagaggatcggtttaagcagtattattttgagaacaggaagcttcagttgacttcggattttcaggtttcgtcgatgactccttttctggagtctcatcaaacgttctttgcgcagattgcagggttcttcgtggtggaggatcgtgttttgagggccgggggtgggttgatttcgaaaatggaagttgagaacctttgggatattgctgttagtaaaatgtgttctgtgttggaggatcagttctctagaatgcaaactgccaatcatttattgcttattaaggattatgtgagtctgttaggagtgacgctgcggagatatgggtatcccattgatgcgttgcttgatgttttgagcaaacatagggataagtaccatgagttgcttttgtctgactgtaggaagctgattgcggaggcagttgcggctgataaatttgagcagatgttgatgaagaaggagtatgagtattccatgaatgtgctttctttccagatacagacttcggatatcatacctgcttttccctatgtggcgccattttcgtccactgtgccagattgttgtaggattgtgcggtccttcattgaggattctgtgagtttcatgtcatatggagggcagcttgagttctatgaagttgttaagaagtatttagacaggcttttgagtgaggttttggatgaagctttagtgaagcttatcaatacatcaattaatggggtttcccaggcaatgcagatggcagcgaatatggctgtcttggagcgtgcttgtgatttcttctttcgccatgctgcacagctttcaggtgttcccttgagaatggtggagagaagcagaaggaacttccctctaagaaaagctcgtgatgctgctgaagagatgctctctgggctactcaaagccaaagttgatggatttatgacattgatcgagaatgtaaattggatgggtgacgaggcacctcagagtggaaatgaatatgtaaacgaggtcataatttatttggaaattttggtttcaactgctcaacagatattgccttctcaagtccttaagagagtattacaggaagtttttgctcacatatcggagaagatagttgggactttagttagtgattctgttaagaggtttaat

SEQ ID NO: 62134 - DNA, 552 bp, Glycine max
  Peptide Sequence Number=SeqID_178912
atggctttctcggacacccaatcggcggaggcaaagacgatgaggagcaaccctcacccgcttcggaaaccgaacccggttcagtgtcagctgaacccgtggccgcacgcggccctcgtcgccgtcggcgaactccgacaggcaaacggcgcagtcctggagagagcggtgggtggcggcggagaaagtaaaagtgggaagggacttgatgacggaagggtcgaggcacgggtcgtcgagagaggcggcggcggaggaattggtcggaagcgaacgagagaagaggcgacggcggcgacggcggcagaagcggacgaaggtgtggaagaaaataatgattattataagaatgaagaggagaatggcggtgcccaccatgaccttgccgttgtgggcatacttggattcaacgtctggctccatagtagtcatgatgatggagaaagagtgaagagagtaacgtcaatttcacaatttgtaattttagtgggagctctgctgaaggaaaccgcaaatgagtgggcagtttccaaaagtcttccaacaacttga

SEQ ID NO: 62135 - DNA, 540 bp, Glycine max
  Peptide Sequence Number=SeqID_178913
atgtatcccactataaatcactgcctccatcctctatccattcctcgtcctggcagcagcctcacaggatctaaaaggaaagaagctaatcaacaaggtatgcacaatcgccccaagcagagacctctgcgttcaatcctctcatcggacccaataagaagccctaacgcagacctcaaggacttggctgttatctcccttagggttgctgccagaaacgcttccggcatcctcagcgacaccaaaatgttgatcgacgacgacaacctagaccccgacgtccaacaaggtttggctgattgcaaggagacaatcttggacgccgagagccagctcgaggacaccattgcttctttgttggttggttccgacaccgacgcacaggtttggctcaaggctgccgtggccgcaatcgacacctgcgacgcttccattcccggagacgacgacgttctctccgtcaagagtgccatgttccgcaggctgtgcaacattgccattgccatcagcaagctcttgaacaaaccacttaaattctaa

SEQ ID NO: 62136 - DNA, 2682 bp, Glycine max
  Peptide Sequence Number=SeqID_178914
atgaccgaaaagaagcggaaggagagggacgaaggtaaccgccgaagactgaagccgaagaagaagtcaaacactcaatggaagaagactggccctcgtttgccctcatctctgcaaaaacatattgaccgtttaaaccctaccacttccttcgacagcgccgattccgatgacgacaatgacgtttacgagtacgaggaagaacgggccgaagaggagtccaagaaaaacaagcgttacgactctgcttccgtcgacgatgaccttgctcaagaaattgagtatttgaagcatctagatgatgagaatgtgcaatctgatgatgaaagtgaggatgatgattacattgggacaaagaggaatgaaaatgctgcaagtgacgattctggagaggaagacgatggaaggcatgcaagaatgctacaagcaattactggcatgccgagtgaagcttttgaagagaataagaaaaagaaggtgatgaaggacactgttataccagagctgtatccagagtctgaatataatcctagtcgtgatgttgtggatggtgatggacgcattagcatagaggacctactgaatcctcttcgtgaaaagtctggttatggaaaacttaggaagagatatcaacaaattgagaagaatgctagaactattcatgtgccactttcaaaggcagttcaagcaaaggtagagaggaaggcagcatatgaagtatcaaagaaagatgtcactaagtggcagcatattattcagagaaatagagaggccccaactattttctttgatgaaaatgtagatctagggttttcaactgtaggagcaatagcttctgaatttgaacccagaactgaatttgagaagaaaatggctgctctagtttatgatgatgaagttatggaagctcataaaaaggatggttctaagcttcttgaaatgaacaaggtctctattgaagatgagaaggataggcaaaatcggattgctaaaatgcggagccttctttttcgtcatgaaatgaaggcaaagcatattaaaaagatcaagtctagaacatttcatcgtttgttgaagaaagataaattaaaggcagaagcttctcagatacaaatggaccctgaagctgctaaagaatatgccatgaaacaagagcgtcaaagggctgaggaacgcatgactctgaaacacaaaaaccataatccgtgggctgcacgtattatccagcgtggtttacataaccaagatgaaggaactcgtgctgctatacatgaacaacttcaaaggcatgctgaattgactagaaaaatgaagtctatgaagggtagcagcagtagcggggaagatagcagtgaagaggaagaggatgacaactctgctggttctgatcaggacatggattacaagattttgggaaaagctaaagaaaaaacaatgaaagtgttggaggaagaggaagaagttcccaaatcaggattgctttctttgccttttatgaggcgtggattggagaaaagaaaagaggcagctgttgaagaagctaaccttgctttccaagaatacgaagattccttgaagaagctggagaattctggtggctcagaagatccaaaagctgcttctaccagtggcagaagagtatttggaacggctaaagcccagatagatgccagtaataaggtaaaatcagataactgctatgatggcagtgatagtgaggatgacttggggaccagcaaaagtggcaacatagagaatgagggaagcgaccttttgcataaggatgtaaacaaggatttggtggtaattcaagatgacactgatactcaccaggaatcagtttttaagaacattgatgagattattaaaaagcctgggccaaaaactacatatgaagtttccatatttgtgtcagatacatggaaaaaggcaaaaaacaaaaatgaagaaataacgatgaagaagtctccaaagcttccagggctagttaggcaagctataaaagatactgaaaatgaatttagagaggatagtgacacagatagtgaaggacagatggtggatggaattctgtcttctgtttctaaagtaccttatgaacttccttctcaagaggagctcattcggcaagcttttgcaggcgatgatgtagaagatgattttgaaaaggataagcaggagatcctcaacgaagaaaatcctgagccagagaagcctctattacttcctggctggggccagtggacacatgtacagcaaaagaaaggtttaccatcttggatgctgaaaaaacatgaagatgcccagaaaaaaagggcagaagccctcaaaaagaggaaggatgctcagctaaataatgtgattatatctgagaaaatagacaagaaggctgagaaactacatactaaatcattgccatacccttttacttccaaagaggtctttgaacagagcatgcgtgtgcccatcggacctgaatataatccagcaactgcaattggtcctcttaaccggccggaagtggtaaagagaccaggggttattataaaaccaatagagttcaaagaagtgaatcctcatgaaaaaacagagcaacggaatggagataagcgtaagtttaagaaaaataaaggcaatgctggcaatatcatgaaaaaggcgaaggtgggaggaaaaagttaa

SEQ ID NO: 62137 - DNA, 3384 bp, Glycine max
  Peptide Sequence Number=SeqID_178915
atgttacgtggagaatcctcctcaaattctccgaatgcgtcttcgcgattgacctaccatgttttcttgagttttagaacagaaggcacccatttagattttgctaacaccttatgtacttcgttgcagcgaaatggaatctcaactttcagatatgataaacaaaaggaaagaggatatctgattttggaaaaacttcataaagtaattgagcagtgcctcgttgtcattgttcttctctccgagaactatgcttcttccacttggtgtttggatgaactccacaagattcttgaatcgaagagggtgctggggacaccagtttttcctctcttttatgatgtcgttccttccgatgttcgacaccagaaaaataaattcgctgaggctttcgaagaacatgcaacaagacctgaagaagacaaagtgaaggtacaaaaatggagagaatccttgcatgaagttgctggtttttctggctgggagtccaagaattggaaaaaagaagagctcattgaagaaattattgagtcggtatggacaaaactacgtcctaaactgccatcatacgatgatggactggttggaattgattcaagagttgagaaaatgaattcacttttgaaactagaattgaaagacaaagtttgcttcattggaatatggggcatgggtggcatcggaaagacgactctagcgagagttgtatttaagaaaatacgtaacaaatttgatattagttgcttccttgaaaacgtaagggagatttctcagaattgtgatggcatgcttagcttacaaggaaaacttctttctcacatgaaaatgaaagacttgaaaatacaaaatttggacgaaggaaaaagcatcataggaggtatcttattcaacaacaatgttctcctggtccttgatgatgttaatgacataagacaactagagaattttagtgtgaatgatcaaaagtggttaggccctggaagcaggattataataattacaagagacatggaagtactaagatcacatggaacagttgaaagttacaaaattgatctcttaaattctgatgaatcccttcaactcttcagtcagaaagcatttaaaagagatcaaccattagaacatatattgcagttgtcaaaagtggctgtccaacaagctggaggccttcctctggccattgagatgatgggttcatccttctgtgggagaagtgaatctcaatggaaagaatttttggaagtgaaagaatacacaaagaaagatgttgtgatggacaaacttataataagctatgatgggttaccgccaagttataagattttatttcttgatattgcatgtttcttcaatgggtgggtaaaagagcatgtgacacaaattctaactatttgtggccgttatccagcaaatggaattgacgttctaattgataaatcgctagcaacttatgatggatcacgtttatggatgcatgatttgcttcaagaaatgggaaggaaaattgttgttgaagaatgtcctatagatgctggcaaacgcagtaggttgtggtcaccccaagacactgatcaagcactgaaaagaaataaggaaaatgaattgattcagggtatagttttgcaatcgtcaactcaaccatacaatgcaaattgggatcccgaagccttctcaaagatgtacaatcttaaattccttgtaattaattatcacaacatacaagttcctcgtggcatcaaatgtctttgcagttcaatgaaatttcttcagtggacggggtgtactttgaaagctttgccacttggtgtgaagctagaggaacttgtagagttgaaaatgcgttacagcaaaataaaaaaaatctggagtggatctcaacatttcgcaaagttgaagttcattgatctgagccattccgaagatttaatagaaagtcctatagtttctggagttccatgtctggaaattttgcttcttgaaggttgtataaaccttgttgaggttcaccagtctgttggacagcacaagaaacttgttctattgaacttgaaaggctgcataaatcttcaaacccttccaacaaaatttgaaatggattctttggaggaattgattctttctggctgctcaaaagttaaaaagctccccaactttggaaaaaatatgcaacatttatcactggttaatttggagaaatgcaaaaatcttctttggctaccaaagtctatttggaatctgaaatctcttaggaagctcagtatttgtggttgctcaaaattttctaccttgcccaacagcatgaatgaaaatgggtctttggaggaacttgatgtgagtgggactcccataagagaaattacttcttccaaagtttgtttagaaaatcttaaagagctctcttttggtggaaggaacgaactagcatccaactcattatggaacttacatcaaaggatttcaatgcataggaggcaacaagtcccgaaggagttgatcttgcctactctctcccgcttaacaagcttgaagttcttgaatttaagttattgtgaccttaatgatgaatcaattccagatagtcttggatccttattatctttgttgggcttaaatctaagtgggaacaattttgttagtccacctactcgttgcattagtaatcttcataccctgcagagtttgaccttaattgattgcccaaggcttgagtctttgcctatgcttccaccaagtgctcaatgcttgggtacaactaatagtactcaaatgaaacccttgaattcagatgcatatatgctgtggaagatttatgagttacatatgaatcagacatactttttatatactcattctctccctactctgccccttacccacccaaattatttccataaagtgtgtgcttaccaaatggaagatagaccacattttttgttcatcattccagggagagagattcagaaatggaatgaagtgttctttctaattgatccatcacatcatccatataacaggctgggttctgattcagttgcatcaataatagtggatgtacctaactatcttgtgtctagtggatggttaggaattgcaatatgcctagcattggaacctccaaatatgcagcactcttctccatcacatgtgagtccacatcctgtgggaaatgaggatacgtgcatttattattgggcatgtaaagttcctcagggtgaacctgacttgactttccccataggacctaaatttagccactttgtttatgaatgcaacgaagagaaatgccaacttcaattgatattttatgtggagaatcattctaagccatggaagccaagaataaggaagtgtgctagcgttatgagattttgccaagaataa

SEQ ID NO: 62138 - DNA, 129 bp, Glycine max
  Peptide Sequence Number=SeqID_178916
atgcccgaaataccatactacgacagtgacagaatccgaaaccacaagatgacatcaaagagttacttgcagctggagagacaaaccgacttctgtaactcagctcgtgcttcaagcttcaagaattga

SEQ ID NO: 62139 - DNA, 1609 bp, Glycine max
  Peptide Sequence Number=SeqID_178917
atgaagttagaggtcccacaatttgatggtaccaaccctcttgggtggattttcaaaattacccagtactttgagtaccatggcacgctagaccgtgaccgcctcacgatagcctcattttacatggaagggcggacacttgcgtggtatcaatggatatccagcaatgcacagttcacttcttggctggcctttttacaagctttgcaaacccgatctcacaaatcgcatcattgggcttccgtcgcccttcctcctcaattgtttcatctctggtttaaccccggagattcgttgggaggtccagatggaggttccattggagttaactacggtcgtatagcgaacaacctcccctccgcggtgaaggtcgttcaactcctcaaatcccaaggactgacacgtgtcaaagtctacgacaccgacccggcagtgttacgggcactgtccggatccggaatcaaagtgacggttgatcttccgaaccagcaacttttcgcagccgccaaagctccctcctttgcatcctcatgggtcgaaaggaacgtcgccgcgtactaccctcacacgcaaatcgaatccattgcggtcggcaacgaggttttcgtggatccacacaacaccaccaagttcctcgtacccgccatgaagaacatccaaaaagccctcaccaagcacaacctcgacaaggacattaaggtttcctcccccattgcactctccgcgcttgcaaattcttacccttcctccgccgggtcgttccgacccgaactcgtggaacccgttttcaagcccatgctggactttctccgcgaaaccgggtcatacctaatggttaacgtgtacccgtttttcgcgtatgagtcaaacgctgacgtcatctctttggactacgcgctgttccgtgataaccctggagtggtggatccgggtaacgggttgagatattataacctatttgacgcccaaatcgacgccgttttctccgcgctaagtgctttgaaatacgacgacgttaagatcgtggttactgaaacaggttggccttctaagggggatagtaatgaggtgggtgccagcgtagagaacgctgcagcctacaacgggaatcttgttcgtaagatcttgaccgctgctgggacccccctcaggcccaaagccgatctcaccgtttatctcttcgccctttttaatgagaaccagaagcccgggcccacttccgagagaaactttggccttttttaccctgacgagaggagggtttacaatgttccgttaacggtggaagagctcaaggactaccacgaccgtccgtcggcgccggtgaacggcggcggacagaagaaggagacgccggcgcccgttgtgagcggcggggtttcgaagagtaccactgggaacacatggtgcgtggcgaacccggacgcggataaggttaagctgcaggcggctctagatttcgcttgcggcgagggaggttctgattgcggtccgattcagcgcggtgccacgtgttacgatcctaacacgcttgttgcccacgcttcgttcgcgttcaacagttattaccagaagcagtcgcgcaagggtggtagctgctatttcgggg

SEQ ID NO: 62140 - DNA, 2994 bp, Glycine max
  Peptide Sequence Number=SeqID_178918
atgggtggagtgaggatcaaggttgggttgcggaaaggaaaatgggctgacaacatcaagcatgaattttgtgcaaggaagattttcgaagattctgggaatgactcagcattctctttttgtcgctatcctcaaacgaagtcgtttaggttttcttcttttgcctttgctgccatcactgcttatgaagggaccgaagcaagtgctctacttgagtggagagctagccttgataaccaaagccaagcttctctgtcttcatggacaagtggtgtcagtccttgcaggtggaaaggaatcgtttgtaaagaatccaactctgtgaccgctataagtgtcacaaatcttgggctaaaaggtactcttcacactctcaacttctcttcctttcccaagctgctaactctggatatcagttacaaccgttttagtggaactattcctcagcaaattgctaacttgtccagagtttctcagttgataatggatgataatctttttaatggctcaatccctatctccatgatgaagttgtctagcttgtcatggctaaacttagcaagcaataaactttctggctacattcctaaggagattggacaactgcggagcttgaagtatttattacttggattcaataacctttctggcaccattcctccaacaattggaatgttggccaacctcgttgaacttaatctgtcaagtaactccatctctggtcaaattccttcagttagaaacttgacaaatttagaaagccttaagctctcagacaatagtctttctggtcccattccaccctacataggagacttggtcaatttgattgtctttgaaatcgatcaaaataatatttcaggattaattccttccagtattggaaacttgacaaagctggtcaatttgtccattggcactaacatgatttctggatcaattcctacctccatcggaaacttggtcaatctaatgatcttagacctttgtcaaaacaatatttccggaactattcctgccacctttggaaatttgacaaagctcacctatttactagtgttcgaaaacacacttcatggtagattaccacccgcaatgaataacctcaccaatttcataagcttacaactatctacaaacagttttactggccctttgccgcaacaaatttgccttggtggttcacttgaccaatttgctgctgactataattatttcacgggtccagttccaaaaagcctgaaaaattgctccagtctttacagactcagactagatggaaaccggttgaccggaaatatatcagatgtttttggtgtatatccagagttgaactacattgatctgagtagcaataacttttatggccacatttcaccaaactgggctaagtgtcctggtctcacaagccttaggatatccaacaacaatttatctggtggtatacccccagaactcggccaggcacccaaattacaagtactagtcttgtcttcaaatcatctaacaggaaaaattccaaaggaacttgggaacctgaccactttgtggaagttgtcaataggcgacaatgaactttctggcaacattcctgcagaaataggagacttgtctcgccttacaaatcttaagcttgcagcaaataatttaggtggcccggttccaaaacaggtgggagagttgcacaagttactttacttgaacttgagcaagaatgaattcacagaaagcattccatcagaatttaaccaattgcaatctcttcaagatcttgaccttagtaggaatttgttaaacggaaaaataccagcagaacttgcaactttgcaaagattggaaacactaaacctctcaaacaacaatctatcaggagccattcctgattttaagaatagcttggcaaatgttgacatatctaacaaccaattggagggttcaattcctaacattccagcctttcttaatgctccatttgatgcattgaaaaataataaaggcttgtgtggaaatgcctccagtttggtgccttgcgacaccccatctcatgataaagggaaaagaaatgtcatcatgttggcattacttcttactttgggttctctaattctagtggcattcgtggttggagtttcgttatgcatttgcaatcgaagagcaagcaaaggcaaaaaggtggaggctgaagaagaaagaagtcaggatcattatttcatatggagttatgatggaaaattagtgtatgaagatatcttggaagccacagaggggtttgatgataaatatctcattggagaaggagggtctgcatctgtttataaggcaatattacccacagaacatattgttgctgtgaaaaaacttcatgcttcaaccaacgaggaaacacccgctttaagagcttttacaactgaggttaaagccttggcagagatcaagcatcgtaacattgtgaagtcacttggatattgtttacattcacgcttctcctttttggtttacgagttcctagagggtggtagcttggataaagtactaaccgatgatacgcgtgcaacaatgtttgattgggaaaggagggtgaaggttgttaaaggtgtggcaagtgctttgtactatatgcatcatggttgctttcctcctattgttcaccgtgacatatcaagcaagaatgttcttatagatttggattatgaagcccacatctctgacttcggaacagctaaaattctgaatcctgattcacaaaatttaaccgtgtttgcaggcacatgtggatattctgcaccagagcttgcttatactatggaagtgaatgagaaatgtgatgtttttagttttggagtgctttgtttggaaataatgatgggaaaacatccaggggatctgatttcttcattattatcaccctctgcaatgtcatcagtgtccaatttgctgttaaaagatgtgttggagcaacgactacctcatccagagaagccagttgttaaggag

SEQ ID NO: 62141 - DNA, 105 bp, Glycine max
  Peptide Sequence Number=SeqID_178919
atgccaagtaaggacattctagaaggtggccttagttgttggcctcaccattcttcctcaaacgtaatcattgagcatgaacgaccttgttttgagccgggataa

SEQ ID NO: 62142 - DNA, 537 bp, Glycine max
  Peptide Sequence Number=SeqID_178920
atggattaccacagaggagctggagtcgaggtgagaatagctaggattttcaacacctacgggccacgaatgtgcttagatgatggtcgcgtcgttagtaacttcgtcgctcaggcactaaggaaggagcctttgacggtttatggggatgggaagcagactaggagttttcaatatgtttctgatttgagtagtgatggtgagcgcaagagtggtgacaatataataacggtggaggggctgatgcgccttatggaaggtgaacatgttggacctttcaatcttggaaatccgggtgaattcaccatgcttgaacttgccaaggtggtacaagaaacaatagatccagaggctaagatagagtacaggcccaacacagaggatgacccacacaagagaaagcctgatattagtagggccaaggagcaactgggctgggaacccaaggtggacctacggaagggactccctctaatggtttctgacttccgacaacgcatttttggggaccaaaaggaaggaacaacctctgcctaa

SEQ ID NO: 62143 - DNA, 615 bp, Glycine max
  Peptide Sequence Number=SeqID_178921
atgattggaatcctgcagttatcttctcaaaatgcggagcatgatgagatagattttgagttcttggggaacagaacaggacaaccttacatattgcaaacaaatgttttcaccggaggcaagggtgacagagagcaagaatctttctctggtttgatcccacaaaagcataccacagatactctgtactatggaacatgtatcaaattgtgtaagttcctagtggataacatcccaatgagggtgttcaagaacctaaacggcttgggagtgaagttcccctttgatcaacccatgaaggtatacaacagcttgtggaatgctgatgactgggccacaaggggtggattggagaaaacagattggtccaaagcaccattcatcgcagaatacatagggttccacattgatgggtgtgaagcctcagtgaatgccaagttctgtgccacacagggcaagaggtggtgggatcaagcacagtatcgtgaccttgatgcttctcaatggcgttggctcaggtgggtgcgcaggaaatacaccatctacaactactgcactgacagaagccgctaccctcagcttccacttgaatgcagaagaaaccgtgacatttaa

SEQ ID NO: 62144 - DNA, 418 bp, Glycine max
  Peptide Sequence Number=SeqID_178922
atggttctcacttctcaggagaggctcaacgacgtcgtgtcggatgagctcgaagttggggttcccaaaatggtgcatcacgttttctttcattccggtgaaaaaattgtcgacgacgatgacgctgtctcctcgggcaatcaaccgatccaccaagtgagacccgacgaagccggccccaccggtgacgacgatccggagccccttccgcttaatcccgagagggatttttcccacggaatgcacggagacgacgtcgtagcttcgggagttggtgggccagcgggggttgggaaggggacgatgatgggaggaggaagaagaagagggttgcgaggacaaagccgaggaggaggaagtggagacgctgttcgcggaggaggtagccgaaggagagccatggcttctgcggcttcgg

SEQ ID NO: 62145 - DNA, 582 bp, Glycine max
  Peptide Sequence Number=SeqID_178923
atgaccactcttacacagatatggatgacgttgctacttagcaacattccacccgacgaccacaatgccgatctcccccctacggaagtattagttgggatcacgcccacgagacacccagtggactcgaagaagtccaacagggccctggggtttccagctctagttacgggcctctgtccgtcctatagggtgctcgtcccccctacaaggtcatgccatcgtgacataggggtagcgcccacaagacacccagtggacccggaggagcccaacagggccctggggtttctagctctggttacaggcctctgtcagtcctacagggcgcccgtccccccagcaagttcatgccatcatgacatagggatcatgcccgcaagacactcagtggacccggagaagtccaatagggtcctggggtttccagctctgattatgggcctttgtcagttctacggagtgcctgtcacccccagcaaggtcatcaagccccctactaaccgagctttcatcaagaagtactgcgcccccaggcaggcgcagggcgagacaccacagcagcctggggatggccggtag

SEQ ID NO: 62146 - DNA, 201 bp, Glycine max
  Peptide Sequence Number=SeqID_178924
atgggcgtaacatcgaaggttgctgtggtggcgattcttaccatgactgttttcctggggagtgaaatgcaccgagatttggtagctgatggaggtgttttttctggtggttattcgttagttcttgttttacccaatgcatggtttgcttatggaaacaacattggtcttactggcgcaatccgctatacaatgccataa

SEQ ID NO: 62147 - DNA, 207 bp, Glycine max
  Peptide Sequence Number=SeqID_178925
atgtcgtggaatattcagagtcgaaatgcgagtgaatggaattcaatatcattcaaatcctcaaacaagatcattttgtcttgggaatgcaagttgtttgtcagcgatgaaattggaattgagggagatggtggaagagaagttgttgacaatgagatcgaggtggcactggagaagtcgttgccgatgaggttgaggttgcgataa

SEQ ID NO: 62148 - DNA, 555 bp, Glycine max
  Peptide Sequence Number=SeqID_178926
atggctagcagtgtcgttggaggtttcgtgactcaagcattcgtttttatgcttaaggattgttatggcaataagtttttcgaacttgaaaaagctattcgggattacacgtgcaccttagatccctatttccattgctttcattgttcgattggtaacattgattcattagttcacctagttatgatgctattgatgcacgataaagaagagggagaaaagagcagagaaattgttgccactgaggtcgaggtggcattaggcatggcacccgcgcgggaaatgcacggtgcgactcgaagaataaaaatgtgcaacaaaggctttcacgagtttacggctgaaacgaatcgtgaagaaagaacggtgaagaagaatcgaagacctcaaatgaaacggtctccgtggggatctgagttgcaggaagaattgtcatgtctaggtggcattgaagaagttgcactaaattggaatgccatctgtgagaattgccttgggtggcaaggagatagttggggagcgatagtatggtgtggaagatacgtaggagtgtag

SEQ ID NO: 62149 - DNA, 345 bp, Glycine max
  Peptide Sequence Number=SeqID_178927
atggatagtgagaaagagtccttatggagcttagttctaaaattgaaatatgaggacttggttggttcacctttttggagagtatgtaacttggactttgtggtggaggaacttggtggaaaggctttttttgaattcttgccaaaaagaaacattggttggagatattgggaagtgggaggttggtatatggagatggaggttataatggagaaggagacggttcaattgggagctaccaatgctggactcatttatgaaggagttggaggtattaacttggtgcctaatggagttgatatagtgttatggaaattaaagtggttcaatcgggttctcaattaa

SEQ ID NO: 62150 - DNA, 822 bp, Glycine max
  Peptide Sequence Number=SeqID_178928
tgtgacaagctaagggatgtcaacatgactacgaccgaagcattaaagcgggaaacaaagagggcccaaaaggaagaatggagcaggaacaagtaccgaggggctctatggggtagcaacaacgagctcaagcttagaagggtcgaaagggatgagtcaaggttggaaagcatgtataaggagaaggtaaacctagctgctagtcatgggcagagactagaggatgagcatgcgaaggtatcagctctgcaaatggaaagggaagcaagagaaagggtgatagaatcattgcacggggaggttgtgaaatggatggatagattttctctcactctgaatgggagtcaagagcttccaaggctgttagctagagccaaggcaatggcggatgtatacctggctcccgatgaagttcatgggcttttcgattattgccaacacatgatagagttgataggaagtgcaagagcagatgaaggccaacatggaggccttgaaggaccaaataacctccatgatggaggccatgatgagtatgagaaggatgatggaggacaatgcgactgcagttgccaccaccagctccgccgcttaggcggatccaactcacccatctggcataaaccaaacaagtcatccagccccagatgtggtaggtctgggaggagaagtgtggggaagtacgggcggtccccatatggtgcaaaaacgccaaccacttcgttcccgttctccttgaaagccagcaaccccaattggggcatgcaccctttgctcaacctatgggagaagcccatgaagagccctgggaccatgctctgg

SEQ ID NO: 62151 - DNA, 912 bp, Glycine max
  Peptide Sequence Number=SeqID_178929
atgcaagagcgtgcggggctggccattgtgtttggaagacatgaaaagagaatgagtagacgctcgagcagaactgtctacgttgggaatctacctggtgatatccgtgaaagagaagttgaagatttgtttctgaagtatggacacataacacacattgacctaaaggttcccccaagaccacctggttatgcatttgtagagtttgaagatgctcaagatgctgaggatgcaattcgtggtcgtgatggctatgattttgatgggcaccggttacgggtggagcctgcccatggtggacgtggtcattcatcctcaagagatcgatacaatagtcacagcaatggccgaggtggacgtggggtgtctaggcgctctgaatatcgtgttctagtctctggattgccctcttcggcatcctggcaggatcttaaggatcacatgcgtaaggcaggggatgtttgtttttctcaagtttttcatgatggaaggggtactaccggtattgtggattacacaaattatgatgatatgaaatatgctatcaagaagcttgatgactctgagttccggaatgcattttccaagggatatgttcgggtgagagaatatgattcaaggcgggattcctctagaagtcctagtcgtggcccatctcattctagaggaaggagctatagccgcagtcgtagccgtagccgtagttacagtcgggaccggagccaaagcaaatctccaaagggtaagtcttcacagcgttcacctgctaaatctccatcaagatctccctctcgttcaagatcaaggtcccgatcgttatcaggtctgttgtttgtgttgaaaggcatcaaaggctggaacttgtttcatttacacccttctttcattgaaattgaaagtcatagagattag

SEQ ID NO: 62152 - DNA, 162 bp, Glycine max
  Peptide Sequence Number=SeqID_178930
atggccaatttgcatcttatggtaaatgacgtagcagtggaagtgctagaaggtgatcctagaaatgttctttgtgatgccgtggaaaagcatcatgcttcaatgttggttgtgggtagtcatagttacggggctttaaaaaggtcatataggagagtatga

SEQ ID NO: 62153 - DNA, 829 bp, Glycine max
  Peptide Sequence Number=SeqID_178931
gctgagggccattgaagggggcaaagattatgcttttgttgacatgacagagttatgcctagtacccgacgtggtcattcctctgaagttcaagatgctgaattttgataagtataaggggactatttgccccaacaaccacctgaagatgtactataggaaaatgggggtgtatgcgaaagatgagaaattgttgatgcatttcttccaagaaagtcttactgggtatcagtacaattctaatatggctccgggtagaatgcagctacagaacttgtgcaagaaggagcatgagttatttaaagaatacgcccagaggtggagagactcagcagctcaattagtgcccccaatgacggagaaggagatgatgacaatgatagtggacacgttaccgttgttctactgtgagaagatggtgggttacacaccttcaagctttgtcaatttagtttttgccggcgaaaggattgaagtgggtctgaaaagaggcaaatttgatcatcctgctttgatgaataggaagcttagggcaaatggagagaatgagaatgagggaggaacccatgttgtgactgtcgttcctacatggccacatttcccaccagctcaacaatgttcaatgaggtccttcaatggtgattttccaccatggagatgcagcggaaggcaaaggagaagaggagaggggaggcaccatccactagggaataagccatggaagaaggagcttcaccaccaaggatgtgcctttgataagaagcttgaagaggatgctttaatggaggaagagaaagaaagaagggggagcatgaaattgaaggaataa

SEQ ID NO: 62154 - DNA, 411 bp, Glycine max
  Peptide Sequence Number=SeqID_178932
atgctccattgccatatccacaccttgtcactctcttttttcgccattttcaaattccctcttgattttgaaacttatgttccaatcaagagatcttttttaattggtgttgctgtgattgcttcttttggttactgcaaagagcatgatggctcttgggtcaaaaagggtgctcaacccgctgatgaagaaggaaacctaccagttgaagataattcctctcttcttcaaaggcttttggacgagtttgatggtcttcagacttttgttggtgacaagtttgatgccatggaattgcaagtcgacatgcggttcgatgccatggaatcaaggatcaccaaagttgaagaagatgtctccttcatccgtacttgctttgatccaccaccaccgcctccatcatcatcttag

SEQ ID NO: 62155 - DNA, 165 bp, Glycine max
  Peptide Sequence Number=SeqID_178933
atggcggacgatgagcaccagaacgtgaattcgcttgctgatctaccagctacaacgaaagcatccaccaaatctgggctcacacattctctcacaatcaagcttgatgagaagattttctcctgtggagtcaacagatttccgttgcaatttgcggtcgattga

SEQ ID NO: 62156 - DNA, 225 bp, Glycine max
  Peptide Sequence Number=SeqID_178934
atgggtctctgtcagttctacggagtacctgtcacctccagcaagggcatcaggccccctactaatcgagctttcatcaagaagtactgtgcccccagtcatagcaggacacacctagttgctcatgatcctaggaatttaaataaaacaagcacaagctcggaaggtagcaaaatacctcatggaaaaaagagagcaaaaggagagcgagcaagaaaaggataa

SEQ ID NO: 62157 - DNA, 651 bp, Glycine max
  Peptide Sequence Number=SeqID_178935
atggcgaggacatgtagtcctctcaaggcgaggatgtgtagtcctctgaaggagagggcgagcagccctctgaagacgaggacgtgtagtcctctgaaggtgagggcgtgcaaccctctgaaggcgaggatgtgtggtcctcaaaaggagaaggcgtgtagccctacgaaggcaaggacgtgcagtcctataaaggtgagggcgtatagccctacgaaggcgaggacgtgcagtcctctgatggcgagggcgtgtagccctctgaaggcgaggaagtgttgtcctctgaaggcgaggacgtgtagtcctctgaaggtgagggcgtgcaaccctctgaaggcgaggatgtgtggtcctcaaaaggtgaaggcgtgtagccctacgaaggcaaggacgtgcagtcctataaaggtgagggcgtatagccctacgaaggcgaggacgtgcagtcctctgatggcgagggcgtgtagccctctgaaggcgaggaagtgttgtcctctgaaggcgaggacgtgtagtcctctgaaggcgaggaagtctagtcctctaaacgtgagggcgtgcagccctctgatgatgaggacgtgtagtcctctaaaggcgaggacgtgtagccctctaaaggcgagagcatgtagtcctttgaag

SEQ ID NO: 62158 - DNA, 207 bp, Glycine max
  Peptide Sequence Number=SeqID_178936
atgtcacttaaggacaagccaaaagaagagaactttcaagtagtcgatgactcgctcagcgaggcagatccgctcggcaatccgctaagcgaggcatatagctcgctcaatgggttgggaaaccctacaagaggatcagtcagagatgtgtttgctcagcatgcagccagcctgcccaacgaggtcattgtctcttcttgcgcttag

SEQ ID NO: 62159 - DNA, 189 bp, Glycine max
  Peptide Sequence Number=SeqID_178937
atggaggcaccgagtggtggagccacacttaaggtgcagagcgcgcggatcaaggacgtggatctccacctcttttcccctcttttctttaattcatttgggagaagattgggcatcgactttacggaggagaatccgggacgatgggttagggaagaccaaggtccggccggggctaggggttcgtaa

SEQ ID NO: 62160 - DNA, 300 bp, Glycine max
  Peptide Sequence Number=SeqID_178938
atgatgggagtgaaagttatattttgtgcaaatgtttcgactgtcttgcttagagcgagtgactcgctaagcgagcactcagtgacgtttgaattttcaggatttaaactcatgcgcttagcgggacaggctcgcttagcccaattcgaaatagtggggtcgcacttagcgagaaggtctcgcttagcgcaatgccgttccagagagagttttgggcttagcgggtatgacccgcttagcccaattgacatgggggtccaggcagagagtgatttgcgcttagtccacagatgtgcttag

SEQ ID NO: 62161 - DNA, 402 bp, Glycine max
  Peptide Sequence Number=SeqID_178939
atgagatgggatttccattcgattagccaacaggaatctgtccttgttgacttccaccggaaatccaatctaccggttacggaaattcctaatctaatcaggatagtctatctccgtataggggaaaagctctccactcacaagccagcaatagaagctatgccccagcttttttacccaaccagacctaggaccagcaatgcctgtcaaagaaagaagtacagcgagtcaatctcggataatctagcaagagcttctagcgcaagggagtaccagatagagcttcaacaatcttccatgtcactcggaaggcagatcaaggtagatgaaccactaccagatgcttcaagccgtttggggattgacaatggaagttggtcattctcttcccttcctgtgtag

SEQ ID NO: 62162 - DNA, 739 bp, Glycine max
  Peptide Sequence Number=SeqID_178940
atggcaacgagtttgccaaaggcaaagcaagtgttggtggttgaaatcgacgacagtgatttcagcacttacgctctccaatggactctggatcacttgctagcccctgcaaatattcctaacttcaagctttttcttgtttatgcaaggccttctgttacctctactgtcggttttgttggccctggagccgctgaggtgttgcctgttgtcgaggccaatttgaaaagaacagctgcaaaactctctcccacactaaccctctcctttcactcgcgccttcttctctccttccattcgtcgttgtcgagaccctcgaacctctgcgccctctctcactcaagctttcactgtgccctctgtctcatgaacttttgcgaagctacaccgtcacagttcctctctcaactctctccgtcaaagctctctgtgaagtgtttcttttccttccataaaagggatcctaatgtgtttgcgcaacttctagagtatgacaaacgttttgggcaatatggaagtgagtacacattttatgactacaatcaccttaaggatattccatcagaattgaagcattcctacaaagttgtagttgctgatcctccttacttgaaagaaaaagcagcagagatcttgggcttgcatccttgtggttttagtccccaacactccagcaaacttggaaatgagtttcggatgttctcaaactatgaccttggaatgagactaggagggcaag

SEQ ID NO: 62163 - DNA, 588 bp, Glycine max
  Peptide Sequence Number=SeqID_178941
atggaatcgagagctccaagtgggccatttttgggaatcgggttaaaattcctgaaccgggacgtggcggctgacggcaacgttagggagtccggagacgtcggcggtggccccggaaagagttatcttttctgtttaacaagcctgcccaccctggaaacggctcagccggaggtagggtccagcggctggaagagcacgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 62164 - DNA, 627 bp, Glycine max
  Peptide Sequence Number=SeqID_178942
atgatgtcagttgaaaggataaaacagttcacaaatatctcatttgaaccagcatggaatatgaaggatcatcttcctccttcaaattggccagttgaagacaatgtagatatcaaagacttgcaggtcagatatcgtccaaacactcctctggttcttaaaggcattactttaagcattagcggaggagaaaaggagcccgtcctttttgaaggaactgtcagaagcaacattgatccaattgaacagtacatagatgaagaaataaggaagtggcagataatggagagaactggagtgtgggggcagagacagttgctttgtctaggagggttatactcaagtgaagccggctctagtttatggatgaggcaactgcttctgttgattctcaaaccaatgcattgctctcagaactcccacagtcatggacttcgacaaagttttagttggagtgcggacttaaacgtataccctgctctagttggagtgaaccaaatggagaccggggcctctagtcagccatcactgccccggcaagctcgatgtcatggccaaatagatagagactctgatgaaggctcagacacagctcatgtagcctgctccatcaccccctatttgtga

SEQ ID NO: 62165 - DNA, 251 bp, Glycine max
  misc_feature (245)..(245): n is a, c, g, or t
  Peptide Sequence Number=SeqID_178943
atgactttcactcttttaaaaaaggttttgggtgaaaacagtaaaatagtggatgggaaatgcaaagcccttgtacagtttgtaaaattgggttgggccaatatagttacgtctgagtatattctagaaaatgattcaacgcagggaagtcgtcatcccgaggttaagtgggctcagaggcttgacaaggtctatatcacggtgcaattggctgattcaaaaaatgcaaaagtggatcttacgcncagatg

SEQ ID NO: 62166 - DNA, 591 bp, Glycine max
  Peptide Sequence Number=SeqID_178944
atggtcttcttctcttcctccgcaactctaacctacagaaacccaacttctgttcatatggaaaccagtgcggccatggatgtcgaggaccaaccttcacccaactccaacaacgttaaacgcttcggccttaaaaactctatccaaaccaatttcggtgatgactatgttttccaaatcgtcccaaaggaagattggagtgcaatggcggtgtcactgtcaacgaacgcagtgaaactctattcacctgtggcgggtcagtattttggagagttcaagggtcactctgaaaccgtcaatcagatttcgttttcgggtccttcaaatccccatattttgtgttcgtgttcttctgatggcaccattagagcttgggacgctcggacatttcagcaggtttcttctatcaatgctggtccttctcaggaggttttcagcttctgtatgggagggactagtggaaatttagttgccgccgggtgtaaatcgcaggtactgttctgggattggagaaatatgaagcaagttgcatgcctggtggactctcatgtggatgatgtcactcaggtttgtgctgttcaaattgcttga

SEQ ID NO: 62167 - DNA, 282 bp, Glycine max
  Peptide Sequence Number=SeqID_178945
atgcaacctttgattggccgtttcaagatacttggcaccctttgttgcacaatatgcccacttgggccttccagattcttcctccagaaggctgttgcttctggaggaagcaaccttgctcgcctgggcgagctgggttgcaagctcctcccctattttgctataaatagtgggaggagtgaagagggaaggggttcagccttcttggcacttcttattctctcgaaattgctgaggaaaattgtttccgtgaagaaaatccaagccgaggcgcttccgtaa

SEQ ID NO: 62168 - DNA, 144 bp, Glycine max
  Peptide Sequence Number=SeqID_178946
cgttttgctgctgtcattatgaggataagagatcccaaaacaactgcacttatttttgcttctggcaagatggtttgtactggagctaagagtgaacaacagtctaaattggcagcaaggaagatggagtctctggtgaaataa

SEQ ID NO: 62169 - DNA, 273 bp, Glycine max
  Peptide Sequence Number=SeqID_178947
atgtcacaaaactttacggattacacaaccatcccctcttcggcttctggaatgttacggaactttacagattgcgcaataatgtttcctttcgactctcgacatgtcgcagaacttcacagattgcttaacgatgggtgtcaagttcctcgaagcggtcaagcgaaggttgcaatcaattcatgggactccgaactcgatgatggaggatgcacaaacagcgctaggcaatcaatttgtgaggctccagactcaatggtggaggatgcatga

SEQ ID NO: 62170 - DNA, 159 bp, Glycine max
  Peptide Sequence Number=SeqID_178948
atggaagacaagtttggaagcatgcatcatgctataatggaatctcttataagccaaatggaatacaagcttatatcaaactgtccctccacttatcttgaacctaaagacaaagaccttggaacaagcgaagttagttttgttgtgaagtatatataa

SEQ ID NO: 62171 - DNA, 339 bp, Glycine max
  Peptide Sequence Number=SeqID_178949
tatgctcgtattatccaaaagcttggcttcccagccaaatttaaggatttcaaaattcagaacattgtcggctcttgtgatgtcaagttccccatacggctggagggtcttgcatattcccatggtgctttctcaagttatgaaccagagctgtttccagggctaatctaccgtatgaagcaacctaaaatagttttgcttatatttgtctctggaaaaattgttctaacaggagccaaggtgagagatgagacttacactgcctttgaaaacatatatcccgtgcttactgagttcaggaaaaaccaacaatgtaaagtggcagacgttgtctattga

SEQ ID NO: 62172 - DNA, 641 bp, Glycine max
  Peptide Sequence Number=SeqID_178950
gtaacgtcatccgaggaagacctgaggaggacctggaggagctacctcctgagcctgctgtggatgcccttgactttctagagggtgatgaggatccacttcttgaggtggattctcccgaggaagtcatgtcggcatctgaggcagactctacggaggatatagagaaacaactcttatctgcatcagaccgatttggcattttggatgattcatttgcactttgtatggctcgccaggaatcattgacctccttgattaacttgatgggatcttacagggaggaagttaattataccgtgttgtctaacctgatgactacaagtcttaaagttcaacgtattgcagctgatgcaataccagactttctagaatatttcatgcagttctttattaacctttttcagtactctgctgagaggcttgttgttgtgtgttgtgggcttgtttgggtcaagttgatgaaagctacagcaattgaaatcgcgctgagtggctaccctcgtaacacacgtgtcgatgaagctcagcctgtgccagccatggtggaggtagaggcggtggcttcggaggtggtggtggtggatgtggcggcgggcgttgacgttgatgacgaacaaagcaaagctgagtctcagtag

SEQ ID NO: 62173 - DNA, 636 bp, Glycine max
  Peptide Sequence Number=SeqID_178951
atggtgttgaaggccgtcagcaagcctacgctagagaaaaacggttacgcggtgcacgtggagtgcaaggtcgctatcatgcgccaactacgccacccgcacacaataagcctctacgaggtcctcgccacgaggaccaaaatctacttcgtgatggagttcgccgtgcgcggcgaactctttcacgtggttgccgtggaggccgtataccatcatcagaagtacttctggcaactcctctcttccatgagacactgtccctcacacggcgtataccatcgcgatttaaagctcgacaacattcatttcgaccaagacatgaacctcaatgtctccgacttcggattgagcgcgttgaggagccggatccaacacgacggcatgttacacaatttgtgtgggacccctgcatacgtggcgcccgagattctcgcgaggaaggggtacgacggtgccatcatggacgtgtggtcgtgcgacatcgttttgttcgtgctcaacgctgggtacttacccttcaatgattacaatgttacgattttatataggaagatcaagaatctagtgacgaggttgttagacacgaatcccgagacaaggattgttatgaacaaaaactattatatgttatgctaa

SEQ ID NO: 62174 - DNA, 606 bp, Glycine max
  Peptide Sequence Number=SeqID_178952
atgttccacagtatggtccagacgggagtaaatcctagtgttcacagctacagtataatgattaatggattatgcaagagtaaaagggtggatgaggccatgaatctcctaagagaaatgccgcataaaaatatggttcctaatacagtgacatacagttctcttattgatgatggtttatgcaaaaaccaaaaccatgacaaggcaattgcactattcatgaaaatgaagaaacggagaattcagccaactatgtacacatacacggcacttattgatggattatgtaaaggtggaagacttaagaatgcacaagaactttttcaacatctcttggttagaggctattgtctaaatgtctggacatatactgtcatgatcagtgggctttgtaaagagggcatgtttgatgaagctttggccattaagtcaaaaatggaagacaatggttgcatccctaatgctgtaacttttgaaatcattattcgttctctttttgagaaggatgaaaatgataaggccgagaaaattctccatgaaatgattgctaaaggcctattacgttttaggaattttcatggtgagcattctccagttacaaattaa

SEQ ID NO: 62175 - DNA, 492 bp, Glycine max
  Peptide Sequence Number=SeqID_178953
atgggttattcttatagcgatggatcatacatctcacaactattggttgagtacataaaaaaacttgatgccatcgttgggaatgcaatcagcgaaggaaagtacatcgtatttggaagtggctcaaccctcttctcaatgctgctgtttatgccttgtctccctactcttcaatgtttccagcaaaagtgctccatagagaccaaattaacgcaaatttttaattctagggattttagttatgaaggagacacatccttgtggaaaaacaacacaaatagcagcttcagatttattgagtttgtgacttcaccaaacaatccagatggaaagttgaacaagggagttctcaaaggctctgatgtgaaaaccatttatgatcgagcctattattggccacatttcactgctatttcttcaccagctgatgatgatcttatggtgtttacaatttctaagctcacaggccatgctgggagtagattttggtga

SEQ ID NO: 62176 - DNA, 525 bp, Glycine max
  Peptide Sequence Number=SeqID_178954
gtgagcccatacactggaaggatccacttgtatacttgcattttgggtactgataaaagaccacagccacttcatgaaaattttcgaccagaggaacttgagttgttaagttctgttgctgatgatgagaaacaggctcatgatgagaaacagaaaacagagtttgtaactgtgaaggacaaccccgcatataggcatgctcttatggcttttgcagaagagtggaagaacttgaggtcaattgaacgcaggaagttacttggaaaaccattacaacttcctttggctgttgaattatgctacttgagtgaaagcaataaccacaacaacaagggattattaaatggtggaagtaaaagacgcaggacgcccttaatggagattagctatcctttaccatcagatgctgtttggagaaaggtatctctgcgaagtggccttggtaaaaaggaaaaagaatacactcaaggctggagtgtgacagatgagccactctgtaagctttgtcaaaagcagtgcctgtaa

SEQ ID NO: 62177 - DNA, 933 bp, Glycine max
  Peptide Sequence Number=SeqID_178955
atgtcattctcactattctcactgtcaagaaggttaagctcttctctctctctttccattcccaactttcctccttttcttccaaaccccactttccctctttgctttcactctcagcctccatccattgacaatgttgttgatgatgctgtttcccagttcaatgacatgctccttatgcgtcgtactccgcccatcatcgaatttaacaagattttaggatcccttgcaaagctgaagcattatctcactgtcatttccctttctaaacaaatggaagtcaaaggaattgagccatgtcttgttactttgaacatcctcatcaattgtttctgccacttggggcaaatggccttttcttttgctgtgttgggcaaaattctaaaattaggttatcagccgaataccataaccttgactacactcatgaaaggtctgtgtctcaagggtgaggtcaagaaatcactgcactttcatgacaaggtcgtagcactaggatttcagatgaaccaggttagttacgggaccctgctcaatggactctgtaaaataggaggaacgagaagcgccaacaagttgctgagaatgattgaagacagatcaactaggcctaatgtggtaatgtacaccaccgtcattgatggcttatgcaaagataaacttgtaaacgaggcttatgatttatattctgaaatggatgctagaggaatttttcctaatgttatcacttacaatactctaatttgtggcttttgccttgcgggtcagttaatggaagcatttggtttattaaatgaaatgatattgaagaacgtcaaccctggtgttaatacctatactatattgattgatgctttatgtaaggaaggaaaggtgaaagaagccaaaaatttattagctgtgatgacaaaagaaggagtaaaacctgatgtt

SEQ ID NO: 62178 - DNA, 999 bp, Glycine max
  Peptide Sequence Number=SeqID_178956
atggttcatatgtttcaaccccagtcagtgatgaaagcatataacctagccaaagtgtatgaatcagcggctatgcaaggtactgcagccacactacctagcaagaacaaatctacagtcccaatcaaatccttgttgggacccaaaccactagtagtaactaaaccagagttcatgaaaaccaaaccaagactcaccaagaatttgacaccagcattcatgagtgaaagaagggtcaaagtgttgtgttatttctgtgatgagccattttttgtggagcatggcttgacacacaagaaactacaaattcaattcatggaggttgatgacatagaggaggacactgttgagatagaaaaccatgcgggggaagttgcaacacattttgaggaggcacaaatctctgtcaatgccttgacaggggttccaaattttagaaccatgtgtgtcatagggagatacaacaaaaagcctctacacatacttattaatagtggcaacacccataacttcttagatgtccatgtagctgcaagaattaggtgcaagattgaagatcttaaacctctcgtagtcatagtggcagatggcacaaaagtgcaaatatcttcagttggcagaagacatgtattaaaaggttctaatccaagcaactgtaaatcagtcaagagcccaactcttgacaaaatagtgaacaatagtgtgcacttgtctatgatccaagtagggattgaagatggagtggacattcctactgctattgaacggattctatgccaatatgcagatgcgtttgtgacacctacacaactaccaccaagtagaggtgggcatgatcacaaaatccctctcttgcaatctactgaactagtcaacaaaagaccttataggtatgccaagcaacaaaaggatatcattgataagataatccatgagatgttggactcaggaatcattcaaactagcaacagccctttgttagtcgtcatttacgactaa

SEQ ID NO: 62179 - DNA, 606 bp, Glycine max
  Peptide Sequence Number=SeqID_178957
atgtctgaagaagtgaatatgaattatgaaaatgaagaagaatgtgatgtgaatgtaccacatgtcgattgttcagaagcgtttaatacttctcaggtgtttgacagccgaggtgatgttttgcggtgggctcaatccattgcttatgaaaatggatttgtggcagtgattgtaaggtttgacacatacagaggtagtagaggaaggacttcgtttgtgttaattggctgtgaaaggagtggcgagtataggtgtaggaagaaagaatttgttagaagagacactaggactaggaaatgtgaatgtcccttcaaatttcgtggcaagccagtggatggagaacaaggctggatggaaaacactgtacatcccatcggcgatcgaagactgaactggtgcggccaattcaatttcagaaagaagcaagatgataaaagcagtgctggtgttgaacacggaggggaagcctcgtctcgccaaattctaccaatttcagatcagtctgtggagaagcagcatgaagctattcgcaatgtgttttcagtcttatgctgtagacctgaacatgtcagcaattttgtggatgccgagtccttctttggcccg

SEQ ID NO: 62180 - DNA, 153 bp, Glycine max
  Peptide Sequence Number=SeqID_178958
atgtatgtgagcttgatatcgtgttcaactataatgcataccatactagatgagatcattctcggaggccaggtgttggagacaagttcaaacgaggttatgaaggctattgaagaaatatcaaggtgctcttctttcccatctgggttttaa

SEQ ID NO: 62181 - DNA, 468 bp, Glycine max
  Peptide Sequence Number=SeqID_178959
atggaggagattcactctgcatgtcaagatgcagtaaatggagtaccatcgagaagaccggttattgagatgacaattccctctgtactggacaaaactatttctccacctggtgcttcattatatcttatctatcctcctattcaggaatcgtttgcacaaaaatgcttcaagttgattgatgaatatgcccctggcttcagcacatcaatcattggttacgatatgctgactccaccggaccttgaaagggaaatcggtttgacaggagggaatatattccatggagctatggggttggattcccttttcctcatgcgacctgcaaagggatggtcaaactacaagactccgcttcgagggttatacttatgcggaagtggggcacatcctggtggtggtgttatgggagcacctgggcgtaatgctgctcgtttagttcttcaagaagttggagaaagaacttaa

SEQ ID NO: 62182 - DNA, 273 bp, Glycine max
  Peptide Sequence Number=SeqID_178960
atggccatgagccatgggcgcctgtatcaacaaaggatgaagaacgtgttcgacaagaaggtgcgctcgcgcaagttccatgagggggaccttgtgctgaaaaaggtgtcccacgctgttaaagataatcgagggaagtgggccccgaactacgaagggcctttcgttgtaaaaagggctttctctgaaggagccctggttctcaccaacatggatggcgaggagctaccttcacccgtgaactctgatgttgtcaagcgatactacgcttag

SEQ ID NO: 62183 - DNA, 328 bp, Glycine max
  Peptide Sequence Number=SeqID_178961
atgagaactgttatcactgactctgataaaccagcgacacccagggagggccgtatgaaccagaacaaggttgttttactgatgttagctatcgccatgagcggatgcgccgagcgccccaccgccgtctcccccgcaacgccgccgaccgacgtcaccgtttcaccgccggctgtgcaaccgcagatggacgccagcacccgcagcaagctgcatgagatcctcgcgctgcgcggcggttggcacgccacgcagccacatggccgcaccgtcgatttgatttcgcgcgagtttctcggcacgccctatctcgccaaccgcctgatcg

SEQ ID NO: 62184 - DNA, 684 bp, Glycine max
  Peptide Sequence Number=SeqID_178962
atggcggccgataaatcagtaaccgatttcgctattgaacggcaaataccagaacagcgcgatttcgtgatcggcgatctccggctcggcgcggtacagcaaacggtcgatgccgccgagaataaacccgtaatgctgcgccccggcgatgccctgacggcgcgcgtgagcgctgaccgcgatctcgtcgatcagggtgtaaccgttccagtttttgctcagcgtgatgtggccaacggcttggtcctggcgatacgccaggaaagtcgcgctgtcttcgttggcgaacggcgccaagggatactgtttgcgaaacggcgccaccgggcgggttggccagctgtcgaccggggtgtcgaactgcggcagggcgtaacagcggatggtaaagccgaaatcgccgcgcgtcagctcccgcagcaggcgcgccgggttgccggcataaatccccttgcgggtgatgttgcgggtcacgaccgccccggcgccgatcaccgcgtcgctgcagatctccaccgccaggatggtggcgccggagccgatggacacacgatcgccgacgcgcgtgcgcccccagctggccggatcggcattgggcgcgccgtctttgaacagatcgttggcgaaggtgacgccgtggccgaccaaaacacgcttcgccgagggttacgtattcgcaaataa

SEQ ID NO: 62185 - DNA, 279 bp, Glycine max
  Peptide Sequence Number=SeqID_178963
atgagaaggggtgagaagcccctagtttctggaaatcacgatgaacacactaagcgccttgctgcactaagcgatttcatcgcttctattgaagattatggatttccagatgaatgcgctaagcccaactaccgtgttaaatggcttctcgtaagagaaaagctccagcttcagtgtcccgggcatgatatgatacatcaagacttgtatccaaagatgcctgggatcgttatgcagacaatgtccttggccgaaagatccttccggaaaggaatgtga

SEQ ID NO: 62186 - DNA, 441 bp, Glycine max
  Peptide Sequence Number=SeqID_178964
atgttggtggaactgaaaaatggggagacatataacgggcatttggttaattgcgacacatggatgaacatccatctgcgagaagtcatttgtacatctaaagacggagatagattttggaggatgcctgaatgctacatacgaggcaatacaatcaagtaccttcgagtacctgatgaggttattgataaagttcaagaagaaaccaagagccgtgcaggtgatcttataaggagggacaaaggaagattgcaagatcgcaaaccacctggtgttgggcgtggaaggggaagaggcagagaggaaggtcctggtgggcgcccaacaaaaggaattgggcgtggtcttgatgatggtggtgctaggggagctggaggaagccgaggcaggggtggtcccagtggaaagcctggtggaaacagagggcgtggtagaggttga

SEQ ID NO: 62187 - DNA, 115 bp, Glycine max
  Peptide Sequence Number=SeqID_178965
atgtctaaggccaatctctctcggttgagaagtgaccctgtaaggattgctgctttctgcttcaagaacctgaagagaactgaggtccttgatactgacatttcttcagctgttg

SEQ ID NO: 62188 - DNA, 507 bp, Glycine max
  Peptide Sequence Number=SeqID_178966
atgtcaagtgtttcttttcttttggccttgttcatggtagtagctttgtctatctttccttccatagtgggtgcaataggtgagcaccggctaaggtgggtgcctgagacaacaacaccatgccaaagctccatagaagagtgcatggcagaaggtgagtttggaatggattcagagtcccaccggcgcattctagcgacctcacaatatataagctacaaggcacttcaacgtaacaccgtgccatgctctaggaggggtgcttcctactacaactgcaagccaggtgcagatgctaatccttacactcgtggctgccccaccatcacccgttgccgcttctattttgatctgaaatcaacaacaataagctttaggctagactatgtttctttcgggcaccatgttggagcctgctccatgagaacgggacgtgaatcaaacttctcagagcactattacagcaaaatagaatggggctgtgtaagatatccacaaaaggactga

SEQ ID NO: 62189 - DNA, 456 bp, Glycine max
  Peptide Sequence Number=SeqID_178967
atgagcgagatagggggagacaaagaaaacaacctgaaagttgccatttcaagggataagggagggcaagtgcaacatgatttaggggtagaggtagtacatactagtgctacatttgaaaaggaggggacctcccaatatttgaccgttgggattgaagacaaaaaatttgagctatttgggcttaaagcccaagaccaaaaaattcaaagcactaaacaacacaaacaaaaagcagtgatatctgatggtgttgttagttctagcaaatgggataaattcatggaaaattccaaatgcccaacatgggtgctagacatagaaagaaatacagagttgaaggaggaagcattgggtgcaacttttaccaacttggatgaggggcctataaggagttccaaaaacatcaaaagtgggattagaagctctagtgaagggcatgtttcgggtgactag

SEQ ID NO: 62190 - DNA, 396 bp, Glycine max
  Peptide Sequence Number=SeqID_178968
atggaattgatgtgccattgttcgagctttcttcttccgccggagaatcctaacacgacgtgttcgctttctctaaagtacgctctcgttgttctcaaccaaagcctaccgagatttgctcctctgctctgggaccacggtatctcaccctgcacccaccgcacccccttcttcctctttactatattgattcatgcattgatgtatgtctatgtggttgctacagctcaagtacgagtttgcgctgatggaggtgccaatagggtgtatgatgaaatgcctcttttcttccctcatcaacaaccttcccatgttcgcaccaggtacaagcctgatgtaattaaaggagacatggattcaatcaggacagaagtacttgacttctatgcaaagctg

SEQ ID NO: 62191 - DNA, 726 bp, Glycine max
  Peptide Sequence Number=SeqID_178969
atgggtgatgaccccctttctaaattcagtcagaaaggattgttatgtttttggaatgaggatgattttgttttacaaaattctattagtggtaatggttatattggtttggaaggcacttggctagaaggtaatagacaagttaccattgttaatgtttattcaccttttgatttggaggggaagagagcgttatggctagaattaaaaaatctcaaagctttgtcaagcaactcaagatggtgtgccacgtgggatttcaatgcaattaggaggaggagggagagaattggagtcaataatgtttctcaaggaggaagagagatggaagacttcaatcaattcattaaagacttggagcttattaatgtacctttggttaggaaaaagtatacttgtttccaaccaaatggaaaagaaaaaagtcatattgatagggtgttgatctctagagattggttggagacttggcatagttgtacacaatgttggggccctaaatcatttagggttctcaatggttggtttcaagataaaagattccataaggtggtaaaggaagcttggttgaatcaaaatgtagtgggttggggagtttatgtccttaaagaaaaattaaagggtattaaggaggtattgaaaatatggaacatgaagagaaggaaaaacttattgaagagattgcatgtgattgatgttcaggtggaggaattacttcgccaatag

SEQ ID NO: 62192 - DNA, 1383 bp, Glycine max
  Peptide Sequence Number=SeqID_178970
atggacatcgaagtttctccacaaaatagtccaactgatttactcctggaaagctgggataaatttcaaagcagcatatctgcctttcaagaaaaggttccgattgaagatgaaaggcttagtgttattccaccaaagtcaaaaaatcttgatgcaactcctcagtctaagtttcaaggcgttggaagaccaaaacaagattctgctacaccagagtcaatgcatgtttctacaccagctgtgagggaacagcctcccttttcaaggaaaagaagagttggccttgatagaatgattgtcctgtctaacaaggcagttataaagaacataaagagtgcaaaagacttagtacgtttccctttcccaagagaatcccgccgtactttacttaatgcacactgtgtgcagagacagagagaatctccaatttccagtcttcctaatagattctacgagcctttgcttccttgttcttcctctgagcttcaactcctattctctaaaaagaaaatgaaattacctaattcccttaagattgtggaaactccagggaatttagatgtgccagaatctccaattgctggcactccactaagcccttctcaatcctcagattcccttgaaattgaggaaactcgaagggtgttagatgtacctgagtctcaggcttctggctttccaaagcataaagcaactgattcacagactcctcctttgagtcaacatgaaaacatagagatagaatctctagaaacgaatgaagtgcctaatttgatggatgagaatgactccttatcagtggtgaacaactacaacaacattttgaaaagacattggtttgtgacatatgagaagaagtttagtggtaacatccttatgggtaacaatgttccttgcaagtttgtaggtataggttctatacaaatcagaatgcatgatggtgttgttagaaccttgactaaagttcgtcacattccagagcttaagaaaaatcttgtatttgtgggtgccatggatttgaaatctttttcttattgggttgaaggtggagttatgcatatcaaagggaaagggaagtttgtgtggcatccatgtttaggccacataagtgaaaaaggtatggatattctaaacaagcgagaattacttggaaatcacaaggtggaacctcttcagctttatcaacattgtgtctacgggatgcaacattggatgaagttcccaaaggttgtgcatacaacaaaggccatgttggactatgtccattttgactattgggggtcttcaagagttccatcattgggaggagcaatgtatttcctctccatcattgatgattactctaggatgacatgggtattcatgatgaagcataaatcttaa

SEQ ID NO: 62193 - DNA, 423 bp, Glycine max
  Peptide Sequence Number=SeqID_178971
atggatgttgtatcctatagagtgcttggctatcttcttgttggcattataagaatattctctaaaaaggttgaatatgtgcttgaggattgcaatgaggttctcattaaaatcaataaatttgtggtcaacaaagaaggcattgtccgtgtggaaaccttgcgcatgcctgttactataccagacagattagagttggatgtttttgagttagatgaacttgaaaatgttgacagaggccacactgctcctccggaggaaattacgcttagagacaaagaaaatgtgtgtaaaacagagggatttgggctgttttctcacgagaagctcttcactaatatatgccaaatcaacttctgtctaatgaatgctctttgtcttccctgtgtatatctgtctgtatcagtcggattcaagaaataa

SEQ ID NO: 62194 - DNA, 438 bp, Glycine max
  Peptide Sequence Number=SeqID_178972
atgttaatgttatataaacgatataatataattgatcgtataaaatgtgacaccactaccttaactgtcatccaacacgaggaatcttgcgacccacatgaacagaagaagtggtccatgcacatgctagctaggctagcactctacatgttcacccttcaagttctactgccacccttggaaacccaaagagcccagcatagccagaatatgaaacctcacgtttctggtgaaagctctaatttggccaaggagtctagcagatccgtcggagagaagctccaccaggtttgtaaggctgccatggtggcaatcatcaccgatggatccaaccaacctagcagtagtagtaggcttctcaccaatcaaaggttgagcctccaatcagaagacccaattagaaccttaatgttcttggtctcttggagtcacacatag

SEQ ID NO: 62195 - DNA, 804 bp, Glycine max
  Peptide Sequence Number=SeqID_178973
atggccaccgtaatcgacggcaaagccgttgcgcaaaccatccgatctgaaatcgccgacgaggtgcgccagctctctcaaaaatacggcaaggttccgggattagcggtggtgatagtagggaacagaaaagattcacagagctatgttggaatgaagagaaaggcatgcgctgaattgggaatcaaatccttcgatgtggaccttcccgaacaagtctcccaagctgaactaatcaaacaagttcaccagttgaatgctaaccctgacgtacatggtatattggttcagctcccgttgcctaagcacataaatgaagaggaagttctgactgaaatcagccttgagaaggatgcatgtattgaactattacaacgaagtggtgtaagtattaagggaaagaaagccgttgtggttggtagaagcaacatagttggattaccagcttcattgctgcttttgaaagcagatgccacagttactattattcattcacacacaagtcagccagaaagtatcatacgtgaagcagatattgttattgcagcagcaggacagccgatgatgatcaagggcagttggatcaaacctggagctgcagtgatagatgttggcacaaatgctgttgatgacccaacaaagaagtcaggttacaggcttgttggagatgtagattttggggaagcatctaaagttgctggttggattactccagttcctggtggtgtaggtccaatgacagtcacaatgttgctgaagaatactttggatggagccaagcgctacattgaacaaaataattga

SEQ ID NO: 62196 - DNA, 1101 bp, Glycine max
  Peptide Sequence Number=SeqID_178974
atggcagggcgtgaagtgttggtcacagccgtgccgcgagcaataccggcatactgtatgagcacctttctaattcccatttccttggcggaggagatccagcgcatgattaattcgctttggtggggctgtaaccgaggcgaaggaagaggcatcaagtggttgagttgggatagattggcggtgaggaaagagtttggtggtatgggtttccgacacttttttgggttcagcctagccatgctagcgaagcaagggtggaagttagcttccgacccagatgctataatttcgagagttttcaaagctagatactaccctcaaggggtcttcttggaggcttcgttaggccatatccaaactatgtggcgtagcatccaagcttctcaggtggactcaaatggaagggaatcagcatttgagatccgtgatatcgatgaggtgttcaaaatacccatctgcaaggagctaggggaagaccatgtcatatggaagttgagtagatggaaggatctctggaagcttcaagtgccaaacaaggtgaaagtgttcctttggagggctgtccgaggatgccttcctacgcgtctaagacttcagactaaaggggttgtgtgtacagtgcaggtggacagtgcagatagttttgatgatctgattttcagattattagctagcatttcaaaagctaagataagccaagtggttatgctgatgtgggtcttatggtggagaagcaatggtaaagtgtgggaggatgctgacagatccccctcagtcactgttcgcagggccacaaattgcttaactgattggggaaagtgtcatagaaggagagttagtgtgcctcaacgtcaaattagtcctcctcagtgggtaaagcctccactggtttttgctaaatgtaatttggatgctgctgtttttggtaaccagagacgttttggtcttggtatgtgcttgcgtgatagtttaggcagattcatcattgctaaatcagttctagtagaagctagggaggcacaatttcatgctagcaaccagctttttgagaacattcctgcttgtattcaggatcttattatatctgatatgaattaa

SEQ ID NO: 62197 - DNA, 756 bp, Glycine max
  Peptide Sequence Number=SeqID_178975
atgctctcactcgaaccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttcttttcctccgcttattga

SEQ ID NO: 62198 - DNA, 195 bp, Glycine max
  Peptide Sequence Number=SeqID_178976
atgttgattgtggaggatggatttgatgaacggacagatttggatttggattatggagcaggtttagagggcgagtattgtgttggcgactggcgtgctgctgtgatgagatgtgatggtgcgcagtgcgcatatgaaccgtcgtgtgcatctgttcagaaagcacgtaccttttcggaccgggaaagaatttag

SEQ ID NO: 62199 - DNA, 363 bp, Glycine max
  Peptide Sequence Number=SeqID_178977
atgcagcagtggtaccgccaacgccgtgcgtcacgtcactgtgggcatcctaaatcgtcactaggactggcgatatcactgctgcatgactatcttgccatcggcggtttgcctttctcgccaactgcagtggcaagtccactgccacggttgtgcgcacgagacgattttgtcattattgttggcgttttacatggattttacgtagtaaaacagtcttatgttgaaatttgttttaaaagagccccatttttaaaaattagtttgaaaaagaagctctatcaggacaattggcctgcggatgagttttgggaaaccggaaaccagctatccttccctatttcgttgtattgctatgtctga

SEQ ID NO: 62200 - DNA, 399 bp, Glycine max
  Peptide Sequence Number=SeqID_178978
atggagtgcgacgtggccggacgaggcgtagacgtcgaggatggagttgcggacgcagaggtcttggtggtggccgagtttaaggacgtgggtgtggacgcactgcgcttgcgtgacgtggcgggtgtcggagagggacttgaagaggggagggaaggtgaagttgttggggaggacggagttgaagcgcatgcgggtgtagatgaagagagggttgtgtggagtttggttttgggaatgggagaaggctctgatgagggtgttgaaggtgtgaacgtgggggtggtgaagagaacaagagcagtgttgagaaggccgtgtgattggcacgcgccgatgaagtgttcagcgattctggttacagttacactctcagtctcagaacccttttatatttga

SEQ ID NO: 62201 - DNA, 540 bp, Glycine max
  Peptide Sequence Number=SeqID_178979
atgggtagacaaattgaccagcaagaatcactgaaagagctaggaaagcgcagaagattatggttaccacaagatataattcaagttttaaaagacaacactaacttgttaacatgtatgaggagaaacttggggatgctggctaccatctcttcaagcttcctcaaaccaacaatcgcggagacgttagttacccccttggtacaaaacccaaaaggtagtgttccccaagagtttctgattgtgaacacccacttgttattccctcatgattcaagtctgactgattttgagaggacaagtctaagcagcttagtcaagggacattcagggtatgaatctttggcactagacataagtggtggacaccttgcagctggtgtggcttctctcttcatagatggagtaggttgtggtgcctgctttcagttcggtccaagcaaatcatctgattcgacaagccttcgggacatagaggaccttatatataaattccttgttttcatgctggaacactcaatgcgcgaaaaagatggatga

SEQ ID NO: 62202 - DNA, 939 bp, Glycine max
  Peptide Sequence Number=SeqID_178980
atggagaccaaaactgctgatccattattttctgtccaaaccttgaaaggaagaaaagctccaccaagtcaatacacatttaaaatcaagtccttctcatggctttccaaggccccggtacaaaaatgtacctcggaagagtttgaagcagggggttataaatggagtctgtctatttacccaactgggaacacaaaaggaggtggtgaaggtcatgtttctatttatttggtgctcatggactcaagttcgttacctgttgattgggaggtcaatgccattgtaaatttttctgcatataattttattgacgatgagtatgttgcaactcaagatacaaatgtaaggcgtttccatgtgctgaaaactgaatggggtgtcgcaaaattcattgacatagacacatttaacgacccttcaaatggatatctgatggacgatacctgcgtgtttggagctgaggttttcgttgtcaagaccacgactaaaggcgattgtttatcaatgattcatggtcctatccctctttcccatagttggaaatttgataacttttccttggcaaaattagacaagtacgagtctgaatcgtttgtcggtggaaactatagatggaagcttattttataccctaatggaatcgttgagggaaagggcaacagtatctcgttatttttaactttggaagtctcaactctgccccccaacactaaactcgttgtggagtgcactttgcgcgcaaaaaaacaaatcagtgggcatcatgctcaaacaggattttgtcgtaagttctccagctcaaattcgacgtgggggaccagacagcttgtggccttggctaaacttacagaccccaatagtggttttttggtgaacgatacttgcatccttgaagctgaatttacgattcttggcctaatgacgccccgaattgattga

SEQ ID NO: 62203 - DNA, 768 bp, Glycine max
  Peptide Sequence Number=SeqID_178981
atgcctcatagggatgtcgtttcctggagcattctgatcacgggatacaacagcgttggaagctacgcgatgccttggttgtctttgaacagatgcagtatgcgggtgtgggagagtggaagaggggttgaatgtgtttggagcatgaaggagaagaatgtatttacctggaatgccgttattaaagggctagctttggccaagagtggacaagaagcaatttggtggtttaacagaacggagaaagatggagttaaagcagatgaagtgactttgttggcagtgctaactgcgtgcagtcactcgggtttggtggacaagggtcgagagatttttggtttgttggttgatgggaggtacggggtttgtcctaatgtcatacactatgcttgtatggttgacatgttggcgcgttctgggcttttgaaagagaccgttgagttcatgggatctcagggtgacttggagttggccctgctagcggccagaaagctcattgaattggagccggataacactgcctattatattcatctatcaaatttgtatgcggtgatgggaagatggagcgatgttgagaaagagagggggttgatgaaggatagacaactgactaaggactcgggggatggtagaaattgctcaccatacttgtgtcaaaagcctcctgttgttttgagtttactgtcattcactgggaaagtaagcgtcagtgttcctgttgaggccctccaactgttgagctttctgaaaattgccaaccattga

SEQ ID NO: 62204 - DNA, 357 bp, Glycine max
  Peptide Sequence Number=SeqID_178982
atggtcattgaccagtcccttttccatgacttaaccaaattacccagtgacggtgtaccatttgaagcttcttttggttatcgcaaagagcgtgatggctcttgggtcaaaaagggtgttccacctgctgatgatgaaggccacataccagttgaagataattccactcttcttcaaaggcttatggacaagtttgatggacttcagacttttgttggtgacaagtttgatgccatggaattgcaagttgacatgcggttcgatgctatggaatcaaggatcactagggttgaagaagatgtctccttcatccgaacttgctttgatccaccaccaccgcctccttcatcctcttag

SEQ ID NO: 62205 - DNA, 2625 bp, Glycine max
  Peptide Sequence Number=SeqID_178983
atggattctcgttgcattgatgacaaaaaagaagacaatgaaatgaaatctgccgaagaatttgaagatatatttggagatccagaagtgctgcctcgtgttggagaggagtaccaggctgaaattccttcattagttacggcaccttatctttctcagcttgtaaacaaggcaagagattcagaaatcactgtcatcgagaaagagtctatgtcactaggattgcccattcctcttaagtgggcacactgcaaatttgaaggtagttgtggttgtgggacttcagaatctttcacaagtgaagcagggccaattatttctgagaatgaatgtccggcggttgaagtgacacttcagactgtttcacatgtaggagggttctcaaattttgaatcatcttctaaaagtaatgagaagaatcagccaagagggaagtatcttctccctggattgttggatgatcaatcttggacagatattgaatacaacagttttcttcttggcctctatgtatttgggaagaaccttaaatttttgaagagatttgttgggggtagaactatgggagacatattgtttttgtattatggaaagtttttcaagtctaaagaatattgccgatggtcagagtgccgaaagttgagaactaagcggtgtatatatggccaaaaaatattcacaggatggaggcagcaagaattgctgtcaagattattttcccgtgtgccaggggagtgtcaaactacattggttgagatttcaaggaaatttgtggagggaaagatgccttttgaagaatatgtatttgctttaaaggatgcagttggcattgacttgcttatagctgcagtaggtattggaaaagggaagcaagatctcaccggcactgctgttgagccaacaaagaccaatcacacattctctgttcgccctgaaattccaattggcaaagcttgctcctctcttacacctgcagatgtaatcaagtttctcacaggagattttaggttgagtaaagctcgatccagtgatctcttttgggaagctgtttggcctcgtctgttagcaaaaggctggcattctgaacagcctatagatcaagttgtttctggatcaaaacaatctttggtttttcttgtacctggtgttaagaaattttcaagaaggaaactgataaaaggtgaccactactttgattctataagtgatgttttgaataaagtagcatctgaccctgggcttcttgagactgaaagtcaagcaactgagggcagtgtagatagggaaaaaacagaagacaaaggagacctagagggtgtgccaaatagggaacaagttcattaccttcaatctcaaagttcaaagagctatcaagatctcacaaaatttactattgtagataccagtatggttcatgatatgaatcagcgcaaagtgacacagatgagaagcttaccttttcaaactataagtgtatctaccatcccaagctgctctagtgaatctgagcaagatacatctgaagaatcagaagatcaggctgaacaagataatgcttcaagccctattgaagatcgggttgaacaagataatgcttcaagccctattgaagatcgggttgaacaagataatgcttcaagccctaacaaagataaacttgaacaagctaattcttcatatcctattcaagaccaggttgaacaaggtcattcctcaaaccctattgaagaattctctgataaggggttgagcatagactcttcagattgtactcatgttcctgaagccctcaacaccaccaatgaagtaaaatatcatagatgtcattctgatctgcataatgaagagcattcaagggagatcaatgagcatccctttattcaaaagatgacatcaatgcagaagttaagagcttgtaaccatggagaatttaaccactgcactgaaagtacttctgtggatagaaagttcgatttaaatgagccaatctcaccatcaaatctgcatgaagaatctgatggcatggttttgtctatgggtttagaaaatttgcctttcccaagttatctggctaaaggcagtccaaacatgagcaatgaaatcagtgtcactgagaaccacctggtcggagaagtttctgcagaaaattctgaaaccaggatgttgattgacttgaattttcctcaagtttcacctgagttaggacttgaaatggaaattccatcctctatggtcagaatgcaaaatgacaatcaatgtgcaaatacatcatcttctccatctgagataacccagttcaatgccgcacaggagtttcctgatggtaataaggagcagcagtctagccttgtcaaccgtcgccagagcacaaggaaccggccattgaccacaaaagcattggaagctcttgagtacaggtttatcaattcaaagaggaaaagaaaaaacacagaatgttcagacaataacacaaagtccaaatgtgtacgtgtaagtagtgggacaattattagtgccactagtgataatggcattgaggattctatggctgatacaagagcagaggaagagaatgttatccaggcatatagttgtagcatcaatctgaatgaaggttcactataa

SEQ ID NO: 62206 - DNA, 484 bp, Glycine max
  Peptide Sequence Number=SeqID_178984
atggggaagaagttcatcaagaaagtcagcaccaacatcaacaaagccaacttcatgactcaagttcaggaccatccgctaatggatgcatttgatgaaacagatcctaatgctgaagttgttgtcttatcaccaaccacactaatggcaacaaatagattcgtgtgtgagatctgcaacaaaggatttcagagggaccaaaaccttcagttgcaccgcagaggtcacaatcttccgtggaaactgagacaaagaacaagcgctgaggtgaagaaaagggtctatgtgtgccctgagccatcatgcgtgcaccataacccagctcgtgcactaggggacctcactggcatcaaaaagcattatagccgcaaacatggtgagaagaaatggaaatgtgacaagtgctccaaaagatacgcagtccaatctgattggaaggcccaccagaaaacttgtggcactagggaatacaaatgtgattgtg

SEQ ID NO: 62207 - DNA, 495 bp, Glycine max
  Peptide Sequence Number=SeqID_178985
atgtgttggtctttgttgaatttgttcgttgacctcttcaaggatgtgtatttgaccactttatgttcaacttgcattgactatatgagagtcagcttgagagcttctgtgtcttccttggggcaaaaggatatggtgaactttatggaccttctgttgtccccagcttctaaggttttgaacaactggtttgagacagatgttctgaaggcaacccttgcaactgatgctgtgataggcagtacagccagtgtccacaccccaggaagtggctatgtgctgctacatcatgtgatgggcgaaactgatggggaacgaggaatttggtcatatgttgaaggtggaatgggctcaatatccaaggctattggtaatgctgctattgaagctggagctcatgttgtaaccaacgctgaggtatgctatcaggaatctctattaagtttcaaatatacttcctccactgtcagcagtgcatcaaatttcacattctaa

SEQ ID NO: 62208 - DNA, 735 bp, Glycine max
  Peptide Sequence Number=SeqID_178986
atgtctcaaaacctcctatttttttcggaagcagctctagactcttctgcagctgcagttaagagcttcgtggacatggctaccaaaaatccacccttcaagataattctgggctcttcttcaaaggcccgcagagagattctttctgagatgggatatgagttcacagtaatgactgcagacattgatgagaaatgtattaggagggaaaagccagaagatttggtaatggcattagctgaggcaaaggctgatgctattgtgcaaaggctccctactggaggcccattggaggaagatgcttctacaacactgttaattactgcagacacggttgtggtgtatcgaggagtaataagggaaaaaccaactagtgaaaaagaagcacgtgatttcatcaaaggttttcataatggatgtcagttccctgcttttgttgcggttattggatattctggtagtcatgcagcagtggtaggatctgttgttgtaactaaccttgcaactggaaaacgttgtgggggctgggacagtgcagaggtttacttccttgaaattccagatgaggtcattgataatctgattgacgaggggattacattcaacgttgctggaggtttgatgctggaacatccactgacattgccctttgtggacgcagtagttgggtcaactgataccgtgatgggactttccaaagctcttacagagaaactcttattggaagcactataa

SEQ ID NO: 62209 - DNA, 288 bp, Glycine max
  Peptide Sequence Number=SeqID_178987
atggcgagacatgatccatgcaatgctgcctcgtcaagtgaagaaatccagcacaacagccatgtcatcatcctcctaagctccattgtcgtccccatgggcccctgtgggtcctgcccctatctcaaaatcaggctcatccccaggctaggcaatcgtggccccgaactgctcgggggtaggccattggaaaagactggcgtgctggctctgctggccagtcacattttgcatgtacctgtgcatctagagctttatccttcacaagtgagtggagatggactctag

SEQ ID NO: 62210 - DNA, 774 bp, Glycine max
  Peptide Sequence Number=SeqID_178988
atgccgttagagcctgggcagttggagaatcggaggttggaggaaggcgcatggggcttgttattggcgaggaggtggaaagcagccatgggaagcggagtcgacatgggtgcggggcatggaggtggagtcggcatgggtggtaaagccctaggtgaggcggttcacgacctcctccaagtggttggtggtcgtctagcgggtggtgtgttctggcatgacaagggcaaaggtagaggcagggtggatggctgtgtggagaggttggaacggaaagaggtgggacacaaccatggggggcaggtcggatcaaattgttatgaactgaagactctagcctatcagaatcaatcctcctttccttctaaaaatcaaggtggtagtgagagtcgttgcagtcattggggtaatcctaaacatgttgtagataactacttcaagctccatggatatccagattggtgggataaccttaatgaacaaaaatctcatgattggcgtaatcagaaggatgtagacaaaagggatagcaaagtcgcaatgatgatgccacctctttccatgttgccatccattacactaacttcaacactagtaacaactatgcttactggtaatgtcaaacttgctcttatgagcactgatacaatcaaggacaccagatggattattgattcaagtgctactgattacatgacgtttgataaaggacatagttatgttgacaccttcattatcattagaacacactttacttgttccctctatctctaa

SEQ ID NO: 62211 - DNA, 864 bp, Glycine max
  Peptide Sequence Number=SeqID_178989
atgacagagggaagcgagggaccgatagaggaaagggagattgccatcgccatccctaatacgtccccgtgcaatactggaaacggggaacaccacctagcaggtgtgcccgtgcttcatagcttggaccaaccaatgaaatcccttaagcaaaccctcaccagtgtatgcactatccatacaagatgttgtagtgctttatgttatttggtgtttggacctttgtcattttgcacctcaagtatgctatatctatatccttcgagtatgatgaatgatatcaatatgaatttttcaccaatatcagtcgcttattatagaagttcaccttattctcgaatacaaggccttcacctaccttcagttcataacaatttggtccgacctgccacccatggttgcgtcccacctctttctattccagcctctccacacagccatccaccctgcctctacctctgcccttgtcatgccaaaacacaccactcgccagacaaccacgaccgcttggaggaggtcatgaactgcctcacccagggctttatcaccttatcccaaaactacaccgctttgaacaataagcttgactccatcttggatcgcctccttgtgctcaccctggtccctacttctcctaagtcaccaccaccagatgcacccatgccgaatctgcttcccatggctgctttccacctccccgccaacagcaagccccatgtgccttcctttgacttccgctttttccaccgcctgggctccggcgacattagctctatctacctcatcgaactcaacggcagctccctctcagttattatcgctgccaaggtcatggtttcactaatggcaccgaaggatgtgtga

SEQ ID NO: 62212 - DNA, 210 bp, Glycine max
  Peptide Sequence Number=SeqID_178990
atggttgtcatagccaaatttcatccggggaccattgttgatcgcttcggaagacttaacactcatcgcggtggaatccgtaaagtttcgcccttccggaacattttggaagttgggttgcttaaggaggaagtaactgggcagcaagctcctccacgttgttcaaaaatggtttctagggcttccggaacttccgtaatgcttccgtaa

SEQ ID NO: 62213 - DNA, 291 bp, Glycine max
  Peptide Sequence Number=SeqID_178991
atggcacctccagactctagtccttcagtagagcagtttaatgagacggtacctcaacatgtggaggatgagtcatctgaggccaccatccatgagccatttgatataggagaagaggcagaggagacacaggtgagacaggtagctgttgccactcctgagcgatccattgaggctacttcagagccttctccaccaatggtaaacctaccctcacctcagcctgcagcaaacccctccactcctcttctacaaattccagaggacccgactacaccagtcctagcttag

SEQ ID NO: 62214 - DNA, 699 bp, Glycine max
  Peptide Sequence Number=SeqID_178992
tatccatggttctattccggaatgccaaaggtcaaagatttcatgaaagtcatagatgaacagtttcaaagttctgagaaggccttggctagaaccctaatgtctaagttgtcatctatgaggctcattggagttacagctgaatttaggatttataattcaaatgaaaagaagctggacctaaggaccattagtgcatatttcattggttatgctgaaaggtctaaggggtataaattttattgtccaactcatagcactagaattgttgagttaagaaatgcaaagtttatagaaaatgatgtggccagtggaagtgatttaactcaaggcattggtcttgagaaaaatcaatgtgagggaacagttcctacatcaaatccagttgaacaacatcaaacacaaaatgttcagctacctattgaacaacatcaaacacaagatgttgagcaacctgttgaacaacaaccagaagagtctcaatttgactttggagttgaaaatgatcctgagtcattttcgcaagtgattaatagtgatcttgttgagttgcctaatgggatcaagcctattggatataaatggattttcaaaaccaagaaggattcgttaggtaacattgagagacataagacccgattggttgctaaaggattcgctcaaagggaaggagttgactacggagaaaccttttttcct

SEQ ID NO: 62215 - DNA, 597 bp, Glycine max
  Peptide Sequence Number=SeqID_178993
atgtccgcaacagctttgttacagaaagcagcacaaatgggtgccactgcaagcaatagtattaactccccaatgatgcaaaaaggctttgttggtggcactaccactggtcctgatcatgtttctttcactactaggccaccatattatggtgctatgcttcagcacaacaactcctatgaccacttctctccacagcatgatctttccaacatggctggggtgagtggtggaggagcattcatcaatcaattgtttcataaaggacaagaaatttcacaagtttttgacactaacactacaatgaatggtgtgggaatgttcagccaaatgccaatggggagtgaacacaatcacaaccaagggttgatgaagaatgtggaacaagaggttagtaatggttccagtttgatacatgtaagagatgtgagtgatggtaaccacacaatgcagccatcaaggtttggagggagtgacatgacaactgttcatgacttcttggggattggtggttcaacttcaagagttatgaatcattttcatcaccattttccacacgaggattcggctattgaggaacccatgtgggatgtttga

SEQ ID NO: 62216 - DNA, 279 bp, Glycine max
  Peptide Sequence Number=SeqID_178994
aggatcccggcatccatcaagaagtactgcatccccaggcaggcgcagggcgagacaccacagcagcctagggatggccagcagcgggcaacaaacgcgctgccaccacctctagagtcacctcagctcatccacaaaaaggttagagcattgcctacgacacatggccgaccaataggcgaccaagtccaaagccaaagtaggacacacctagctgctcatgatcctaggaattttaataaaacaagcacaagctcggaaggtagaaagataccttag

SEQ ID NO: 62217 - DNA, 3363 bp, Glycine max
  Peptide Sequence Number=SeqID_178995
atggctgcctcaaaagtaattcctgaaattcacccgggtcccgaacatggcttaattctctctcatcccatccgactcagtactctatctaactttctctctccagaattagctccgagccaaaccctaaccagttcggttcccaactgggaatcggtgagaagcattgagagattcattcaatcacctcaagttaaatgcgtgttgctacgcattgcggcgaagcaacttcgatcaacgatggatgcgtggaacgaagatttttcggagctggagattgggagctccactgaatcgttccagaagtttttggtttcgcagagagagcttttccacagccagatcgatcagtttcaggaaatcgtcgtcacgcaatgcaaactcaccggcgtcaatcctctctctcaggaaatggcagctggtgctttgtcaataaaaattggaaaaagaccgagggatttattgaatccaaaggctgtaaattacatgcaatctgttttttccattaaagatgctattagcaagaaggaattgcgcgagattagtgctttactcggtgttacagtgacacaggtgcgtgactttttcaatgctcaacgttcaagagtgaggagatccgtgcagttgtcaagggagagggcactgagttctaattcttgtgaagaacctcatgatgatcaaataaactctgatcctatgagaccaataaatccaactcccttaaactctgctggcctgtccaatactgaagaagcatcttgttcaacacaggaagtgactttgtctgacctagatgactcagataaacaatttgttgatagcatttttagtttaatgcaaaaagaggagacattttctgggcaggagaaattgatggagtggatattgacgatacagaatttttcagtattgttgtggtttttgagcagagggggtggaatgaatttagcaacttggttgagcaaggcagctgttgaagagcaaacaagtgtccttcttcttgttttgaaggttctttgtcatttgcctttacataaagctgttcccatgcacatatcagctatattgcagagtgtaaataaactacggttctacaggacatcagacatatcaaacagggcaagggttttgttgtcaaagtggagcaaactatttgcaaggaaccatgtaataaagaagcccaatggtgttaagacttctagtgatggtcataaagagatgatgctttctcggaggcaagcttgcattttatctcttttctgtgcacaatttgttgggacctcctttctcaattattgtgatttatatttttgcagtattggtcaacttatgggctctgaatcatggcattcaaatattgatgttcctgaagacattcttgctctctcaagtgaatgttcgaataatttcaggaaaataggatctccacaaggctatatctctttgatattccttaacaccttatcagaatctagagaacgcagaaaagtgcaattggtggaacagccgggccaaaagtcagtgagcagaagctcacaagtgacgagagcagggcctgtaagtcaaggccgtcccatgtctgctgatgatattcagaaagcaaaaatgcgtgctttatttatgcagagtaagtatgggaaatctggttcaaaagagagtagcgaaacaaaaattgatagcccatataaacaacctcagacaaaccccgccagtattgcagcttgctcttctaaagttcctactccacccaaaattgaagaaaacgagaaacctttgttacttgcctctaaagccactaataagctggaagcttcttattcaaaaccaaaaatggatgtgaaggaacctctctgggagaagtgcaagagggttcagatcccatggaaaacaccagcagaagtggaacttaaagatacctggagagttggtggcggtgaaaatagcaaagaggttgaggtccagagaaacagaaaccgcagggataaggaaattatatacaaaactgtccaagagatgccacctaaccccaaggagccttgggaccttgaaatggactatgatgatactttgacgttggaaatccctattgaacagctaccagatggtgatgcagatatagcaatttcccccaatcatgttgcaactcatagtgttcaaggggtggcctccacttcttcaaccagtgtggctactgctgaacctgatttagaattgcttgctgtgctgttaaaaaatccagagttggtgtttgccttaacttctggacaaggtggtagcataccgagcgaagaaaccgtgaagctgcttgacatgatcaagagtggaggtgtgaacttgggtttaagtgaaaatacaaatggaagttatggcacgagtgtaaaggccccggagaaggtggaagtttctcttccatctccaacccccttaagcgatccaagaacgagtggatggagctcagaagcatcaaaaaatcccttttcaaggcaaagtctagcacccgatagaattacacagaaacatactgcagtggcaactaccaacttattatctcagattcctataactgtcactacagtaaggcaacaaccaacagttgtggttccatcttcgaggcatcttacaagcatatcagtttctccatattcactgcctcaagcaactaatgttattcctgaaaagccaccgcccctggggcatgtacaaacatcctcagatgtaggtttaaccatgaagaagaacttaatcactgcaaatgcatcttcagttaactttactggcacacattcaactctagcaatgcggggtgatggcaccaattatgtaaaacctgtacctaatttgagtgtgcaacatgagggtttgtctaattcattcccacaacccttcatgccaccctcaccaacaccatcccattcagcctcacagcaacaaagacatcaacatttggcccaggaagtccattacactgaacctccatatcgtaaccctggccgttcctacccgccacaaatcgaaaaatcagatcacgggtctgataatatgtggagagttaggcaggatcatgtgtcatctagttatctttctcaacgaaaccataacaacaactataacacaattgttgggggatccagacaatctggtttttatgatagaaataatcatgcaaggggagaatttgaatcatggagtccggaaaatagtccaactagaaatcctaggtatgcaccaggtagaaattacccagagtccagaatgaatcatggtagaaatcatagacctgaatggtcaaggcagaggggttcttctggacactgggaccctggcagacagggaaacagaaagtggcatgatcagagacgatga

SEQ ID NO: 62218 - DNA, 1269 bp, Glycine max
  Peptide Sequence Number=SeqID_178996
atggattctttcaatgctctgttagggtttagagctgattcttgcactggcgcaatggagcgaaagatcattgattttgaccaaggttgggactatatgcagaaggggattaccaagctgaagaaaattcttgaaggagcaccagaaactcctttcagttctgaggaatacatgatgctatacacgtatcctttttcttgcaattaccatcacagaaccatatataatatgtgtactcagaagcctccgaatgacttttcacaacagctttatgacaagtacaaggatgctttcgatgaatacatcaaaatcaccgttttgccatctctaagagagaagcatgatgaattcatgctgagggagcttgtccaaagatggctaaatcataaagtcatggtccggtggctttcgcgcttcttccattatcttgatcgctacttcatttctcgacgctccctgcctggactcggtgcagttggcctcacttgcttccgtgaatcggtttatatggaggtacgagtcaatgctaggaaagctgtgattgcacttattgataaagaacgtgagggtgaacaaattgatagatcgttgttgaaaaatgttcttgatatatttgttgagattggtatgggtgaaatgggtcaatatgaacaggattttgaggctgaggattgcttgagaagggagagagatagagtgtctcattacttacactgtagcactgagcagaaattggtagagaaagtgcaactagagctgctggtgactcatgcaaatcaattactcgagaaagagaactctggctgtcatgccttacttagagatgataaggtggaagatctgtctaggatgtatagactttaccataaaatacctaaaggcttggatcctgttgccaatgtattcaagcagcatattacggttgagggtacatcattggttcaacaagctgaagaagctactagcaatcaggtccttgtccgtaaatttttagagctccatgacaaatatatggtgtatgttaatgattgctttatgaatcatacactgttccacaaggcattaaaggaagcatttgagatattctgcaataaaactgttgctggtagttccagtgctgaacttttatctacattctgtgacaatatccttaagaaaggtggaagtgagaagctaagtgatgaagcaattgaagatacccttgagaaggtagtcaagttgcttgcatatatcagtgataaggatctctttgcagaattttacaggtaa

SEQ ID NO: 62219 - DNA, 375 bp, Glycine max
  Peptide Sequence Number=SeqID_178997
atgagggagtggcctcactttgctactcctgatgggctccaaggctttttgaattgggagcttggagatcggtatacgttatatccgtatgtggtgatcacttctgattgtcatctacatgattatgtaagaccatcaagacctgagaggattgatggcaaagtttggaccctaataggtgagagtgttatttgcttagaggaaccacatgtagtggttaattatgttacatgttgtctttgtttgactattgtgtgtttgtggcatttgaggagtggaggactaatccctacaactaacaacttccaggtactgacgaaaagtgcaccgaggcatttgcgagcttggtgtagcttgcagaaggagcgagtatga

SEQ ID NO: 62220 - DNA, 345 bp, Glycine max
  Peptide Sequence Number=SeqID_178998
atgggtagtaacaataagaaaagcaactccacttccgaggaacaaaccctcatcagcgacgattctctcaaaccactcaataaaaaacagtaccgcatcatgcccacgcaaacacttgggacaaagagaggcatagaaccgcaacccaacccaaactcgaaccttcgcctccgtccattggttcgcctagcaccagcggcgacacactgtcggagttcaacactggcgtgttcaaggacatggccgtggtgtccgagtcgtatgggtcgggttatggaggtggtggtggcgtcgaactttgtatgggtgacgttgatggtggtccggagtggcggatctgggtag

SEQ ID NO: 62221 - DNA, 198 bp, Glycine max
  Peptide Sequence Number=SeqID_178999
atggaaaaagagggaaattatatggaagctgaaaaagcaagaatgaatcttaaaacaaactttgcaactctctcctcctcaaaggggaaggcaccaccaaagggagagaaaccaaaaaagcagtggatgaagctggttctaaatcaaatggggactggcagctcatcaagcttggctgtgttgcactggtcaatgtaa

SEQ ID NO: 62222 - DNA, 468 bp, Glycine max
  Peptide Sequence Number=SeqID_179000
atggagggcaagtctacttatattaagtccttgcctatcttagtacttattcatgtaaattctcctagtttagttatatttctgaggggtgctgtttttcgacgtaacctccatgcatggcgtcaccaccagtggcgcttacgccagggacgtgccacgcgccattcccaccagcgccttgccttttgtctacgtgacattgaaaatgccagcactaatggtgagttggtcatggctctagtcaaatgcaaggtcttagggttgcagcattgcagagtgcagcaggttagggttgcagtgacgcaggggcagcaggtcaggggtgagagacgcgccattgggtattgtgagctgcataaaggagatgtcattccctccagcgattattcagaaagcttgattcgtagtgcttctttggtttattgttgttacttggatttcttggtggtagttataaattttaagtag

SEQ ID NO: 62223 - DNA, 5195 bp, Glycine max
  Peptide Sequence Number=SeqID_179001
gttgtgctttcaattctgctatagtttttgttgttgtgaaatctgaggctgtgatttctacgcgagcccgcaatcgtgtagaatttttcaaattacttgcgggggtgatttgtttgggtgggtttttgattccggggaatggatcgaagagggagtgcgattttgattgggacgaagggttctcaatgcggaggtttaagctggagggaggtagggatgcaataaaggggctagggttagggttagggttgggagctgggaggagagagatggtggagtcagagcttgaagaaggtgaggcgtgctcgtttcagaaccatgaagattatgatgccaccgtagatcccgatgttgccctctcttacattgatgaaaaacttcaagatgttctgggacactttcagaaggattttgagggtggggtgtctgcggagaatctgggggcaaaatttggtggctatggatcatttttgcccacctatcagcgctctcctgtttggtctcacccaaggactccactaaaaaatcatagtcaaaatacacccagatctcccaataatttgcaaccagagggtgggcagggggatgctgtacaatgttcaactggaactcagtcatcgagacttggcccaggttctggtaactcctcaaggatgcctgcaaacaagggtctctctttagatgacggaactaatcaagaaaaatacatgacaaccactaatgctgacacatccacttctaagcatgagtctctaaacaaaaaagttaatagcacatcagaccagaagacactgaaggttcgaatcaaaatgggtcctgatagtttatcaacaaggaaaaatgctgcaatatacagtgaaattggtctcgatgtgtcaccatcatcatcacttgatgacagcccctctgaaagtgaaggaatttctcgtggtcctcaagatgctccttttgaatctccaaccattatccttcagattatgacagacctccctcagctattgtcgcctattcccgatgatacgatcgagttaactgtaaaggaaacacgtgctagagatagcatctctggtcctgttcatatggatgacccagaaagttttgacatgtatgaatctaataatgtaaagggagacagaaaattgttaggtgggagtgggaggaaaatgaaatctctggagggttgtgaatcctcaatggaagtcaatggttctacaaagaagaatactcggaatgatgttggagtgctgtcaagaaaggaacaaagtacagatgcattgactatggaggagctagtttcaaaaactatgaagcttccacttttatccagttcatattctttcggtgatgacttgcttaaggctgtggatgggcaatgtgattcatcaaaggaagccaacaaagttatggtgagggagaaaaccttctctgatcagggacaaagggaacaggtggagtcaacatctactgaggtgaatggttctgctgagaaggcaaagggaagttcaggaagaaaagttgtgggagataaggtttctcttgatgactacccagtaaaagaaaatcctcaaggagataaaaatttcaactcaatgatagttgaatctaatgtttccaaagttaggacagaaccaaacactgaagagctgcctaagaaggctaatcagagaggtaacctctctgaaccagatggtatagaacatccatttccagggggtaagaaaaagccaaagggaagtcatggcaccatggttatggagagggaaaaagaaaatttgaaggttggatcctctttggttcctaaaacaaaaaagagttctgatgatagttctgcatcgagaaatgaaactgaagatgccagaatacaaaaaagtcttggaaagactagagatacttacagagatttctttggggaattggaagatgaggaggacagaatgggttcattggagaccccttatgaagaaaaactgaaggaatctgaggtggtcgagaggagtgcacctatgactagttatggagcaaaggagagatctggtggtaagaaagctgataagccattcacagcaatataccctaaaacagccacaaatgtctcatgcactggaaatgcaaatggtactgacatagagaatggtaaaggggttcctgtaatgatacctcctgttgagatggacgataattgggtacagtgtgaccagtgtcataagtggcgtcttctacctgttggaacaaatcctgacaacctacctgaaaagtggctatgtagtatgcttgattggctgcctgacatgaatcgatgtagctttagtgaggatgaaaccactaaagcacgtattgcattatatcaagggcttcctcttgatggtcgaagtaacctacagaatgtctctggcagtgttatggtgggaggaaccatggcaacatcccagcatccttaccaataccaactaaataatgatctgcatgcagtacctgggggcaagaaaaagtttatgaaagaaatatcaaattctataagtaaagacaacttttctcaatcatcatattctattaagaaaaacttgcagtcagccgtgaaaagtaagagcttaaatgatgtgaacaaatctcctgttgcgagtgaggctgatgttcccgcagacaaacacaaaaataagcagaggatgctggagcacaattctgatagaggtgatatgaaagtcaaatgcaggagggactctgatcaagatagttctagaccatccaagaaatctaagagtgacaaggttcattctatcaatgaagagtggattatagaagagagtgggactactaggaaggtgggttcaaatagcacttttccaacaacctcagttggcaaagatcgacctagacagaaaaaccactcatcttcgcaggacttcaaatcaggaaaagacgggttgccagattctgctgaaaccacaaaagataaaggtcagggttccttggatgagggatccctggatctggggatttgtgattcaattggtagtgtgaaaaaaaggaagctgaaggggtatcaggatgctcaaacttacagccctggtaacccttgcctgcaggagagcaaaacttctgagcatgagtttagtaattccaggaaggaaaagaaggcaaaaaattctaaatatgaaggcaaagaatcaaatgccagtaaaggaagtggtagatctgacaaaaaagttagtcatacaaagacccagaaattcaggcaaaagcctgagagcagtttgtcacaacggagcttggatggactggactgttcaaaaagggacttggggtctgtacaggcttctgttgctgccacttcaagctcttctaaggtttctggctctcataaaaccaaagccagcttccaggaagtgaaaggctcacctgtggaatcagtttcttcatcacctataagaatttcaaatgcagataagtttacaaacaaggaaattattgggaaagatgattctcatgatattgctgctgcggatagtccacgaagatgctccggtcgtgaggatgatggtgagaatgatcgatctggaacagctaggaaggataaatctttcaccatttcccataggtcagattttcaggacaagggtgttaatcacctgtcagatactaaacttaaagctcaaacaactggttattgtaccgatggtggtgttgacactatagtcccagatgggacacatccaggcacagagcagattaagcatccaggtgaagacaacattgtttattatgctaatacgtctcaagcaaggaaaaatggcatagaatcaggtttggagggcaacaatcccaatgacagctgtaagtcagagtcccatgcagataaggtcaagagtactagttccccatgtcaactgaaagatcaatctcctctacatgaggcaaaaaataaggatggaaaaattaagttgcaggagaagtttgggttcaagcctgacctaaatgggattacatatgctggcaagaatgattatacaggaaaaaaggagagcaggaaaaaggagaatcactcaaatcggggtcatgactttcaagatgttagtacagataccccatgcaaacaggaggtatttcatgctcctattcagaatcagttgccggactgtgatactgaaagatccacaaagagatctcttttggaaagaactgatcaagaagtacatggaaaagggaagccattgccatcatttccatctgaaggatctcaagttgagacattaggtcattgcccacgaccagttggcttacataaaggaaatggagatatggaagttgatccttccaaagtggatgatgtgtcaaagttacaaaagaagcaattgaaaaagaccggccatcaaaatggaaatcagcaaattggttcaagaaatcccatacttaatggtcacaagtccaaggagcttgatgcccctagtccagctagaagggattcttacacccatgctgctaacaatgctctgaaagaagctaaagatcttaaacatctggctgatcgtcttaaggtttttatgcagtcccttttagacttttatgcttttgctcttctcagtccttattttaccaattttgggtttatcaaacagaatactggatccagcgctgagggcactagtctttacttccaggcagccctcaaatttctccatggagcctctctgttagaatctggcaacaatgataatgctaaacacaatgagatgattcaatcaatgcaaatatatagtagcacagcaaaattgtgcgagttttgtgcttatgaatatgagaaatcaaaagacatggcttcagctgctcttgcctacaaatgcatggaggtagcatatatgagggtagtatattcttcacacactagtgcaagcagagatcggcatgagttacagacagcactgcaaatggttcctcttggcgagtctccatcatcatctgcctctgatgtagacaatgttaacaactctacagcagctgacaaggctcaggatgttaattttgccatggaagcctcaaggaaatcacggaatgcttttgtagctgctaattctagcctggctgtggacaagattgcagatggtatctcctctatcaagaaggctcttgattttagctttcaagatgtggaggaattactacgtttggtaaaggttgctgcagaggccattaatcgataa

SEQ ID NO: 62224 - DNA, 222 bp, Glycine max
  Peptide Sequence Number=SeqID_179002
atggttcgtggattcatgcaaaaggagggtaggggacgatccgtcaacaagattctgggagcacaagtgggtgggggcgggttatctctgaggcgtggaagaaagtgtttgattggttggatatccctcttattttttcctaatgattttcatggacatacaacagggtttttctattctttctggtgcactgatccgagggagttcttgattgctaggtag

SEQ ID NO: 62225 - DNA, 138 bp, Glycine max
  Peptide Sequence Number=SeqID_179003
atgttgaagagtaatggtagtctctccgcatctcaagtgaaaggttacatccacaaaacctcaccatcaattggattagacctaatttgtatatttgatgagtatgacgacgaagatgtcattgatcctgcaaaataa

SEQ ID NO: 62226 - DNA, 255 bp, Glycine max
  Peptide Sequence Number=SeqID_179004
atgggagcggtaactgttggtgaattgaagcccagcatttcaggaaaaaggacctttcgtccaagttcaagtataagacatgccactgaatggccgatatctgatgtctctagcgatcttaccatcgaagtaggagcatcaaccttcgcacttcacaaggtaaaggaaactagctaccattctgataagagctcctttgaagagaatttcatgcccaaccttagtccactagcattaatggctgataagtggtaa

SEQ ID NO: 62227 - DNA, 1413 bp, Glycine max
  Peptide Sequence Number=SeqID_179005
atgtacgtgccttccgcttctctatccggttactctgtggcgatgaacagcttaacggcgagtttcacagctcgaatatgcgccacgcgccgcgacctactactccctatacgacaccgttcccttcatcctttcactaccagacgcgtcgccaccaaactcactcctccaagaatcgtttgcatggcggaaccttatctgataacgaagcttgagtccgccgagaaaacgtggaaagagttatcggtatttattccactgcgcgctactatgctttccattttctgcaaagttttttttttctcaaagatgaaatttcaggtcaagcttgctgatccagacgtagtttctgatccaaaggagtaccagaagttagcacaatcagtttcagagcttgatgaggttgtgtccacgtataggagatttaaagactgtgagaaggttctagaagaaaccaaagctttagcgaaggatgatggcaacgatgaggatatggtggaaatgatatcttttgaaattgacactttgtccaagcaactcgcggagcttgaggaaaaaattaaggtgttactgcttcccagtgatcctatggatgctagaaacatattgcttgaagtacgagcaggcactggtggtgacgaggccggaatatgggctggtgatcttgttcgaatgtatgaaagatatagtgaaaggaattcttggaagtattctcttgtctcaagctctgcggcagaaaaaggaggatacaaaacttatgtgatggaaataaagggaaatcgtgtttacagtaaattgaaatatgaatctggtgtccaccgagttcaacgggttcccctaacagaaactcagggccgggctgatgaagttgaagtcgtaattgacccaaaagatattgaactgacaacggcacgttctgggggtgctggaggccagaatgttaacaaggttgaaacagccattgatctcttccataaaccaacgggaatccgtatcttttgtactgaagaaaggacacaacttaagaacaggaatcgcgcttttcagttgctccgagcaaaactatatgagattaaggtaagggagcaacaggagtcattacgaaatcaaaggaaattacaggtcggtacaggtgcacgttcagaaaaaattcgaacatacaattataagtttatgacactttcaaatttttcttatcaggacaacagggttactgaccacagattgaagataaactatgagctcacctcttttcttgatggtgatatagaagatgctgttcaggtttgtattaagatgaaaatcggtctggtaagcaagggcttgcaacgagaaagtttgaagagcttgagagaaacccaaaatcattgcaactcctggattggatttgataatgttgagtggggtctttga

SEQ ID NO: 62228 - DNA, 237 bp, Glycine max
  Peptide Sequence Number=SeqID_179006
atgagaattgtgagaacttacagggttgtgagcgtgttggagaagataggggctctgttcggaagcgagtcgattagtgtgtatgtggtgggaggaatgagacgatgccatggagaggaccttgagtgtgagaggtttgaaattcgaagaggggaaggggggttggcgaaagagaaaacgaggaaggagaagaggagagaagcggtgcaggagcatagaagaattatgtatcagtaa

SEQ ID NO: 62229 - DNA, 2163 bp, Glycine max
  Peptide Sequence Number=SeqID_179007
atggcgattccgttcgaagttggttacagcacttgtcactggtgtcatgttatggaggtcgagtctttcgaggatgaagcggttgccaagttgctgaacgattggttcgttagcattaaggtggatcgagaggagcgaccagatgttgataaggctttgtatggtggaggaggttggcccctgagtgtgtttctttcacctgacttgaaacctttaatgggtggaacttacttcccccctgatgataagtatggacgaccaggatttaagactatacttagaaaggtaaaagaagcttgggatagtaagagggatatgctaattaagagtggatcatatgcaattgaacagctttctgaggcaatgtctgctagttcagattctgataaactgcctgatggggttccagctgatgcgttacgcctatgctcggagcagctctctgggagctacgattcaaagtttggtgggtttggatctgcaccaaagtttcccagaccagttgagataaacttgatgctatatcactccaaaaagttggaggatacggggaagttgggtgtagctaatggaagccagcaaatggttttctttagcttgcaatgcatggcaaaaggtgggattcatgatcatattggagggggatttcacagatacagtgtggatgagtgctggcatgttccgcattttgagaagatgctttatgatcaagggcagcttgccaatgtttatctggatgcgttttctatcacaaaagataccttttattcttatatatcacgagatatccttgattatttaaggagagatatgattggtccagaaggtgaaattttttcagcagaggatgctgacagtgcagagactgaaggagctgcaagaaaaaaggaaggagccttttacatatggacaagcaaagaggttgaagacttacttggagagcatgctgctctttttgaggagcactattacatcaagcaattgggtaactgtgacctatctggaatgagtgatcctcacgatgaattcaagggaaagaatgtcctgattgagagaaaggaaccttcagaactggcatcaaaatatggcatgtcagttgagacatatcaagaaattcttggagaatgcaggcataagttgtttgaagtaaggtcaaggcgtccaaagccacatttggatgataaggttattgtatcgtggaatggactggcaatctcatcttttgccagggcttctaagattctcaagggtgaagctgaagggaccaaattctactttcctgtcattggcactgaaccaaaggagtacatgggaattgcagaaaaagcagcatcctttattaggaagcaactttacaatgtagaaactcacaggctacaccatagtttcagacattcgccatctaaagctcctgctttcttggatgattatgcttttctgatttctggattgctggatctctatgagtttggtggtggaattagctggcttctatgggccattgaattgcaggaaacccaggatgctttgtttcttgataagacaggaggaggatatttcaataatacaggagaagatgcttccgttctcctccgtgtaaaggaagaccatgatggggcagaaccctcaggaaactcagtttctgctataaatcttataagattggcttccatggttgctggaagtaaggctgagcattataagcgaaatgcagaacatctattggcagtttttgagaaaaggttgaaagatatggctatggcagtgcctctaatgtgttgtgcagcagatatgttgcgtgtactttctcggaagcaagtggtcgtggttggtgaaaggacgtctgaggactttgaaaacatgcttgctgcagctcatgcagtatatgatcccaacagaacagttattcatatagatcccaacaacaaagacgagatggaattttgggaagtaaataacagtaatgttgctctcatggcaaaaaataactttgcagtcaacaaggttgtagctcttgtatgccaaaacttcacttgtagcccctctgtgactgaccattcgtcacttaaagctttgctctccaaaaaaccttcctcttcgttcacaaagctcaaaaggtttgccaatctgagacattcttctgttttcgagacattttattag

SEQ ID NO: 62230 - DNA, 1869 bp, Glycine max
  Peptide Sequence Number=SeqID_179008
atgcttgtttttccttcttgtgatttcccttctaatggttctgtgttagatgatcaagtagcttatatatctcctcttttagcatttaaccttaacttgcacgtgacgtgcttaaaatctatttttcaccacgggcaagatgctttagtttcttatttcaaaagaggtgatgaggatgctgctaaaggaacggtggattctgttatcaacgttgaattggaaccacttgctcagcctccaaaatttgccactcttctgagggtttcttttgttaagataccagaatgtggcatccttgaatccattagagcaagttcgcctggatatgttttcgggatcaacataagctggaactgcaattcccccatttgcattccttgcaatcaaagatcattgaataaaaatgacaaccttgtctgtttcaagggagttagttctccgtccgcacttcctccggatttgttgattggtggaccagcagaagaacccgtgcccttgcaaggggacactgtgaacatcttggctttgatacttacaccaactttttgtccattggtgctttcttccaagtttagagtttcagttctattgtatggcttggcagcacaagctttcaagatggctcgaagcatgttggtgaaggtggagaagaagaatgctgaaaagacaagtgggcatcaggtcctgttggttgctgctgctgacagttcagaaggtctgcctccaactatcagacgctgttttagccatgaaataagcatggggcctttgactgaagagcaaagggctgaaatgctattccagtcactgcaaagtgtttccggactcctctctaatactgattcagaagctttagtaaaagaaatagttggacagacatctggttacatgcccagggatatatgtgctttgattgcagatgctggtgccaacttatttcccagaaacaatgctaaagtagacaaagatgtgcctgatgatgtaggtagttccttaagttccaaggtggcagaggacaacaatcaacggaaagtttcacctctgattactgggaaagaagacttgttgaatgctctggaacgatcaaagaaaagaaatgcatcagtgttgtgtactccaaaggttccgaatttgaaatgggaagatgttggtgggcttgaagatatcaaaaagtcaatcctggatactgttcaggtgggcttcttgtacaactccaccctttcattggtcagtttggataaatttctcaaaaagaacttgcggaaggagaaaggtcctgaactgatcaacatgtacattggagagtctgaaaagaatgttcgagacattttccagaaggccagatcagcatgtccatgtgtcatcttctttgatgagtttgattctcttgcaccagctcggggtgcttctggagattctgggagcgttatggacagagtggtttctcagatgcttgcagagattgatggcttaagtgattcaacacagacccggcgtcgatttgataaactgctatatgttggagttaactctgatgcatcttacagggagcaggtcctgaaagctcttacccgaaagtttaaattgcatgaagatgcctcactttactccatagcaaaaaaatgtccaccaaactttactggtgcagacatgtatgctttgtgtgcagatgcttggttctatgctgcaaagcgcaaagttttgagtgaaaattcggagtcttccagccaagacaatgaagcagattctgttgttgttgaatacaatgattttgtccgggtcttagaagaactgtcgccttccctctcgatgtccgagctcaagaagtacgagcaaatgagagatcagtttgaaggcacctctaaatga

SEQ ID NO: 62231 - DNA, 249 bp, Glycine max
  Peptide Sequence Number=SeqID_179009
atgcatgtcaattctgaagcagaagctgctgtcgaggaatccatagtccccactgcgatgccgagaactggccttgcactagtttatgtgttctatactagttctcttttcgaagcgcatatgccaagctccccttttatttttgttttacactggttgaatgtattcctctcttactacaatgcgatgctccttttcagaatggcactaggtgtttgtagaaggtattttaacactcaaatccgttaa

SEQ ID NO: 62232 - DNA, 647 bp, Glycine max
  Peptide Sequence Number=SeqID_179010
tagcactagactcaaacttgttgccttcaaaattcacagcacttgcagaactgcttccagatcatgcacgtgtggttagtgatggactctatagagctgttgacatcttccttaaggttcatccaaacatgaaggactcagagaggaaccggctatgcaaaaccattgattgtcagaaactgtctcaagaagcatgcagccatgcagcacagaacgaaaggctaccggtgcagatggtggttcaagttctttacttcgagcaaatgaggcttcgcaatgccatgaatggagggcacaaccaactcttctttggtcagttccctcaccgttcagggagtggtgcagggagtggagccatttccccaagagataactatgcatctgttagaagagagaacagagaactgaagcttgaagttgcaagaatgagaatgaggctcactgacttggagaaagaccacgtgtccatgaagcaggagcttgttaagtctcaccctgccaacaagttgttcaaatcattcaccagaaagctgagcaagctaaattctctattcaggataaatagcattaagccacttattggtggcaaagctagttcagaaactcgcttcccttttccaaagcgaagacgccactccgtttcatga

SEQ ID NO: 62233 - DNA, 318 bp, Glycine max
  Peptide Sequence Number=SeqID_179011
atggatgtggtaacatcattgactgctgataagccagtggtgatcttcagcaagagcacatgtttcatgagccacaccgtgaaggctctcatatgcagctttggtgccagcccttcggttattgagcttgacaaaatgcaaagtggtcaccaagtagagagagcacttattcaactaggttgcaaaccaagtgtgcctgcagtgttcataggacaacaattcataggtggtgctgatgaagtcatcaaactcaacgttcaaaacaagcttgcccaattgcttcttggtgctaaagctatatttatctggagtaggtag

SEQ ID NO: 62234 - DNA, 459 bp, Glycine max
  Peptide Sequence Number=SeqID_179012
atggctaggtatattttggtgtatgatgaattcggttataacagtcttatatttcgaatggaaggatttttagtttcagaaaaatatgttgcgttgcaaatttgtgatgacaaagatgttgaaactatgatcgaaaattttcaacaacaagaacaaatgtcagttatagaattgtacatagaaaatgatgttactagtgggtctttagatgaagatgatattgttgatgatatatctgatacagatgatgaagtcacccatatgattgaatcacttacaattgttcaaccaagagaaggtgtagaaggaattcataatccattttggaatgatgttttgcattataacaatatcaattggggtcatcctgatgaggagaatatttgcggtttgaagccatcgagttttaatattgggcaagaattatatgttggtatgaattttgatagtaaagatgcg

SEQ ID NO: 62235 - DNA, 2742 bp, Glycine max
  Peptide Sequence Number=SeqID_179013
atgggtttgaatgtgaaggacattcaaattcgtttgttcaaagtggttcaagattcagccaagtctagttactcatttatgcgaaggcatccactggtttcaggtgcttcattagtatgctccatcctatatgcattcctttcttatatttacagcttcttggtttgcatgtcccctttccttgtttgtgctgttattttcattaaaatcttttggagttctgagcaaactcaactcaaatatgtcaaaacaaaggaggaaaaaggagggcagaaaaaggttgaaccaaaatgtccaaagataccaaataataggagacctgagatgctttgtaagtatccatcacagaatgccacaagtaaaaggagaaaatttagtgacaagaattgggatgtatatagtggtttagaggataaggccaaggatttgtcagcagtttttcataatgagttcaccaaaagaaacatagagaacaaaggggccagatcttttgagaagggagagagttctctggataataggttgtcagcaaaaaaaactcaggttcctaagaggcaaatcttgagatctgaaccttcaatggttgacttggtggaatgtggtgatttagagatagagaaaaagatagaggatggagatgatgaggatggggaagaaacacaggaggaaagtaacaaggctatcgaatggacagaagatgatcagaaaaatcatatgtatcttaggaattcagaaatggaaagaaacagaaggatggagagtctcatagccagaagaagagcaaaaaaactattcaaggggcagattgagaagggtcaaattgataaaaagtcaatggcaccagtgcttaccaaaagaagaaatcacttagattcttcaaaggattttgatgatggcttagacatgcctggttctgccccatcttttatgccaagaagtccttatgatattccctatgatccttctgaggagaagcctaacctcacaggagatagtttccctaaagaattttctagtcagaaggatatgccatttagcaggcatggaagcttcagttcaacccatcttttcccatcagaaaccaaacatgaccatggagctagagagcactattactttaataaaggaagcaaatattctgacagacttgcatactcaagattcagaaggcatcatacagataagggaactcatgactggctaattgaccagttgatatacaatgaaggtggtgaaaatggattgcaaatacctaatacactaacaaatggagaagaatcaacacatgaggaggatagaaaatgtaaaactgatggggaaaacatgaaagatgagaatgatcatgaaacaaaatccatgtcaggtcaaataagtgagccaggatcagatagatcacggccatggccaacgtttcctaagcctcacaggaggctccttacttttccggtatctactactgctactactcatactactaacataaatgaagctttgtatgaaactgtcacatctatagttgataagaggcaagaaagtatatttttaacccatgggagaatttgtcacaccccaacatattctgtagcttctgacttacaagtggaggtttctgaagttggttcgccaacatcaacagttggtgagaatgctgagactaactcatccattgatagagactctatactgtatgatggggacattgatagagatgttagttctggtagtgaagagttgtggggagcctcattccatggaggaaaagaagcacaaggagttagaagtgaggcggatgataatgccgaagttaacaacaattcaaaagatgttgtctcgtcaactactccgcgacatatagatgaaaatgaagctgatgtgagctcaatgtcctcaaaatctgatgtgcctgaagatactccaactcatgcaagtcatcataacttctttggttatatgaaacatcccgtgaggaaactgaagcaccacaatcttccaattcttctcatgctttggatcaattacccaatgaaacacactcagaaagaccagaggcgagtcactttggaatggtgcaacatgccagagaatgtaacaaatgaggcacaggttatcaatgctgtgaacaactcaacaagcacagaacaagataacacagacaacttaagaagtaatgaagatccaggcacatcggtaatgcgacaagaatcaatcgatgaaaccttcaatggctcagtttcttcatcaccaaggtctgtgctacctgagataaccatggcagatgaagtttcaccttcagcttttgatcaagacctgcatatagatgctcaacaatttattatggagggtttggcccaagaaactttaaacagtgaaagtccacctgacaccatgcctcaaactattcagccaacgatggatgatacaactgatgaatcacatagtgttgacttcaatttcaatcattgtcaggagcagactaatcacttagagaattgtattgaagaatcaaatgtctttggcagtatgaatgatgaagtcagcaatatggaagaggaggacaagtcaaagaatgatgagaacagtgaagacaattcttaccacctaaatagacaagaagctactacagaatccaccagaccaataagtgagatagcaactttggaggatatggtgccatcaacagagctgattgaagatgataagaatgacaaaccatcaagcagtagtaatattcaaaaggagtga

SEQ ID NO: 62236 - DNA, 710 bp, Glycine max
  Peptide Sequence Number=SeqID_179014
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggagggcgcggcggtctgctgctaaaccccagggcgcgaagccgggcggagcgatcgtcgggacgggaggaagcccgtctgatagcgctctgtgcgcgtactccgaaaagggaatcggcctgcccaccctggaaacggctcagccggaggtagggtccagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 62237 - DNA, 201 bp, Glycine max
  Peptide Sequence Number=SeqID_179015
atgacaccgaggtctaagcaagggctctttgtgatgggttggacaccctttgttgggcgggtggcgagttggatgagcttctggcgcgggcctaaaaactcggatggtgctgagcatactggtgagtattatgaggggtttgctagaattttggccaagcaggagccgaggggagacatagtcaaacttccccctttttag

SEQ ID NO: 62238 - DNA, 1074 bp, Glycine max
  Peptide Sequence Number=SeqID_179016
atgtgggccatcatcaacgagtacaaggaaaagctagacctagcagcaactcatgagcaaaagctagaggacgagtacgctaaggtgtcagtcttgcaagcggaaagggtgatcgattcattccacggggaagcaatgatgtggatggacaaattcgcctttactttgaatgggagtcaagatattcctcgattgctagccaaggccaaggcaatgtcgaatgtgtactcggcccccaaggaaattcacgggctcctcaattattgccaacacatgcttgaactgattgacaccataactaagctcgctccaaagcacccctatagaacctgttctaagtctagagtcatgggggaagtagaggaagtgcaggaacatatgaaggtcgacatgtcagtcctgaaaaatcaaatggcttccatcatggaagccatgctaagcatgagaaggttaatcgaaagtaacacagccacggctaccgccactagcaccgccactgaggcagatctggtcctcccatctgcaaccaatcaagcaaaccaactcgctccggatatggtaggacgaggaagagacgcattggggaataccagcggcctgcatcggggggacgccgacaaagagcctcgggagcatgctcaattggacatcgactcataccccctattcaccactaagggatcggcacccaatgccttgcctcagcctaataccgtaggagtctctcaacccctcccgatgcaaccacttcacttctccgtaaaggaatcgcctctagaagcggagggaagagaaaagcttgatttcattgaagagagattgagagcggttgaagggtttggtgactacccctttgtcaatatgaccgacttatgtttggtactggatgtcgtcatcccacccaaattcaaggtaccggattttgacaggatagaggtaggcctaaaaagggggaagtttgactatgtctcccctgccaacacaaacaacagaagatatgggccaactggggcaaaaaggaaagaaagagatgctcatgctgtgacctcggctcctgcttggccaaaattctag

SEQ ID NO: 62239 - DNA, 495 bp, Glycine max
  Peptide Sequence Number=SeqID_179017
cattccataactggtgaatctatgcattctgttattggtgattttgaacatcctgatcttgagcattataattttgagcattctgattctgagcattctgattttgcacattctgagaacatgacacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcagagggagtggcaaaggactggttgtattaccttgctccaaggtccatcacgagctgggatgaccttaagagagtattcttagaaaaatttttccctgcttccaggaccacaaccatcaggaaggatatctcagtaatatggagagaaagtatgatagatgctgccagtggtggagcccttggagacatgactcctgctgaagcccagaaatttaattga

SEQ ID NO: 62240 - DNA, 536 bp, Glycine max
  Peptide Sequence Number=SeqID_179018
ggtacatcctttgtggtacaagtagagggtacatttacttgggtttgactgagaacaagagagggtacatctcttgtggatcagttttggtggagggtacatccactaggttcaaagagaacaagggagggtacatcccttgtggatctttgcttgtaaaaggatttttacaaggagggcgacacgaggctcacggttgcgtcttccctaatgaagatctaattaataaagttttaagatgcttaagtagggaatggcagcccaaggaacatgaaatagaactccaacgtcttaatcaaaatgaagaaaccgacaaaaagaaaagaagtatagcacttaaagcctcctcatcaatgcaagaagaaaatgaagaagaagaattagatgatgaagaagacttctcactctttgtgaagaagtttcaaaaatttgtcaagaaaagaagaatcgagaggcgtcagaacatcaacaataggaaaagacctcaagaagactctcaaggtatgattgatcgaggccgtacccgaatcaaataa

SEQ ID NO: 62241 - DNA, 342 bp, Glycine max
  Peptide Sequence Number=SeqID_179019
atgatgcacatgttagctatgctaccacagaaaaagaaatgctaccatagaaagattatcactgacaatgccaccaatctgaacaacaaaatgattaaagagacgtgtgaggatttcaagatccaacatcacaattccatgccttgtaggcccaagacgaatggggaagttgaggcggaaaacaaaaacatcaagaagatcgttctgaaaatgaccgtgtcatacaaggattggaccgagatgctccttttctcgttgcatggttatcaaaccttagtacacacgtcaactggggcaactccgttttctttggtgtatggaatgggcccaaactcactttga

SEQ ID NO: 62242 - DNA, 876 bp, Glycine max
  Peptide Sequence Number=SeqID_179020
atgggtgaaacagacaaggtgcacgagcggataaaggccgacttggaggccatgaaagagcaaatggccgcaatgatggaggccatgatgggcatgaagaagataatggaggtcaatgcggctagagttgccgctactagtgccactgctaaggtggacctgactcccacatctggcctcaaccaaataaatcatgccatctcggatatggtagggcagagaggcaaagaattgggaagtacgggcggtccctattttgtgcaagttcaaaacaagtattccttcccaccttatggcttggctcctaaccatacaccgcctaatgttgcacacactcccattgaggatgtcaacaactctgcacccatacccattgagagccaaaaacccgaagctgatcatgcacatgtctctcaacccatgggggagacacatgaaataccccactataatctaaccaactttgagtctcacctcggatatgccactaaagggcaagcagtcggtggtgtgcccctgccaaacactttggaaggccctcaatttctcccacaaccacaacccttgcattttgaggcgggaagaatccctcttgctatggcggagaagggaaagttggatcatatagaggaaaggcttggagccatggaaggggttggaagttatgcttttgctgacatggcggaattgtgcttagtgccttacattgccatccctctgaagttcaaggtgctcgacttcaataagtacaaggggactacttgccccaagaaccacctgaaggtgtactgtaggaaaataagggcatacacaaaagatgaaaagctgttgatgcatttcttccaagaaagtcttactggggcagctgtcagctag

SEQ ID NO: 62243 - DNA, 866 bp, Glycine max
  Peptide Sequence Number=SeqID_179021
tctccctttgctatccagagacaatcgagtctgataacatgcagagacaaatatggtcatctgcccccattgttgaagacttgatgtctttcgaccgcgactattgtagtctccctttaccatccacagacaaatatgtatccctttgctatcctgagacaatcgagtctgatagcatgcagagacaaatacggtcatctgtccccttttgtcgaagactcgatgtctttcgacctagactattgcagtccccatttgctatcaagagacaactgtgtccgatagcatgcagagacaaatatggtcatttgccccctttgtcgaagactcgatgtcttttgatcgagactattagagtctcccttttctacctagagacaatcaagtctgataacatgcagagacagatatggtcatttgccccctttgtcgaagactcaatgtatttcgaccgagactattgtagtctccctttacaatccagagacaaatatgctcatttgcccctttggtcgaagacccagtgtctttcgttcgagactattgtagtttccctttgctatccagagacaatggagtctgatagcacactgagacaaatacgaacatctgccctcttttttcgaagactcaatgtctttcgacctagactattgcagtctccctttgctatcaagagacaatcgagttcgatagcatgtagagacaaatatggtcatctaccctctttgtcgaagaatcgatgtctttcgaccgagactattgcagtctcccattaccatccgaacacaagcatgtgtgatggcatgcagagacaaatatggtcatctgccccttttgtcgaagacttagtgtctttcgtctga

SEQ ID NO: 62244 - DNA, 249 bp, Glycine max
  Peptide Sequence Number=SeqID_179022
atgtcggcaggaaaatatcagtcgcgactatacaatgaccgatgtcggttattggaaatgttcgatcggcgtcatccggtgatgcttcttgatgagaatcctaaaataggtcaaatacaggctaaaggcccaatggagaaggacgaaggctcaagtggagaaggacaaagcccccgagtggagaaggatgaaggcctagaggcagagacactatcaagactattaattgttgctgaaggcccaaactaa

SEQ ID NO: 62245 - DNA, 1112 bp, Glycine max
  misc_feature (33)..(33): n is a, c, g, or t
  Peptide Sequence Number=SeqID_179023
ggattacatgagtacgataagaataagtcaggntgttggtatcaggcaacctaacaaatatcgtgatgttaaaaccgttcagtcactactaaatgctaacagtgttataacaacgccaggtaatgagcttaaagtagatggttatatcggcgaaaagacgattgcgaagataaaagattttcaggaaaaagtcgtcaagcttaataatcccgatggcattatttcacctcatgggccgactatgcggagattacatggaaatattacacctgcaaaaaatattaaaattaatttagatactactgcttctcaggttactgatgaaatgtatatcagtatggcaaaagcattaaattgtgagccagcagccattaaggctgtcgtgatgtcggaaaccaagcagagtcctttcgatgcttcagggcgtcccactattttatatgagaggcactattttagtcgtttgaccaataaaaagtatgataaaagtcatccggatatttcaggggagccttatgaagtctatggaaagtttagtgaacaatatggcaagctcaacaaagctatcgcgcttgatcgcaccgcggcattacagtcagcgtcctggggagcttttcagattatgggaagtaattatgcgacttcgggttatgccaatgttgaagcttttgtccagggaatgaacaccatttctgtattgcttatgactagccacattgctgctgcttcgacggcgttatcgtcttctaaagaatcttcttataaagagaatattttgaatgaagcggaacagcacggtttgagtcgagttcagttagatgaaagtcagaccttccgcttaaccagagatggtacagttttaggaacgcttatccaggggaaagggtggataagagaagtgcaacctgtatgctttataggctggagcaaagatggtaaaaaaatcgatgcattcattccaaccgtcggtcagggcgactgggaaacggtaggttgtcataaagttgattcagtgggattaatatcgaaaaaagatgatgctaatgtgaaggttgcagtagtttacaccactgaggctcctggacgttatagcaatgcttattttatcgtag

SEQ ID NO: 62246 - DNA, 831 bp, Glycine max
  Peptide Sequence Number=SeqID_179024
atgcaagattttttatgtaacaatcaggacaagccaatgcaattagaatttctcaatcttgcatcaaataatctatcaggagaaatacctgattgttggattaattggccatttctagtggaagtgaatttacaaagcaaccattttgttgggaacttccccccatccatgggttccttggctgagctgcagtcattagaaattcgtaacaacttgctctcgggaatatttcctaccagtttgaagaagactagccaattgatatccttggatcttggagaaaataatctttcaggatgtattccaacatgggttggagaaaagctctcaaatatgaaaatcctccgccttcgatcaaacagtttttccggtcacattccaaatgaaatatgtcagatgagtcttcttcaggttttagaccttgcaaaaaataatttgtctggcaatatacccagctgtttccgtaacttgagtgccatgacactagtgaaccggagtccatttccccaaatctattcttatgcaccaaatgatacagcatactcttcggcatcaggtatagttagtgtgctactatggctaaaaggaagaggagatgagtatggaagcattctgggtttggtaacaagtattgatctgtcaagtaacaaattattaggagaaattcctagagaaatcacagatctaaatagattgaactttttgaacttgtcccacaaccaattgattggtcctattccagaaggtattggtaatatgggatcgttacaaaccattgatttttcgaggaatcaactttttgttgaatccctccaaccatttctaatttga

SEQ ID NO: 62247 - DNA, 336 bp, Glycine max
  Peptide Sequence Number=SeqID_179025
atggggatcatggtgtttgtgccatatgcctttagacttgtcaagtctagtacgcagggccctgagaatgactcgattagttgcctctgcatgtccgttagtctaaggatgttcaacagaggtgacaaggtgcttgatccctatccttgtcaagaagtcttcgtaagtctgagctttgaattgagtgtcgttgtcggtgacgatagcatatgggaggtcgtacttggagataaggtatctctagctcctagggcctttggtagcagtcccagtatgtccattccccacatggcgaaagggcaagcgccacatggcgaaggaccaaggggagcttag

SEQ ID NO: 62248 - DNA, 1179 bp, Glycine max
  Peptide Sequence Number=SeqID_179026
atggcttcttcagctatggaaacctgcaaatcagaggatttgcacatgcaggttgacattgagaagaacgcgaaggatataaggtctcagtgggtgcttaacgctcatgagcccccaagtccatggcgtgtggttgcagattctgtgagcaaaactatctcccactataaacataaactttcctctctcatagatcaaccctgcaccacactcctcctttcagttctgcaggtggtttttccaattcttgcttcgggcagaaactacactgctactaagttcaggaaagatcttcttgcaggtctcactattgctagtctttgtattccccagagcattgggtatgccaccttggcacatcttgatcctcaatatggcctttatacaagtgtggtaccaccacttatctatgctgtaatgggaacctcgagggagatagcaattggtccagtggcagtggtttctcttttgttatcctcaatgatggagaaattagtagaccctgctactgatccagtggacttccttcggactcctcagtggaaccctcgaaattttatcttgggatgctcgttcttggtcttcatcctaacgacgagatttttgggtaaaaggaagaagaaactattctggttggcatcaatctctcctcttgtatctgttgttgtgtcaactctaattgtgtttatcacaagagctgataaaaatggagttaaaattgtgaaacatgtaaaaggggggttgaatccaagctccatccatcagttagacttcaacaacccctacattggagaagtggccaaaattggactagtggttgctgtcgttgcccttactgtgactattcttgcttctgtgattctctctgccctaccaggactcattgacctcagtgaagcttacaaaatttggaaggttgataagatagactttcttgcatgcgctggagcattctttggagtactatttgcatctgtggagattggtctacttgctgcgggtactcaaagatttttgcaacgcttggagttgtatgcaagtgttgtgatggggttggaggcgcctgcactaatttttgaaactgaaccctttttggatgttatggttaaaactgagttattatcggagtccactgctttccatgttcagtcccttgattcagttcatatgaatttttaa

SEQ ID NO: 62249 - DNA, 501 bp, Glycine max
  Peptide Sequence Number=SeqID_179027
atgtcaaatcatagttctgtttcatctgtgcatccttcagctgggctaaattcatcacttccatcatcttctggtattggtcttagcaataacttaacatcatctggtccattggcagcccctgccagggatagtagatatggagtttcacgaactccacctttatcagttgacgaacagaagagaatacaacaatataatcagatgatatctagcagaaacatgccgcaatctaccatgtctgttcctggatctctttcaggaagtgatcttggtggtgtgcgaatgttgcctggtggaaatggtatgggcatgttgggttctggaggcatgccttcttctagtatggtggggattccaagccctgtaaatatgcatgctggagttggtgctggacaaggaaactcaatgctgagacctcgggagactgtacatatgatgagggtgagaagtggtctggttctctcttcgaatttaattggttctattggtgataattaa

SEQ ID NO: 62250 - DNA, 1008 bp, Glycine max
  Peptide Sequence Number=SeqID_179028
atgagtggtgaagcgcgatcctgtgactactgtggccactccacagcacttctttactgcagagccgattcagcaaaactctgtttctcgtgcgatcgcgaggttcactccaccaaccagctcttctcgaaacacacgcgcacgctgctctgcgacgcatgcgatcattcccctgccaccatactctgttccaccgacacctctgttctgtgccagaactgcgactgggagaagcacaaccctgcgctctccgattcccttcacgaacgaaggcccctcgaaggcttcactgggtgcccttcagtctccgaactcttatccatcgtggggttttcggatttaagcaaaaaatctcttctttcttcgcctcagggaagtggcgctgatgggatcttcggtggagaaattgaagggctttcggatttgtttgtgtgggattctccttctttcgttacgcttgatgatttgatttcttcttctccttcttctcatagctttcaggccatggaggttcctcctctgcccaagaatcggaaggctgcttgtgggcaacacaaagaagagattcttagtcagcttcgggaattggccaagtctgagccattggaccttgaaccatatgtgtcatcggggaacttgtcctcgggttttgaacgtgaaccagaggctgatatctttccttctcatgagtggcatagagaaagcagcgagcctatgtatcaggttgttcctcctgacccattaatgagaacttatacagaagaaattccatttaaacattctacttctgctgttggggaaactcaaacctacggtgacaatggaggaaaaccatccatttctcttaaatctgaaaccctatcaactactcccaaagctgcagcatgtatctattattttctaatgcttgaaagtgcttatttgagactgagccgcacaatttctgatatgttaagttctcaatacactatatcccaggcctttaaccgtaacatgctgaaattatag

SEQ ID NO: 62251 - DNA, 675 bp, Glycine max
  Peptide Sequence Number=SeqID_179029
atggagcctgcaaccgagaagagagaggattttgggaagttgcagtacggatgcgagcactataagagacgatgcaaaattcgagcaccatgctgcaatcagatttttccatgtcgtcactgccacaacgacgccgcgaactcatctagcaaccccgcagatcgtcatgaacttgttagacgcgatgttaagcaagttatatgctctgtctgtgatactgaacaggaggttgccaaggtgtgttctagctgtggcgtcaatatgggagaatattattgcgagatttgcaaattctatgatgatgatacggataaaggacaattccattgtgatgaatgcggcatttgcagacttatcttcgtctacccagacttatcttccttcattggaagtggcgtctacccagacttatcttccttcactggaagtggcgtctaccgtgacttatcttccttcaccggaagtggcgtctaccctgacttatcttccttcatcggaagtggcgtcatccaaaacctccgtagccttggcgtctacccagacttatcttccttaaccggaagtggcgtctaccctgacttatcttccttcaccggaagtggcgtcatccaaaaactctacagcctgtatcaagtgatccgccccgtaaggttcacatcatcttacactttttga

SEQ ID NO: 62252 - DNA, 372 bp, Glycine max
  Peptide Sequence Number=SeqID_179030
atggagagacctggcagctcaagtagcgcccccaataacagagaaagagattatcacaatgatagtagacacattaccgatttggtcttcgccaacgaaaggatcgaagtgggtctgaaaagaggaaaatttaatcatcctacttggacgaatgagaaaactggggtaaataaagagggtgagaatgaagaagaaacccatgctgcggctgccattcctatacggccaagtttcccaccaacccaacaatgtcattactcagccaataacaatccatctccttacccaccacccagttatccacaaaagccatccctaaatcaaaccacaaagcttgtctaccgcacttccaattctaaacaccacctttag

SEQ ID NO: 62253 - DNA, 255 bp, Glycine max
  Peptide Sequence Number=SeqID_179031
atggcctcctatggtgatgagcttcttctagactcacttctccttggagtggcgtctcctctctctctccctttctccatttcgctgccattcatcttccaagaagcaaaggaatccattgatgaagaagatcctaggcctacaagctccaatggagcttgcatcatgtggtatcaagagcatcttcatctagattcctacatgatgcctatgatgaagttgagttgtggtgctgagttgtggctggatttgtga

SEQ ID NO: 62254 - DNA, 3411 bp, Glycine max
  Peptide Sequence Number=SeqID_179032
atggctttgtgttcaatttttctcaatcttcatcttctgttttttgtttgtttgacgatagaagcgttaggtgtggcaaagccttcagtagctagttacctttgccaggagatactggcagagcaagaagctgatagagtgcatgaattacctgcgcagcctccggtgaagttcaacaatatggtggttatatcactgttaatgaaactcaaggaagagcactgttctatttgtttttcgaggccactcacaaaccagaacaaaaacccattcttttatggttcaatggaggtaagggtaatttctagtgaatttagctttaaaatcttgcacgccactcctaacgcttttgataacaacgtttgttcctacttcctacattcccttctctctctgcgtgtctctgtctctgtctgcggctccgtacgggtttcgctggtgagtattcttgatcctgggttggatttgttgttattaaaggtggttcttgtttttcccttggtgcagaggcaatctaggtgcaaattgcttgtcttgaatagaatgccaagagaagaagtattagctcaagaagatgagaggggtagatgttttgagcctgaaacctctgaggatgagtggcagaagtctcgaactagatctcttaggagaaaagcaatgactgcttcaaccagactcgcttatagtctcaggaagcgtaatacacgtgtagcaaatagtgactttgcttcaattttcatagaagatgtccgcgatgctaacgaggaaaaagctgtgaattcatttcgtcaggtgctacttacaagagatctgcttccagattcccatgatgattatcatgaaatgctgaggtttctgaaagccagaaagttcgacattgataaaaaagtccagatgtgggcagatatgttgcattggaggaaggagtatggagtagattctattttacaggaatttgtatataaggagtatgaagagggatttgagaaaatgtttaaagagaaattcccagcatgttctattgcagcaaagaggcatatagataaaacaacaacaatacttgatgtgcatggagtgaattgggttagctttagcaaagttgcacatgatcttgttatgcgtatgcaaaaaattgatggtgataactaccctgagacattaaaccaaatgttcattgttaatgctggtagtgggttcaagctactatggaatactgcaaaaggcaataagtttcagagcagactgttacaaattatagacacaagccaacttccagatttcctcggcggcagttgttcgtgcccaaatgatggagggtgtcttagatctgataagggaccttggaatgatcctgacattttgaaactattgcattctagagaagcaatgaagctaacaaagtttggaagttcttctgttgctgatggggttgatgtgaagtcatatgccagcaaggttaaaagcactggaatatctgaacctttatcagcgtcagaagtaagattgaatccttcagccttcgtacaatctgttccttctagtgaaaaaagactaggaattaattttgatgtaacacaaaatgttactcacgctcatctgataggagagaaacacagagctctatcatggagaaataataaggacataacatccttttatttctctcatttcccagactctgtgaatgaaacttacctctggaatctattccaggagtggggaaaagtgtgggaggtgtttatacctcaatcaaagaataaacagggtcaacgttatggttttgtccgcttcaaaggcgtggaggacgcaggttggttggagagacaactggataacaaaatctacatagaagggaagaagttgtttgtcaacaaacccaagtttcagagaagaggtaaaagggaagtgggaagaacagggggtgaagtggttcgagtaaggaaggtatccatgaatcctatggaacccaaacaagccagaatcaacagtacgacctccactagtatgaaatcgtacgctgaagctgtcaagcacgaccataagacgaaagagaaggagattacgatgcctttgatggggaagaagggaccagaagttcctgatgtttccgtagttattcaaactgggaaggacaaaactagctggttggataatctctgggtgggccgtttaaaaaatagaggtatgtttgagaaggcggtggatgaggttcaggagatggtaggtatggatgtgaaggacacagagcactttcagaccttgctttcgacatttggagagattgttgacctcgacgaggagacagcggaccgttcgaggcttgacgtcgcgcggattctgattcgcacaaaggagaaaccaatcttctccaaatcgatgatggctatggttaatgacaacgagcatcacttgtttctgagggaggaggtagctcgacctatcggaaaacgagggtggcggccggagttagagacttttccgccatcatcgttcacgatggtaatggaggattccaacaaagattccattacttgcgtccctgacggagcctcgtcggaatacaggagggacgggcagcggcgaaggtggaccaacgacatcaatctatggtgtgcggattccgaggtctcctctgatggagacgtgtcacctcaccagcgggagccgcttcatgctatgagcctgctacactgcgccacgcaacaggaggtcttcaacggtcctctcacagagcctttgcatggaagcagaatggaggctcgtaggatctcctcccttgctcagaagacattgccgattaaggaaaaagaagacgctggccccaaggaagatgacatagtcaaaggcgctgaccttagggtccttcaatatagcccagaggatattactccagtcctatgtcctgcggtcaatacaagtttaaattccccaactaaagtgagtcacggtttgaataatagcattcacaatagggggccaaaaggggtaatgcagaatttgggcctgaatattaaaggcccagaatcaattggagaagtaactacccataacctcaaggtgtactctaaaaaaaaggtgggtgcaggaagtaggtattcgggccacacaaagattgctgagaccagtaggaatgacaataagtcatcacctctggacattgcagatagtggcctcatctatagggaagatgatgtgtcagggggggtccacccagctgatgtcgttacacctcagacccagacctgtctcagccctatttcttcaaccagtttcaccaatgctcttgcagaggatgaggaggttttccaccatgaagtagctagacacctgggtttgacttttgatggtcactttagcgaggatgcggtagcttcaccagctatgatgggaaggaatactcttgcctcatga

SEQ ID NO: 62255 - DNA, 333 bp, Glycine max
  Peptide Sequence Number=SeqID_179033
atgcctaaggttgatgctcaagtgccagactgggtgcaacaacatacgtggattcatgggattcaaattcccatcacgctgtgggttatttggagggctaggaataaaagcattttgaggaggagatggggacaactactcagtgacatgcgcaaatggatttgctgggtgagacctcctttaagggcggtgacattgaaggtaaatggtagcatgatgggtagccctcctagggcagggtttggaggactttgtagggttcaccatggaagctttcttgtgggcttatatggtcatgttggagggcaagagatcttatatgctgagatttaa

SEQ ID NO: 62256 - DNA, 546 bp, Glycine max
  Peptide Sequence Number=SeqID_179034
atggcctcctatggtggtgattcaaacaacaattatctcagaagactacaggagaagccaattccatatattataagtattttggctcaaatcgcagtcaaattgttaacttgtatttatgtagtatttgcggcattggggaaatgttttgtggttcgctctgtagacaaccaaccaagaagccatgagaaaaccaaatcggctcaatccaattccgaggaacaattaatgactccggcgataaaagagccactttggcaaagaattcagaatttagaggcagtggtaactgagatggctaataaacctaatacaattcctcctgaaaaagaggatattcttcaagagtcattgagtcgcataaaatgtatagaatatgacttgcaaaaaacaaagaaggccctgctagccactgcttcaaagcaagttgagcttgccgagtcattggaaagcttaaaggagagtaaatttgacgaaactcttccaagtggattacgattgcttgaggaatgtgggctatggggagtgcatagccccaatgtatag

SEQ ID NO: 62257 - DNA, 825 bp, Glycine max
  Peptide Sequence Number=SeqID_179035
atgtcaggttaccatctggtcggttcatgtaatgggttgcactgtggggttagcgaaataccaaaaggataccatgtttgtttctggaacaaggcgacaagggtgatatccagagaatcgtcagcgctgtctttttccccgggcatcggtcgtagaacaatgtttgggtttggcaatgatccgtcaagtgacaaatacaaggttgtagcaattgcgttgactatgctctcacttgatgtatctgaaaagactgagatgaaagtttttggcgtgggtgacaatagttggagaaaccttaaaggttttcctgttctttggactttacctgaagttggtggagtgtatctgagtggaaccattaattgggttgttattaagggaaaagaaaccattcattctgaaatcagggatcatgccaaaaagagattggatagtcatcactttgaacctaatggaagtagcggtttgtatggccagcatagtgtgaagaagctgaagccaacaaaacaatcccttgataattttgacaatgttgctccaatagctaattctattccctcccctgctgcttcgcaaatgagtaacatgtccagtccaagtaaatttattagaatcattagtggtggacgagatagggggaggaaagccaaagcacttaaggtttctgtgggacagcctggttctggaagtccttggtcactatttgaagagcaggctcttgttgtcctggtgcatgatatgggtccaaactgggagcttgttagtgatgctatcaacagtactagagaagggtttaggtcgtatgacttgacccgtatgacatga

SEQ ID NO: 62258 - DNA, 705 bp, Glycine max
  Peptide Sequence Number=SeqID_179036
atggaagtggcttatctcatcatatgctacatttatgccaacttcagagccaagacagtgattgtccgatgggtgtttttgttcaatggtgcgacatacttagtcatcctatttttaacttccttggtctcaccattaagtaataggttgaaagttgtgggatggatctgcgccactttctctgtcggtgtttatgtgacttctctgatcaatcccatgatgagaacggttgtgaggacaaaatgtatatccatgcctttattgatttctctgaccctgagttccatcgtttggttcttctatggctttttttctcacgattatttcatcgtgatgccaaatgtactacacttttggcttggtgttgcacagatgatcctatgcttcatctacaggaatggtggtgctgatgagagagaaagggtgcagtcagaaactggtgagattaataatgaaaatgacgagattttggagacaatagaaatgcaaattgctgaggcgaagaacacaaatgttgatcaccaaacagacaacgatgatattaagaaaaaagaaaatggcagcagcagcagggtggaattggaaccttgtgagattgtccatttgcagaacaatattgttgttgttacaagaaacggcacaagaatagtgtgtaatgagatccagtcggtggcggaaccagagattgttgaaattcccggatga

SEQ ID NO: 62259 - DNA, 999 bp, Glycine max
  Peptide Sequence Number=SeqID_179037
atgaagaagaacgaggaacgcagcgataatcagagcatgaagaagaaacaaataatgatgaagaagaagaacgtttcgaggttgggcggaagtggcctttcgctcaacgctttcgccaacgcaaaattcaagaacaatcactataacccagccatcataaagaagcaaagggagttctataaaaatgctaagaatgtgaataagtttaagaagttggtaaagcagcaaaaccagcagaatgaaccctctttggctcagagacatatagagaatgtaaatgaaactgaagagaacaaggacgatagtgagaggaggaagaggaagaatagtgcccttagtttggaagagttgtacaagaagcagcatgaagagaaggagaaagaaataatggagagagaggctgtcctgagggtaaagaaggaagagagagaacaagctgaagctcggagaaaggctatgcgagaaaaaatgcttaagaagacacgaaaagggcagcctgttatgaaatacagaattgagcatctcttggagactattcaaggttcaactaaaaatgcagctggcaccgtgataatcactgaagtgatcgtagtagttgcaactattctcgcacggatcaaactcaagagagtatctatctatttagctatgagaggcaggggaaatgaagatggcacatccccagttaactgcttccagctatatgaattacaccagataaaatcacaaaggaaatctgtagcgattgacagagatattctggggagagaaaaaggtcaaggccagcgatgcaccacgacgcgcctcttaggggaggagcagatgatcatgagggtgagagcaatcaccagcgccatgagaagtcccatgaagtcaatacataactccgtgcaagccattgttgtgccttggtcttgcgtaagtcttgctctgccaaaaagaagcaagggcaaaataaggtcgtgtatggccacggtattcgcttatcttattttatga

SEQ ID NO: 62260 - DNA, 1752 bp, Glycine max
  Peptide Sequence Number=SeqID_179038
atggcgtacacgttttcgtttccggaggaggtgctggagcacgtgttctcgttcatatggagcgagagggacaggaacgcgatctcgctggtgtgcaagtcgtggtacgagatcgagaggtggtgcaggaggaaggttttcgtggggaactgctacgcggtgagccctttgatggtgatcaagcgcttcccggagctgagatccattgcgctcaaagggaagccgcacttcgcggacttcaatttggtccccgagggttggggaggttacgtttgcccctggatcgccgccatggcccgggccttcccctgcctcgaagagatcaggctcaagaggatggtcatcaccgacgagagcttggagctcatcgctaagtccttcaagaacttcaaggtcttggttctcacttcctgtgagggttttactgccgatggacttaccgccattgcttccaactgcaggaatctaagggaattggacttgcaggagagtgaagtggaggaccttagtgggcactggctaagccattttcctgattcctacacttcattagtttcacttaacatctcttgcttaaaccatgaggtgagtttatctgcattagagcgtctgcttgggaggtgtcggaacctgcggaccctccgtctcaatcgtgccgtgccccttgatagactacccaacctacttctccggtgtcctcagctggttgagttaggcacaggagtctattcaactgagatgcgaccggaggtcttctcaaacctggaagcagcattttctggttgcaagcagttgaagagcttgtctggcttttgggatgtgcttccatcctaccttccagctgtctaccccatctgctccaggctaacatcgctaaacttgagttatgctattattcaaagctctgatcttattaagcttatcagtcaatgcccaaatttgttgcgattatgggtgctggattacatagaagatgctggtctttatgcccttgctgcatcatgtaaggatctaagggagttaagggtgtttccgtctgagccgtttggtttagaaccaaatgtttcattgacagaacagggccttgtctctgtgtctgaaggttgccccaagctccaatcggttctatatttttgtcgacaaatgtcgaatgcagccctacatacaattgcacggaacaggcctaatttgactcgttttaggctttgtattattgagcctcgaactcctgactatctaaccctggaacccctggattctggttttggagctattgtagagcaatgcaaggatcttcaacgcctatccctgtctggtcttcttactgaccgtgtttttgagtatattgggacttatgcgaagaagctggagatgctatctgtggcttttgctggagatagtgatttgggacttcaccatgtgctgtcagggtgtgataatcttaggaagctggagataagggattgcccctttggtgacaaggcccttttggcaaatgctgaaaagctggagacaatgcgatccctttggatgtcctcctgctcagtgagttatggagcgtgtaagctactgggtcagaaaatgcccagactcaacgttgaagtcattgatgaaagaggacctccagattcaaggccagatgattgtcctgttgagaagctttatatatacaggactgttgctgggccaaggttggacatgcctggttttgtgtggacaatggaagatgattcttcactaaggcttgagtga

SEQ ID NO: 62261 - DNA, 512 bp, Glycine max
  Peptide Sequence Number=SeqID_179039
attctttgacgaaatgggggattgatggggttgatctggatctggagccaggctatacggatgccggttttaatgccggagattgggaactttatattaaggcctttgctaaatattttggaccgggatcaaactcaggaaagctactcatcattgatacgaatgtaggattatcagaattaggggtgtctagtgcaaccctttcaaagatcgatcttatttatatccaggattattggggaagtgaagcatccagtgataataaaatcgatggttacatacaatccggttttccaaagaagaatatcctgttgatttctgctgactttgaatcttcttattcttatagtaatgatagccagggacctttgaggctaaaaaagtattacacttctacgaaataccaagctaaggcgggaggatatggtgcttatggattcaattttgataaaaaacaggactataaaatttatagtgaaatgattaccagcatcaatcagctaaaccagtaa

SEQ ID NO: 62262 - DNA, 192 bp, Glycine max
  Peptide Sequence Number=SeqID_179040
atgacgggaatgaccttgcggtgtcacgttaacttgctcttgaggacaaccaagagaagaagaagagtgaagaagatgactggaatgacgaagaatcaaccgtcacagtggtggtggcttgatagccacaccacttctaatcgatccccttggcttcaatccactctctctggatttcttgcattggagtaa

SEQ ID NO: 62263 - DNA, 540 bp, Glycine max
  Peptide Sequence Number=SeqID_179041
atggcatataaatggacatcaaaaagagggatgaaaacattccatacgtacagaagatctggtgaggttgaggagtacgctggatggtacctggtcctggccagtggcgaaacggcggaacctcgtgtgcctcagattgaagggttggagagtttcaatggaaaagtgattcactcaaccggttacaacaacggcaaggagtttaaggataaacttgttcttgttgttggatctgggaattccggcatggagattgcgctcgacttgtccaattttggtgccaaaccttccatcattgttcgcagcccgataggtgttgccagcggaaatagatcgaaaagtatcagaggtgatgaagttttgttccgagatggcaaatcacgcccattcgactcaattgttttctgcacacgcttcaagagatcaactcaaaagtggcttcagattataaacttggttgcagaaacagtacatgacacatttttctttcgggacatgctaggtgcacccagcaacattgctggtgcacccagcaattag

SEQ ID NO: 62264 - DNA, 265 bp, Glycine max
  Peptide Sequence Number=SeqID_179042
atggcttccttttggtcattcttggcaatgttgatggccatgttggcatgtagttgttcattggccttggcttctagttctcaacaaagtatgcaagttacttccatcacagcagcaccagcaagtgcccctctagtttctcctactcaatcaccagatattgagccactttttcctaccccaggtgcaggcactgtgttggattctttgccatctgaggctcctgctttccactattcttatcagcccttatattcaatttcat

SEQ ID NO: 62265 - DNA, 285 bp, Glycine max
  Peptide Sequence Number=SeqID_179043
atgagtcacaatatcaaatcatgggcacattcactcatttacacaataatatcatcacaagtgaagtttcatcgtgtgaagtgtcataatgtgagagtcgccgagaagttgaaaatcagagatgttagaaatggtatcagagcaaatctctcccctagtatggtgtggttcgaggacgaacggggtgaatgttggtggacatgtaacaccttgatgaatcacaccaaaaagaaagagatacatacctcgtgcaagtatgagactgtacaaatgatgatgacttaa

SEQ ID NO: 62266 - DNA, 375 bp, Glycine max
  Peptide Sequence Number=SeqID_179044
atggcctcggaattagaaatttctccggcggacgctcgcaaggctcccggcaaggagcagcaagccgccggcgtcggaatcctcctgcagatcatgatgttggtcttgtccttcgtcctcggccacgtcctccgccgcaagaaggtttacatcattcccgaagccagtgcttctcttctcatagggttaattgttggtatactagcaaacatttcagacaccgagactaatatcaggttattttctggagctgacattgggattgtcgattttccgcagggcgtgaaaccctttttctcaaattttggagcaattgtcacatttgctatattcggtaccttcattgcttcaattgtaacgggtatcttggtgtaa

SEQ ID NO: 62267 - DNA, 738 bp, Glycine max
  Peptide Sequence Number=SeqID_179045
atgacgtttaaaaggaaaaatgaagcggcaatcatttcaggttcctcgctgctgcgcagtattttgctgtccggcggattgctgatatgcgcgatcattgcgctcaccctgtggacgctgcgggaagactggcacggcgcggtgcgccagacggaagagatggcggtcaatctttccctgtcacagtcacgtcaggcggaagataccgtgctccagaccgaactggccctgcgtgaagtgcagcgcgacctgcaggcgcagccgctggaaaagctaaacgccgccaacctgagccagattatgcgcgatctgcaaagccgtctgccgcagctgcacgggctgttttactacgatgagcagggacgctggatcgccacctccacgcgcagcgtgccggtgggcaccaacaactctgaccgtgaatatttccgctatcatcgcaacaacagccgtgacagtttgcacattggcccggtgattcgcagccgcagcactggcgatctggttattccggtttccctgcgcgtcagcgatgccgcgcgtgatttcaaaggcatcctgttagccaccattaaggtggattatttccgacgtatatacagttactacgaactggggccgcgcgacgtgcttggtactgatgctggcagaaccagcacggtgctttatgcccgatcgatgcccgacagctatatcggcaaaagtctctccgccagccatctgttccagcagatgctg

SEQ ID NO: 62268 - DNA, 363 bp, Glycine max
  Peptide Sequence Number=SeqID_179046
atgaaaaaggagcttatggacaagctccaaaggcttagacaagggagtgtgattgtcaaagaatatagacaacaaatggaagtactccttttaagagttggacttaggcaggaggaaagaacaagcatagctacgttccttagtgggcttaatatgaaagtgagggacaaggaccaagcccaaggaattttgggggctacaccttcaaaacccaaggaagacaagggtaagaccatagagaaatgtggaagcaaagctttccaagtttattttgatcatgccaaagactcaagtcaagaaccaaaagtcaagcaagtatcaagaattaaagagtcgttcaatcaagattcaagattaaagtga

SEQ ID NO: 62269 - DNA, 156 bp, Glycine max
  Peptide Sequence Number=SeqID_179047
atgtgggccattatcgatgagtacaaggagaagctaaacctagcggcgactcataagcaaaggctagaggatgagtacaccaagataccagtggaaagggaagcaagagaaagggagccgctaaggcaattgtattgtcgctttgattttgtctag

SEQ ID NO: 62270 - DNA, 978 bp, Glycine max
  Peptide Sequence Number=SeqID_179048
atgggtcaacttcaacggcaagccttccgcaaagcctatggtaagatttgggacctagctatggtagaagtctccgtggaagcaattgcatcccttacccagtattatgaccatcccctgaggtgcttcacatttgaggatttccagcaagtgccgattgtggaagagtttgaagaaatcctgggatgcccactgggaggaaggaaggcatatcttttctctgggttttatccctccatggctagagtttccaaggtagtgaaaatcttggcacaagagttggaccaggtaaagcaaaacaagaatgaggtagtcagagtaccaaggaggtttttggagggaaaggcaaaggcctcggtgaatcaaggcgagtgggtttcttttattgacatcttggcacttttggtctttggggttgtcctctttccaaatatggaagggttagtggacgtagcagcgattgatgctttcctcgcttttcaccatagcaaggaaagctcagtcgttgccattttggccgacatgtatgacacattcgaccactcgtgcactgagaaaggaaaggcgaattgggaccaactcttggctagcatggaggggggtgaccccaacgcgagggtacttcaaggagttcacaaggcatgggatgcagcacgaaggaaggacaaagagcttaggggaagcaataatgggatcatcggcggctatcgtaaatggctgagagtccggacacaaggattagattggctcccaaagctaagggttgtgagaaacaaagaggctgaagctctagaagaaagtgaggaggtacaagccctaaagacggagcttgaaagagctcgggcaatcaaagagaagttcaagtcaatggccatcaaagtccaaagagagtacgatgaactaagagacgtcaatatggccaccaccgaagccttggaacgagaaaccaagagggcccgaaaggaagaacacggttga

SEQ ID NO: 62271 - DNA, 150 bp, Glycine max
  Peptide Sequence Number=SeqID_179049
atggagaattggcgaatagcgctacgcaataacttcgcgtggctccagactcgaagtggagaatggagaaatggcgaacagcgctacgcaataacttcgcggggctccagactcgaaggtggaggacacatgaacagcgctaggcaataa

SEQ ID NO: 62272 - DNA, 249 bp, Glycine max
  Peptide Sequence Number=SeqID_179050
atggaacgagaagagaaaagggaagtgtactggatacgttgttcttccgaggagaacaacgtagaagaaggaattggtgctggttgtgctctagaggctccgtggcatcgagtttcggtagccgcgttttgggagaaagggttgagtcgcggaagagaaaacaagaagactgcgtttttgacattttgtatttatagatggagacgcgctgtaattgattacacagttattgtaatcgattacatgtaa

SEQ ID NO: 62273 - DNA, 306 bp, Glycine max
  Peptide Sequence Number=SeqID_179051
atggcactgagatctaacaaaatggcacgaaacttcaagctttcctccaccttagtacctagcggaggagtgtatgtagggttttcttcaagccacagttccaagagcagtgtagggggttctgtgggttcgagcgaggggtttccggcagtattgaaaacaatgtgggacaatgtgggtgttgagagagcggtggcagatttcaggcgggaggagaaagagaagagcgatttcaggcaggaggagaaagagaagagcgagtgcaaggttttcaagcacgcgggttgtgaaatgtcaacgttttaa

SEQ ID NO: 62274 - DNA, 309 bp, Glycine max
  Peptide Sequence Number=SeqID_179052
atggtttgcagagatgtgtcttttcaaaaaaaaattctgaattttttcactggtaatcgattattggttgttgcaacctaccctttggcgggagggcgacgcaggcctcacgggtgcgtcttcccagaaaggaaaatgcgcggagtcgccaccaacgtttatttgaggaaaacgttggaaaaaccggaaagatgtggtctacaaactttaatcgtgaaaggttcgggagttatttttacgcactgggaagggtgtttccctcgctcctatgtatcctcaattgcgatgagggaaatcaaatctatgtag

SEQ ID NO: 62275 - DNA, 394 bp, Glycine max
  Peptide Sequence Number=SeqID_179053
gagcaccgcacgtcgcgtggtgtccggtgcgcccccggcggccctggaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 62276 - DNA, 882 bp, Glycine max
  Peptide Sequence Number=SeqID_179054
atggcacctttatcttgttctacacctttcctcaccgaaaaaaagaaggttcttttcataatgggtgcaactgagagaggcaaaaccaagttatccattaacttggacactcaatttccttctgaaatcattaactctgacaaaattcaaatctataagggccttgacattatcaccaacaaggtaccagagtcagaatgtcgtggtatttcccatcatctgataggcattattaacgatcctgactatgatttcactgttgatgacttttgcaaacatgtcctcaatgctctcgatctcatctttgaaaatggacacctacctattatcgtgggaggctcaaacacttatcttgcaacattgcttgaggatctcaacatgacttttcattccaaatatgattgttgcttcatttggtatttagataaaagagtggacaaaatggttgatgcgggagttgtggatgagattcaagaaaactttgtgcctggagcaaattactctcgtggggttagaagagccatcagggttcctgagctaggagagtatttcctggttgagaaggaaattagtgataaggctgaaaaagagaagatgctacaacatgctattgctagaaccaaagagaacacttgtaaattggttgagatgcaactcttgaagatccataggattaactatgagcttggatggggaatgaccaaaattgattccacagtagtgtttgaggctatcttaaaaggagttgactataagaacttgtatcatgaaattatattcaaaccaagcatggagatagtgaaaagattcctgcaggagacaactcgaatgtggggaaagacaccatgccaatatgacgaacaagtgacaatttatacttaa

SEQ ID NO: 62277 - DNA, 675 bp, Glycine max
  Peptide Sequence Number=SeqID_179055
atgcaagacgaagaccctgctgcagcccttcgactcctgctgaccacaagtcaagccgacatctcaagtgaaaagattcctggtgcttcgtcctcatctgatgccgaaataaactcttcagtacgccaagattctctgctcttgaagttatccatggaatacgcacgggaagatgtgtttaaatccattgaagagaacccctctgctgcctttgggcacctgaactttttgaagaaattgcacaacccccttacctctgatgagattctaggcaaagttatccaaatcgaggccatcattgaccaatttgcaacccgagctgctcaacatgaagtcgaacgtctcaccaaagaggcgaaagaaggatcttctgagatcaaagcctgtgatgataacatctcctcctgggaggcaactattacggatttgctgtctcaggtcgatgatctaaggcaaaaaattgtgacggagcaggccaaacgcaaggaactccaggagaaggccgctaattcgattcagaagctggttgctgaaaaagggagggaaggcctgaaggcctttagcgcatctcaagctatagcagatgaggcgagagttatggagagtgctgaccaggtcttaactaaagagatggccaccttgaagaaactatatgaggacttggtcatgcactag

SEQ ID NO: 62278 - DNA, 444 bp, Glycine max
  Peptide Sequence Number=SeqID_179056
atgtcacgttacagaggacctcgtttcaaaaaaatacgtcgtctggggtctttaccaggactaactagtaaaaggccaacagtcaaaagcgaacttagaaatcaatcgcgctccaaacgacaattgcttaaatacgttcgtatcgccggaaaagctaaaggatcaactggtcaggttttattacaactacttgaaatgcgcttggataacatactttttcggttgggtatggctgcgactattcctcaagcacgccaattaattaaccatagacatgttttagttaatggtcatatagtggatataccaagttatcgttgcaaacctcaagatattattacagcgaaggatgaacaaaaatcgaaaactctgattcaaaattatcttgattcagccccccgtgagaattgccaaatcattgactcttcacccattccaatataa

SEQ ID NO: 62279 - DNA, 225 bp, Glycine max
  Peptide Sequence Number=SeqID_179057
atgaccaaacttggtctctgcttgtcatcgggcccgccgcctctggatgacaaaagggtccggataaccgtaagaatgaccaaacttggtctctgcttgtcatcgggtccgccgcctctggatgacaaaagggtgcgaataaccataaggtatctccgcgtatcatgggtgcagaatgaccaaacttggtctctgcttgtcatcgggcccgccgcctctggatga

SEQ ID NO: 62280 - DNA, 156 bp, Glycine max
  Peptide Sequence Number=SeqID_179058
atgcgagtcattgagggtggcattttagaaacgcgattgctttgtcgccttacaaggattccgcaagaagagttgagcagtaccttcctcaacctagacctcgatcatatcactatgctctgtggtaattcttgtgtttctttcgggtgcatgtaa

SEQ ID NO: 62281 - DNA, 324 bp, Glycine max
  Peptide Sequence Number=SeqID_179059
atggttggtaggatctttaactcaaagaaatatgcagttggcagggacattagaaatgatgtgtatgcgctgcctgaatatacaacccatttgtggctacatctccatttgcagctacggttccctcctctccgagacaagtgccagaaccactttccccaacctcgtcatcttctgaattgcccggaaattgccgacctttctgttgaaccatgtgatggtgaattcgttattgtagttgtttttgagataaagaacacagagattccagcatttattgaaaaggagagtggtcgagcccgacaagtgcaccggatcgcgtaa

SEQ ID NO: 62282 - DNA, 1257 bp, Glycine max
  Peptide Sequence Number=SeqID_179060
atggcgaccggtgccgcgctggccaggcaggcggtggtgaccaggtcgtttgccatgccagcggtaatgcgtgcaatcagatcggcggtcatcaaacaccggatagccggaaaccgcctgcaggctgagcggcgtaataaaggctttggccgcatcggtcatcatcacgcggacatccgcgccgcgatcgcgcagacggcgcaccagttccgagtgccgcgcctggcgcgacagatgcaggcaactttatcacaaaatcggcgacccgccttttcactgcctgcgccctttgcgagccggctctggaatttgtcacgcgccgctggtggcctgcaatgcaccggtgcagaatggcggcattgcagggagggcggaacgatgacggaactggcaccacgggaaaaactgacgctgctgggcgccgaggcgctaagcgatgccgaactgctggcgatctttttacgtaccggcacgcgcggcaacagcgtgatggggctggcgcggctgatgctgaatgaattcggttcgctgtatcgcatcatgaccgccagtaaagaggagctcgggcagataaagggcgtcggcagcgccaaaatgacgcaactgcatgccattgcggaactggggcggcgcttttttgccagccagctggcgcgcgaaaatgtcatggagaatccgcaggtcacgcgccactacctgcaaagcgtgctggcacatcaggagcgtgaaatctttatggcgctgtttctggataaccagcaccgcgttttgcaggcgcagaagatgttttccggctccattgccagcgtggaagtgcatccgcgtgaaatcgtgcgtgaggcgctaaagctcaacgcggcggcggtgatactggcgcacaatcatccgtccggcatggcggaaccgagccgtgccgatcgcgagattaccagcaaggtggcgcaggcctgcgcgctgctgaatatccgcttattagatcatctggtgattggtcacggcgagtttacctctttcgctgagcgcggctggctcggcgtatactacgccacctttgagaatctcgggtttggcgtttgggccagcttagcgggttcacatggaactcgcctgggcgggctaaggcctgacgaggcggccaaaacctacgagaagcgcttcgttactctgcgtgtatctgctaaaggtatgcgtgttattgataaaaagggcatcgatacggttctggccgaaatccgcgcccgtggtgagaagtactaa

SEQ ID NO: 62283 - DNA, 360 bp, Glycine max
  Peptide Sequence Number=SeqID_179061
atggtggaggagtaccggaggccggtcgtgaagctcggcggcgagaccctgacgatctcgcaggtggcggcgatcgcggcgcacgaccagggggtgaaggtggagctggcggagtcctccagggccggggttaaggccagcagcgactgggtgatggagagcatggacaagggcactgacagctacggcgtcaccactgggttcggtgctacctcccaccggagaaccaaacaaggcggtgccttgcagaaggagctaattagctataccattgacgtgggatctgcaacgttacattacacagctaactgtacacgttgttgcacctcgcgaatcaatgaacagaaacagtatagctag

SEQ ID NO: 62284 - DNA, 549 bp, Glycine max
  Peptide Sequence Number=SeqID_179062
atggagcgaaacagacacggcgaagaaccatatggagggcgacgagtcaacattttcggaagggacaatgactacgctgaggaagaaaactggactaaggtggtaagcagaagatcaatgaaggttatgcagaaatcctctttagcgggaagacaatcacaaaatctggagataggggacaacaacaaacactatcgccttaactggaggaacaatgccgacattacctccttttatttcacccatttccccgacgaagctaatgaagagttgctatggaggcacttcaaaaactggggtgacgtacgtgaagtatacatcgctaaaaggctcaacaaggatggcaggagatacgggttcatgcggttcaagggagtctcggatgcaaaaggattggaggtgagactggacaacatcttcatcaacgattgtaaactatttgtcaaccttcctaggttcgacagaccagttcggaataccagagttgcagaaaaagaaccccattgggaggaagtacaccgacgaaagcaagtaagccctgcggggtaa

SEQ ID NO: 62285 - DNA, 843 bp, Glycine max
  Peptide Sequence Number=SeqID_179063
gattctcctatgttaaaccctgcagagaagtacttaagattgagatcgttcggagcacctgcagtacttctctccttggccatgcaaggcatcttcggagggttcaaggatacagcaactcctttatatgtcatcgtttcgggatattcgttgaatgtcatattggacccgattcttattttcactttgaaattaggcatcgaaggtgcagccattgcacatgttctctcccagaggatttttgatgctaagagtaatagcagtgacattttgtgtgaccttggcagcatcattggcatcaaggctaggttcaattcctatggcagcatttcaaacatgcttacaggtctggttgacatcgtccctcctagcagatggtttggctgttgctgttcagcttgttcttttgccgagaaagaccataagaaaacaacagcagctgcaacaaggacactgcaaatgagttttgttctaggagtggggctctctcttgctgttggacttggattatactttggagctggagtgttttcaagaaatgttcatgttgtgcacttaattaaaataggcatcccgtttgtggctgctactcaaccaatcaattcattagcctttgtatttgatggagtgaactatggtgcttctgattttgcatattcagcatactctctggcaagttctggtgtcactagtaagtgtagctacagaactccttctctacaggaccaaacatttcgttgggatttggattgcactaaccatctatatgactcttcgcatgttggctggatgggaactgggacaggaccttggcgctatctaagagatggctcattgccttaa

SEQ ID NO: 62286 - DNA, 273 bp, Glycine max
  Peptide Sequence Number=SeqID_179064
atggcgagaaggggttgcaacatcgtggaagtgggattgtggccgaggaagatgaaggagttgcagcaatgcagaagggagagatttaaaccgagagtgggagtgacagtggatgcaagaggaggttcactaagcgaggcggttgtctcttctgtgctaagcgcaagatcggcgctaagtcaaatatcacttactcgcgctaagcgtgagaatggcgctaagcgtgccttcgaggttcttagaggtggaggagacatccccactgctttgtaa

SEQ ID NO: 62287 - DNA, 384 bp, Glycine max
  Peptide Sequence Number=SeqID_179065
atgacgacgttagtctctgcatgctaccggactctgagtctgacggatagtgaaagagtgtttatacggataaccacttgggtcaggataacggaaaccgtttgtacggataatcacttgggtatctccatacgtcaattgacttcacgggtcaggatgatagaaaccgtttgtacggataagcacatgggtatcaccgtacgcaacctgacttcatgggtcaggatgacagaaaccgtttgtacggataaccgcttgggtatctccattcgtcacctgacttcatggttcaggatgacagaaagcgcgaaagacgatgtaaatcttcacatgtcaacgagttcgttggccccgattgacaaagggtgcagaagacgacgttag

SEQ ID NO: 62288 - DNA, 279 bp, Glycine max
  Peptide Sequence Number=SeqID_179066
atgcagagcttgcagaatgtggtccaccagcggtcggtaatgagcgttgaagaatttattcaacaggtggcctggccaggagtccagccatctcctttgggagggggtgaggcctctgcagcccaagagcctcagcaggaggacattccagaggccgcagagcctacacctcctgagccattcactttagagtctgatccaattattgtacaggctgatccagctatatctcctcagcctgagccatctgcactagtgtcggaccttcctctttcttag

SEQ ID NO: 62289 - DNA, 243 bp, Glycine max
  Peptide Sequence Number=SeqID_179067
atggctcagagctccaagaaaaaggatccgaaagaactggagttgctagtgctagagggagaggaaggagctgatgtagaaggagctgaggtaaggggagctgaagtagatggtgcctcagatcctctggccctagatttgtgggttccccgaaaagtgaccgaagggttatccagggattcaaaggtcagagaatcagatgtgactcctcggggcttgtataaagcagtaataagggcttga

SEQ ID NO: 62290 - DNA, 972 bp, Glycine max
  Peptide Sequence Number=SeqID_179068
atgataaaaccttctatgttaacaaaaattcattttgaaaccgcaaagacgcgatttctgcagcaacgcgaccctaaaatccctaaccttcagaacttgatttctccctcaattcttgaccaaatcacgacctacaaagcccaaaattcatcatttttcattctctttcatctccaccaatcaaaacttcctaaaaatccttcaaatggaagaaccatcgaagaagcgaaagggcgtttcgacttcatccgcagtcatcgaaactcgaagctaaggagcatccaaagtgcagacaaccaaaattcctccctccatatcatctcctatttctttgatgatgaagtgtttgattgctttcaagcatttcaaaattttggtttaattcagtttatctccatgaaacttcctttttgccctgaattggttaaagcctcttattctatcttagaaattcaagaagattccttgatttacgaagtttatgggattaagatggtcatagaccagtcccttctctttgaactcactcaattatcctgtgacggtgtaccatttgagggtacacttgatgatgagtggaagttcgatttttctgtttctgatgcccgtcggatggtttgcaccaaccaagcagatatgaccggaaggcttcttgctggttcattggcattcgaatgccgcatcatgcactactttattatctgcattctactccctagatcatccaaccttacacatccctttgtcaaagtcaagagatccttctctatctgttcgaatgtagtctcctctttcggataccgcaaagagagggatggctcttgggtaaagaaggatgctccagtacaggccgctgaagaccgctctccatcaccacaacctcagagagatgactcttcatctcttatgcacaacattcttgacaggttggatggactccacactttcgtcggagacgctttgactcgttga

SEQ ID NO: 62291 - DNA, 647 bp, Glycine max
  Peptide Sequence Number=SeqID_179069
atggcttatggacatggtctatatttacttcttacagatgcagatgctccaattcctgtacccactgatgaggtttccttagtggggcaggcacttcacaccttccttgcttggccgacacatctggtcaagtctttatcacagcaggtagctgtgtcttcgccaaaaccacctccgaagcccgatccggaggtcaatgatccgctttatctgatgacattgaccatcccagagcttttcttgaggccttatcaggttagatgggatgccaccgtgttcggggtcgttaatccagatttccccctctacataaagcacgaagacctctccgaaatcgcacacggtggtcaatgtctcagcatatcagtgttacagttgtggattcagcatctcactgaaacatgtatgcgagtagggaattctgatatctatggattccttgagccacggtccattcagaggtctgggcaatcgcagtttgagtttgaaagttacataaagagttggatgcagagttcacaacgcgatgtctatcttggagcctacctaaatgggccagacaactaccttaaggggattattaatagggtcttgatgatgctccacagcctaaatcaaaggcttctgctaggtggattgtcgtcaag

SEQ ID NO: 62292 - DNA, 372 bp, Glycine max
  Peptide Sequence Number=SeqID_179070
atgaggataagcctgaagagagttgttccatgccagtatgtgcttgtatgcagctcactaagcgaggcggttgtctcttctgcgctaagcgcaagattggcgctaagccaaatatcacttactcgcgctaagtttgagaatggcgctaagcgcgcattcgaggtcagaaagccctttttaagcctgatttgcacaaaaaaaagaaaaggagagcatgacaatgtgaaagatgctttgaattttagcattgacaattgtacagtttccttggaacttgatagagcagggctatataactatagtgctagacatagtgtgcaaggctctaagttcaacaagagacatctgcgaatgaagcttagtttaaattag

SEQ ID NO: 62293 - DNA, 165 bp, Glycine max
  Peptide Sequence Number=SeqID_179071
atggcttccgggactcccattattttcgaagcaggattgcctctagtggatgcaacccacgagctgggcggcaacctccttcccttttttcctataaataggcaaaaaagggctgttctaaggatccctaacccccaagctatgcatttcagctgttttgggtga

SEQ ID NO: 62294 - DNA, 639 bp, Glycine max
  Peptide Sequence Number=SeqID_179072
atgatagaagtctctacagaggccattgcctccctcgcccagtattatgaccagccgttgaggtgcttcacctttggggacttccaactatcacccatggtggaagaatttgaagagatcctaggatgccctctaggggggaggaaaccatacctcttcacagggttctatccctcattagctagaatttccaagatagtccaaatctcggcgcaggaattagaccacaggaagcaagttgaaaatggggtggtcggaataccaagaaaatatttggaggtaaaagcaagaatcttggcagataaaggcgagtggatcccgttcatagatattctcacactgttgattttcgggggggttctctttccgaacgtggatgggttggtggacctggcagcgatcgacgcttttctagcctatcataaccacaaggaaagcctggttgtcgctatgctagccgatctatacgacacctttgaccgaaaatgtgaaaagaacaatacaaggattgtttgttgtactccagctctttatgtatggggttgcatcagctacaatcccgttcttgctataagacaacttggctatcctatgagaggagcaccactagaggaagagatcgtgcctgtcatttcatga

SEQ ID NO: 62295 - DNA, 213 bp, Glycine max
  Peptide Sequence Number=SeqID_179073
atgcagagttcaaaacgtgatgtctaccttggagcctacctgaatggtgctttaaaaggtcttgatgatgctccacagcctaaatcaaaggctcctgctaggtggattgtcgtcaagtgtaatagacaaaaaggaagtactgagtgcagctattatgtcatgcactggatgtccaccatcattttaggaagtttcaggaataattgggaagtg

SEQ ID NO: 62296 - DNA, 948 bp, Glycine max
  Peptide Sequence Number=SeqID_179074
atgaggaaacctgatctgatggccaacaaggacaaaatgaacaacattaagagcaagttgagaaaagggttgtggtcaccagatgaagatgagaggctcgtaaggtacatgctgacaaatggacaagggtgttggagtgacattgctaggaatgctggtcttcaaaggtgtggcaaaagttgccgtcttcgttggatcaattacttgagacctgacctcaagcgtggtgcattctcacctcaagaggaagatctcatcgttcatttgcactccattcttggcaataggtggtctcagattgcagcgcgtctccctggccgcacagacaatgagattaagaatttctggaactccacattgaagaaaaggttgaaaactaacacttccactccctcactaaacaacagcactggctcatcagagtctaataaggatgttttgagtgggatcatgccctttaatgaacatgacatcatgaccatgtgcatggattcctcttcgtccatatcatccatgcaagcaatggttttgcctgaccaatttgacccttttttcatgttggcaaataatcagtgtgacatgactaatgtttcatctgacttttccaacatgcctgctgcatgcttgactcaaattggcatggtagatgggcatcaagggaattatgggatattggagccaaataaaatggggtcaggaatagacttctcccttccttcactagaaagtagaagcattgaaagcaatagtgtcccaattgatgtgaaaagccataacaaccacttcaattatggttccttcaagaacactgataagattcagggctccaaagtggaggacttgatcgggtttggaaatcatggccaaggggaaaatttaaaaatgggagagtgggatttggagaatttaatgcaagacataacctcttttcctttccttgatttttaa

SEQ ID NO: 62297 - DNA, 721 bp, Glycine max
  Peptide Sequence Number=SeqID_179075
aagcagatagcagccatagggataggtattcaatcgcttgctttaaaaggtatgagattgctcgcagaggactaaggtcgacagatagggataggccagcaaatgcaatgagaaagtcttcttcttttcttgctcaggacttgtcttggaagacgcctgattggattccatcctctattctctacccgatctctatgagagctttgaagtcggataacaccggctgtcgatcaggaatgaggtcgtcgatctccaactcaacctcagtgttcagccgcctcatccaagatggagggctctttcaatctcagctgatcaacattgaggggtggcgggcagttctagcaactttaaccacagtagatctcccacctggaacttatgatcggttccgtctcggtcgtgcctttgcttctgttgcctctgcgttttctcctgagtatcagcaacctgcccatggagatgtaccgctgactgggttcaggacacaaccatcgtccgaaccgtcagctaccaagtcccatgggggcctttggttggaacccataacaaacttaaaaagcacttctgccggtcgacaaatgcgtgctccggttgtagcagtgttgaatgaacggcaggtttggaaccagaccggtgctcctcttcatttgttcccgttaacgaccacaaagcccttaactgctcctcctcgcttacttgccccttttttactacaaag

SEQ ID NO: 62298 - DNA, 1158 bp, Glycine max
  Peptide Sequence Number=SeqID_179076
atggtagcctctagcggcatagcttctctgctattgcctgaaggtagaactgcacattcaaaatttaaaattccaatttcagtttttgaagactcaacttgcaatatctatcaaggaactcaattagctgaactattaaatgagacaagtccgatcatttgggatgaagcacccatggctcacaaattctgttttgaggcacttgatcacagtcttagagatatcgtcaaacacaactcaaaggacaataaaatctttggaggtaaagtcatggtctttggtggagattttcggaagatcctgccagtcattccaagaggcagccgctctgatattgttaacgcaacaattaattcctcttatttatgggatcattgccagatcttaagactgacaaaaaacatgcgtttacaaaacaatatgcaagcaacaaatcaagaagaaactgcagcttttgcacagtggattatagatattggtgatgatattattggagatgaaaatgatggctatgctactattgaaattccacaggaactattaatcacagaatataatgatcctattcatagtataattagctctacatttccagatctatctcatcatcacaatgatcctgaatacttccaaaccagagcaatattagcttctacaaatgaaacagtacaacaagttaatgattatatgcttataatgataccgggtgaacaaatggaatatctaagctataattcagttgacaaatccgaaaaaattgaaagttgtcatttccgctcactaacaactgaatttctgaattcatcgacaacatctggcttacccaattactgtctcaaactcaagattggaacaccaataatgctattaaggaacttagaccaaactcaagggttgtgtaacggtactaggttaattatcacaagactagcaaaacacgttattgcagctgacataatttctgggacaaatatcggagatcatgtttatatcccacgaatgtctttgttgccttcacagtcaccatggccttttaagctattgaggagacaatttccgataatgctttcttatgccatgacaattactaaatcccaaggacaatcactatcttcagttggactttacttgccaaaaccagttctttcacatgactaa

SEQ ID NO: 62299 - DNA, 402 bp, Glycine max
  Peptide Sequence Number=SeqID_179077
atggaatttcaggcacatgaaatgttgaagcagaagaaccttgaaaaacaagtgaaatatcctacttttgaggatttatggtttacttttcatgaggctgaaagtggttctgctgttgctgtagctcaaaatggtgaaatcaatttagatagagaagtgaagactagagaatcttcagaagggtcaccggagcaaagtaaccctacaaagattttagctacatccaatgcctttgatgctgctacccacaatgtcggctctcacttgcagggaaatttcatcgaaccatcatctgtttcactgtttaaagagtttatgacgaagttcagatcatctttgagaagtcatagcaatctttctctgctccttattactattgtcgctctgattttcttcattcag

SEQ ID NO: 62300 - DNA, 1358 bp, Glycine max
  misc_feature (16)..(16): n is a, c, g, or t
  Peptide Sequence Number=SeqID_179078
gatgtcgaagcgcgcncggtggatgccgccacgctggcggccgcactgaacagcgatcggcagcagacggtggccagatacggtgtcggctcgccgctgccggtgctgccggtcaaactgcagggcgtggtgcagccggggcagatgggtgttttcccgttacaggtcgccggtctgccggcgggcacgcagctgcggttgcaaaccggcccggcgattaccggcaccgatctgcgtgatgccagcggcaaaattcagtttggtgattttactaatcagatcgaataccagaacgccggggcggcgattaaccgcgccatgaaagcggcggtgctggagaaactggaccgcgacgcgctgccgggcaaaaccgtgcagtccgaccaactggctgattacgccggtgcgcgtggaggtgcaatgaaaccgttcaacgtcaacccggcgctgctgaaaggagaagtgattctgcaggcgcgcaacgtcagcaaagtatatggctccacccatgcgctgaaaggcgtcaattttgaaatccgccgcggcgaagttaccacgctgtttggtgaaaacggcgccggtaaatcgacgctgatgaaaattctttctggcgtgattacgccaacatccggggaaattctgttaaacggcgaagcaaaggtgttccgttcggccaccgaggcgcgcgactgtggtatctcgattattcatcaggagctgaatctcgcgcccaacatgaacgtgcgcgacaacatttttatggggcgggaaatcatgcggcccggcggggtggattacgccgaagaggcgcggctgacccgccatctgatggcggcgctggaggaggaaattgatccgctgacgccggtggagaacctacgtctcgggcagcagcagattgtggagatcgcccgcgcgctgtcggtgaattcacaaatcctgatcatggatgaaccgacctcggcgcttagcgcagcggaagtggcggtgctgtttcaggtcattcgcgatctgaccagtcagggcgtggcgattgtgtatatctcacaccatctggaggaagctctggagatcaccgatcgcgcagtggtgctgcgtgacggcgtgatgaccgcctacgcccggcgcgacgagatcgacctcgaatggatcgtgcgcaacatggtgggagagcacttcgacctcggttcaccgcccggcggctatgccttcggcggtgacgcgctgacggtgcaggcgttaaccgtgaaaagcaaaaccggcatccggctggtggatcagctgtcgctgacggtgcaggccggcgagattgtctgcatttatggcctgatgggcgcggggcgcaccgagctgctgga

SEQ ID NO: 62301 - DNA, 1626 bp, Glycine max
  Peptide Sequence Number=SeqID_179079
atggcgagggcgtgtagccctctgattgcgagggcgtgtagccctctgaaagggagggcatccgaggacgtgcaatcctctgaaggcaaggacgtgcagccctcggaaagtgagggtgtgcagccctccgaaggcgaaggcgtgtggccctccgaaggcgaggacgtgtggccctccgatggcgaggacgtgcggccttcagaaggcgaggacatgaagccctctgagggcaaggacatgcggccgtctgaaggcgaggacctgtggccttctgaagtcgagggcgtgcggccctctaatcgtgagggggtgaagccctctgaaggcgaggacccctatgaaggcgaggaaagcagtcctctgaaggcgaggacgaacagtcctttgaaggtgaaggcatgtagttctcaaaaggcgaggacgtgcaatcctatgacagcaaggacgtgtagccttttgaagtcgaggacatgcagtcctttgaaggcaaggacgtgtagtcctttgaaggcgacgacgtgcagtcctttgaaggcgaggacggacaatcctttgaaggtgacgacttgtagccctcgaaaggagagggcgtgcagcccttcgaaggcgggggtgtgcggctctcggaaggcgaggacgtgcaatactctgaaggcgaggacgtgtagttttctaaaggtgaggacgtgcagtccgctaaaggcgaggacgtgctgtccactgaaggagaggaggtgcagccctttgaagtcgaggacatgtagtcctctgaagatgaggacatgtagtcctctgaaggcgtggacgtgcaatcctctgaagacgagggcgtgcagccctcttaagacgaaggcatgtagccctctgaaggcgtgggcatgtaatcctccaaaggtgagggcgtgtagccctctaaagctgagggcgtgcagccctctgaaggctagagcgtgtagccctctgaaggcgaggacgtgcaatcctctgaaggcgaggatgtgtagccctcggaaggcaagggcgtgtagccaaccgaaggcgagggtgtgcaaccctcagaaggcgagggcgtgtggccctcggaaggcgaggacgtgcggccctcagaaggggaggacgtgccaccctcttagggcgaggacatgcggccctctgaaggcaaagacatgcagccctctgaaggcgaggacgtgcagccctctaaaggcgaggggcgagggcatggagccctctgaaggcgaggacgtgcagtcctctgaaggcgaggaaagccgtcctctgaaggcaagaacgtgcaatcctttgaaggtgaggatgtgtaacactctaaaagtgagggcgtgctgccctctgatggcgattacatgcagtcttttgaaggcgaggacgtgcagacctctaaaggcgaaggcgtgtagccctttgatggcgaggacatgcagtcctctgaaggtgagggcgtgcagccctctaatggggaggatgtgcagtcatcttaaggggagggcgtgtagccctctgaaggcgaggacacgcagtcttctaaaggcgaggacacgcagtcctttgaaggtgaggatgcgtagtcctctgaaggcgagggcgtgcaaccctcttaaggcgagg

SEQ ID NO: 62302 - DNA, 243 bp, Glycine max
  Peptide Sequence Number=SeqID_179080
atggagattaagaggaagaaggatgtcattagttttgctatgctcatagccaaggatttggaggtagggattgaggtgaataggagtgaagatggggactttaagaaagaggatatactgaaggcagtaaaaactatcatggtggaggatgataaagatcctgggaagcacataaaagaaaatcacatgaaatggaaggagtttttatctaggtttgggaattcagaacaaattcatcactga

SEQ ID NO: 62303 - DNA, 345 bp, Glycine max
  Peptide Sequence Number=SeqID_179081
atgctggaaacttttaaacaacaagaccaaatgtcagttctagaattgtacatagaaaaggatgtggctggtggttcaatgtttcattctgcgaattcgcttacatcatgtggaaattatttatctaatgatgagacacaaccgccaataaatatgagcaatttacatgttgacgaagatgatgatgatgatgatgatgatgattattatcttgtgtctaactcatacgttgaagagtcgttagacaaagatgacagtgttgacggtatatctgatacagacgatgaagtcaccgacatgattcaaccaataagaattgttcacccagcagaaggtgcacaatga

SEQ ID NO: 62304 - DNA, 1588 bp, Glycine max
  misc_feature (105)..(105): n is a, c, g, or t
  Peptide Sequence Number=SeqID_179082
ccacggtgattgccaccactgcgctggaagccgacggctgggacaccgggctgatggtgctcggcaccgagcgtgccaaagcgctggcgctgaaacagcatctgncggtgtatctgattacgaagcagggcgacggcttcagccactggatgtcgccacagagccgctggccgagggcgcggtgattctgcgtcgccgggcgcgcgagcaggccgatgcgctgctggcggcaattcatgacgtcgcggcccttaacccgtttgcccatcgcatcacgccgggtggacatcgcatgtcagtcgccatgaccaactgcggcgatttcggctggtcgaccgattcgcgcggttaccagtacaccgaacaggatgtcagcagcggccgtaaatggccgccgatgcccgcgctgttccgcgcgctggcgcagcagaccgcgcaggaggccggctttgccggtttcaatccggacgcctgcctgattaaccgctatgagcccgcgcggcgatgcgacgcagcgcgtgctgctggagcacggcgatatcgtggtgtggggcggtccgtcgcgcctgcgctatcacggcattttgccgctaaaagcgggcatccatccgcaggctggcgcgttccgttacaacctgaccttccgccgcgcccagttgtttttcgccagtaccgctggccgtttattggcgtgattgtgctgacgctgctcagcgccgcgctgggtatcgggctgatcgcctacatcaataatgaactgatcgtggcagtcaatacctcgctcaccgtgctgccgggctttctcgcccagctgtttctgctgatggcggtgacgctggcgtcgcagctggcgctgactcagctcggccaccattttgtctggcggctgcgcggtgagtttatcaaacgtattctggatacccgggttgaacgcattgagcaaattggtaacgctcagctgctggccggcctgaccagcgacgtgcgtgccatcactatcgcgtttgtgcgcctgccagagctgattcagggcatcattattacgctgggttccgcgatctatctggcgtggctgtcaccgcaaatgctgttgatcaccacgctgtggctggtggtgacgctgatcggcggctggctgctggtgtcgcgcgtctatcagcacatggcgaagctgcgcgacatcgaggacgagctgtaccgtgattttcagaccatcattgaagggcgcaaagagctgcagcttaaccgcgagcgcgcccggctgatttacgacaccgtgtatcaggaaaatgccacggattatcgtcgtcacattgtgcgcgccgataccttccatctcagcgcggtgaactggtcgaacattatgatgctcggcgcgattggtattgtgttcttcatggccaacggtctgggctgggccaataccgctgtcgccgcgacctattcgctgacgctgctgttcctgcgcacgccgctgctggcggcagtaggcgcgctgccgacgctgctcagcgcacaggtggcattgcggaaaattaataccttcgatctggccccttatagcgccggattcaacgcgctggcgacg

SEQ ID NO: 62305 - DNA, 406 bp, Glycine max
  Peptide Sequence Number=SeqID_179083
tcaagcaagttcacaactgcccggttctagtcagttttcagcagaggatagatttttttacaaagctaaggcgaagagtctttctgagataaacaaaatctcagaggaaattgtttgtgtaactgtgggtaccattggtagtagaattgttatgaaaaatcattcatggtgttatgcagcttgcatccagtataacaagaaaattgatatagacaatactcctttcacatgtgcatgtggcagatataatcaacaagatgctgatgatttgaatacttctctagaagcactcgataaaatcctaggttatacacttgcatttaaagtcaaggctgttgcttctggaggaagcaaccttgctcgcttgggcgagctgagcttgcctgggcgagctgagcttgcctag

SEQ ID NO: 62306 - DNA, 210 bp, Glycine max
  Peptide Sequence Number=SeqID_179084
atggctacagccaggtgggcactcaaacatcctgtttatggcattgtgatactacggttgggaatttacacagacagacccaacgtttccaagttatgttctttcatcagttcaatgaattcatccatctttatctcggttcattccggaaaatacactcttagcatcagtcccttgtttccagaagatacgtttgctctttacgaatga

SEQ ID NO: 62307 - DNA, 348 bp, Glycine max
  Peptide Sequence Number=SeqID_179085
atggtgggagcaggtttgaaaaaggatcttagagtgtctagggttgtgccaggagggtctcttaatgccttcctttttcttctcatcggagttatttcacaaagacttgccatgggtttcctcatttgggatcctggggaagaggatcaagctggcccttgcgaacagcttgatgcactatctcccttcaacccttttgagcgaaatgtggcaaaaggaaaaagaatccatggaccgaccccatcgtctccaccccgtaggaactacgagatcaccccaaggacgccttcggcatccaggggtcgcggaccgaccatagaaccctgttcaaaaagcggaacgcattag

SEQ ID NO: 62308 - DNA, 273 bp, Glycine max
  Peptide Sequence Number=SeqID_179086
atgagagatcgattgaaggatatgatttgtgaccctggacaagagtcttttcagcaaggtgcaagaattacttcactgcttcaagtagtgtacgatctgcttccagagaaaaacacgttgcctaaaagttactatcagccaagaagatattgtgtccgatgggtatggagtatcagaagattcatgcttgcccgaatgattgcatactgtactggcatgcattcgaagaaatgtccaaatgccctaggtgtagggcgtcacagtacaaagtaa

SEQ ID NO: 62309 - DNA, 474 bp, Glycine max
  Peptide Sequence Number=SeqID_179087
atgaggggcatcgtgcatgagcctcaagtgaacataggggcagatcaaaataccctcacctttagaggactacacgtcctcatcattagagggctgcaaaccctcacctgcagaggactacacatcctcgccttccaaggactgcacgtcctcacctttagaggactacacgtcctcgccatcagagggttgcacgccctcaccttcatagggctgcacgccctcaccttcagagcactacacgtcttcgcctttagaggacttcacgtcctcaccttcagagggcttcacgccctcgccttcagaggactatacgtcctcgcctttagaggactacacgtcctcgccatcagaggactacacgtcctcgccttcagagcacttcacgtcctcaccttaagagggttacacaccctcatcttcagaggacttcacgtcctcaccttcagaggggttacacaccctcatctgtag

SEQ ID NO: 62310 - DNA, 261 bp, Glycine max
  Peptide Sequence Number=SeqID_179088
atggggtcacgctgttttgggagaatgctccaaccatgtgggatcggcatatgcttagaggaacactcaaatcggacgacccccaaggcctacacttcgaagagtccgtcagggcctctccctcctgattcaggtccaatccctaaaaaagttttgcatgcagacactactaatgaattatacaatacccacgacctcacactcgtgttttacacatgtttaacacaattgcgatacaatttaacaccgattcctgaatag

SEQ ID NO: 62311 - DNA, 465 bp, Glycine max
  Peptide Sequence Number=SeqID_179089
atgtctatttggcaaacctcagtccactttgctcttccctccactacattccctttgtcggtgattgttcatattcgggcttggcagtcagggttttcatttgcattgtcttcgcgtttcgcagagagaatgaatgacaatataactttaatattgcaccatggaggaagattcactccacgtgccagtgatggaaaggttgaatatataggcgaagaatttgacgtttgggaggatatatctgcagatttcctggatgcatttatcttatatgatctggtgaaagcttgtaagaagtatagcaatatgggagattgtttttggttgattgataaggacttagtgatgcaatcctaccccgcaagggcattggctagaagactccaagtagattgggctagagatccaaggaaaggccctagggttctcatgagccttagggtagatttcgagcccatgggctaa

SEQ ID NO: 62312 - DNA, 397 bp, Glycine max
  Peptide Sequence Number=SeqID_179090
atggaaagtataattatgagaggaaagcttagtcaagatgcaaacaagggaataatggatgagaatgatcgcttgttaaatattttttcaaaggaaacatcaacaagattgttgtatgtggagaatccaatttctttatttggtgctcttcgaacaagaaatggagctccagttatagttctcgaagggcatcttgaaatcaatccaacactgagcattaagggtgcaaagattggtgccactctttggcaaaaattgtttcctgaatatgaggcaaagttgcaatgtggttctgcatatgtcattcagaacattaaggagatcgatcgtcctgaaattcctcctaatgttcatgttattactcaatttggagtagcaccacgtgacactttagttg

SEQ ID NO: 62313 - DNA, 483 bp, Glycine max
  Peptide Sequence Number=SeqID_179091
atgcctcaccaacctccaggatggaagcacgagattaaagccaggctctgtattccttgcaaggggtttattctgaatgctgagggccaaccatggaaactccttaggaaggatctgactacactagcccagacatggagtgtcttctcttactccaacttagttcccacatcccacacctcatatttgaacatggacagagccaggttggtttatggcttggtaacccacatggatatgaacattggtgccctgatctcaggtcaaatctcttctattgctctaagtaactcctctttacttggatttccagccttgatcactgccctctgcagagctagaggagttacctctgacagtatgacttatcagagcctgagtctggccattaacttggcctacattaggaaaaagtgttggaatgtggatgatctgacagttaactttagaggggcaaggaaggcaagggctcggccagctgat

SEQ ID NO: 62314 - DNA, 723 bp, Glycine max
  Peptide Sequence Number=SeqID_179092
atgtggtttgtcaggctaagcgagggtgtctctcttagccagagttatgtttctaaggcctccaaaaagaggaaagcatcagcctcccgacctcgagaaccatacgacactacaggatttgtttctaaggtcgcttgggaacgatacgcacagaacgttcactccaggaacatcattccaaagaggaacatcaccctgtacatctccgagtatgatgagttcaattgggaactcgagcagcggcaatggcatagagccttgaccaggcagcctgacaatcacattgatgtggccctggtaaaagagttctatgccaatctttatgatctagaggagaagtcccagagacatgtcagagtttggagcaaattgattaagtttgatgttgcttccctcaatgagtttgtggccagattatgcattctagggcgtgggtttgttctgaacgctgaaggagcactctggaagctcctgaggaaggacatcactactcttgctcagacctcgagcgtcctctcctactccaacctcgcgcctacttcttacacatcagatttaaatatggatagggcgaatttggtgtacagcttaatcatgaagatggacatggatgcttggatttccagctcttatcacaaccttatgcatagcccggggagtcgtctcagattctctgaccttcgagctctcttgatcatgaaggtaatcattagccacaacctg

SEQ ID NO: 62315 - DNA, 243 bp, Glycine max
  Peptide Sequence Number=SeqID_179093
atgtggaggttgtctaagaaggtgtcagacactaatttcttccggatactgtcgtttgctgatattttgattcttgctagtcaaattatggtgtttgacaccagttatagcacaaagcaaggaatcactcagtgttttgatcaagaatacaaaaggataccaaggaaaggggtaaagggtctttttgggatttttctagaccctggcttgcccaagatagcatttgactcacctgagccatga

SEQ ID NO: 62316 - DNA, 279 bp, Glycine max
  Peptide Sequence Number=SeqID_179094
atggccacaccttttaaaacaaaggatgtcaatgaggaaataaccacgaaggatattaggagcttaatggaacaggctaattacaccaacaaataccttgaggtgttacaggaatctattagtgaagaaaaggagaagggtgtttttgagcggaaggaggcacaagcgtcgaagtcaaagaaggaggaagtggtggccatgagggaaagtgttttggagattaagaggttaagggagagggagggggtactgagagagttacaccacgaaggaaagtga

SEQ ID NO: 62317 - DNA, 537 bp, Glycine max
  Peptide Sequence Number=SeqID_179095
atggtagtcataagcctaacaaagattcctcaacctccatttcctcgaggatacaacttgtcgcaacctaccctttggcaggagggcgacgcgagactcatgggtgcatcttccaaggaaggaaaacgcgcggagtcgccaccaacgtttattcgaggaaaacgttggaaaaaccggaaaaggcgtagtctacgaactttaagtgtgaaaggttcgggagttgtatttatgcacggggaaggtattagcacctcacgcgtccgtcacaagggatgtcagcctttaatcaaggaaaaagagggaggtggttgccgcccagctcgcccaggcgagctggattgctttcaccagaaggcaccgccttctgttggaacatcctggaaggcccaaaatgtcacggaacttcacggattgcctaatgatggatatcaagtacctcgaagtggtcaagcgaggcactgtatgatcttgaaacataaggtgcaaagtctaattgacgtgggttggatgagatttgaggaggagaatcacttgtga

SEQ ID NO: 62318 - DNA, 435 bp, Glycine max
  Peptide Sequence Number=SeqID_179096
atgcactacattatttgtcacatttttcttcctaggtccaccaaccttgcccaagcctctgaggaggatttaatcttgttatgggctcttcaaactggtggtcaaatcgactgggcctatcttgttcggtactggatgcataaggcattacgggccaatgcacctttgctatatccccatcttgttaccctctttcttcaccatttcaatgtccccttggatgatgaaccttttgtcaaagtaaaacattccttttctattggtgtcggtgctgtcacatctattggttaccagaaagacatggatggtcaatgggttcgcaagcaagacatgcccctccctattcccgacgagtgtacaccatctccaccaccgcaacgggatgcctcttcttctctcgtggctggagttctcatggagctccatgatctttga

SEQ ID NO: 62319 - DNA, 720 bp, Glycine max
  Peptide Sequence Number=SeqID_179097
atggagaatttttttaatcaaatgagggattcgaaaataccaattcagaagactcaatctttcaaaggagagaagaaacagggtggtgagaattggttccagaaacagttttcaaggaaaagaagtggtgatcatgactccagagacatggaccatgctgctgcagtggctgctgctgcattcgcagttaacttgcaagatgtttctgaacagaagagtgagaccccggaggcctcattgacaaagatcaaaagcaaggtggatggcacaaaacctccaatccccttacttaatagtgcatccaagcgattgtcaagttcatttagatctaagaatgaacaaggtaagaagccagaagagagcattacccctgcaccatcaatgagaaagagttcactttctctgatgaaaagcctgagacttcaacaaagcctgcccctgtatgacaagttgagagaggtgatagattcatgggaaaacaagaagaagatgaaagccagacgcaagctagataaggaagagagaggagttgcgcaaagaaggatgaaagctttggaagattttcagaataagatcacagctatagatcaaattgcagatggagcgagaaccaaggcagaagaaagccggaggaatgaagaacaaaaagcaaaagagaaggcaaatgcaattcaaacaacaggcgagatgccaggcatttgcttctgcttctgcttctga

SEQ ID NO: 62320 - DNA, 312 bp, Glycine max
  Peptide Sequence Number=SeqID_179098
atggaggcacttgcgagaacagcaaggagaagacgtagaagagctattcttttggcttgttgggccgcgatgcgcgtgtctacttggtgggccgcgtccaaccgcgcatgtcttactgttcaaccgtgtccgatgacagcagaagcaacggacaccgcgtcgcaccggagtcgtactcgcatgggtgtccagtgcgagtctgacgcgggacacgccggtgatgtgccgcgtccgtgcttcttagctttccaggtagttcaatttcttttgaaagcagatactactggattcccaagttctgcaccttcttga

SEQ ID NO: 62321 - DNA, 300 bp, Glycine max
  Peptide Sequence Number=SeqID_179099
atggcgggtcacagcagctacacttctgggagatgccacacaggtcacaggcacgggctctctcacgtactcacagcacgagctccactgcacacaatgggcgttgccgagaaagcgaggtttcgaggaactttcaggggtttgaggagagcgaggtttgagggaaacctaggtacagacttcgcgaagggcacagtagagagaggggttagagttagggcacaacagagagaggggagagagcgaggttcaactatgttgtggaaagagagagtgaggttcagcagagagaggggttag

SEQ ID NO: 62322 - DNA, 1053 bp, Glycine max
  Peptide Sequence Number=SeqID_179100
atgtccaagtatggaacatctctattggtgccttctgttcatgaacttgtgaagcaacctatcaccaaagttccagatcaatatcttcatccaaatcaagatcctcctgatatatctaacacaaccttaccacaagttccagtcatcgaccttagtaaattgttatctgaagatgtcactgagctagagaagctagacgatgcatgcaaggaatgggggttcttccagctgattaatcatggagtcaacccttcaatggtggaaaacgtgaagagagatgttcaagagtttttaaatcttccaatggaaaagaagaagcaattttggcaaatcccagatgaattggagggttttggccagttgtttgttgtatctgaggatcaaaagctagaatgggcagatatgttcttcattcacactcttccaataaacgcaaggaatcttcgcttatttcctaactttcctcaaccattgagggataatatagagaactattcttcgcaattgaaaaagctttgcctcacaatcattgagcgtatggcgatggctcttaagattgaatcgaatgaactgctagattacgtgtttgaagatgtatttcaaacaatgagatggacttactaccctccatgccctcaaccagaaaatgtcattggaataaatcctcattcagatgcttgtgctcttaccattctactccaagccaatgaaacagaaggcctacaaataaaaaaagatggaaattggatccctgtcaaacccttgcctaatgcttttgtcatcaacgttggagacattttggagatattgaccaatgggatttaccggagcatcgagcatcgagcaactattaacaaagagaaagagagaatttccgttgccacatttcacaggcctctaatgaacaaagttataggtccaacacccagccttgttacttctgaaagagctgcagtgttcaaaagaattgctgttgaagattattacaaagcatacttttctcgcgggctaaaaggaaaatcatgccttgatttgatcagggtccaaaaatga

SEQ ID NO: 62323 - DNA, 756 bp, Glycine max
  Peptide Sequence Number=SeqID_179101
atgaagatcaacatggcaaagccatgtgtgcaggagaacgaaagtatttgctctcaaagggcaccagtcattgaaccaactgtagttgaagtttcaccacaagctaaccctcatgttgaagttataaatgtcccatcatttgtaccaacaacacttgcgcaaaatggtaggcatggattctttccttcaggatttgcacgatctgatgcagatggcaaggatccatttggtgattcaaggcgaatagcctgcaaaagatgtgctggctttcatgtctggatacacaccaagaaacaaaagtctcgggcaagatggtgccaggattgccaagactttcatcaagctaaggatggtgatggatggtttgaacaatcttcccaaccatttctttttggcttattacagaaggttgatgctccttcagcatatgtgtgtgctggtagcaggatatatgatgccactgaatggtatatctgtcagggcatgagatgtccagcgaatactcataagccaagttttcacgtgaacacaaatttaatgtccaagcataattctggaaaaggaactagttcaggtcaaagaggtgggcatatgccaacacctaatatcgaagaaaccatgactgaggaagaattatttgagtggttacagaatgcagtacatgcaggtgcatttgacaattttagtggcactgcaacaaagagcccatctcccaaatctggaaatggaatgaaaagcctttgtgatccatgctag

SEQ ID NO: 62324 - DNA, 396 bp, Glycine max
  Peptide Sequence Number=SeqID_179102
atgggggtgcaaatagcacccaggcccatttgggccctccagaagattcctccagaaggcgccgaggcgcttccgaaacgtttcagtaacgtttcccgtgaggaatttcgcaaagatttcaaccgttcttcgacgttcttcattcgttcttcatcgttcttcgatcttcaacgggattcaaatgcggtggcggcgaggaagcaaaacatggaggcgaggtcagaggggacgacgacggagaagagtcgaggggtcaagaacttgatgcgggggatgtatacgttgaagaacaagtgcgactataggaatgtcaggcgccaaggctattgtgccgctgcctcatcggagaagaacgtcttcctccgcctcccattgcgctgctgccgccgcactgag

SEQ ID NO: 62325 - DNA, 105 bp, Glycine max
  Peptide Sequence Number=SeqID_179103
atgacacagtcagacattaacaaagatgaacatcagacaccaactaacactacacaggatgatcaatttgtcggcgatgacagctcagattccaccgataatgat

SEQ ID NO: 62326 - DNA, 1725 bp, Glycine max
  Peptide Sequence Number=SeqID_179104
atgtttaaactcactattttgcttgactcagtatcatactctcttcatataaattgtggggggaagcaaataacagtcaatggaaatggaacatatgatgatgatacagatacagcaggaccagctagattccaccttggtggaaaaaaatggggatctagcagcactggtcacttcatggataatgaccgtgcagaatattctatttggctaaatcaatcgaagcttttcatcattgatgttgaattatacatggatgcacggaaatatggtgctgaaggatttcaatattgcagaagaagcaggggagttaataaagcagtcacaaaatcattcaccattgtgattagtagtaacacattggaaatccgcttatattgggctggaaaagagacaattggtattccatttaagtccgtatatggtcgtcttatatcagctatacctgtaaatcccagaacaattaaaacatgccatataagctcgtataacaatgtcttctataacaatcaagcagacttcatcctttcctcagaaaatggaagtagcatgtctgcaggttccgtggctgcaattgtggctggtgtagtagtttttcttgtgctgttgatcaagtgtgccaatggtgaaaatagtattaataatctggaactttctcaactattagagatctacaatctttctttgtttgaatttacagagctaaagggtttaaaactgcaaatgggtatatttaccttacgacaaatcaaagcagcaacaaacaacttcaacaaagccaacaaaattggagaaggagggtttggtcctgtgtacaaaggaaatttatcagatgggacaataatagcagtcaagcagctttcttcaaaatcaaggcaagggaaccgcgagtttctaaacgagttaggcatgatttcagctttgcaacacccttgtcttgttaaactctatggctgttgtgtcgagggagatcagttattgttggtatatgatgaatatatggaaaacaatagccttgctcggactttgtttgcagaataccacattaaattggattggccaacaaggcaaaagatatgtgttggtattgctagagccaagctagatgaagaggacaatacccacataagcacccgaattgctggaacttatggatacatggctcctgagtatactatgcatggatatttgacagacaaagcagatgtttatagcttcggagttgttgttgccttggaaattgttagtgggcggagcaatatgattcaacggcagaaagaagaagcattccatcttcttgattgggtaaatacttccataatgtgttcacgaaaatgctattttcctttagccatagagtatctaatagtgctagggtggtatatgtttggtaatctgatcgagctagttgatagaagattgggtttggacttctacaaaaacgaggttacagcgaggatcaacgtgtctcttttatgcaccaatgtcacagcctccctcaggccaacaatgtccttagtggtaagcatgcttgaaggtagatctgtggttcaggaggtgttttcagagtcaagtgaggcattggatgagaagaagttggaggcgatgcgacagcgttaccaagagataatagaagaaaataagttaactgaaaataagttaactgagattcaacggatgacatattggctgcttcatcatctgcaacagatctctatcctgtaa

SEQ ID NO: 62327 - DNA, 894 bp, Glycine max
  Peptide Sequence Number=SeqID_179105
atggctgcgtggaagaagttggcaattttagggaagggttcttatgctacggtttatcttgctactgttgctcttccacaagaatgcaatgagaaggttgtagcggtcaagagttcgagccctttctctttctcaattgcttcaatgcagaaggaaaaaagaatactggactcattcttgggttgcaaggaaatccttcaatgctattttgaccaattcactgttgagagaaattatgtgacatacaatcttttcatggagtgtgctccttatggttctcttcttggtttagtaaacaagaaggggccaatatcggatagtgaagtaagagtctacactcgtatgcttctcaaagggctttcttgcattcatcgaaaaggagtcgtccattgtgatctcaaaccggacaacatccttctctttccttcatctgatgatcatgcaaggtatcaactgaagattgctgattttgggttgtccaagactagagaagatgcaaatgctgagtatgggaaggtcaagtttagagggacacctttttacatgtcgccagaatcggtcgttggtcagattgaaccagcgttagatatatggtctcttgggtgcattgtaatcgagatgatcactggattccgtgcatggaagaacctgcgaacccaaaaggagataatgttcaagcttgttgtccttcaagaagcacctgaaatacccaatggactgagttgggattgcacgaatttcttgagcaagtgttttgtgaaggatcctaggcagagatggactgctacaatgcttctcaaccatccttttctttatccaacatgttacatgcgtagttcatcttttttctcatatgatattgttagtcatgtgccctttaagactgttatgtag

SEQ ID NO: 62328 - DNA, 273 bp, Glycine max
  Peptide Sequence Number=SeqID_179106
atgaggatggaagctgaaggtgtaacatcaaaaagcaagaaaaaaactgaagaaaagaagaaaattggaagcatgcccggtctagtacgcacgcttagcgcgtgtcacgtgctaagcgggccaggaagcacaagccctaagcagggcgttaagcacgaagacgcagaatccgttactcacgctaagcgcggagcacgcgctaagcgaacgattcaacagaagcacacgctaagcctgcaacacgtgctaagcgcacgatctgaacgcgcttag

SEQ ID NO: 62329 - DNA, 951 bp, Glycine max
  Peptide Sequence Number=SeqID_179107
atgggagaagtggctgatgaaggtcaatatttcagatcagaaatagctctattgaattactcggatgcaaccttcaaacccccactttcttctctgttgatacacattgatccactcataatacccaatggccacacttgttctgcatcagaatctgatccatcacccacttctcagcaccatcagcaggagcagcatcccaaagatgcctggcttccaatcactgaatcaagaaatggaaatgcctattatgcagcctttcatattcttaattccaacattggattccaggctctcatgcttcccgttgccttcgccactcttggttggtatcttagagtccaaatttcttatataaggaagacaacacatccatgcaccggccgcacccaaagatttggatctttcaactccaaaaagatcgaatggccaaaaatcgtgagaacacagctacaggagcgaatcccattcatgcaaagaggaaatacacctgttggactgaagaggaacacaagccacaggccaggccatccatgcataactcttccatccaaagtggtaatcatcagaatgtctccatgcctccagcagcttcagataacaatttgcattcaactgaagatgtgcccggttatagtcttaattcttaatttcttcctttcagctgaagatgatgtttcatcagtggctgcaaacatagagcattttcaatttgaccccataaagtctattcacttcagtaactcaaatcctgtgtgccaggcatttgatcaggatgctaaggatgggcgtgatttgctcattggtttgaactctggtgatgtctactcagtgtcattgagacaacaattacaaaatgttggtaaagcctatcggcgcttcatagtctattatagattatttattgttcatgttgtggtgactgccaataatgcagtcctttatgtgtga

SEQ ID NO: 62330 - DNA, 383 bp, Glycine max
  Peptide Sequence Number=SeqID_179108
gcaaatctttagtgtcatggcgtgctaaaaagcaagcaactgtgtccagatcatcttcagaagcagagtacagggctctgtcttcagctgcttatttgagagttcagcttaccagaactccaactctttactgtgacaaccaaagcgcagtccacattgcctcaaatccggtttttcacgaacgcacaaaacacttggaaattgattgccatcttgtgcgagagaagcttttgaagggcactctaaagctactaccagtttcaacaagtgatcaagtggcagattttctcaccaaagcattggcaccacccaaatttcatgattttgtctccaagcttagcatgatcaacatctaccatgataagcttgagggagggtgttga

SEQ ID NO: 62331 - DNA, 1102 bp, Glycine max
  Peptide Sequence Number=SeqID_179109
atcatggttaagactagaggattaggccatgcgttaggtagggttgttgctagagtacctgcggactcgcctgcggtaccagaggcacatgctactgtagttggggatgagccaatggacaccggtccagagactgacgcacaggatattggtgcacaggatgctacagatgagcctgagggatttcctggtggacccagggacccatcagtgcttacggaatatcttgaccatgttgcagccagtgtatggtctggacaggaatgtcctaagttgaagttatcctcccatgggaggaaggtgcataacttgggcaggcctgttcctgcaattgaggacatggttgttgggataggattaagtcctttgatcgcatgttcgatagacactggcgatcggggacttatatcctcctttatcgagaggtggcaccgggagacttctagtttccatcttcctatgggggaggtttcgatcacgctggacgatgtcgcgtctcttccccatttgcctatcgttgttgcattccatgactttcagcctctacgcaccgatggggcgatggtgctgttggttgagttactgatggtctcaacagaggtggccatggccgagactggccaatgtggtggaccatatgccctgcgtgacctcacttttgctgatggggagctgctggcctcatccatatgtacgatcaacttaatgatgccagtctcagcactagctgacaacttgctgtgcaatgctgatttggactacgacgaggtgtcaccacgtgcatgtcggtggattgcgacaaagaagactgtgaaaaaggtatccacaacgacgtacaagcagtgcttggatcgtctgaggatcctatatgtctgctggatgccatatgcggagcaccgacctgcgcaggactttcatctgatttcatgcttctcagggcagctccgctgggggcctgttgttgtcagatacagaccagagaaggttatgcgccagttcagctacgtccaatgcattcctacacaccctatccattcatgggtgtcatatgatgacatggatgatacttggacgcattactcagaccatttggcggcagcag

SEQ ID NO: 62332 - DNA, 201 bp, Glycine max
  Peptide Sequence Number=SeqID_179110
atgaggaactcagacctacgtagttcttgcaaaagcgattcgaaaacttacccgttgaagaatgaagaacggatgaagaacgatgaagaacggatgaaaaccttcacggatttgcttacggaaacatctcggaagcgttacggaagcacctcggcttggattttcttcacggaaacaatttttttcacccaaaacagctga

SEQ ID NO: 62333 - DNA, 693 bp, Glycine max
  Peptide Sequence Number=SeqID_179111
atggaagagaagcagagagtgataatagtgggagcagggccttcggggatatcggcggcagcatgcttcacgaaacagtcgattccgtacataatcctggagagggaagactgttccgcttccctgtggaagaaatattcatacgagcgcctccacctccacctcaggaaacagtactgccagcttccccacaaacccttcccagcatcttttcctccctacgttcccaagaagcagttcttgcagtacctggacgactacgtctcccacttcggaatcacgccgctgtaccgaagaaccgtggagctggccgagtacgaccagggctgccacaactggagggtcatggccctcaacggggactccggtcagctcgaggagtaccgtgggaggtttctggtggtggccactggtgaaaccactgacccttttgtgccggagcttcaaggcctcagtggctttcctgggaagctcattcattccactgggtttcgttctgggaaggatttcaaagatcagcatgttcttgttgttggatcggggaattctggcatggaaatcgcattggaccttgtcaaccatggtgccaaaacttccattctcgttaggagcccgggagatggtgagtttggggttgtttctgttgaaatatttgtcgttgagcaccgtggactcgctgatggtgatgcttag

SEQ ID NO: 62334 - DNA, 192 bp, Glycine max
  Peptide Sequence Number=SeqID_179112
atggctgaggcaagatctcaacaagctgcttccatgacagaattcctttggcttgggccacatatttccaatatcaaatgccaaaacaagggtttccatcctgaaagatcaacaatagagaggtacaaaaaggcctattctgatcactcaagcgcgagcactaccacaaaaatcaatgctcagaaaaattaa

SEQ ID NO: 62335 - DNA, 624 bp, Glycine max
  Peptide Sequence Number=SeqID_179113
atgacgccaagaaccctaacccccaatccctctagaggctccacccgcgtctcactcctcgctccaaaggctaaatgcctcttcgtctccgcatcgctctcccaactctccaccctcctctgcctccttctcacagcgctcccccggttgttccccgtcgacgtcacgctctccgccgccttttgcctccgcgggctctccctctacgccgacgccttcatccccgagggtggccaccgcctcctcaacgtcaccagcagcgtcggaggttccactcagtgcgatctggatgagtccaagctccgcgccttcttggcaagaagggctttgagggcattgaaggcagtggccttggttcgagttcaggccagagtaagagctagtcgtgtgaggatgtccatagaggggcaagctgtgcaaaacttgctcaacgtgcgacggagtaaacatgatcttttgaaacaagctgaggaaggatggtgtgacagcagaggaacgttggaagacgttaagacaaagatacaaatgaggcaagaaggagctttcaaaagagaaagagccatggcttactctcttgctcacaagcaatgcagggcaacaccaagcctttttcctcatttctag

SEQ ID NO: 62336 - DNA, 348 bp, Glycine max
  Peptide Sequence Number=SeqID_179114
atgggagactactggaagaatatgatgaatggcctacctatgtctgaatcaatcaaagacatccttgttcaagatcctcacgtatcagatgcaatgaaggacctatatattacagactttgatataaagcctaatgtcatcttatatgacacacatgttgttcccaacaagcataagcaaaagattcagcaggccatggccaagaaattggaaccaaagtttcaaggaactgagagacatggggaagtccatttcacttgcaatccaagcaaaagtgaatgttcaaagaaaggaaggtttgagtttgactgggggcagaagtttgacaggctagaaagagcattttga

SEQ ID NO: 62337 - DNA, 595 bp, Glycine max
  Peptide Sequence Number=SeqID_179115
atggtataccaagaaggcgcggagcttggactcatccagatcgcactgagtggaacctccgacgctgctggtgacgttgaggaggcggtggccaccctcggggatgaaggcgtcggcgtagagggagagcccgcggaggcaaaaggcggcggagagcgtgacgtcgacggggaacaaccgggggagcgctgtgagaaggaggcagaggagggtggagagttgggagagcgatgcggagacgaagaggcatttagcctttggagcgaggaagcaaaggtattggcttcaccactttctgttactaatggttctattcatgtcatgccagttagtgttttgcagctttgctataagcagttaactggaaggatacctacacaacttggtgatttgaagaagcttagtgttcttgctcttcagtcaaacctgctgggtggagctatccctgctagtctaggtgatttgggaaagttaatgaggctagatttgaaatctaataatatctttggtttcattcccattaaactagctgatcttccttcactgcaagttctggatgttcacaataatactctctctgggaatgtacatcctg

SEQ ID NO: 62338 - DNA, 522 bp, Glycine max
  Peptide Sequence Number=SeqID_179116
atggtggaggcggtggctttagaggtggtggtggatgtggcgacggtagttgacgtcgatgacgaacggagcaaagcggagtctcagggatctagcagtaacggcggggttggtgcggagcggcagaggccacaactggatggatcggaagtggcgattgatgtcggcacggtgctgccacacgctaacggggaaatcgatggtgttggaatcgattccaataacaggactatctcgttgtctagccatgggaggaggcacgaggaaacgatagcggcgacaatagcgatagtgatgggggtggtggttgcgctaaaggagggaacagtggcggcggcggcggctgcaccagagaaggtgacggggagtgttggcgggagatcaggatctgaatcctttgcagcgaggttggccatggctgcctcgagtcggtctaggctagcgtcgagaggttcggtatctgccattgaagaacgacagagaagggggcaggtcgaaccaattgttacgaaaaggaattaa

SEQ ID NO: 62339 - DNA, 1248 bp, Glycine max
  Peptide Sequence Number=SeqID_179117
atggttagaggaactatatgtggagcaattagacataaattgataccgactcctcagaatttggtgacttcaactccattaacaactacttatgaatctttttttggattacatccattatctcaagttttggatcaaactaatccattgacccaaatagttcatgggagaaaattgagttatttgggccctggaggattgacggggcgaactgctagttttcggatacgagatatccaccctagtcactatggacgcatttgtccaattgacacgtcggaaggaatcaatgttggacttattggatctctagcaattcatgcgaggattggtagttgggggtccatagaaagtccattttatgaaatatctgagagatcaaaaagaatacgcatgctttatttatcaccaagtagagatgaatactatatggtagcaacaggaattctttggcacttaatcgagatattcaggaggaacagactgttccagcccgataccgtcaagaattcttacgattgcatgggaacagcttctctgattccttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcag

SEQ ID NO: 62340 - DNA, 735 bp, Glycine max
  Peptide Sequence Number=SeqID_179118
atgtctctgatctgcaacaagtttgaacctctcactattgatgaggttgaaactttgctactaagacatgaagctagtcttgacaagttccacaagaagaaatctttggtttctgttaatctaactgaaggtgtttcattatccaattctcctattgtccaaatagttcaaatccttaattctcttccaaattttcctaattcttcgaatagcaatttgaacaataggtctattgatgcacatcttacttgtgaaaataacaacaattacagtataacaatagtggaaatcgattttttaactttggtcgtggtggtggtcttggcttccattgtggtggtgttggtggtcgtaatggaggtcgcaacaattgtggtagaagagatggccatggccatgaatattatgtccctatacagccatgggttccctcaactatcactactacccctaattggtataaatatccttcacaatcaccctatgctacatagttttagtacatgcttggttatggctccttcaccacatcttgttccacctatgcaaccatatcataatcctatctatgtgcaaaaagttgcacttgtagcttccattccctctcaagctcatattgctactgttgcaccaatgcaatcaagcaattggtatctagactcaaggacatcacaccatgttactaatgtctcacagaatatacaacaacttgcaccctttgaaggagatgaatag

SEQ ID NO: 62341 - DNA, 978 bp, Glycine max
  Peptide Sequence Number=SeqID_179119
atggtagagaagtgcatcgaagttttcatggaaaatttctcagtcttcagtccttcttttgactactgcttaactaatttagagctcgtgctaagatgttgtgttgaagcaaatctggtgctaaactgggaaaaatgtcacttcatgctacaagaaggaatagttttgggccttaagatctcagctcgagggacagaggtggacaaagaaaagattgatgtcattgaaaagctacctctactagtcaatgtgaaaggcatcaggagtttccttggacatgcaggattctatcgacgattcataaaggacttctccaaaactgccaggcccttgagcaatttgctgaacaaagatgtgttccatgccatttattatgccagcaaggtcctcaatgatgcacaactaaattatacaaccattgagaaggagatgttagccatagtctatgcattagagaagtttaggtcatatttggtgggttccagagtaattatttttactgatcatgcggcaatcaaatatcgtctcacaaaggaatattcaaagccaagactgattagatgggtccttctgattcaagagtttgatatagttattaaggacaaaaagggctttgagaatgtaatggttgaccacctctccaggttagtcaatgaagaagtaactcaagaagagcaacaaatctgggatgaatttcccaatgaatctcttctatatgtgaatgaaaaaccttggtttttagatatgaccaactacaaagttgtcagtattattccaaatgacctcaactggaatcaacggaagaagttcctccatgacgcacatttctatgtctgggatgacccacatttgttcaaaattagagcagataatctgttgagaattcggggcaagacaactgctaaggtgctacaagctggattcttctggccttctatcttcaaagatgaacatgatcatgtgcttcgttatgattga

SEQ ID NO: 62342 - DNA, 472 bp, Glycine max
  Peptide Sequence Number=SeqID_179120
atggcgagctcactggtgcgtgcggcaaagcgcgccggctgccagatgacgcatccggccagccacagcgccagaatcagctgcgcatcagagcttgtcgtcctgcgcaccgccctcttccacatgctcgatcgccagtgccgtgaccacgccaaacgcacaggccagcaagtacagggagtgcgtattgcgctcaatgtgttctttggtgatgcggccatacatcttgtagtaacaccagctggtgtaagccagaataattggcacaaagatgatggctgccacggtcatgatctgcagcgtcagcaggctggaggtcgcgtcccacatggtcaggctggtgcccggcacggtgctggatggcatgatgaacgggaacagcgcaatgcccgccgtcataatgacgcacgccagcgtcagcgaagagaagataaacgcccatgcgcccttctccatgcgcgaacacaggatg

SEQ ID NO: 62343 - DNA, 318 bp, Glycine max
  Peptide Sequence Number=SeqID_179121
atgagaccgggatgtagagtgagtacaacgctgtttcgctggccggttcgggtctattacgaagacactgacgccggtggtgtggtttaccacgccagctatcttgctttttatgaacgagcacgtaccgagatgttgcgccagcaccatttcaatcaacaggccatgttggaagagcaggtggcttttgtggtacggcgcatgacgggtggactttattgccgcggcacgtctcgacgacattctggagatccagagcgaagtgacagcaatgacgcgcgcaaccatgacgttctcgcagcgtatcgtgaatgctga

SEQ ID NO: 62344 - DNA, 435 bp, Glycine max
  Peptide Sequence Number=SeqID_179122
atgggtagaggtaggttgcaagtgcaaggtgttgaatctggaaatgatgatgtagcaatatgtagttctggaatcaagttgggacggtattcacttgagagtaaagttcgtccaactagtttatttgcaggcgttggtcaagcaggatttggttttgggatttcaccaaatcctccaactgctactactagagacagcggcaccaaacctccattgattaattcttccacgaaatatgttttaatgcctgaaacggtgtcaagaacatcagtggcaccgttggagaccataaggacccatttgatggtggggagctgtggacatagtacaattcaagtgtttcaatctattatggagaacgatggatggaagggctggttcagaggcaattctatgaacatcatcggagttgcgcaagcaaggccattgaggtga

SEQ ID NO: 62345 - DNA, 2040 bp, Glycine max
  Peptide Sequence Number=SeqID_179123
atgtctctaatgttgctttcatatatcctaagagaccctgcaaataaccacttttcctccaatcccctttctacacctgttcactacggaaaagatatttcacgtgatgctcccctcccacgtcaccacaaagtggaccccactcctctccctcctcctcctcctcctcctctgtcttcttttctgcacctgacccgtcgttttcagagccactctcattcctacttatactacaatactcttcctcactacactgttttttcttcactactactaaccatgccctcgtcttatgcctcgccctgtgtccctccacgactccgccgtggcgctagaccacgtggcggtggccgtggtggtttttctcgcccccgcgatccctcttcccggctcctccctgcagacgaagcacgaaacggtgacgctattaacttcgaggcgtacgagtctgtaccggtggaggctagtgggaaggacgtgcctgcgccggtgaacaccttcaatgaagcggacttggacgaaggcttgaagaggaacatcgagcgttgcaagtacgtgaagcccacgccagttcagcgccacgcgattcccatcgtgagtgcgggacgcgaccttatggcgtgcgcacagactggttcgggcaaaacggctgcgttttgcttccccattatatctgggattttgaagggtcgttatcgttctgggttttcatcaattccatctcctggtgccgctattgcataccccgccgcacttattctttctcctaccagggagttatcatgccagatacgcgacgaagccaataaattcgcgtatcaaactggagtgaaggttgtggttgcctatggtggggctcctattactcagcagctgcgccttttgaagaaaggtgttgatatattggttgcgactcctgggcgtttggtggatattattgaaagagaaagggtttcgttgacaaagataaagtatcttgctttggatgaggctgatcgtatgttggacatgggttttgagcatcaaatacgtaagattgtggagcaaatgcatatgcccccgccaggtattagacagacattgttgtttagtgccacgtttcctaatggtatacagaagctagcatcggactttttatccaactacatattcctgtctgttggaagggttggatcgagtactgaactgattgtgcagaagattgagcctgtacaggatatggacaaaagggaccatcttattaaacatctacgacgtcaaagtgtgcatgggttcaatgggaagcatgctttgactcttgtatttgttgaaactaagagaggagcggatgttttggaaggttggttgttgagaagtggcttttcagctgttgccatacatggtgacaaagttcaaatggaaagggaacgggctttaagatccttcaaatctggtgtgactcccattttggttgcaactgatgttgcttcacggggtttggatatcccgcatgtggctcatgttataaactttgacttgcccagagacattgataactacgtacatagaattggaagaacaggccgtgcaggcaaatctggtttagctactgccttcttcagcgataagaatagccctattgcaaagtcgcttataggactcttgcaggaagcaaatcaagaagttccatcttggctcaaccaatatgcagagggttcatcatctggtgggggtagtcaaggctatggagctcagcgttacagcagtggtgggagttatggtggtcgtgatttccgaaatgttattgaagcagaggtggagaataacaactgttacagtacaaatgtcaatgcagatcatgctgtagagtcttattacactgctgatgatgcctcctatgacatccaaaactccaacatagattcctcttttgacactttgaatattgcatctgcgggcagttataatcacactgatttttgtgagttgaatggagctggtagggttgaagaagatgggcctcttggttatgcatctattgttgccactggatgggactag

SEQ ID NO: 62346 - DNA, 246 bp, Glycine max
  Peptide Sequence Number=SeqID_179124
atgactcttctaattggatcagctgctggtgcaatttcgagcagtgcaacatttccacttgaggtggcttgtgagcatatgcaagctggggcactaaatggaagacaatataggaacttgcttcatgcccttaggcttgtgactaagttgcttaaaattggttcctgctgctgggatttctttcatgtgctacgaagcttgcaagaggattttgcttttccttgcatatttggccatttcaactag

SEQ ID NO: 62347 - DNA, 267 bp, Glycine max
  Peptide Sequence Number=SeqID_179125
atggaaggttcccaacaaaacactcactatcctaaggaaaaattgcctaaatttattacacacaaatggaagtttggtaacctattggaggctcctaacacacttccaatgaaaggcctttttgttacaaaacttgaaagcaatgaagctcttaaggtggttggcccctttcttcttgactcaaattctttaagggatggcaccaatcctccttccaattccctatatgacaacccacaaacaaggaaacaaagagacaagcaataa

SEQ ID NO: 62348 - DNA, 294 bp, Glycine max
  Peptide Sequence Number=SeqID_179126
atggggattaaaaaaatgggaaataacaagcatctctgtgttgccattcgccacagtatttggaatcatctccttctgcttgtaagcaatgaccagatcttccgtcttttgtttcaatttatcccttgcctctctaggttctcctttgctttgtggccaatatggagtttcttgacacttcctcttctgtacaaccaaaagtttacactatttatggcttgcatggtagtaatcccttgcctcatttttgggacgctgcggcctcaatattacgatgaactccgtacagattaa

SEQ ID NO: 62349 - DNA, 231 bp, Glycine max
  Peptide Sequence Number=SeqID_179127
atgtgggcagaatggtcatataatatattcattcattcaagaacaaggttgtcaccttacaatatcacctttgggaagaaacctcccaatattcctgattatatagcaggaacatcccacattgatgccatggatgactttcttgttgaccgagaagctgtattcgctaatttgaagaagaagcttatcaaagctcaacaaactatgaagcattttgctgataacaattga

SEQ ID NO: 62350 - DNA, 205 bp, Glycine max
  Peptide Sequence Number=SeqID_179128
atgtctggtggaaccccgcgtgggggaggtggattaatgaggcagaggcatagccaggggtatgcaagcagtggtgatgacctagaggatgatgcatgctcaaggcaccgcccctttttggccccgagtcctccgcctaggacgtggattgagatgctggaaaatttcctttggcttgcttctgctgctttcattctatactttg

SEQ ID NO: 62351 - DNA, 339 bp, Glycine max
  Peptide Sequence Number=SeqID_179129
atgaaaaagatgaattaccatgagacgtctgtgcagtgtgaggcaacaatgaacatcagaagggcgacacaagagagtcactatcagaatgggaagggagagtgtgcggaggagatgagaagaaaatggggaggagggatacttgggtgtattatgataagaggaatccgttggactaagagatcaacaatacaatttcttacagttcactcagggtgcttcgaggtagcgaagatagacatcaaacttggcagaaacatagaaaggcataaagcacaaatagtcaaatactgcaactcggttgagataacacatgaaagatttaacctctttttttaa

SEQ ID NO: 62352 - DNA, 777 bp, Glycine max
  Peptide Sequence Number=SeqID_179130
atgtcatctaactgctattcagtttgttcctactcagatgaagctgctttgatccttattcgatacggggagtccttgtggaatgaaaagaacttgttcacaggttgtgttgatgtccctctaagcaagaggggtatagatgaggcaattgaagctggcaaaagaattaggagtattcctgtggatctcatatttacatctgctttgattcaagcgcaaatgacagccatgcttgccatgacacagcacccccgcaagaaggcaggggagtttaactgttatagtcatcataatccagaaaagaatagaaaactgacaacagattatgcaatatatattgcagatgatgttcctatcataatgcacaatgagagtgaacaagcaagggaatggagtcaagtttttagtgaagatacaaaaaaacaatccattccagtcatagcagcttggcaattgaatgaaagaatgtatggggaactacagggtctcaataagcaagaaacagcagacagatatgggaaagaacaagtgcatgagtggcgtcgaagttatgacgtacctcctccaaatggtgaaggtttggaaatgtgtgctgaaagggcagttgcctatttcagagaccaagtgattagtttagaattgtcaactggaattccaatgctttatattttcaaagaaggaagattcattaggagggggagtccaatagggcccactgaaactggagtttatgcccacacgaggatgaaatggcacttgcagtcaagaaacagatag

SEQ ID NO: 62353 - DNA, 150 bp, Glycine max
  Peptide Sequence Number=SeqID_179131
atgtacaaatttttatctagttattttcatgttaactccggaagacaaaaattcatttcattcctcattgcaaatggaaggagagcacatggaagcaattactctccttcaccatatgagaacaacactggagtggagaatggatcttaa

SEQ ID NO: 62354 - DNA, 402 bp, Glycine max
  Peptide Sequence Number=SeqID_179132
atgagtgtggatccaaagagaagtgcctctaatggccaggagaaaatgttaccatcactagaacagcaagcattgatcaatgaggtgagaaggttaattgggccacagtctggtaaggcgtccattttttgttctgatgcatgcatctcaaggtatttgagagcacggaattggaatgttaagaaggcagccaaaatgttgaagctgaccttgaaatggagagaagaatacaaaccagaagagattcgctgggaagatattgctcatgaagcagagacaggaaaaacctatagaacaaattacattgacaagcatgggagaacagtcctagtaatgagacctagtcgccaggatatgtgttggaaagccgccttagttgcagtcacccctagccttccttag

SEQ ID NO: 62355 - DNA, 774 bp, Glycine max
  Peptide Sequence Number=SeqID_179133
atgtcctccccttcaaaaggagtacatttctgcacctccagaggactacacgtcctcacctcaagaggactacacgtccgcacctccagaggactacacgtcctcacctcaagaggactacacatcctcaccttcagaggactacacgtcctcactttcagaggagtacacaccctcgccttcagaggactacacgtcctccccttcagaggagtacatgtcctcaccatccaaggactacacgtcctcccctttagaggacttcacgtgctcaccttcagaggacaacacgtcctcaccttcagagggctacacaccgtcacctttagaggactacacgtcctcaactccagagggctacacgcccttaccttcagaggactacacgtcctcgctttcagagggctacacgccctcacctttagaggactgcacgccctcgccttcagaggactacatgtcctccctttcagaggagtacatttcctcaccttccgaataatacacgtcctcgcctttagaggactacacgtgctcaccttcagaggactacacgtccttgccttcaaaggactacacttcctcgcctttagaggtgtacacgctctcgccattagaggactacacgccctcaccttcagagggctacacgccctcaccttcagaggagtacacgtcctcgccttcagaggactacacggccttaccttcagaaggcaacacgccctcaccttaagaggcctgcacggcctcaccttcaaaaggctacacacc

SEQ ID NO: 62356 - DNA, 503 bp, Glycine max
  Peptide Sequence Number=SeqID_179134
atggaggtcaacacggctacaatcgttgctacaagtaccgccactaaggtggacccgactcaccaatttggtctcaaccaagtaaattgcccagcctcggatatggtaggtcaggaaggtgaagcattaggaaatatgggcggcccccattttgtgcaagttttgaacaagcattccttcctaccatatggcttgcctcccaactatacatcacccaatgttgcacacgctcccaatgagaatgtcgataactccgctcccaaaccattgggagccaataaccctaatctgatcatgcacatactacctcctaccgtagtggaaagggagaaatttgatcatatagagaaaaggctgagggctattgaaggagacgaagattatgcctttgctaacatggtagaactgtgcctagttcctgacgtcaatatccctccgaagttcaaggtgccggatttcaataagtacaaggggactacttaccccaagaatcacctgaagat

SEQ ID NO: 62357 - DNA, 106 bp, Glycine max
  Peptide Sequence Number=SeqID_179135
ttgggctaagtgcgcatccaccgctaagcacagcttcagcgtgcttagcacaaaggagaatctggcagagcatcagcatcaaagccacgcgctaagcgcaagatga

SEQ ID NO: 62358 - DNA, 244 bp, Glycine max
  Peptide Sequence Number=SeqID_179136
atgggggagcggtggaggcaatttaagtctgatttcatgtcgaaatggacacttgcagtcgacaaggaaagtggcgatgacactatatgcgaaaagatgtgcgaaagaaggcacaggccatccaatcacgtgttgtctcgtgggggattcgttggaggagcaggcctcacagggttcctttgtcgcccatggacgtcaggatgtattgactgctaccattgggtgaccagaacaccctggtcgt

SEQ ID NO: 62359 - DNA, 417 bp, Glycine max
  Peptide Sequence Number=SeqID_179137
gtgagtgtgcatgtggctcatctcatatctgacgctatttatcagtttgcagggattgtacccatgagacaccttgtggacccgaagaagtccaacagggtcctagggtttcttgctctgattacgggcctttatcagttctatggagtgcccgtcgcccccaacaaggtcatccggccgcctattaacaaggccttcattgagaaatactgcacccctaggcaggcgcagggccaggcaccacaacaactagaggaagaccaacagctagctgcaaatgcgccatcaccgcctcaagaggaggtaccgtctctgaggtccatctctgatcacctacggaggatagaactccagatgcataggtacatgcatcacgtgactagccagcaggcgactaatcacagagggcaggtgtag

SEQ ID NO: 62360 - DNA, 99 bp, Glycine max
  Peptide Sequence Number=SeqID_179138
atgatggcacatcagggtgttgaagtattggcaatcaaaatttctattcttgcgaacatagggtcaaaccaagcacatgcttttaagaaaaggttttga

SEQ ID NO: 62361 - DNA, 881 bp, Glycine max
  Peptide Sequence Number=SeqID_179139
atgtcgctttatcgtacgtttacggctgccgatgccgttgaatatgcccgccaatacgggcaggtggccgatccgcaggcgctggtgagcgccgacgagatcggtgacggcaacctgaacctggtgttcaagatccgcgatcgcgaaggcgtgagcagggtgatcgtcaaacaggcgctgccctacgtgcgctgcgtgggcgtatcctggccgctgacgctggatcgggcgcgtatcgaagcggaaacgctgcgggttcacggcggtttctgcccgcggcatacggtaaaagtcttgcatcacgatcccgaattggcagtgatggtgcaggaagatctctccgatcatcgcatctggcgcagtgagctggtacagggcaactatcacccgctggcggccgggcagttggcggaatacctagcgcagacgctgttccacacctccgatttttatcagtcggcgcagcagaagaaggcggaagtcagacgtttcactaaccccgaactgtgccagatcaccgaagacctgttctttaccgatccctatatcgaccatgagcgcaatcagttcgaggtggcgctgttgccgcaggtgcaggcgctgcgcgaggatgcgccgctgaagctggcggtcgccggcctgaaacatcgctttctcagcaaggcggaggcgctgttgcacggcgatattcacagcggttcgatcttcgtggcggaaggccggttgaaagcgatcgacgccgaattcggcttctacggcccgatcggtttcgatatcggtactgcgttaggcaacctgctgctcaactattgcggggctgccggggctgtttcgggcccgcgcgacgccgccgccggggcgcgagcagcgccctgcaggat

SEQ ID NO: 62362 - DNA, 408 bp, Glycine max
  Peptide Sequence Number=SeqID_179140
atgaagaagtttgctcaaacacaaacaccacagcaacaatccttcttcgtttttgctcaaacacaacaccagcaagctcctcttttctgtatctttttctcgcgtgaatggtctacgggagagggtggatttaaaaaccccaagcaacgcaaatcgctgcttgtgctggcgattttgaccaaccaaaacgccattggagctggcgacaccctgcagttgcagactgcagtcttggaaatagcctctgctggcctgaacctaggaactgtgccctaccctcaactcgccagtcaaactggcgagtccaagctctacaacacgccattgaagctggcgacaccatggccagctgtcgcgtcgagaacgaaagcgccaataagagctgcgatttgcatgatctctacgtaa

SEQ ID NO: 62363 - DNA, 231 bp, Glycine max
  Peptide Sequence Number=SeqID_179141
atgaatgaagacaagaagcacctcaagtggcagcgagaggtgacgtggagtgtgagtgagaaagaagagtcgcaacgtggtggagaggaacaaagctgtgatgaagatgatgacgcagaggcaatgcgaaggcgacacaaagctgcgatagagacgaagatacgctacagacgtgattttgtttcttggatcgttgatggcttgattgagataatttcatttgatttctaa

SEQ ID NO: 62364 - DNA, 804 bp, Glycine max
  Peptide Sequence Number=SeqID_179142
atgtttatgtcaacagttgagctggagaagcaaacatactgtgatcttaaagttctgaataacacagggaactacgttgcctttaaggtcaaaaccacttcgccaaagaagtactttgtgcgacctaataccggtgttgtacatccatgggactcattcaccctccaggctcaacaagaataccctccagacatgcaatgcaaagacaagtttctcttgcagagtacaatagtgaatccaaacactgatgttgatgatcttccaccagatacttttaataaggatggtgaaaagtcgatagaggatatgaaactaagagtggtatatatctctcctacatcaccccaaggaagcacagaaggtgacacagtgaagaattcaacccaaaaacctgatactaattctaagcaaaatgcactcatctgttgggtgcaaaatggatttggaggtgttattaaaagaaccagtcttgtgagccaatactgtagcaagaatcaaacaagattctgcagcaaccagcaagtaaaagagggaaatcaaggacacagagattatcatggttcagagcaattaactcctacgtccacactgagagagacttctgttatgatcacagaaacagtacaagaattttcaggctttgagccttgctcttcctcacttgcagtcacaagtctgatcatgaatcactcaattacatgtatgtgctatgaagcaccaagccatgacttatataactgcaaactaaccctcttaagtcagttacaaaggaccagcccaataaacctcctagtaactaactaa

SEQ ID NO: 62365 - DNA, 561 bp, Glycine max
  Peptide Sequence Number=SeqID_179143
atgtcaaaaaatgtgagggtccccaagtattggaacttggaatggttctctaaccagggttcaactttcccaatctgctggaagtacatggactgtcaaagctggaagttgccagtctgtacatgggtggagtctggaagttcgatgaaacgcctaatgggtatagctagatgcagacctataggggaatgcttcttgactctgatagtttatggtctaaaattaggtatcaagatgagttgggtattggtgattaaagatattatgctgaaaagtcatcgcttggtggattatgagtttccttatgttgtgttttcctcaagattcattgtctacttcaatattgatgtctctaatgagattgtgtactttaccaaagccccttgtaagattaccaaaaggcatctcaagaagcttggaatgagatttgttgatcatgaatggataatggctagagaacctgccactggaaacattgaccagatggaagaagatgttgaagctgaagctctacaagaacctgcacatcaatggattccttttgagtcacttatgatttag

SEQ ID NO: 62366 - DNA, 213 bp, Glycine max
  Peptide Sequence Number=SeqID_179144
atgggtgaagaatttgaggggacaactcaagtcattatgaaggttgaacttgagaagttgatatctagagttgaacaagtaattaatgaggcactaaataaggacttccccttatgggtgaaaagcaaggatcaaatacttgtgaagtatatgaacgaggacatcaaagtcaatgttatggtggctcaagatggtcttcatctctatggatga

SEQ ID NO: 62367 - DNA, 384 bp, Glycine max
  Peptide Sequence Number=SeqID_179145
atgccacccaccaggcaccgtttagacccggataagtctaacagggccctggggtttccagcattgatcacgggcctctgccagtcattcggggttcccgtcacaccttgtaaggttcgccagcaggcggccaaccaccgggcgcaggtgcagatacacgagtgtctctaccagctcagcctcagtcagcagggccagggtttcgctccttttgcatgccctactccagatcagtttaggactgaggtcgcatggcccggagattggcccgaggcccaggtgaaggaggcgattgcaggagctcccgacgatgcagaggaggcccgtatggatgaggagatgacagacttgctcggcttcttgggaggaagcggagccatgtga

SEQ ID NO: 62368 - DNA, 804 bp, Glycine max
  Peptide Sequence Number=SeqID_179146
atgggatccaaaattgactgggatttcatctgggtgttgcttctcaccttgtgttgctgcggctccttggtgcacagcttggacaacactgctgctgcatgtgaatcattgaattccttggttcaagattttgctttcaggtcactggtcaaacacaggcctcaaactggtgctctatatgatgctcttcttccaaggaacctgtccggtatggatgtttcagtagtacgtctcagaagcagaaggctctggaacaaaggtgccaactttagttactttcagatcccaccaagaaccatgtccattccccatgtgaggaggttggctattgtctaccaaaacttgggcaactggtcttcccactacttcaatttgccaggttactcactcatctcttctgttgtcggcttcatggtttttgatgcctcaaatgtaacagacacgagtgagagaaacatcactctcaacacaatggggcagcccatatctgttcaatttcccaacgttacatttatgggtaggggtagcatcaacacaagggtgagatgtgtagctttcaatgccaatggaacatttcaacttactgagatgagttcccctggagtgtgtaactccagagaccagggccacttttcagttgtactcccattggagaagaagcggggaacatggtatctgtgggtgattggctttgttgttggattttttgggttgatcatagcgggctatgcggttttttcttctatgagacttctcaagaccaagaggattcaagccatggaaaaacaagctggtgaagatcag

SEQ ID NO: 62369 - DNA, 216 bp, Glycine max
  Peptide Sequence Number=SeqID_179147
atgataaatgcaggaatgatatgtccattacgatgccatgaagagatgcatgatgcaatcaaggaacaaggcagagaactatccacgacaatgcatcaccagaagaggaaaactctagataaggcttcactgttatctagcgagtcggagacccaacatgaccacagatcaacctccactccctatggctcacacagacctgggtatagggcctaa

SEQ ID NO: 62370 - DNA, 393 bp, Glycine max
  misc_feature (289)..(289): n is a, c, g, or t
  Peptide Sequence Number=SeqID_179148
atgagtgaaataaaagaggtgcaagagcatatgaaggccgacatggaggccatgaaagagcaaatgaccacaatgatggaagtcattatgagtatgagaaaaatgatggaggtcaacacggctacaatcgttgccacaagtaccgccactaaggtggacccgactcacctatctggcttcaaccaagtaaatcgcccagcctcggatttagtaggtcagggaggcgaagcattgggaagtgcaggcggccctcattttgtgcaagtccagagcaagcattccttaccancatatggcttgcctcctaactatacagcagccaatgttgcacacactcccgatgagaatgtcgataactccgttcccatactcattaagagccaacaagcctaa

SEQ ID NO: 62371 - DNA, 309 bp, Glycine max
  Peptide Sequence Number=SeqID_179149
atggaacctaaactgcttgtattagttcaatggaaaagtttgccagctgaggatacaacatgggaagattgggaggttttgaaagaagtttaccaccttgaggacaagatgagctttgatggcgaagggaatgctaggaaacaaacccctaaacttcaacataccactaaaggtgatcaccagcgccctagacgcaagagccaaccacttcgacatttggtggactatagacttacgattgtggagattgaagtgtggtggtggaaggctaggtggcaccgtaggaacaacatgcaacatgttaggtga

SEQ ID NO: 62372 - DNA, 291 bp, Glycine max
  Peptide Sequence Number=SeqID_179150
atgccaaagttggggatgagtgaaaaggtttcagtagagaacaatgatgatgagaatcctgaaactggccaaatacaggctaaagacccaagtggagaaggacgaaggcccaacttctctctgggttccttgttgaaccaatctaagacttatcaaggtaatccttgtggtgtctaccctgacttatcttccttcaccagaagtggcgccatccaaatcttcgttgcttgtatcaagcgatccactcctagtcaggatcacatcatctggtatcagagcttcgactcttga

SEQ ID NO: 62373 - DNA, 870 bp, Glycine max
  Peptide Sequence Number=SeqID_179151
atgattgtgaatgaaagtaaaagtatgttctattcttattacacagcaataaacgtgagcaactctgacggctattccttctctctatttttcctctcctttcattctccgcaaatcaagcttaaaaaagggcttcttgtccacgaaggcgctcttagcgccattctcgtgctaagcgatcctgcatactacgtacttaaggaggatgattctccttgtatttttggttcaattgaaaagcagagatggtcctatgcctgtgctaagcagttgattgagaggcttgtttatgctgagggtgctgaaaatggcttggaattcacaattgtgaggtcttttaattggattggaccacgaatggatttcattcccggcattgatggcccaagtgagggtgttcctcgggttctggcatgctttagcaataatctcctccgtggagagcccttgaagcttgtggatggtgaccaatcccagaggacttttgtgtatattaaggatgctattgaagttgtcttattgatgattgaaaatcccgccagggccaatggacatatttttaatgtgggaaacccaaacaatgaggttatagttaggcagcttgctgaaatgatgactcaggtttattcaaaggtaagtggagaagcacctctggaaaaacctattattgatgtgagctccaaagaattttacggtgagggatatgatgatagtgacaagagaattcctgacatgaccataattaataggcagcttggctggaatcctaaaacctcactttgggacctgcttgaatcaactctcacttatcagcacaggacttatgctgaagccgttaagaaagtcattgcaaagcccatggcaagttaa

SEQ ID NO: 62374 - DNA, 423 bp, Glycine max
  Peptide Sequence Number=SeqID_179152
atgggtttgtcactgcttttgatggttgcacagttcaaccagtttaaggcacgcaccggaaagttcttcaagcaagaagggagaaactccttcagagaacactttcctaggctagaggactttgccaaggctatctacatatttgatattgggcaaaatgatattgttgctgctattgatagagtgggccaggaagattttcatgcagtcatctcagacattgtggattattttgaaaaccaactccaagtaaaaactccacaccagtttttgggtctgccacacggagcatggtttcaagatggtgggttcgagattgctgtgatagatttgggtctacaaactagcaaaaactccacacctgtagatttaaatactaagtttagatttggtgttctacctacgatatttaatgaattataa

SEQ ID NO: 62375 - DNA, 387 bp, Glycine max
  Peptide Sequence Number=SeqID_179153
atggatcgtgctaaagcgcgcgacctatacccggccggcgcgagcccgggcggagcggtcgtcggtgcagatcttggtggtagtagcaaatattcaaatgagaactttgaaggccgaagaggggaaaggttccatggaatcgggttaaaattcctgaaccgggacgtggcggctgacggcaacgttagggagtccggagacgtcggcgggggccccggaaagagttatcttttctgtttaacagcctgcccaccctggaaactgctcagccggaggaccgagtgcctcccacgcccggtcgtactcataaccgcatcaggtctccaaggtgaacagcctctggtcgatggaacattgtctgcaatggaagtcgagcaacatggatcc

SEQ ID NO: 62376 - DNA, 555 bp, Glycine max
  Peptide Sequence Number=SeqID_179154
atgagtacgaccgggcgtgggaggcactcggtcctccggattctcaagggccgccgggggcgcaccggacaccacgcgacgtgcggtgctcttccagccgctggaccctacctccggctgagcagtttccaggcgaccgccgcgccctcctactcatcggggcttggtccttgccccgacggccggtctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatga

SEQ ID NO: 62377 - DNA, 417 bp, Glycine max
  Peptide Sequence Number=SeqID_179155
atggattcaaatgcttgtctaccacacttgctagtgttagcaataacattggtattggttagtcatgcaatgggagattcagctcaagacaaacagagatgtgcagaatccctgacaggtgttgcaacgtgtctgccatatttgggtgctgacgcgaaagcacccacagcagattgttgcagttgtctcacacaagccatgaagaccaacaagaagtgtgtctgccttattctcaaagacagggatgatcctgatcttggcttgaagactaacatgacaattgctgttggtctcccttctctttgcaaaacacctgatgatctctcacagtgttctgttgaaggaagttcccataaggaacagatgaaacggcctcagctaagaatagtgaatcttatatcgggaagagattgttag

SEQ ID NO: 62378 - DNA, 1048 bp, Glycine max
  Peptide Sequence Number=SeqID_179156
atggaaaaccttgagatggacctgatggtgtgggctatgctttggttgttgagcttaccatgcagagagagtgtgtgcatcccaagtgagcgtgagacacttttgaagtttaagaataatctcatagatccttcaaataagctttggtcttggaatcataataataccaactgttgccactggtatggagtcctctgccacaaccttacttcccatgttcttcagcttcacctccacacttatgattctgctttcgatcattcctatggattcgatgtgaatgcttacgagagatcccagattggtggagagataagtccttgtttggctgatttaaagcatctgaattacttggacttgagcgccaatgaattccttggtacggcaattccttctttccttgggacaatgacttccttgactcacctcgacctctctgatagtggattctatgggaagattcctcctcagattgggaatctctcaaatttggtgtatcttgacctgagagaagttgccaacggaagagtaccctctcagatcgggaatctctctaagcttcgatatcttgacttgagcgacaattatttccttggagaaggtatggcaattccttctttccttgggacaatgagctccttgactcagctcgacctctcttatactggattcatggggaagattccatctcagattgggaatctctccaatttgctctatctcggccttggaggtcattctagtcttgaacctctgtttgttgaaaatgtagaatgggtatcaagtatgtggaagcttgaatatctttatctgagtaatgcaaacctatccaaagcatttcattggctacacactctccaatctcttccttctttgacccacctatatttttcagaatgcacactccctcactataatgaaccatccttgctcaacttctcatctctgcaaactctccatctttacaataccagttattcccctgccatttcttttgtccccaagtggatattcaaattgaagaaacttgtttctcttcaattacagg

SEQ ID NO: 62379 - DNA, 849 bp, Glycine max
  Peptide Sequence Number=SeqID_179157
atgttaaacatcctggttaaaaacatttccaagcgcctgcccgatgcctggcaccatcaggttaaatacgcgctctatttcaagaagctgccgcacctgtcaaagccgaccggcttcagcgaaaagatcatgcgccgcaaaatttacccgcgcagcatctacaccaccttgtcggacaagttcaaggtacgtgaatttatcgccggtctgtggggcgaggagtatctggtggagctgtatgcgcatggcactgaactcagctacgacatgttcaggcaattgcccaacgcctttgtgctgaaggccaaccacggcagcggttataaccggttggtgttcgacaagcggcaggttagctacgcagagttgtacgatctcagcaacgcgtggatgcgcagcaacttttatgagcagagtcgcgaaaaacattatctggatatcgaaccctgcatcatggtggagcgcatgttgctggatggcgaacaggtgccgaacgatatcaagtttcattgtttcaacgacaatcatgaaattcgcatgttcatccaggtggattatcagcgtttcggcacccatcggcgcgatatttttgatatcgactggaaccgcaccgaaatccgcatcagcttgcccaatgccgacgaaccgatgccgcgccctacgcggctggatgaaatgatacgtttggctcgccagacggcgcagcagttctcttatgtgcgcgtggatttctaccaggtcggcgagaaggtgtatttcggtgagttgacgtttacgcctggtgcggggctaagcaagctgatgccgaaaaacattgagcaggaatggggcagttattttactgagtaa

SEQ ID NO: 62380 - DNA, 1326 bp, Glycine max
  Peptide Sequence Number=SeqID_179158
ctcggcgcgtcggcgcaggggaaggttgacacgctggtcgtcacttcgcagccgcagcgtttgcaggtcgacagcgaattgctcaatgccgaggggcaggttgttcaccgtagccgcgaccgttatcaggttgaagggcagcgccgtatcgaataccaaccgccgaccggcctggcccagggcgaataccgcctgcgtcagcaggtcaccgggcagcaatcccggccggcaccggacagcgagctgtcttttcgcgtcgggcagcctgcggccaaagtggcgatcgacagcgaaggctttaccctgcgcgacggtcaacggcttttcccgttgggcatttacgccaacgtggcgaccgatgagcatttggcgcgcatcgcatcggcgggattcaacacggtgctgaattatgattatggggagaagaaagacccttacgcctttttccgcaacgcacgcaagcgcgggctgctggtcatttactccgtcaaagatcagtaccgcggcagccgtttcgctccggccgtgcgcggcggcgattatgcggcgatgacggcctggtacgtgcagcgcttgcgctctcagcccaacctgctcgcctggtacatcaacgatgagctggggccggaatatctcgataagatcgaggaaaaaaacctgcaaataaagcggcttgacggcgatcatcctaccttccaggtgttgaacaaaaccggggagttggacgctcacttcaacagcagcgacattttggcgaccgacccttacccggtggggaacgatcgcgatctgacgcgcaccacgcgttataccgaactgacggtgcaggccgcccgccaggcgcgcggggcctgggtggtgatgcaaatcatggatcatgccgcttatgacgcccgccgcaagccacatccgccgtcagaggcggaaatccgcaatcaggcctggcaggcgctgatcggcggcgccaaggggctgttgttttattcttataccgatctgttttacaagcgcaaaaccggccgcttcgaccaacgggagtttgacgccacctggcgcggtgtggccgccgtgtcgcagcaaatcgccgccttcaccccttatctgctgacgggaaaatcgacgccgctggcgggaagcaaccctcaaatgccggcgcggatgtttgttctgggcgatcgcgccttgctgctggtagccaacccttactatcgagagggaagcacccgattgcgccttccggcgggctggcggcagcaggaaggggggacggagatccagctggcgttgcccgccgtgggcaccgcgacgctgtggctccaacgctga

SEQ ID NO: 62381 - DNA, 804 bp, Glycine max
  Peptide Sequence Number=SeqID_179159
ttcctcgcaaagctagccgaaaaggcaaagacattttacaaaatgctcaagagaactgagccattctcatgggacaagacttgtgagcaagtcttcctggctttcaagaagaccatcgccacatccctagttttgagtcgacctaggctaggagcacccctgctcctatatctctcaatagctgacaaagtcgtcaccttagccttcatacaagaggaagggaagcatcaactccctatctactttatgaatcgcatgatccaagacgctgagaagcgctaccaaatgatcaaaaaggtggcgctagcactcatcacctcggcccgacgacttaggccttacttccagagtcatcaagtggtagtcaagacgaaccaccctgttaagaagtccgtcgaattgccagagttcgacattcagtacgaaccacacggccccatgaagacacaattcatggttgactttttggaagaatttggtagaaatgacacaaccaccctagactggtggaccctttatgttgacggtgcgtccaacataagaggaagcggggtagggatcatccttgaaggcccagacaatatcacactagagcaagccctcaagctcaacttcagagcctcaaataaaaaggtagagtacgaggcgctcattacaggtctaaagctagcaagagaagtcggagccaagcgactacgatgctacacaaacttgaaacttgtccaaggacaagttgtcaacacataccaaactatggaagaaaagcaatactggagaagacctaagttggccaacaccaagaag

SEQ ID NO: 62382 - DNA, 207 bp, Glycine max
  Peptide Sequence Number=SeqID_179160
atggaatatttagccctcatggtcatggagggctcaactatacaaaagtgtgtaagaggtgaaaggatagggaatgaaagttctctaaactgcttcttcgcgttggacgggcattctcctgctaagagacaaagctcgttgagcgagttttatgcacttagtgtgaaccatcagacttcaactccactctctatcctttgcatgtaa

SEQ ID NO: 62383 - DNA, 384 bp, Glycine max
  Peptide Sequence Number=SeqID_179161
atgggagatagaaaaggagatgtcagaatatatctcatctctgggttgtttttggcatccaccgttggaggagggatctttctttgcatgaccttggttgcagttccatggtggttttggtttctcatctttttatatagatgttgctttaaacccaaggttggccaacaatttgataatcgtggtaaagttggagcaactaaaaattgttccctaacagcagttgtgaccaacccttctggtaaaaaatctcctgatgaattccttgatgatggagggcgccatgttcattttggcgcagttgttgagatggggagcggaattcaagatcaccaagaagttgcggataagttacaacgtgagtccaaggaagaaacaacatga

SEQ ID NO: 62384 - DNA, 279 bp, Glycine max
  Peptide Sequence Number=SeqID_179162
atggacaaggcaaagacaattgaggctctaatatcaaatcaagttatcattgtcaacctggacgaagtgttcttaggaatgaagcacgccgtgagggtgatgatcccttctcaacatggcagcatagttgcaatggctagcatttatggatgcataggcggcgtggcttcgcaagcctacacgagctcgaaacacaacatcgtggagctcgtgcgaaatgctgtcgtggagcttggacccttaaggattcgagttaatattgtttctccttatgagtaa

SEQ ID NO: 62385 - DNA, 396 bp, Glycine max
  Peptide Sequence Number=SeqID_179163
atggcatttgggaccatggcagctcgcccaggcaagctggttccttcagccctaagcaatttgggggcctcggctagcctaggcgagccagggtccagaaaactccctaaaatgacccttttgcccctcctttcggtatctttcgcatccttgaccaaaatatcgaacgatctttcgtcttgtgcggtaactggtgtcgaacaacacaattcggatttcattgaaaacattgtcgatgtcaaagctaatggtaattgtggatatcatataatttttaccttattaggtatgggtgaagattcatggtctttggtaaccatgaataagtggatgaatattattgatatgggtcatgtgatcgcatcaaggtatagcaatgataatgacgctcattaa

SEQ ID NO: 62386 - DNA, 240 bp, Glycine max
  Peptide Sequence Number=SeqID_179164
atgctgaattcaggcactgagaggacacttttgacactagctctgagagttgaagtttggcagcttcaagtcctactactcctaagctctgtctacctagtgtttcctgagccttctccaacactgcctgaagaagtatggatatctgtagggtctaacattgatggggttggcggaggagacgaagtttatgtgatgaacttatgtgatgaatgtgctggcgaagagggggaagtgtag

SEQ ID NO: 62387 - DNA, 366 bp, Glycine max
  Peptide Sequence Number=SeqID_179165
atggcaaaaaaaaaatccttggccaacgctctatggcttcatcgtcgcttcctttccatgtggatacttgattccggtgatgcatcctaccactccaaggaggcaatcagcatgcatcatgactttggcacctttctgcagaatgaattatgtcttctccattcctgctcaacttttgttgatgattttgtggatgtccaagcacaagctgcatattctgcttgttacatactgtggttaaaagtgcaaatcgccaagcctctggagagtaagctcttagagaagataaaagatgtagatctgaagaccttgttggataagtcatgcccagagagatcctcactcttcaattactttatgaactag

SEQ ID NO: 62388 - DNA, 147 bp, Glycine max
  Peptide Sequence Number=SeqID_179166
atgtctcacgatactcaagaattcatagtgacctcagtgaggtttgatgcgaggggttatgtcttgagttggagattcgagttgatgtatatcaatcgtttcaccacttttacactttgggttgtgtccaaatttcttctacagtga

SEQ ID NO: 62389 - DNA, 270 bp, Glycine max
  Peptide Sequence Number=SeqID_179167
atggccgatcacagtatatcaaatataaacatgagggcgagccctggtgcagcggtaaagttgtgccttggtgacttgttggtcatgggttcgaatccggaaacagcctctttgcatatgcaaggacgtctattactgaaatttatggagaaccaaaattctgtggaagaaactgtatcttatggtcataatgctgatattgtccaagccttgaaggtttctaagagccatgagttccaaatgttgaagaaatttgacacgaagcactag

SEQ ID NO: 62390 - DNA, 2979 bp, Glycine max
  Peptide Sequence Number=SeqID_179168
atgccatatcctccaattgagtttgagagtgttttgaggatttggagagattatcaaacctctgagagagagcagaagattaagcagcttcagaaaatgggagaggggtctgtggaacttgaggctattgtaaaggaagctgttgatctggagaacattcctattgaggaggtttttgataatctcaaatgcacaaaagaaggtttaagctccgagcaagtacaacagaggcttgacttgtttggatacaataagcttgaagaaaaaaaggaaagtaagatactgaagtttttgggctttatgtggaatcctctgtcatgggttatggaagctgctgctatcatggccataggcatggcacatggagggggtgaaggtggagattatcaagattttgctggcatagttcttttgctacttataaactccaccatcagtttcatagaagaaaacaatgctggcaatgcagctgctgcccttatggccagattagcccccaaagcaaaggtacttcgtgatggaaaatggagtgaagaagatgcttcagtgttggttcccggagacataattagcatcaagcttggtgacatcattcctgctgatgcacgtctccttgaaggcgatcctttgaagattgatcagtctgctcttactggagagtcacttcctgtctcaaaacatcctggagaaggagtatattctggttcaacttgcaagcaaggagaaattgaggcagtagttattgcaactggagttcacaccttttttgggaaggcagctcatcttgtggaaaacacaacacatgttggacatttccaaaaggttctaacatctattgggaatttctgcatctgttcaattgctgttggtatgattttggaaatcattgtgatatatggaatccataaaaagaaataccgaaatggtattgataacctccttgtgctattgattggtggcatccctattgcaatgccaactgtcctttctgttactatggctattggttcacacaagttggctcagcagggtgccataacaaagagaatgactgccattgaagaaatggctggaatggacgtgttatgtagtgacaaaacaggcacattaactcttaacaagctttcagtggacaagaatatcattgaggtttttgctaaaggggttgatagtgatatggttgtacttatggctgcaagagcatcaaggctagagaaccaagacgcaattgattgtgctatagtttcgatgttagcagacccaaaggaggcacgaactggaataaaagaagttcatttccttccattcaatccaactgataaaagaactgcacttacataccttgatgctgccggtaaaatgcacagagttagcaaaggtgcaccagagcagattctcaatcttgcacataacaaaccagaaatccaacagagggttcatgcaattattgacaagtttgcagaacgtggacttcgttctcttgcagtcgcccgtcaggaagtacctgagggaactaaagacagtccaggaggaccatgggagtttgttggcctgctccctcttttcgatcctcctcgccatgatagtgcagaaacaattagaagagctcttgatcttggcgtgagtgtaaaaatgatcactggtgatcaacttgcaataggtaaggaaacaggaaggcgtctagggatgggaactaacatgtatccttcttcatcactgcttggtgaaaataaagatggattgggtgctgtcgccgttgatgatctcattgagaatgctgatggttttgctggagtctttcctgagcacaagtatgagattgtgaagaggttacaagctagaaagcacatttgtgggatgactggtgatggggtgaatgatgcacctgccctgaagatagcagacataggtattgctgtagcagatgctacagatgcagccagaagtgcttctgacatagtcctaaccgaacccgggttgagtgtgatcataagtgcagttttaactagccgtgcgattttccagagaatgaaaaactacacaatatatgctatatctatcactattcgtattgtgcttggtttcatgttactgaacagcttttggaaattcgactttcctccctttatggttcttgtcattgccattctcaatgatggtaccatcatgacaatatctaaagacagggttaagccttctccacttcctgatagttggaagcttagtgaaatctttacaactgggattgttcttggcagctatctggctctaatgactgtgatcttcttctatatagttgttgaaacaaacttctttcctgaccattttggtgtgaaacactttcactacaatccagatgcttctatcaaagatccaaccaaaagaatgttgggatctgctgtctatcttcaagtcagtacaattagtcaagccttaattttcgtgacacgctcaaggggttggtcctacacagaaagacctggtcttttgcttgtcactgccttcatcattgctcaagcgattgcaactgttgtatctgccactctcagttggagacttgctggaatcaaaagtattggttggggctggacaggagtcatatggttatacaatattataacgtatctatttctagatcctttaaagtttgctgttcgttacgcactcagtggaagggcttggaatacagtgataaaccaaaggactgcattcaccaacaaaaatgactttggtaaagaagctcgtgaggctgcatgggcaaccgagcagagaaccttacatggcctccaatctgctgagtcaaaagggtttacagacaagcacaccttcagagaaattaatacattggcagaagaggctaggaggcgcgcagagatagcaaggctgagagagcttcacactctcaaaggtagagtggaatcatttgccaagctaaggggtctggacattgatgccatgaacggacactacactgtctaa

SEQ ID NO: 62391 - DNA, 807 bp, Glycine max
  Peptide Sequence Number=SeqID_179169
atgaagcttgacatccctcgatttaatggtcatgacccattggggaactccggaggaagaacaaactacggtcgcctcgttctatatggatggccttgcactcaactagttccagtggatgttcagaaacgacttcatcaccttttggccatgattgttgtaggccctagaaaatcgtttcgcaccgtcgttctacgacgatccctgtggagccttgttcaagctttgctagcgtgggccaccgcccttgcccgcctccaggaggacaaaattaatgatcgtcgaaagggctcccagcaaacccttttttcagttcctccccaacaccatgcccaatctttttccccaactaatttccccaaacctaaaacccaattcgcacagcgtattgctaaggacatggcctttcgacgccagaaaggtctttgttacaactgtgatgagaagtggagttcttctcaccgttgtaagggtcgtgtcttgctctttgtggccgaatccgatgaaccccttggctctgaaccaacacaatctttctcgacccccattgaatcttcctctgatcctcacccacctgacctttctccaataaacccccacatcagcctcaacgccttagccggtattcccgtcactgacacttttcgtgtctacgacttcattaaccaggcgagcctcatcgtgctcgtcgatagtgggagtacccacaactttgtccaaccacaggttgctaagttccttaaccttcccgtagtggacatacctcccttacgagtcatggttgggaatggcttagttttggagtga

SEQ ID NO: 62392 - DNA, 476 bp, Glycine max
  Peptide Sequence Number=SeqID_179170
atgagtgaagagtctcattctaatgtagaggctatggatctcttacgtcagtttgaggatattcttgaatttgatgctctaattgacgagctgggcttcattcatccatcccaatttgccttgctaaaggaagaatcctacatttcgtctaatttatctgatgaagctatccatcaatcagcagacggggtagtgatctctgaggaatcttccaaacaagacaacctatatttctggaacagagatcataaattgggaatttcaactcatgttcttctaccgttatatagagctgctaaacacgtgtttatgactacgttaaaacaatacaggatgtgtgacaatcaatctgacaaagttggaatttgcttacctgcttcttcttcttcttgtgatcatcttgaaagtatgcttctgagacacagcaagtctcttctgctgctaagctgtgactttttgacagcttggaattgcag

SEQ ID NO: 62393 - DNA, 318 bp, Glycine max
  Peptide Sequence Number=SeqID_179171
atggtggttcatgccactgagtattcttctcataattattattgggacagctcttggatgggggtctgttattttactacaaagcgcctacctgaggagcgcgttccaccagaacgcgacacgtggcttgactggacaagacgatgtgacaggggtggtcgtgcctgcctgtcaggcgctacctgtcgtgcctacctgccaggcgctaccagtcgtgccgacctgccaagcgctaccagtagtggtggggtccctggcacgtccctgttccctataaaaccatttgccctccgtttcattttcacacaaaaatcttga

SEQ ID NO: 62394 - DNA, 333 bp, Glycine max
  Peptide Sequence Number=SeqID_179172
atgtcaccacacgttatgcaggatggtggaagcagtcaatacagtatcatcatcgtgattttgcaaagaatattactcagtgacagagcagtctatgcaatgatgctagtgtttccacctgaattttctcctttgaaaactattttatttggaaatccttcccaagacaccattgaaccacagatggaggctttggaggaagattataaagatggaaataagataaatgaatcaaggcagtttattggaggagtattggatcttgaaaagagaatcaatagactatatacattgactcagaaattaaatataacaaaattttatcattgttga

SEQ ID NO: 62395 - DNA, 249 bp, Glycine max
  Peptide Sequence Number=SeqID_179173
atgagtgatggctccatgatttgttatgaggagagaacgacaatgggttacagtgggtgtgggtacgatgatggacaaagagggaagcattgctgctatcatggcaccagatctaaaactgttgtggtggcttcgacgatttatgacgaggagagatcaaatatggtttgtggtgggtgtgggcatgatgatgtcttgagtgtatttattatcctaaggaaggagttgggattaaaagcagcaagatag

SEQ ID NO: 62396 - DNA, 228 bp, Glycine max
  Peptide Sequence Number=SeqID_179174
atggcaacctcaaagagagttgggcttcgtcctcaaaaggaaacaacaccagaaaatctagccttccatggattcaaacagaaaacacaaatgagacatgaagcagaaacaaacgtaaatgaaagtagaagaagaagcaagaatgaactcgtaattagaagcagaaaacggaaatttgcattaagaacgagaactgtagcaagagaacagaaaaatgtgaaaacctaa

SEQ ID NO: 62397 - DNA, 240 bp, Glycine max
  Peptide Sequence Number=SeqID_179175
atgcatctacttttcggtagcctatcacataagaacttcatatttaagggtgcttggcttagattagttatgggatgggtgaccttttgggaagtttcccataaagcattcattgatcttgaaagcaaccaaaatagattgtcaaagtctcagaaaaagctacctatgaagggttctaactggtggagggttccgaacaatgaggagttgagtgaagtgtcaccgtgtgaagtatcgtag

SEQ ID NO: 62398 - DNA, 759 bp, Glycine max
  Peptide Sequence Number=SeqID_179176
atgagggataaatttcctggatcagagggaaaaggaagtttttggccactatctcatgttgggtacactgaggtgacacttaattcaaattctgagtccaaatttccattttgtaatgatgatgatgatgttagtagggtgcatgatgagaacattgaagtcagcaatgaccctattgctcaagttacatctgcaccttcctcaaaatgtattccatcaagcaaatcaagagtcattaaatctgatccggttgagctcatttcaatagaggaggtttcaccaccacctattgttaagaaagttcctcatagagaattagaatctgaggatagtaagattacttctcattttaaggattctcttcctagtcccctatctgagtttatgactttgaatggcacatatgcacatgttggagcatcatcagaaaaatctgcaaatgttgcacaaccaagagatattggaatggaaacaacatcaacagacactcatatggttgtatgtgattctgctcctataaatcctaaagaagagaattcaagtaacatgaataagtcctctgtaaccactgaggaaagagaagaaactggttttatcaaagagaagccaaccattgaggaagttaacaatgcagttgttgaggcttctagtttaaatggagttcaggaactggaggaagaaagaaacgcttctcctattgctacaaatgaagcaatgtctatgattacaaggttacaacaggagaaggcaacactgtag

SEQ ID NO: 62399 - DNA, 111 bp, Glycine max
  Peptide Sequence Number=SeqID_179177
atgtcattcatatgcagggcttccacttctaacagatctattaacttcactcaaggggattcaacttctaacaattctgcttgtggttgggctatctatgattatggatga

SEQ ID NO: 62400 - DNA, 558 bp, Glycine max
  Peptide Sequence Number=SeqID_179178
atgaggattagtcttgtggtgactaaggaagaattgaagaggatgctgagagataggaatgagaatgattctcagcagacttcgttggagctgttaccaagcaatatggtgttgagagacaaaagggcagctggaagcattagaggggatgcgctagttgttgataccgaactcttggcaacactcccaaggtcccctccacatttagctgctccttcgaaggctatgtctaggaggagtaaacaatccacccaactgagacggttgactatcagaagcttagatcagccacaaccaatggttaacgtcaatcctaccactgggagaggatcaatcccttataaagaaacgttccatagttatctggggggaaattttgatatccctaaaggttcgaatgccaggaagaaggagatgtcaacagtcaccactagatggaggcaatttaagtcttccctcaccactaaatacgtatatgctgacaatgagggtcaacaaaagcatgatctttttgttaagtatggtctggaacaagaaacttgggatgaatttgcataa

SEQ ID NO: 62401 - DNA, 216 bp, Glycine max
  Peptide Sequence Number=SeqID_179179
atgagattatatctcactgtgtgcaagaggaagagagacagatctgaaagtgttcatttaagctccacctctcagaataagaaaagaaggaaaactaagggtgttgttgaagggtcttttcagcaaaacaaaccaaataaagatgaagagtttacctgctacttctgcaagaagtctggacacatgaagaaagagtatcccaagtacaccacatga

SEQ ID NO: 62402 - DNA, 1098 bp, Glycine max
  Peptide Sequence Number=SeqID_179180
atggccagcaaagaagaccgagaccagaaaccagagaaggaatacagttttcagaagggaaaaaaatcaccaatggacagtggtgggtccactgggaattcatggaatagggttgtctctagtcaaactctagacaccatgcagaaagagacaaaaaacaagagagcattccatgagacttggcgtgccatgactatagcagctgcttcttggtcaaatccagcaatcaagtcctacattttagacaagagactcgaccccttagtctcgaattcaagggggtgcttctatcaagagcataatacgcgttcgaaaatcacaaataggctggaagaggtgatcctccgtctcacccagaccaaccacgatatgtctctgcgcttggataccatccaggagcaactccacctcctgcaacttcaacaccacaccccgccgtcacctccacccttaccttccccacagtcgtcaccttcctcccgccatcacctcaagctggatattccccgctttgacagcaccgacgccatgggatggatcttcaagatctcccagttcttcgattaccaccacacgccggatgaggaacgcatctccgttgcatccttctacatggatgggccagctctcagctggtatcaatggatgtttcgaaatggctttatcacatcgtggactgcacttcttcaggctctcgagaatcgctttgcacctacatattttgaggaccccaaaggtgctttgttcaagcttacccagactggatcagtcaatgactacttgcacgaatttgagcgccttgctaatagaatcacgggccttccatcatcctttttgctcagttgttttgtttccggcctcgtgccagaaattgcgccgagaggttcaggctttccagccaacaagaagctaggcaagggaagaaacatagtggtagaaaaatgcatcattcccaaactacttttatcgcttttgcaatttgaaaactccaaccaaattgttttagcaatgaatgcagatcaaaagaatcaggaaatcacaaggttgaagatgaaaccttacctgtatactttcaggtccagcaacccatctacgtga

SEQ ID NO: 62403 - DNA, 1500 bp, Glycine max
  Peptide Sequence Number=SeqID_179181
gtattggaggagctgcagaaggatccttgggcggtgccggcggatcagcgtgctgctcggtgcaccagcacggcactgagtatcgcggcgggtttgttgggggcatgtgtccctggctctgctgcgagaataatggcatttattggaggaccggctactgaaggacctgctcctattgtatccaaacaactttctgaaccaattcgctctcacaaggatctggataaagattctgtgccacattaccataaatgtgtgaaattctatgatggactttcgaagcagcttgtgcatcaaggtcatgtactagatctttttgcttgtgctcttgatcaggttggaattgctgaacttaaaactgctgttgaaagaaccggaggtcttgttgtacttgctgaaagttttggccattcagtgttcaaggattcactaaagcgtattttccaatcggctagtatagatgctcctgattgtcatgttttcctttatatatcgacttttattgatcatttaacttcttttcgcagtggaatatttgagataaactgctctaaggacttgaaagtccaaggtattattggcccttgtgcatctcttgaaaagaaaggcccattatgctcagatgttactattggtcaagggggtacaagtgcatggaaaatgtgtggccttgacaaatccacatcattgtgtctattttttgacgttgtgaggaaggaaactcctgatgcaacaatccagtccacaagcaatcaattttacttccaattcttgacttattatcagaataacggtgggcaaatgagattacgggttacgaccctttcacgtagatgggttgctggacctgaaagtatacagcctgaacctctcggcgcaatttctggcacgaggccggaaacaaaacaactgagcaaaaaggatgatggaaggcccgtgattctattagcaaggcgctcaaattcgtgcaagtgcaaagcgattctcgagagcctgaagaagtgcagtccacgatgtgataaagccatttcgaaacatccattgataccagctgagagctggcccatccatgtagaaggatgcaacggagatgcgttcctcatccggcgtgtggtggtaatcgaagaactgggagatcttgaagatccatcccatggcgtcggtgctgtcaaagcggggaatatccagcttgaggtgatggcgggaggaagggtggaggtgacggcggggtgtggtgttgaagttgcaggaggtggagttgctcctggatggtatccaagcgcagagacatatcgtggttggtctggtcatctaaatgagctggtgggtgagtctctctctttggacgagtggactgagttgggcgagtgggctgagtcctatcatgggggtgcttatggttggtttgatgtttcatgggatgatttttcaacagctgctatagtcatggcacgccaagtctccttcaaaatggaaacagagggatccacttattgctga

SEQ ID NO: 62404 - DNA, 213 bp, Glycine max
  Peptide Sequence Number=SeqID_179182
atgacgactctttgcaaatctagaagaaagagattccttaccatccaaaccataagcccaaatgagaagttcattttcatggggaatggagtgaaagctccagtggaaacagttgagacttattgtttaaaactcgatactagacatcgtttaaatttattggaaactccttatgtacctagtttatttaggaatttagtttcatttatctaa

SEQ ID NO: 62405 - DNA, 144 bp, Glycine max
  Peptide Sequence Number=SeqID_179183
gctcgatttttactggcaaagttaaacccttctgctacttataacactgaatcttacaatcccggaggggatattatctttacggatgatagtagaggtgttgggttgaaaccagtgagaaagctagctgatggttttgattag

SEQ ID NO: 62406 - DNA, 282 bp, Glycine max
  Peptide Sequence Number=SeqID_179184
atggccaaaatacaaggcccaaaagaaggaaaaacctattctaatatttacaaagaagagtggacccaaccttggcccatgggctcagaaatctaccctgaggttcatgagaaccccagggccttttttagcaactctagcccaatcctcttggagccttctatccaatacccttgggggataggattgcatcataacaacccctacaaacaaggtttttctcacccttttcatactcactcattctcacttaacaaagggtattctcagtccaacatgtga

SEQ ID NO: 62407 - DNA, 588 bp, Glycine max
  Peptide Sequence Number=SeqID_179185
atgtgcaccactacaaggtttgtgtttggtgttgaatcgatcaacagtctaaaagctgaagaaaaagacagggattatgatgaaagctcaaagcctcttactagatataaagcattggcagcattcatttggaaacacatgacacctgcatgcaagatgaaatctaataacacaagaccagcagttgttatccatattctggacaggagaaggaggattggtgaacctttctctagatacacaattaacaacattttgtggccagtgatggtgttttgtgaaaaacacaaagtgcagaaactactgttacatatttgggaattgtttttaagagtcaaaagtgatcctaatatcctagggagcactcagtgtatggacttgactcaagggggcctagattttggttttgggaagcctttgtgggttggtgttacaagaggggataaggaaactctccccaatgaagttattatcatggaaataaatgaagccattcaagcttggttgacaatggaaatgcaacatattgctaacttggaaagagacattgagtttctaagattagctttgcctaatcctagtgtttga

SEQ ID NO: 62408 - DNA, 330 bp, Glycine max
  Peptide Sequence Number=SeqID_179186
atggcaggcatcgttgactatttgaagaaacaaagtggtcctgcttcaactgaaattaaatttgctgatgagcctactgcttttgttggtgaaaacaaagtcgctattgtaagttggagtttttctttagaggattttgacaacttttctgccttagcagagaagttgcgttctgattatgactttggtcaccctctgaatgtcaaactccttccaagaggagagtcgagagtttctgggcccatagttaggttgtccaagccattcaatgaactttttgttgacttccagccattgagtgttcacgcaacaaaggctccatatttgtaa

SEQ ID NO: 62409 - DNA, 1197 bp, Glycine max
  Peptide Sequence Number=SeqID_179187
atgattgggttgctcctacattgcaaaagaaaacacagttcctcaagtggtcaattccaaacaagaaatacttattctactccctcttctccgaatgcagaagtcgaaagtggcagtgtgtactttggagttcctctcttctcctacaaggagcttgcagaagcaacaaaccgttttgaccttagtaaacaaattggagatggaggctttgggactgtctactatggaaaactcaaagatggaagggaagttgcagtcaagcacttgtataatcataattacagacgagtagaacagttcatgaatgaaattcagatcctcacacgtttgcgccacagaaatcttgtgtcactctatggctgcacttcacgtcagagccgtgaactactgcttgtgtatgaatacattccaaatggcacagttgccagccatctccatggggaattggcaaagcctggcttactaacgtggtccttacgaatgaaaattgccgtagagacagctagtgcattggcttatcttcatgcttctaaaatcattcaccgtgatatcaaaactaacaacattctccttgacaacagtttctatgttaaagttgcagattttggcctttcaagactattccccaatgacatgactcatgtctccacagcaccacaagggaccccgggttatgttgacccggaatatcaccaatgctaccagctaactagcaagagtgatgtgtatagctttggagttgtgctcattgagctaatatcatctatgccagctgttgacatgaacaggcataaggatgaaattaacttgtctaatctagccataaagaagatccaagaaagggcattgagtgaactggttgacccttatctgggttttgattcagacacagaggtgaagaggatgataattgaggcgacagagttggcctttcaatgtttgcaacaggacagggaattgagaccttccatggatgaagtccttgaggtattgaagagaattgaaagtgggaaggatgagctaaagcatctagaagaagcagttcatggttctggggtttcacataataataatgtaacaacctcaacagaattggatgaagctggattgttgaagaataggaagccaccttcttcaccaatatccgttcctgatagtcgggaaagtaaatccactacgcctaatgccagttcttaa

SEQ ID NO: 62410 - DNA, 414 bp, Glycine max
  Peptide Sequence Number=SeqID_179188
atggctggacttttgggatataggagccttccacctaaggcaaagaatttggtagttgttgggggtttgacaacttttgtctttggtgcctacttctacaccatgagggctgttggaggcactaatgaactgcaggtagcaattgataagtttgaagctaacaagaacaagaatgtgggtgatgccaacatgcgatcaaaggctatacttgattcaacaggttccttagctaagttttcctgtgaagtggaaataatagaattgaaagtcgtaggagattttgtatcatccgttcccgggatcaagatgagtatcttgttgcaaaggttgaatggatacaagatatttagccaccagaaggaacaagtgaaagagagactgtttagaaggaaaatcctcactacaaagtcctga

SEQ ID NO: 62411 - DNA, 483 bp, Glycine max
  Peptide Sequence Number=SeqID_179189
atgggcctaaatttagagttgaagagccattcggagaatgttaatgcccttgcattttccagacaaagggttcttgtgccagttaaagtcaacatgggtgacgatgcttttggcgtggaaacggtgccgatcaaacaaattccttcatctggtggagatgaggatgtggaagttgatatcattgggtgttcaaatttggggaaaccttttctgatggaagattcttgtgaggattcccccgagtgttccagctcttttggtgattcaggatctggtgctgagaatgcctcatcctttagcgatactgaagttgaatcacgaaagtgtgctgacgatccatcctcatcaaagtgtgatgactggtttgaatcatgtcaaggaagtgctgcagatcactggttaagaggttattataggaatagtttattaaataaaaagcctgctcttgctaaagggcgtgagacaccagtttcttcttgctag

SEQ ID NO: 62412 - DNA, 283 bp, Glycine max
  Peptide Sequence Number=SeqID_179190
ggtaaattctgatagggatgatgaatgtctcccaccacaagaaacaaagaaacctaacaggaaagtggcaatgcaagttgatagaagctggtcaaggaacatgaccccacccaaatatgcacgtagtggaccattggtcaaggttaaggcagaacatcatagacgcaccaatagtgaaggggatgttggaccaaggttggtaaggagcagtggcatgagaagagagtggagtttggaggatttggctgggcaacaacaagacaagggagttagatgctattga

SEQ ID NO: 62413 - DNA, 801 bp, Glycine max
  Peptide Sequence Number=SeqID_179191
atggaggtccggtgtggtctgcgtgcagtgatggcgtgcacggcaacggaggcgtttggttcgcttgcaggaaatgtgaaggagaagaagatgaagcaacttcagtctcaagcacgtaaatatgagaaagaacttgcagcatacaatcactcaaagcaacttgatttggcacactttacattagaagactctaatatcaaatccatccctatatctgatcggatgcatagaaataaagttatgaagaggaacaaaagaaaaagagttgaagagcagtgcgatatagaatcttacatgtctaaccatagtttattctcctattatgagaaaacagattgtactgctgatacatgtttgaaagatgtttgtgatgttggtataggaggtgtcaatgatagtaaccaggaattcaagctgaatgatgagtggtcttctgaagagtatggaaatgttgataaatccttggatgacatcattcagaagattgaagctatacagtcagaagttcagcaattaaaaactagaaccgacaaggtgataagtgaaagttgtggaaagttttgttctataactcaatttagcatgcgtggccgatctgatggatttaatcattttgattctactttcaccagtaatgaaaacacattaccatttagttttcctcgttcctcatctcagcttgaatctgagtttcacatgggagatctacttatgcctggaaatgcatcagctagtcgtgaagtgatgattccctgtattgtaaccactgatgggcctgagcttgatgatccattgaaagat

SEQ ID NO: 62414 - DNA, 225 bp, Glycine max
  Peptide Sequence Number=SeqID_179192
atgatgcctgcacctgactcaacactcagatgcaatgtggtacgtaccaacaacaaccaaatctcaggaaatagcctaagcatgtccacacgacactattacttagggaactatgctgagtttgttgagaccacccggctagtgccaaagaccctagaaggtcagtgcacagtgccccccacggtcatacacaacatccaacgtatgaacgtgaccaaaaggtaa

SEQ ID NO: 62415 - DNA, 933 bp, Glycine max
  Peptide Sequence Number=SeqID_179193
atgagtgagaaagatgatggcttgggtttggggttgagtttgaagttgggatggggagaaaatgatgatgataataataataatctaaatcatcatcaacaacaacaataccctttctacgtgcacaagcctcctcaatcggttccaaaccaaagggcttccttcaataacttgttccattttcatgatcggagctccgagacgcggtcgttcctccgcggaatagacgtgaatctgccacctccgcccccatcggcggtggtcgacgacgagaacgcggtgtcatcgccgaacagcacgatatcgagcatcagcgggaagcggagcgagagagagggcaacggagacgaaaacgagagaacatcgagttctcgcggcggcggaagcgacgacgatgatggcggagcttgcggcggagacggcgacggcgaagcgtcgaggaagaagctgaggttgtccaaggaacaggcattggtgctggaagaaacattcaaggaacacaacagtctgaacccgaagcaaaagcaagctttggcaaagcagttgaatttgatgcctaggcaggtggaggtgtggtttcaaaacagaagagcaaggaccaagttgaagcagactgaagtggattgtgaatacttgaagaactgctgtgagaatctaactgaagagaataggaggcttcaaaaggaagtgcaagagcttagggcattgaagttatccccacagctttacatgaacatgaaccctcccaccactctcacaatgtgcccttcgtgcgagcgtgttgccgtctcatccacatccttttcctcatcggccaccatgccctctgccccgcctccagctaatctcaacccggcaggccctaccatccagcggccggtgcccgtcaacccttgggcagcaatgttgaatcaacaccgtggccggccataa

SEQ ID NO: 62416 - DNA, 225 bp, Glycine max
  Peptide Sequence Number=SeqID_179194
atggctgaagatttgtctctaaatgatagaaagttatccaaagagcataaggacctagaagcacttcatgagttgaagggtccaatgataagatccaaagtcaagcttctacaagaagagatgatcaagaggatcaagaatggactactcatcaaaggcaaggaaggaaaaaattacaagaagttgaattggagcactttgaagattggtaaacaactcgcttag

SEQ ID NO: 62417 - DNA, 582 bp, Glycine max
  Peptide Sequence Number=SeqID_179195
atgttagaccctacaaatatccatacttccagaagtcggaaattgaacgacagttatggaattactcaattccagtttaatgcaacacagtcgaagcccattctcctccccagtgttactcgtgaaaaagaaggatggaacttgacgcatgctcatcttcaccacttggaggtggtatttcagatattattgtgcggccaattcttccttaagcgttctaaatgtttgttcggccaacgccagctggattacttgagccacgtagtttccaagaacagagtgtcccctgaaccatccaaggatctccgtgcatttctaggccttacagggttttaccgcaagttcgtgcggggttatgcaaacattgcttctccccttacgaccttgctatgcaaagatgcttttcgacggaccccagccttacaagatgatttcgccaaactgaaacaagccatgacgacaacccctattcttgctcttccagatttcgaattaccattcgtcctggaaaccgatgtgttcggcatcgtcatgggagttgttcggccttacgcaacgcggttatgccattgccttttttag

SEQ ID NO: 62418 - DNA, 783 bp, Glycine max
  Peptide Sequence Number=SeqID_179196
atgcagaccatcgtctttttggtttttctgacgttttcctcgaataaacgttggtgtcgactccacacgttttccttccctggaagacgcacccttggcccacatgaggggccttttcgtgcccctgccagatggcaggtcgcgacactccccatgatggaaagagaaatgataacaatgatagtggacacactgccagtgttctactatgagaagatggtgggttacatgccctctagtttcgcagatttggtatttgtgagcgaaaggattgaggtaggcttgaagaggggaaagttcaattatgcctctcccaccagcacaagcaatagaaggtttggagcgagtggggccaagaaggaaagagacgcccatgctgtgacttcaacttctacttgggataaaccccaacaaacccatcacaaccccacttaccaatattacccacaccaaccaagcttcttggccaacatcggaaacactcccaatccagcgcccgtccaacagaggttgttcgctcaaccaaaaaggtctcccccacaaaactcacaatctcgtcctgccggcagctccaatcccagcataagcaccaatccagggagaaattttccagtgacgaaacttgtggaattcaccccaatcccaatgccatatgctgacttgctaccatccttgatcaccatccaaatggcggtggtgaaccctaagaagatctaccaatctcccttccctaacgtaacatgtgcttatcttggaggtgtcccagggcattcaatagaataa

SEQ ID NO: 62419 - DNA, 216 bp, Glycine max
  Peptide Sequence Number=SeqID_179197
atggaagacattaacaatgttgaaaatattatgggaggaaacttatttcaaccccggcaacaccaccagatttataatcaaggatatcatcaaacttttgcaactatggacaataattttgcttctcaaggaacatttgatgggttccatttcaaagaaattgatgatcctttctcaatggaagacattcttaacaacttccacatgcagttttag

SEQ ID NO: 62420 - DNA, 927 bp, Glycine max
  Peptide Sequence Number=SeqID_179198
atggagcctgacaggttaaattccccaaccacatttgagatgccattggaggttatgggccatgagttacagttttctcaggatcccaattccaagcacttagggactacagtatgggatgcatcacttgtgtttgtcaagtttcttggatatgatcttaagttaagagatccttttgaagatgaactaggtcatgaacggaattgcagaaagggaaagttttccccagctaaacttaaaggaaaacgtgtaattgaactaggagctggctgtggtgtttctggtattgaccaaaaggaggttttgccattgttacagagaaatgttgagcgtaatatttcaaggatcacgcaaaagaatcctgagtcatttggttcgatcaaggtggctgagcttcagtggggagatgagagtcacattaaggctgttggtcctccatttgactacattattggcactgatgttgtttatgtagagcatctattggagcctctattacagacaatacttgctttatctggaccaaggactacaattatgttgggctatgagatccgctctacgagcgtccatgagaagatgcttcagaagtggaaaagaaactttgatgtcaagactgtcgcgaagtccaagatggatgaaacatttcaacatccaagtattcaactcttcattatgggattcaaacaatctgcagagtgcacagagaacccaggtcaggcaactgttgaaaaagttgatgtggaaactgttgtggaggataaaagcagggagggaaatgttgtagtagaaggatctggtctcgttgaagaaaatgttgaggatcacagtaagccaatctcacaaaatgcaaagcttagtgagtgggaagccagaaggtatggagcaatggctgcaaggattttaaaagatgtaaaaatatcctga

SEQ ID NO: 62421 - DNA, 363 bp, Glycine max
  Peptide Sequence Number=SeqID_179199
atggtcaacaacattgaagacgaggaagccttagagactagcactgttgtctttgagttttcgaacggaggaatcggtgttgtggcctttggcaaagttgttggcggcatcttccttgctagagacgagttgtttggggtggaagatttgatagtaggtgtcgcagcgaacttcatcaaagatggtgggaagatcgacgaagatgatgtgcacaacatgcttgtcagatctagtttcgctaaggaaggtgttgaaagcgtcatgggccacaccgagggtgatgtgcatgcgaagattacaccagtctactcccgcagctctcaatatcacataaaatatgaaagtgtagatgtctggtcgtga

SEQ ID NO: 62422 - DNA, 606 bp, Glycine max
  Peptide Sequence Number=SeqID_179200
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgcagtggcttggttaagggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 62423 - DNA, 201 bp, Glycine max
  Peptide Sequence Number=SeqID_179201
atggagaaggtgaagaacattctgaagccgaagccaaatccgcagcaactattgagggattggcagcgcaggcttcgccaagggtgtcgcaacattgagcgccaaattcgcgatatacagagagaagaaaaaaatgtgcagaaggcgattagagaagcagcaaagaggaatgacatgggctctgcaaagtgtcatgattga

SEQ ID NO: 62424 - DNA, 357 bp, Glycine max
  Peptide Sequence Number=SeqID_179202
atgtggcacgatttcgcttacggccgcaacgcggtctatcccgagggccatcatggcaacgcgatactgtcacgctttccgatcaccgaataccaaaaccgcgatatttctgtcgccggcagtgagaaacgcggcatgttgcattgccagattagcctgccggatcggccggaaccgattcacacgttatgcgtgcacctcggcctgaaagagaagcaccgtctggcgcagatgcgcatgatgtgtgaactgattgagtcgctgccaccggatgcgcccctggtggtggccggcgattttaatgactggcaggtacgcgctaatcgattcttacagcgcggagccggtctgcaggag

SEQ ID NO: 62425 - DNA, 1320 bp, Glycine max
  Peptide Sequence Number=SeqID_179203
atgaagctcgaggtccctcgttttgatggctctgatccttcaggatggacctttaaaattagacaattcttcgagtaccacgcaacccttgaacccgaacgcctagtcattgcctccttcgccatggaaggacttgcactcgcttggttccaatggttgactcgccctctaacctttgacactggtccaagcagcgggtctcgcgagactctaggaagagaaactagtcgaccaacgccgtggcgtccatggtggcttctgcggccgagctccacccaacctctcccctcttctccctccgtcaccaccaacccctctgttgttgccttcccctgtgaagccaccaccgacccatgtttgtctcttgttgccagaagagatgaccatgtgccgagagaaggggcccagcccacacatcctctttgggttgtggtgactaacgacaacgaattggcttggcatcagctttgctctggcttcgcaattcacattcagggacagacgttcatcgtcgacctccatgtcttacccctctgtggatcagacttggtccttggtgttcagtggttgaagtccctgggccctacctacccacaaccaaaccagagactacccaatacccagaaatcgccaatttactcaaccgattctcggccctgttccaaacaccgacgaccctccctcactcccataccaccaaccacgccatccacttactacccaactcagaacccatcaatgttcatccttactgctatccctatttccgaaagcaagagattgaaactcaaagctttaaacgctgttacaattaaggatagattccctatcccaactactgatgagttattagatgaattaggcggcacattttggttctcgaagcttgacctcttacaagggtatcatcaaattctgatgaaggctgaagatgtatgcaaaactacgtttcacactcaccatggtcactatgaattatgtgtcatgtcgttcggcttgtgcaatgcaccatcatctttccaagccactatgaatagcatctttggaccttacctatgcaggttcatcatcgtcttctttgacgatatattaatttacagtaagaccttcactgatcatctggatcacctcacaaaagcctttagggttttactagaaggacgcttcttcctcaaactcactaagtgcacctttgcccaactacaggatcttaaaacagagttgcagcatcactcaagctaccaagaactccggcggaacatcgaggacaatcctcaagctcactcgacttacgttgtaaccaaggactccattctctag

SEQ ID NO: 62426 - DNA, 378 bp, Glycine max
  Peptide Sequence Number=SeqID_179204
atggcttccagaaagagaaagagtattggtacaaggcccacagctcagtatgatacaaggaggttccactcctttgaggcctggacccgatacacaaataatgttctaggaagacatatactgcctgagaggaaggtagaaatataccatactgagctagacgagtttaaggttgaattgcagaggcgtaacttccataaacgcctcaccaatttagttgagagcagcataaatctagctttggtgaaggagttttatgccaacctttacagctccgaaggaccttcaccaaagcaagtcaaggtcagaggccacgtggtgaagattgatgcagacagcctcaacacctttctagagacaacctgtggtactagctga

SEQ ID NO: 62427 - DNA, 184 bp, Glycine max
  Peptide Sequence Number=SeqID_179205
tccttgcgctaagcgcgagcctcgcgctaagcgcatatttggtcatgcactaagccgcgagtctcaagcgcttagcgctcaaccattgcttctgaggctaatttgctctgctaagctagccaaggatgagctaagccaacttcaattcaatctgaattcggctaagcttcagcttgatcgctaa

SEQ ID NO: 62428 - DNA, 825 bp, Glycine max
  Peptide Sequence Number=SeqID_179206
atggggctcactccattcgaattaactttcggcaagaaacctccgagcatacctcaatacctcgttggcgcctttaacatagatgtcatcgatgacttcctcaaaattggcccagttgcttatcagcttaagcttcccccagagtcacgaatacaccctgtctttcgttgttcactccttaagcccttccacccttccaacactttgaccacgcatgtcgctgacttaccctctcagtcagaagataatgaacccgtagttactccccttgtcattcttaacacaaagtgggttacttcagacactgggccaaagttaatggtgctttcagaagagcaaagggatgttatgaataagcaatacacaacacaggcaagggaaaaatgctaccaaacagagaagagacaaacacttacccgagaatcaaaaaggcagagcactaggccacaatacctgaggtacttcataaccaattctgacaaagaactggatttggaagctgtggcagaggctgttgaaaattctgctgaaataatatcagcagcatgtgaaggcagttccattgaggagccaaatgttgggatggagtttcagtctgaagaagctgccaagaacttctatgaagaatatgcgagacgggaagggttcgttgtgcgccttgatcgctgccatcgttctgaggttgacaagcaaatcatttcacgccgtttttcgtgcaataagcaaggttttcatgtgagggaacacagtcatctgctaaatgcttctgctttgccttataattcactgatagtgagtcttatcttcttcagtcccagacattga

SEQ ID NO: 62429 - DNA, 525 bp, Glycine max
  Peptide Sequence Number=SeqID_179207
atggaaaactttaggctgaaggacctgcctgactctataaggacaacaaatccaaacagttttatggtagaattttcctttgaagtggcagataatatccatagagcctctgctattgttttaaatacttctgatgaacttgagagtggtgtattcagtgctctctccactatgttgccttttgtttaccgcattggccctttcctttcatttttaaaatcaaagtccacagagccgcttggcatctttaggttccaatctttggaaggaagatacagagtgccgacaagctgtagatatatttggagtgaatggggcattgggattgaaattgataccaatgtaaagagagaagaggtggagaaactggtcaatgaattgatgatgatggtaaggaaaggaaaggggatgaggctcaaggccatggagttgaagaacaaggcagaggaggacaccagaccgggtggtcgttcatacatcaacttggacagagtgattaatgaagtgttgcttaagataaaataa

SEQ ID NO: 62430 - DNA, 162 bp, Glycine max
  Peptide Sequence Number=SeqID_179208
atgaagaacaaagagcatcaccatacagttgatgaatgtgactgccaagatacaacaagcacttgttttccaacattgtggtcgctaaaatggccaaccaaggctgaaaattcccaagaccctcagcaatgtcttccacatacacaaccttcccctctctga

SEQ ID NO: 62431 - DNA, 617 bp, Glycine max
  Peptide Sequence Number=SeqID_179209
tttcacacctttttcgccaagaggtgaggcatgcttgcccgctagaaagtcgccgttcatgcacagagaaaggaggggcaaattgggaccaactcttagcaagcaaagaaggagcatctgtcaactggttccctcgatggaaggaaggaagaaccgaagttcttatttcatgcggaggatttccaaatgttcccttgatggggacgaggggttgcatcaactacaatcccgttcttgctataagacaacttggctaccctatgagaggggcgccactagaggatgagctcacgcctatcatttcacgaggtttcaataagaccaacgtggagacacttcagaaggtccgcaaggaatgggaggtgttgcaaaagaaggacaaggaactcaggggcagtaacaatgggcccatcggtggctatcgtaagtggttaaaagcccacgtgcaaggtttggattggcttccaagtttgagaaccgctaaaagagaggaagttgaggcaccggagggagacgaagaggtgcaggcccttagggcggaactcgagcaagcccaaacagttaaagaaaggttcaaatcagcggctctaaaatccgaaaggagaataccgaactga

SEQ ID NO: 62432 - DNA, 711 bp, Glycine max
  Peptide Sequence Number=SeqID_179210
atggctttgataatttccgcctcggtgcctcattgcgttgtccgccaaatgccccgttttttccgttttcccggcatgaaggtgcgggaaggcaacatgctgctggcggactttgctgaccagtttattcttcgactctgcgcacgcttacgcgaaattgatgcattcggtcatgagctggcgtctgattcagggcttgagtatgccggtctggatgcctcgctggcgccttttccggatggcagtatttctgtcggcaggttagttgaaaatcttggtgcgcgtcctggtggcgttcagggatcactctttataaccagtattctgacgaatgcgattaaaagcgcagtcgcaatcagtggtgctcgcgcaacgggtttcaatggcgtcatgttctcagtactggaagatgatgccctggcgagtaccaataatcgtcgtgcattaagcattgatacgcttaatgcatggtcaactgtttgtggttgtggattagatatgctcccggtgccaggttcgacactgcctgaagatattgccgcgattattcttgatacggctgcactcgcggtgcggttaacgaaaccgctcggtgtacgtttattacctattcctggcggagagggaaaacggtacttgatctcggcgccggggtcgggcagtgggcttttcgctttcagcatcagggcgcaaaaaaaatcaccgctgtag

SEQ ID NO: 62433 - DNA, 387 bp, Glycine max
  Peptide Sequence Number=SeqID_179211
atggcacaagtgagaaacaagcaagtacttctaaaggactatgtcacaggttttcccaaagaatccgacatgaacattgtcgaaaataccataacattgaagctcccagaaggttccaatgaagtcttgctaaaaaatttgtactggtcctgtgatccatttatgaggaatctcatgaacaagcccgaaggccctcccaatagtcttgcccacactcctggttctcatcaaaaaccagaattcatgttagttaaggaagagtatagcttgttaccctcagctcaaatactcttcaaaattgagcacactgatgttccacttacctactacacggggatgcttgctatgtactcaatgatttcaatttatattgtctatcatggataa

SEQ ID NO: 62434 - DNA, 159 bp, Glycine max
  Peptide Sequence Number=SeqID_179212
atggtctcggacacagaaacgtcgcgcacactccagacatcttctagaagatcccaatggtcagctggtggaaagggtgttacacatcctgtacctgttggggtacttgggctgtgggacctgttcgctttcagcaagtgcaccggattgcgcaagtag

SEQ ID NO: 62435 - DNA, 162 bp, Glycine max
  Peptide Sequence Number=SeqID_179213
atggagactagaaatcacgacagcgtcgcatttggaggtcggaaatcacggcagcgatgctgcttcacggagtgtgttaatgttgcaagagtgattttgagttctaacagagaaggttggagcatgagggcagtgtcagagatcgataaatttcatatctga

SEQ ID NO: 62436 - DNA, 2091 bp, Glycine max
  Peptide Sequence Number=SeqID_179214
atgaaagaaggggcaaacggaaaacacacacacacatactatgagtatttgatttataggccagacgccgagcaccacgatatcccagaccaggtaacggacgatacataccctcacatcagcttgcacgcgctctcaggattcccgtcatctgaaacttttcgtctttatggaatcattaatcacgcgcgtctcactatcctcattgatagtggaagcacacataattttcttcagccacgcatagctcagttccttcgcctcccggtaaagcccacctcgccattacgagtgcttgtggggaatggctcagtccttgactgtaaccagctatgttctgatacccctctctcacttcaaggtcaccacttcaatgtttccttccacctcttgccgataagtggagctgatgctgttttgggtatcgaatggctcaagcaatttgggccggttattactgattataccgcccttattatgaagttccaccatttgggccaggccattgagcttcatgcagacgtttcaaatgggctcgaacccgtctcggcaccccaagtcaagcgcctgatccgaactgggtctacatccgccctatttcacttaagcctactatccataacccggcccaaaccgccacatcatcatcttcctcaacatcatcttccccacccagaccctgcaatagaaaatcttctccggcgttaccaccaaattttcgagacaccaaccacccttcctcctccccgaaacgtcactcaccacataaaccttctcccttcatcctcccccatcaacgtaagaccatatagatacccccatttccagaaaaccgagattgaaaagcaagtttccgatctcctttcagcagggttgatacctaccagtacaagtccatactcttccccagttcttctagtgaagaagaaggatggaacatggcgaatgtgcgtggactatcgcgcactcaacacagtaaccatccgcgacaggttcccgataccaactatcgacgaattgttggatgaactcgggcaatcatcttggttctctaaacttgatttgcggcagggctttcaccagatccttatgcatgaaccagacattgagaaaacggcattccgaacgcatcaggggcactatgaatatcgcgtgatgccattcggtttgagcaatgcttcctctatgtttcaagctgccatgaacagcttgctcacaccattcctgagacgctgtgctacggtatttttcgatgatattctagtctatagtaagagcctatcattacatgttcatcatctggaaatgattttcaaagctctattagatgctcaattctatctcaaatatactaagtgtgttttcgcgcaaaaacaagtagattatttaggccacgtcgtttcaggtagaggggttgaaccagaaccctctaagattcaagccatgctacaatggcctactccgacttccgtcagagaacttcgaggattcttagggctaacggggttctatcgaaaattcataagagattacgcgtccatagcctcgccacttacaacactcctatgtaaagatgccttcgagtggagtgaagtttcccaagctgcctttgatgcccttaagtccgctatgactcaagctcccgtactagctctccccaatttctttgaaccattcatagtggaaacagatgcgtcgcagaccgccatgggtgccgtcttagtgcaaaaggaccacccagtggctttcttcagcaaagtttttggtcctcgactagcccatgcttcaacttacatacgcgaactccacaccatagtcacggcggtgcgaaagtggcgtcaatacctcttaggaagatctttcactatcctaacagaccacaagagcatccaagaacttatgacgcaggtaatacaaacccctaagcaacattattacctctctaagttgctggggttcgattacaccattcgatataaggcaggcacttccaacattgtagcggatgctttatctcgagcaccaccaccttccagtcagatactgttactctcagtccctcatctggacttcatttcagatctccgatga

SEQ ID NO: 62437 - DNA, 2049 bp, Glycine max
  Peptide Sequence Number=SeqID_179215
atggtgttcatatttccaacgcttctgtccatgaagctccaaccacttttgctgcttcttgtgatgtacttctgtgcatttgctgcttcttctgagattgcttcagaagcaaatgctttgttgaagtggaaatccagccttgacaaccaaagtcatgcttctctctcttcatggagtggcaataatccttgcaattggttcggaattgcatgtgatgagttcaattctgtttccaacataaatcttacaaatgttggattaagaggtacgcttcaaagtctcaacttctcattacttccaaacattctcactctaaatatgagtcacaactccttgaatggaactattcctcctcaaattggttccttatccaatctcaacactcttgacttgtccactaataacctctttggtagcattcccaataccattggtaatctctccaaactcttgtttcttaatctttctgacaatgatctctctggtaccattcctttcaccattggaaatttgtcaaagcttagtgtattatctatatcctttaatgaactcactggaccaatcccagcttccataggcaacttggtcaatttggactccatgcgtcttcatgaaaataaactctctgggtccatacctttcaccattggaaatttgtcaaagcttagtgtattatatatatccttgaatgaactcactggaccaatcccaacttccataggcaacttggtcaatttgaacttcatgctccttgatgaaaataaactctttgggtccattcctttcaccattggaaatttgtcaaagcttagtgtattatctatatcctctaatgaactctctggagcaatcccagcttccataggcaacttggtcaatttggactccttgttccttgatgaaaataaactctctgaatccattcctttcaccattggaaatttgtcaaagcttagtgtattatctatatactttaatgaactcactggatcaattccttccactattggaaatttatcaaatgtcagggcattactattttttggaaatgaacttggtggcaatattccaatagaaatgagcatgcttactgctctggaaggtttgcatctagatgacaataattttataggccatttaccccaaaacatttgcattggcggaacgttgaaaattttttccgcttctaataacaacttcaaaggtccaatttcagtgagtttgaagaattgctccagccttataagagtcgggcttcagcaaaaccagctaacgggggatataacaaatgcttttggtgtacttccaaatttggactacatcgaattgagtgacaatcacttttatggtcaactttcacctaactggggaaagtttcgtagcctcacaagcctcatgatctccaacaataatttatcaggtttgataccaccagaactagctggggcaaccaaattacaacgacttcacctgtcctcaaaccatcttacaggaaacattccacatgatttatgtaagttgcccttgtttgatctctcactcgacaacaataatcttacaggaaatgttcccaaagaaatagcatcaatgcagaaacttcaaattttgaagcttggatcaaataagttgtctggcttaatcccaatacaactaggaaatttgctcaatttattgaacatgagtctgagccaaaataattttcagggaaatattccttcagagcttggcaaactgaaatttcttaccagtcttgatcttggtggaaattctttgagaggaacaataccttcaatgtttggagaattaaaaagcttagaaacactgaatctctctcacaataatctttcaggtgatctctctagcttcgatgatatgacaagcttgacatctattgatatatcatacaaccagtttgagggtccacttccaaacattctagccttccacaatgctaaaattgaagcattgagaaataataaaggcttgtgtggaaatgtcactggcttggagccttgctcaacatcaagtgggaatctcataatcatatga

SEQ ID NO: 62438 - DNA, 816 bp, Glycine max
  Peptide Sequence Number=SeqID_179216
atggtgtcaaaaagaaccttcattggaggaaaacagctcttgcatagtgtattcattgctaatgaagttatagatgaggcaaaaagaaaaaagaaaaaaatgctttctcttcaaggtcgattttggaaaggcatatggttcaaggtcgattttgaaaaggcatatgaaggattgaccggcttgatgagagaagtttccgccaaaggtttctacaagggatttgaggttgtagatggctctttagtctccggtttgaagactaggactacacctttcatttaccttggtctgccaatcggtgcaaatcataagagagttgagacttggcaacagtttcctaaaaaggtgtgcaagaagcttgaaagaattcaaagtagattcctatggggaggaaatgatgaagttaaaaaaagtggcttggctaaggtgatcggatatttgcgcaaaaaaggaacatggaggcttgggggcgaaatacatggcatttcagacaatacttctcaccaatgggaatccctttggtggagagatttgaaaaaagttcgtggaggactaaatgattcaaaatggtttgaaaatgcattctcatggaaggttggcaatggtgacaaatgtagattttggaaggactcttggttggaggaacaatctttacaacaaaaattccctagattattctcggtctcggtacaaaaagatagtcttatttgtgagggtaatgttgattctgaaactcatggcgttgggactgtgatcaaaaagggatcttcactactagctcaacatatgatttcttcgagggcccgggacatgtag

SEQ ID NO: 62439 - DNA, 348 bp, Glycine max
  Peptide Sequence Number=SeqID_179217
atggtgctgagtacttgcaaaatcaatcccaatggattgagctggatgtacataaagagaaggaagggatggctcctgcaggggtggttgtgggtggtgtgttatggcatggccgggagtagaggtagaggcagccatggacggcaggtggaggtgatcgagaatcgagtccaccttgccggaaagttctacgcggacgatggcttcttcaaggcgatcggtggtcgtctttctggttccgtggtcggccatggcaatggtggcggtggcaggtcggaccagttgttatgtgacagagggtggggtagtgcctttgttcgaggcaaggctcctcctaagaaagtctga

SEQ ID NO: 62440 - DNA, 1174 bp, Glycine max
  Peptide Sequence Number=SeqID_179218
atgtctctcctccgccatgtttgcacaacctcaaagctctcagcagcagcagcagcatcaacagcaacgatggcgatcccttggaagtacaagaagttcgccatatcacagggtcagaagtccctcaccgactacctccacgccacgcgcagcatcccttacgcctacgccaaccaaatcgccaagaactccctcacttccctcaccaccctcatcaccactctcggcacttcttccttctcccctctccacttcccccacaacctcaacaagttcctcatgtaccaccccatcaacgaattcgagttcttcttcgagagcattggcattcacccctccaacttccattctcttttgccccaagacaagttctttttctcccaagatgatacccttttgagtgctgcttgtgttctttacgagtttgggtttccctgggataggcttggggttttgtatgtggagagtggctgttttctcaattggggtgcttctgagttgaaggatagggtttgtgggttcaaaaggtatggtctttgcaatgagcaggttgttggggtgtgtatggcttttccctttgtgtttgatggccaaaagggtgatgatgaggttgaggctttgtttcgtgatctggggttgctgtttggggagtttggtttggctgagtgtgttgaggggaaggggaactatagtgtcgatgattggattcgggtgtgtaggaagataaggttgttttatgatttgaatggtgggaagagcttagtggagctcattggaaggaacaatggtggtggtgttggtgtcattgtggagcatggggaagaggagttggttcaagcagctgagtatttttgtaggtttggtgcgaagaaggaggatgtggcacgattgattgtagacggaccggagttgttggagcttgatttggaggcatgggtggttgatgtggtgaagctgttgaagtactttggaatgagatcggatgatgtcgaggatgttaggagggattatgctcatgtattggggacagttaagatgggtaatctgcccaatgtgatgagagcgttaggtttacgtgagtggttctttgataagatcaaggatgggaatcatcaattgttagttagttttgtcacgagctgtcccggtgaattccaagatgaaggctatctag

SEQ ID NO: 62441 - DNA, 222 bp, Glycine max
  Peptide Sequence Number=SeqID_179219
atggaaaagagaaggtcagttcaggccagactttacgtaggggggcgcgcaagcgaaggcttagaggttgaggttacgcgtgtagggatctgttggaccatggtggtgctgccaacattgggattgagtgtgcaaagcctcagaggtttagacttggggaaaaagatggtgcagttgggtggtggcgttgtgaggaggtcgtgcatgacgcagagccactaa

SEQ ID NO: 62442 - DNA, 785 bp, Glycine max
  Peptide Sequence Number=SeqID_179220
tattggttcaagacccacagcgcagtatgacacaaggagattctcttccttagatgcttggaccagatacacagataatgtccaggggagaaacattttaccagagaggaaagtagagatatatcactctgagctagatgagtttaaggctgaattggagaggcgtaatttccataaacgcctcaccaatttagtcgatgggagcatagacctagctttggtgaaagaattctatgcaaatttatacagttatgaggaccatccaccaaagcagtccagagttagaggtcatttggtgaagattgatgctgacagtctcaacacattctgggagacacctgtggtattagctgaggaggagaccttacctgcatactccaaataccgcaggaaggatatgactacactagctcaggtgtggagtgtcctctcatactccaagttggcccccacatcacatacttctgacttgatagtggatagagctaggctgatctttggcctagtctctcgcttggatatgaacataggagcgatgatctctggccatattacctctatagcccagtctaacacttctagacttgggaagaacagttggaaccccgaggatctaacagtttctatccgaggggctaggagggcgagggcaaggccaactgagcttccttctacttttgcagctcctactccagcagtcccttctgtcccagctcagacagattctctgcgctttgaagccatgctccagagcattcatcggggacaaatcattctattacaga

SEQ ID NO: 62443 - DNA, 417 bp, Glycine max
  Peptide Sequence Number=SeqID_179221
atggcgataaccgaagcccaagaagtcaaagctgcagctcccagcctgcacttgcacctgcacccctaccactggagctcctgctcctacaccgtagcctacatgcctgctccgcaagcctccagtcaaaccagtggtttcacaaccactggctgtgtcgccagtggaagtggcgagatgtcacgttacgtgaaaaagagcaccatgccagaattagttctaaaagggccccttttgggtaatttgcctggtgactacccctttgatgtccccccttatttagatcgttggaaagtaggattcaaggtcgatatgtttggttttgatttcaacaatggacctatttacaacattgatgatgagtcctttatcaatgctatgttgtactattttaagccctcattttccaacagataa

SEQ ID NO: 62444 - DNA, 1305 bp, Glycine max
  Peptide Sequence Number=SeqID_179222
atggctgagaagacaaagaaaagactggaagaagttgcccagtctagaagcactgagggcatcattgaccctccatctcccatcagacgccacgtgaaatggaagatggctcgcacgaagaaaactggacagatgacgtctgaggcagcaaaggaaatagctgacaggattgaaagcgtcatagggatcgttcgtcccccatggacgtcaggatatcctgactgctgccattgggcgaccagagcaccctggccatgttcgtgttgttggagccgacctagaacaactgacccaatcacagaaaaagtgactcgaaagatgatggcatccttcagacagatgcagtaccagtttcagtctcagatgcaatcacagggacttgcactaccttcagagccagaggttggtccctcaggtcctcgtgtcagcacaaaggagagttgtgttgctccctcagggaacgatccagggacgggtcactcagccaaatacgggctatacattgaagaaaatccttccagcctggttgccctaggaagactttatgagggatccacaacagttcacaacatccctttgttgcatggccaagtcaaggttggtgttgaggaggttaaagatgcagaggctctcgttcctgtacccactgacgaagttaccttagtagggcaggcgcttaacaccttccttgcttggccaacacatcttgtgaagcgtttatcagaacatgcagctgtgtctccagcaaaacctctagaaagcccggatgaagtggtcgatgatcccctgtacctgatgacattgatcatcccacaactgtttttgaagcctctccaggttatgtgggatgctaccatattcggggtgtttaatcaaaatttcccattgtatataaagcacgaagatctctctgaaattgcacacggtggtcaatgtctcagcatatctgttatacagttgtggattcttcatctgattgagacaagtgtgcgagcggggaattccgatgtgtatgaattcctcgagccacagtccaatcagagatctaggcaatcacaatttgaatccgaaagttacatcaagagttggatacagagttcaaaacgagatgtttaccttggagcctacctgaatgggtcagacaactaccttaagggaataattaacagtgctttgaaaggacttgatgatgctccacaaccgaaatcaaaggctgctgctaggtggattgttgttaagaccattggaagcagagagattcaaggcgtttcgcatccagtggacacagtattatctaaaagttag

SEQ ID NO: 62445 - DNA, 207 bp, Glycine max
  Peptide Sequence Number=SeqID_179223
atggatctcatcacaatacttgtcatgaaaaaactcgtcgcccttaaaggatcttacagttgtgggattgtacagttcatagctcacaaatcaatgcacacatctcaaaacatgtgttacatgggagctttgggagaagaaggagtggagtgcgatgccaacaatggaggcaggcttggtggatttgacgttgagttggtgttctaa

SEQ ID NO: 62446 - DNA, 759 bp, Glycine max
  Peptide Sequence Number=SeqID_179224
atggcaaatcaatgctatcttgcaaatgttaatagaaaagcaatagcagaaaaggccataaagaagatgggagaggcaaaagcagcaaagaaggtcgctaccattgaggaagttattatagaatctctgaaaacctcgacaagggaagatgagttgagaaatgaatctgatattgagcaagtacttgatgaggtggtgcttgaagttgtaaaagttgtgtctgaagaggaattgcagaaggctgagttgaatgcaagaatgcatttagctttggaaacagtctcattgcaagtgtctgatgttgctactgatttagacactattgaaatagaccttggggttatacctttataccattgcacattcataactatagatgaagttgttgttgatgctctgcttgctcaacctatattagaaggggacatctcaagattggagaacatctatggagccactaatatggtcaagttatggaaagaaggtgtgttagggattgatcctttctcatgttcatcttctaagaccttgaatccctctcctccaaacctcaacaggatcatcttcgaacacagaccaactgacataaaggtctatcctctaggagctacactttgggcaagaatagaggttgcatatgatgaaatgcctttctatactcctctagacctacaacgacttcttggtttgatggctacatttaacgcttctcagattgagagttctatgattatggctcacagatatgtctgtgcttaa

SEQ ID NO: 62447 - DNA, 670 bp, Glycine max
  Peptide Sequence Number=SeqID_179225
atgttgaaaccatgcttgaaacaacaagatcaaatgtcagttctggaattgtacatagaaaaggatgtggctggtgatgatgatgatgattatcttgtgtctaactcatacgtggaaaagtctttagacaaagatgatagtattgacgatatatctgatacagacgatgaagtcaccgacatgattcaaccagtaagaattgttcacccagcacaaggtgtacaaggaattcaaaatcaattttggaatgatgctttgcattataataatatcaactggagtaatcctgatgaggaggacatttgtggtttggagatgccatcgagttttaatgttggccaagaattatatgttggcatgaattttgatagtaaagatgctgtcaagaatgcagtcaaacaatatgttatgaaggtgcaccaaagtttcaaagtggttgaaagcaaattgaacaagtattctgcgcttcactatccatgttcacacattattgcagcttgtggttttgtgagcatgaactactaccaatatatagatgttgtttacacaaatgagcacatattaaaagcttactccacacaatggtggcctcttgggaatgaagcggctattcctccttttgatgacgcatggacacttatccctgacccaactacaattcgtgcgaaag

SEQ ID NO: 62448 - DNA, 183 bp, Glycine max
  Peptide Sequence Number=SeqID_179226
atggtgaggctggtttgggttgggaaggttcaaggttttgaagagggtgaggtgatggtggtgaaggtgctgctaatagttgggtctagaaagtttgattctgatgtccccatcttcacaaaggttgcctcatttagttgggtggctccagatgatgctctatcaaagaaacctccactctag

SEQ ID NO: 62449 - DNA, 4950 bp, Glycine max
  Peptide Sequence Number=SeqID_179227
atgaatgcagaggataataagtatgctgaaggagtgagtccatcacttgaattcatcataacttcaaaggacataacagctactggtgcatcagccacattgctaattttcaacaatgaaaagggtttctctcgcgaaaacattgaatctatctgcagtgttggacggtccacgaagaaaggcaacaggagtagtggttacattggcgaaaaaggaattggtttcaagagtgtatttttgcttactgcttatccttacatatttagcaacggatatcagatacggttcagtgagaaaccttgtccacactgtgacattggatatatagttcctgagtgggttgagcaaaagccaacccttcatgacataaagcagatatatggtgctggtgctggttctcttccaactaccacaattatcttacctctaaagccagacaaggtcaaacctgtgaagcatcagctctcaaatattcatcctgaagttctgttgttcctttcaaaaatcagacacctgtctgtaagggaagataatgaggatccaaagctgaatagtgtgaatgctgtatccatttcgagcgagattaacttttgcacaaggaaaaacatgaatgctgagtcctacacacttcatctgtcggccgcggaaaatggtggttctgaaaaggaatgcagatattatatgtggaagcaaaagtttcctgtcaggttcgaaaatgtggtggaaaggagagaggatgtggaggaattgatagtaacattagccttcccaaatcaggagaggcttcataggggaaagagcttaccaggagtctatgcatttcttcctacggaaatggtaactaattttcccttcataatccaagcagattttgttctggcttcgtcgagggagacgattctcctcgacagtaagtggaaccaagggatactagaatgtgttccatcagcttttatggatgcattcaaaacgcttgttttaggatcagatcaagctccaatatcctgtttgccacccgtgttcaggttccttcccatcgatagttctccttttgaaaagttaaattatgtgagggagaaaatcaaagaaaaaatgcttggagaaagcattattcctattgagacatacggggagcagaagcacttctataagccttgtgaagttagcaggctactgcccgaattctgggacattttggctgaggctcaggcggaaagagtatacttgcataacctgtcatctcacaatggaaggaaaatcttgagttcttcatttgataaaattgagtatgatgacattctcagttttttagggatacaacaagtcaacactgattggtatgcgaagtgcatccagagttctaatcttgtggatggagtgtcagaagttgtttatctgaatcttttactgtttattgctacaaattggtcaagttttaaaagctccaaagtgacggacattccattaatcaaatatgtggattcagatgggaacctgtcccatttcactcttgatcaatgcagcaaccgttatggtgccaagcaagtagtcctcgcagatccaagtcagccgagtctttgctcttggctgattgattggaatagcgaattttcatgcaaaacctcccgattttttatgccggaagtcacacagcaagctatcttgcattcgctcagcaggcatactttgttggaatggctagaaaatcaagttcatgttactactttggatgtgaactattttgcacaagtcctttgtagttgtataaaaaaagactccaagcttgccattaaatatgctcatttcttatatcagtctttctcaaagttatatttatcaagccgtgaggttcataatttgtgtagttccatgccacttttggacagctatggacatgtgattgaatgcacttgtagaaaaggggtccttgtacctgcaaatgtgagcaaatgggcagacttgattgtttttaatccatggagaaatgaagattatgttgagctgggaaaggagtacttgcaccgatctcgtaatgcaggccaatatacaggttctgggaagctcatagaattcctcaaaaatcatgttgatgcttctgatattcctcacatatatcctccaaatgctggattttctgctgtagatacaccacttaccaaagacaatgcttttttgcttttggattggattcgaaacctgaagtataggggtgtgaatctaccagagaggttcttgaaatgcataaaggaaggaagctggcttaaagttacagtcaatggatggagaccaccatcaaagtcattcttaattggctcatcattgggaagaattttgcaaagtggttctgttcttgttgacattccactgattgatgagagcttctatgggagtcgaataaatcagtacaaggatgagttgaaaacaattggggtgatgttcagttgtgaagaagcatgtgaattcattggaagagaactaatgtctcgtgcagtgtctttcactttaagcaggaatcatattcttttgatgcttgaattcatcgaatatctgaggcaaaattatctccctttggaccaatttgtcaacagcatcaaagagggaagttggctaaggacttctcatggtctcaggtctccaacaggatctgtattgtatgattcaggatggaaagttgcatcaaaaattagtgttatacctttcattgataaggattattatggtgaggatatatgtaaatttaaagaggtgcttgagttgctgggtgtgatagttggcttcaatgaaaactaccaagttgtcattgaccatttaaaatcgtcctcggagttggccaatttgacagccgatgctcttcttttaacgatgaaatgtataagattctcacaaggatctagcgaactcgtagattcactcaagataacaagctgcttgaagacaaacatgggtttcaaaacaccaagtgaatgtttcttctatgatcctgtatggggctgcattttggaggtattcagtggtcttcctgtgatagatcataaattctatggaaagcaaattttcacttacaaagatgaattgaagcaaataggggctgtggttgactttgaggaggctatagaaaaaattgctgatctcttcaaacagaaggcatcacaaactttgtttaaccgacatcatgttaaatcgtttctttcttgttgtaggcttctgaagggaactgaataccaattcccttccagtttctcaaagatcatacatgaacagaagtggttacaaactggggttggtggttataggtgtccaagaaaatgcattttagatggtccagagtggaaacctatctcctcaataactagtctccctttcattgatgacagtgaaaattgctatggtaagggaatacatgaatacaaggaagaactgaagagcattggtgttgttactgaagtgaaagatggggtgaagtttgtgcctgaatgtttgaattttccttctgatccctccaccatttctcctgaaagtgtgttttctttgcttgaatgcatccgtctcctcatgcacggggttgttccccccattgaagatggcttcaaaaaaagattgtctcaaaattggttgaaaactcattctggttataggtctccaggtaagtgtttgttgtttgattccaagtggaataagcacctcaagccaactgatgggcctttcattgatgagaaattttatggacctgaaattgcttcttacaagaaagaactcaatgcaattggagtcacaattgacgtcggggaagggtgcctcttggttgctagtcaccttgactttctctctgattatgacaccattgagcgaatatataggtacttgagtgaacaccactggaaacccgagcctgatgataaagctgccagaaagatttggattccaggaagtgcaaagtgggtctattctgaaaaatgtgtcatacacgaccaggataatctttttggttcaaagttttatgttttgggagatatgtatgataagaagattcttccatttttctcctttgccatggaagtccggaacaagccctccattgatgattatgtcaatctttggaatgattgggagagttcagtggaacaattgtcatatgacaagtgctataagttctggatgtttatgttgaaacatttcagcacagaaactaagaaactttccaattgcttggtgaagctaccggcaacatcaggcaacaatgaaatagttttgttagataaaaacgatgttttcattcctgataaccttcatctgaagaagctttttcagcaggagaaagtctttgtctggtatcctcagaacctggcaccattgtccaggtgtgagttgtttgacgtgtacaggaaaattggtgctcgaaatatctctgaatctatatgcatggaagagccgtccttgctcaatggtgttgaactcaagcaagttgatcctggtaatatttgtaatgtgaaggtgttggctaagcttattcttagttttctttcttcttctagcctaaaaatggaaccaaacaagaggcgtgaagctgttcaaggtctactcaacttgagtttctttgagacaaaggaagcagtcaatgtaagttacagtttgtcactatcatccggggccatcattaccaaaaaggcagacagaatggtacggtggcaagggcaaagttccaagtttttcactcaaacgaactggcaaagtggaaatgcaagtttaataaaatatgctacatatttctcagaagccatctcagagggtgttttgcgtgagaatcatgatcatgttcctgcactctctgagctcatcacattggcttttgtgctgaaattcaacaatgagacaattgaatttcttatggagtccaagaacttgcactgtgaggatgaggagttcctcagttctgccttcccttctaactaa

SEQ ID NO: 62450 - DNA, 170 bp, Glycine max
  Peptide Sequence Number=SeqID_179228
gtggtgagtattacggaagatatgatgaaactatgcaacacctaggtccatttgctaaatttcttcagaaacatggcatttgtgcgcaatacaaaatgcctgggcattggatagaagactctaagaagattgggccagagatgcaagagaaggccctagggttctcatga

SEQ ID NO: 62451 - DNA, 1317 bp, Glycine max
  Peptide Sequence Number=SeqID_179229
atgaaaagggtttctcccccagaaacattgaatatatatgcagtgttggactgtccacaaagaaaggcaaaaggagcagtggttacaagggcgacaaagatactcttcaatgagaagccttgtccacattgtggtattgagtatatagttcctaaatgggttgaggagaggccaacccttcaagacataaagcagatatatgatgctggtgatgatttggttccgactacaacaattgtctttcctctgaaaccggataaggtcaatcctgtgaaacagcagctctcaaactttcatccggaagttctcttgtttcttgcaaagatcagacacctttctcaaaagtttcctatcaggtttgaaaatgaggtggaaaggagaatggatgtggaggagtggattgttacattagcctttccaaatcaggagaggcttcataggggaaggagctcacctgggatctatgcatttcttcctacacggatggttacttatttcccgttcataattcaagcagattttgtcctagtctcttcaagggagacagttatcttggatgataagtggaaccatggaatactggagtgtgttccctcagcttttgtagatgcattcaaaacacttgtcagagggctactgcctgaattctggggtatttcgagagaggctcagacaggagtatacttgcataacctatcatctcacgatggaaggaaaattttgagttcttcattggatacaaggcagtatggcatactgaattttttaggggtacaaaaggtcagatttgattggtatgcaaaatgcattgagagttccaatcttgtgagcagagaatccgaaaaggtctatctgaagcttttactatttgttgctacaatttggggatggattgtctatgattgcaccaaaggtgccaagcgcaagcatttggttctagcagatcctgaccaccatactttgttggggaggctaggaaatcaagttaaagttactacatcgaatgtgtacacttttgctagtgttctttgcagttctgagattgatacattgtgtaggtctatgccacttttggacaactttggctgtgtgcgtaaattgagaaaaggggttcttatgcttgcaagtgtaagcaaatgggcaagcttcattgtttctaatccgtggaggagtgaagattatgttgagctgggaaaagagtacttgcacccatcttgttatgcagggcaatctactgactatgagaagctcatcaaattcttgacagattgtgacattctttatcccaacatgcatataaatggaaaaaatgtataa

SEQ ID NO: 62452 - DNA, 1434 bp, Glycine max
  Peptide Sequence Number=SeqID_179230
atgacattcccgcctcaaaacaaatttggaatacagagttcaataaaacaatcaatcatagaacagaagctagaaggatggacactttctcaggcaatggaacatggaagaatattcatgttggaccaccatgactttctcattccatatttaaacagaataaatgcaaatggggtatgtgcttatgcatccaggactcttctattcttaaggagtgatggcatgcttaaaccattgacaatagaacttagcttgccaggccaatctcctcaccttgaaatccacagagtttttcttccagccaagcagggaacacaagcagcactttggcagctggctaaagctcatgttttagctaatgatgctgtttaccatcaactaattagccattggttatacacccatgcagttgttgaaccatttatcattgccaccaaaagaaggctaagtgttatgcatccaatccatcgattgttgaatcctcatttcaaagacaccatgcacataaatgccttggcaagactgatccttataaactcaggaggaattttcgagagaatattatttcctggtgaaatctgtatgcagatatcatgtgacctctataaagagtggagattcaatgaacaaggacttcctgccgatctactcaaaaggggtatggctgtaaaagatccagacaaaaataaccccactaggattcagcttctattgctggactatccctatgccactgatggacttgaaatatgggtagccatcaaagaatgggtcaaagacttctgctcattcttctacaaagacaatgaggccattgagggtgatgttgaactacaagcctggtggtcagagattagaacacaaggccatggtgacaaatacaatgacatatggtggtaccaaatgacaacactctcaaaccttgtggagtcacttacaaccctcatatggattgcttctgccaagcatgcatctctaaactatggccaatatgcatacaatggtttccctccaaaccgccccatgctatgccgaaagtttgtgcctctagaagggacagtggagtttggtgagttcctcaaggacccagataagtttttcctcaagatgctaccagacaggtttgagatgagtcttgcagcagcattggtggatgtgctctcaaggcacacttgtgatgaagtctacttggggtgccagcaatcaccagggtggatagacaatgaagtgattcagaataggtttgctgaattcaaacaagaactaaaagagattcagacaaggatcatgcaaaggaatagggaccctaagcttaagaataggcgtggccctgcaaacattgagtacactcttttgtaccctgatacatctagttcttctgcctcagctagtggaatcactggaagggggataccaaatagcatatcaatttga

SEQ ID NO: 62453 - DNA, 861 bp, Glycine max
  Peptide Sequence Number=SeqID_179231
atgacgtctgaggcagcaaaggaaattgctacaaagattgcgtcacagggttcctttgtcccccatggacgtcaggatctcctgactactgccattgggcgaccagaacaccttggctgtgtgcgtgctactgaagtcggtgtgaccggaccagctggaggagtcgattacataaaaagtgactcggcaactgatgttatccttcatccagatgcaatcctagggagttgtgttgatccctcagtgaccgatctagacacgggtgactcagacaaatgcgggttgtacatcaaagaaaatccttcccgcctggttacccttggaagagtttatgagggatccactgccgttcacaacatccctttgttgcatggccaagtgaaggttggtgttgaggaggttgaagatgtagatgctcccgttcctgtacccactgacgagattaacttagtgggacagacacttaacaccttccttgcttggtcgacgcatctcgttatgtgggatgctatcgtgttcggggtgtttaatcaagacttccccttgcacataaagcatgaagatctatctaaaatagcacacggtggtcaatgtctcaatatctttgttatacagttgtggatactgcatctgattgagacaagtatgcgagcagggaattctaatgtgtatggattcctcgaaccacatgctttgaaagaacttgatgatactccacaacctaaatccaaggctggtgctaggtggattgttgttgaaggttacatggttggaaatggtgtcacagatgaacaaattgatggcaatgctcttgttccatttgtacatgggatgagacttatcccagacgaactatttgag

SEQ ID NO: 62454 - DNA, 276 bp, Glycine max
  Peptide Sequence Number=SeqID_179232
atggcaaaggcgacggtggtggcggggactagtggcaaggtgcaaatggtggtacgaacgtcggtggcacggcgagaattagcgaagaaggaagaagagggaagcgtattagcaacggatcgcaagccctattttgctcgcgctgtgttcttttccatcgaaggcttttctttttcgcaattgttcttcttcatcgaagtggtcattgcgaggttagtttggggcgctaagtttgcagtccgtttagacagctcacagggtctcacaacaagttag

SEQ ID NO: 62455 - DNA, 294 bp, Glycine max
  Peptide Sequence Number=SeqID_179233
atggatccaactcaaaaaaatatgtgcaaatcggaaggcatgcctgcatctataatgcctgcggagccttcaacgctagaacatggtcctggaaattggagggtagttcctaccaaaatagggttgtcaagatgcagcaagagttacagacttagatcgactaattacctgaggccaggaatcaaacggggcaacatcatagaacaagaggagaagatgataatccatcttcaagatcttttaggaaacatgtacaaatcaatcttccaagcacctacttattttgagttttga

SEQ ID NO: 62456 - DNA, 1413 bp, Glycine max
  Peptide Sequence Number=SeqID_179234
atggcttcttctgcagctagttacactgcagtacctgaaacagaaccccggattgaacacataattaacatcaatcctaaagacattgaacctgcatggcatgatgtgtgctgcatttacaaggttcctcctaatctcaaaaatttgaaggttgaagcctatgcaccacttttgatctcaataggcccttttcatcacaacaaaccagaactagagccaatgcacaaacagaagcaaaggtattttctttccttctgggaacgtgtcacaaacaaaaaggctttggccaaatacaaagccttcctcaatgaaaacatcgaagcaacgatacgccaaaggtattcagagccgattactagcttcagcaatgatcagtttgtggaaatgatcctcttagactcggtcttcattttggagctgtttttgagaaaatcagaaaaatctaagcaagaaaaggattacatgttcaccacaccatggatttacaagggtatacaaagagacctcttgctacttgaaaatcaacttccaatttttgtcttggatgagttacatagaagggtttgtaagcaaaatggtgttagctttcttgagcttgcatttaactactttgaagattattatccttatccacacaaatcaacaacaacaagtgattatgatcaaactaaagagatggtcaagaagaacttcaaatcttgtaaccacttcactgatttgataaggcttttctacctcccagaaagggttcatgtcaaggagtggatgccatcaaaacatttcaccccttgtggtaaaaatgaatgtgtacttaagactgcagcaaagttgaatgaggcaggggttagctttgagaaattgcaccaccacaagtgcttgttagacataaagttcaagatggttcctgttttgagctggtttctatgcttaggttgcataccatgctctatgtgtgtcaaagctcgtttgcaaattcctcagttgaaagtgctccaaacaacagaatgtgtcctaaggaacctcattgccttggagcagtgtcactattcagaccaacctttcatatgcaactatgtttctctaattgactctttgattcacactcaagaggatgtggagttgttggttgacaaagaaatcattgtgcatgaacttggctgccacaatgaattggcaactatgataaatggtctttgcaagcatgttgtggtgaattgcaattattatggcaaaacatcaaggaaactcaatgatcactacaattgttgttggaaacattatatgggtatgttgaggtcagtgtacttccgtgacccttggagactcagctcaactgttgtaggagttgttatcttcttgtttgctattgtcaactttcttcgagttaccaatttatatcatccaaaagactga

SEQ ID NO: 62457 - DNA, 978 bp, Glycine max
  Peptide Sequence Number=SeqID_179235
atggagagccagagttacttcaaggctttgattattattcttatagcactaattggatcaactcaagctcagttgcagcttggtttctatgccaaaagctgtccaaaggctgagaaaataattttgaagtatgttgttgagcatatccgaaatgctccatcactagcagctgctctcataagaatgcacttccacgattgttttgtcaatggttgtgatggatcagtgcttgtgaactcaacacaaggcaatcaagctgaaaaggattctcctccaaatcttactcttcgaggctttggcttcattgacacaataaagagtgttgttgaagctgaatgccctggtgtagtctcttgcgctgatatcctggctttgactgccagagactctgttcattccattggtggaccctattggaatgttccaacaggtcgaagggacggggtaatctctaaagcagaagaggcattgcttagcttgcctgctccatttcacaacctcactaccctcctaacactctttggcaatgttggacttgatgtaaacgaccttgtcttgctttctggtgctcaaactattggtgtttctcattgttcttcaattgcaacccgtttatacaattttacgggtaagggtgacactgatccaactctggataatgaatatgcaaaaaatcttaagacctttaagtgcaagaacatcaatgacaacactacacttattgagatggacccgggaagtcggaacacatttgatcttggttattttaaacaagtggttaagagaaggggtttgtttcaatcagatgctgcattgcttgaaagttctaccacaagagctattattgccagacaacttcaatcaactcaaggattttttgcagaatttgccaagtccatggaaaaaatgggacgaattaatgtcaagactggaacagaaggagaaataaggaaacaatgtgcacgagtaaatagctaa

SEQ ID NO: 62458 - DNA, 288 bp, Glycine max
  Peptide Sequence Number=SeqID_179236
atgtcaattgatccctttgctgatgcaaatgctgaggactcaggtgctgggacgaaagagtatgttcatgttcgtgtacaacagcgcaacggaaggaaaagcctaacaactgttcaaggtttaaagaaagagtacagctatagcaagatactcaaggacctcaagaaagaattctgctgtaatggtactgttgtccaagaccctgagttgggccaggagcctgaaataacatgctatcgctatttgccattcagtgaacttttttgctctcccaatacccgggaataa

SEQ ID NO: 62459 - DNA, 327 bp, Glycine max
  Peptide Sequence Number=SeqID_179237
atgactgttgaggttgtggctcaagaggagacacaagcagatgaggttttttgcaacgaaaatacaatatctcaaaccaccacacccaactcttcgtgcaacgaggccggtgttacatctgtgaacaatgtcaccgcaacgacctttgagttctcaaaagttcaaaaactcacaaactcactcacaaggaagcgcaagaagttttggtgtgaaggtgtcaaggtgttgcgaaacctagtgtcactcagaaactcactcacgaggaagctagcgcaggaagttttcgttcaaactcacgaaaaaacaagtgaggaaactagcatatga

SEQ ID NO: 62460 - DNA, 1518 bp, Glycine max
  Peptide Sequence Number=SeqID_179238
atggaacctgctactaataacaatccttctccttctgctcatgcttcattacatgaaaccaaatatattgagagggtgaaacatgccctgatcgactttggagtcccagaagagctaaggttgtctgatcgtagcatctacaaggttccttgctatctccgaaaggtgaaggaagatgcctacactcctcagtgcatctcaataggtccaattcacttcaaaaaagaagaactcaagccaatgcaagagcataagctaagatactaccaattcttcgggagacgtgttggtgtctcagacgaacaaatggaggcatacaaacactaccttgagaccgaagaaaagcagattcgacaatgctatgcagagaaattccttgacataaccaaagatacattcgtggacatgatgctgctggacgccgtattcatcatggaacttatgttgagaaactgcgagttcaaatcacacaaagccaagcatgagcaaaaccacaagcgaaccgaatcctttagaattaaaaacaacaatgatctgatcatgacacactcatggcttagcaggaacatcgctggggacttgatccttatagagaaccaaatacccttttttgtgctgcagaaactctatgatgatgttgtccctcgtgaaagcaagaaggatgaacacactgcggggtttgttaagcttgctactgagtactttgctttctatgacacccaaatgtcttcttctggtgaaaccaagaaacactgttcctgttacatactccactgtctgaaggaaccttgtaagtcaaaaggaaaagataggagtgagatttcgaaacgtcctctaggaagcaattctgaagagaatccagaaggaccaaaacatttcactgatctgataaggtggcaattttaccttcccaccgagtgtgaagccggtcatgctcatcaggttctaagaactgcaacaaagttacaaggctcagggataagctttgagaaaggtgatgtgaacaagcggttactggaaatagccttcaagaagaccccaattctgagttcatttctttgctttggttgctttccattgtcgaagctcttcaaagcgcgtttgaggattccccaattgaaggtagaccacacaactgaacgtgtgttcaagaacctcgttgcttttgagcagtttcactatccagacaagccttacttttgcaactatgtttctttcattgactctctgatacacactcagcttgatgtggagttgctggttgagaaggaagtgattgtgcatgaacttgggagtgataaggaagtggcaactcttgttaatggtttatgcaaacatgttgtcacaaactcaacttgttaccatcacattataaataagctcaacgaccattacatgaacgattggaaccacactattgcggctttaaggttggtgtacttcagagatctttggagggcaagtggcactgtggtgggtattgctgtgctggtttttgctgtcttccaattcctccgt

SEQ ID NO: 62461 - DNA, 342 bp, Glycine max
  Peptide Sequence Number=SeqID_179239
atgcactacatcgttgttcgcattctattacccagatcatcaaacttagctcaagcctctgaagaggatttaatcttgatgtgggattttctcaccggtcatccgatcgatttggcccatttgatcagataccacatgcataaggcattgcagtcaaatgcacctctgccttatccacagcttgttactttatttcttcatcattttcagattcccttggataataagccctttgtgaaagttaaatgctcctttgctattggtgtcggtgtggtaacctcctttggctaccgtaaggacatggatgggcaatggttgaagaaggacgcgcaacctccataa

SEQ ID NO: 62462 - DNA, 453 bp, Glycine max
  Peptide Sequence Number=SeqID_179240
atggcactatgtttcatggctattgaaggtgtgcaacttacaattcctgaaaatgctccagttgaaggtatttttccagatttaagtgcaataaaactgaacttccttagtagtagtgctgagtttctaccaatctcattttttccacgtgtgacaaagacatttcttcattctttcttggaccctacaaaagctttgcctcaacactatggttcaattaaagggatagaagctcttggatcaagactggcctgtagattgttagaaatgaagaggcatgaagcttggcaagtttatggggctttgttgggaatatggctgggaatgctaggtggcaccgttatgcaaacagttattctattgtgggtcacatttagaacggattggactaaggaggttcctttatcatttgatctagccatcgaaaacacgaggtatggctacccaatttga

SEQ ID NO: 62463 - DNA, 805 bp, Glycine max
  Peptide Sequence Number=SeqID_179241
cccgtggccctcgcttagcgtgcgtaaaggattctgcatctttgagcttaacgcctcgcttagcgcctatactgccttgcgagcttagcacgaaggaactggaaaaaatcttaagaggaagtttgcaaagccctattcccggtatgggttcaaaggtatttgagaacttagatgctagtgaccttgtgaggatgatgttaaaacttgaactctgttatgagcaagacccatcagatccatattctctgctattgattccctcaattcttgaagaaggaagaggaaagccttggaagtggcagctaagcatgcaagattgtgtttatgcgggatgtcatcttgagtgtgatgattcaagccacatgtttctaactccaggattcttctctggtttacagtttgacggccacttcacaattacaagacgaaagtatgaatttggaccttcggtcaactacagagatggagggaatagatcattaagagccaaggatgactctacaactaatgaaccaggggatggtaattgtgatgaaggtgatgctcaggacgatgaaactgtaaccccagatgaaataggtgatggagaaaatgctgatgagctaactttggacaaagacgcaacatattcacattgcattgggttcaagcctgatgtgctggatcaaacttcttacacgaatatggatttggacgtacataaagatgcaactctcatggaagatggagaactgaatgagcaagttcaattagctcagaacagaaatgaagggaatcaacatgaagagactgctctattgatgaa

SEQ ID NO: 62464 - DNA, 375 bp, Glycine max
  Peptide Sequence Number=SeqID_179242
atggtttgtcggcaagtggtggtggttggtgtggctgttaaaggtggaggcaagatggatgaagatcaatggatgtataacaacataatgtctgaagaagttgatatgaatgaagaaaatgaagaggaacctgttagacatccatatgttggtcgactgactaaggatgagaagattattgttggtgatatgacaaagtcaatggtcaaaccaagaaatattcttctaatattgaaggggcacaatgtcaatagttatacaacaatcaagcaaatatacaatgcaagatatgcatatcgttcttccataagagacagtaatactgaaatgcaacaactaatgaagcttcttaaatgggatcaatatattcattag

SEQ ID NO: 62465 - DNA, 477 bp, Glycine max
  Peptide Sequence Number=SeqID_179243
atgatggatgaagatcaatggatgtataatagtataatgtctgaagaagttgatatgaatgatgaaaatgaagaggaagctggtgtgaatgaagaaaaacatgttgattgttctaaggcattcaatacttctcatgagtggtcagagtataggtctaggaagaaaggatttgttagaagagatactagcagaaggaaatgtgggtgtcccttcaaggttcatgggaaaccagtggttagagggcaagttggacatccatacgctggtcaattgactaaggataaaaagataattattgctgatatgacaagatcaatggtgaaaccaagaaacattcttctaatgttgaaggagcacaatgtcaatagttgtacaacaatcaaacaaatatacaatgcaagaagtgcataccgttcttccattagaggcagtgatactgaaatgcaacatctgatgaagcttcttgcacgggattag

SEQ ID NO: 62466 - DNA, 972 bp, Glycine max
  Peptide Sequence Number=SeqID_179244
atgaagataaaaactttcaaggatgaggatacaaggatttcaatatggaaccttgctggtcagcatgagtttttatccctccatgatcttatgttcccagggcatggaagtgcatcatttttcatcatcatatcaagtttattcagaaaaccaagcaacaaagaaccaaaaagttcaactgaaattgaaggagacttgcaatattggctcaggttcatagtttccaactctaaaagggcaatacaacaatgcatgctaccaagtgttgctgttgtactcgcacattttgataaaatcaaccaaccatcaccaaatttgcagcacatagtagattcaattcagagattgagagacaagttccaaggttatgttgaattctacccaattgtattcacagttgatgcaagatcatcagcatcagttaactggagatctgagaactacaacaagccagcaatgaagtggaaggagtttggtgagctatgccaagttaaagtcccgtcgttgagaattcgatcaagaaatgataataaagagagggtggaaatgaagagaagagctattgctacctgtcttcatcacattggtgaggtggtttactttgatgagttggggtttctaattttagattgtgagtggttctgtggtgaggcacttggtcagctgataaagttgaatgttaggaagcgacacttgttgagactttggcaagtgtaccaaatcgctctaagtagtaaacctcggaagtccgagtatcgtttccacagggattttattgcactttaccgaatacttttcaatttgcaagggattagccactcatggccattgagggctttacaactaggggtgaaagaaagaatggggcgtgtgtttctgttggattacgcccttagcgcgtggccctcgcttagcgtgcgtaacggattctgcatcttcgagcttaacgcctgtactgccttgcgcgcttag

SEQ ID NO: 62467 - DNA, 744 bp, Glycine max
  Peptide Sequence Number=SeqID_179245
atggagtatgaaatttcccgtacttttggtcatttatattatgcttggtcattgggcaatttgaatacactctgctgggcaattggttctatatcaggtcccatgatggaagaacagggctatcatggggacacatcagcaactttctattgtggagatgttgatgatatagctaaaaaactagttcaggagattgaacgtggtgaaaaaggaattggagatggcacagttaactatggaatggatgatggtgatgacatttacatgcgctcttggactattggcccccataatgctgtacatgaaggaagaatttatcaactgaagttgttttgtgataaagactacccagaaaagtcccctagtgttcggtttcattcacggatcaacatgactggtgttaatcatgaaacagaagtggaaatggccgctcctcataaccggaagcttgtccaacctccagaaggtacctacttttaccatccaagattgtatacacgttggatcgaattgcaatggccgctcctcataaccggtgaggtactaggacaaagggaaggccttgtatttgagaacaagatgagtgaccctcttgggtttgtcgtgaggtttgctgcagctagtgttgctaacagggcttgcatgtgctatccaaggttattctcggatggccttgggaagagcctaagttatggtagtggatatgagttggtgtttgtgttgttggatttagggttgagttag

SEQ ID NO: 62468 - DNA, 496 bp, Glycine max
  Peptide Sequence Number=SeqID_179246
atggacgaagatcagtggatgtatgaacgtataatgcctgaagaagtggatatggatgatgaaaatgaagaagaatgtggtgtgaatgaaccacatgttgattgttcggatgcattcaatacttctcaggtgtttgatagtcaagagtatgttttgcggtgggctcgatctgttgcttatgaaaatggatttgtggcgatgattgtaaggaagaaaggatttgttagaagagacactgagactaggaaatgtaggtgtcccttcaagcttcatggcaagcctgtggttggaggacaaggtaaagctgaaaagacacttattgctgatatgacgaagtcaattgtcaaaccaagaagcattctattgatcctgaaggagcacaatgtgaatagttacagtacctacaaaacaaacagatacagactcccactgctcgattttgttggggtgacaccaactgggatgatattctctgtcggttttgcatatatggagg

SEQ ID NO: 62469 - DNA, 168 bp, Glycine max
  Peptide Sequence Number=SeqID_179247
atgcttaggtttaacattgctcgtgagtttgcttgtgagttcacgcaagaaagtctccttgttgccgtagaaggtgttgatgatgaggctgagaagggatttgattttgctaacaggttgaagacggtattgaagaacctgattcttgtgatgaacaaaaaaaattga

SEQ ID NO: 62470 - DNA, 243 bp, Glycine max
  Peptide Sequence Number=SeqID_179248
atgactactggcaggatcaaccagcaagcgccagggcaagcgtcatccgagacaaccgattttaaggaacaatgtgggggcactagaccacccacgttcactgcatgcaccgcatccgagagaacaatcaccacacgtgtgccacaggaagccgcttatggatggacgactaacgtggttcacgtgtgggactttgaatcctccagcgtccccaacaaagaggcctggatggaatgggtctga

SEQ ID NO: 62471 - DNA, 741 bp, Glycine max
  Peptide Sequence Number=SeqID_179249
atggcatatgacaaagaaatgttagcagaacaatactacacggcataccaattgctgacagatgagcaaaaaactattgtcaataccattatgtctgtggttaacactcaatcagctgcagtttactttctctatggatatggtggaactggcaaaacatttgtttggacaaccttatcatctggtatacgctccaatggtggaattgtttgtacaattgcttcattactattgcctggtggtcggattgcacattccaaatttgctataccagtccctgcaacagaaaattcaacatgcaatattcatcaaggcagtgagttagctgaattattaaaggttacaaaactaatagtctgggataaagctccaatgtgtcacaaatttgcatttgaggcactagataaaagtcttaaagacatcatgcaaaacaatctgccttttggagggaaaattatggtttttgggggagatttcaaacagatcttgccaattgttccaaaaggtatacctaatcataaattaaaacttaaggttggaactccaatcatgctattacgaaatctcgaccagactgatggcctgtgcaatggaactaggctcattatcaccaaactcggatctaatgtgattgaggctgaagtaattactgggtctaattcaggaaataggacatacatacccagaataaatatgtctccttctgaatctccatggccattcaaacttataaggaggtag

SEQ ID NO: 62472 - DNA, 177 bp, Glycine max
  Peptide Sequence Number=SeqID_179250
atgtttgggattcaaaatgttccaaggaaggtggactctcttggctggatggaaatgaagatatgccatgttgctcttccaactagctacatcaattctctatcacaagacgggttactgattctagcacgtgtttgggttgcattagtgctgcggaggaaaccaaaatgctcgtga

SEQ ID NO: 62473 - DNA, 523 bp, Glycine max
  Peptide Sequence Number=SeqID_179251
atggaactagtcgtcaccaaagggggatttcttcaaaacagcgatgacgatctcggcgaggtgttggaggttcttgacggcgtcgaggctgagggtgttggtgttgtggttgtgcgcgacaacagcgagtacggagagcttgccgaaggagaaaaggataaaggtggaagggttgaaaagccacctatgagagagaagattgaatcaagggaaaatggggaaagaaaaaagaatagatacaagaagatgatctcacgacccagatcaatttgtgaccaactactcacagttgttgcacttgcaagacttgttttgctcttgcatgatagaattcgtcaaaaactagaaatagaaagggagcaacaccccgaatttcatgggggagaccagtcagggtcacagtgttttgcgagaatgctccaaccatatgggatcaacataggcttaaaggagcactcaaaccgtgtgacccccaaggcctacactccgaagagtccgtcagggcctctccctcctgattcag

SEQ ID NO: 62474 - DNA, 351 bp, Glycine max
  Peptide Sequence Number=SeqID_179252
atgatgcttttggtgttgcaaataagcaccatgcaaatgaagaacctattgcatcaaatgcatatgttaaacttggatgaagatgtgatgccaaatgtaactcaagaaaggcaagaagctagagagtactatgaattagctagaattagtgacaaggccatgactatgattttagaattattgagagatgcatttgagcatgtaaagattctagggaagatgaagaaagggaaacatgcagaatttgtcacacatcaaaatggaaaaaaaccaaaggcaaaagctggtatgactgaggtgtctagtgaagacaataatgttaagaaaatactagcaaaagttcttcaataa

SEQ ID NO: 62475 - DNA, 729 bp, Glycine max
  Peptide Sequence Number=SeqID_179253
atgaaggcgatgtgggatcttatacaagtgactcatgaaggtactatagaggttagaagatcaagaaaagactctctcatccaagagtatgagacattccggatgcaacaaggagaaactattagagatgtccaaaagagattcactcatatagtaaatcatctcaaaggactcagaatagtgtttgaggaggaagaaacatggcaaccaatggtcactataattttagagtctaaagacctcatccccatcgcacatgttgagttatttggaaaattaaaagaatatgagatggacattactaggatggttgaagaggaagctaaggaaaagaagagcaaatgcttagcattggaatcctccataccatctagtgatgaagaaaatgtagaaggttttgagaatgaaaatctaacattgcttgttagaaaattcaagagattcttgaagaaaaataatcccaaaggaagatcctttcaacaaaagcataactttaagaagaatgactcaacctctccaaaattcacttgttttgaatatggaaaaccaggtcacacgaaatctaaatgctccatctacttgaagaaacaacaaggagaagagaagaaggcaatgagtcaaggcaataagaagaaggaatacatagcatgggaagagaatgcttccaacactacaagtgattctagcaatgaagaagaagcaaacatttgcttcatggttgatggataa

SEQ ID NO: 62476 - DNA, 369 bp, Glycine max
  Peptide Sequence Number=SeqID_179254
atggttgccttcattaggcagtatcagtacaattacgatatggttccagatagaatgcagctacaaaacatgtgtaagagggagcatgaatctttcaaagactacgcccaaaggtggagggatctagaagctcaagtagcacccccaatgatggaaagggaaatgacaacaatgatagtagacacatcacttgtgttctactatgagaagatggtgggatacatgccttcgagttttgtagatctagtgtttgcaggcgagaggatcgaggtaggcctaagaagaggcaaatttgattatgctgcttcaatgaatagaaagcctgaggaaatggagaaaataagaaggagggaggaacccatgctatga

SEQ ID NO: 62477 - DNA, 228 bp, Glycine max
  Peptide Sequence Number=SeqID_179255
atgtttcattctaagtgtgataatggaatattgcttggttattctgaaacttccaaggcttacagagtttacaactctagaaccttactagttgaagaaactatccatgtgaggtttaatgacaatatcagattggaagatacgaaaaatacatcaaacaaagatgagcccaataatgatccaacagtgtatgagtccaatgcgatgaaccaaaagaggaggaaatag

SEQ ID NO: 62478 - DNA, 858 bp, Glycine max
  Peptide Sequence Number=SeqID_179256
atgagtatttgcttttctactagtcagtcctcaataaatgctgttgtcctgaaaggtcgtactccgctgctgatgagcagtaacattcatggcctttggtcccaaggaatatcgacttcaatttcttccagtttgtctcctgggaagtcagagataagtcatgttggtctttctgtttgcacaaaattgtcttgctccactgttatgggccaaacaattagaggaggtttccttggatcatgctgctccaagcaaaggggcaatcctcgattctttagttctgtagtacctcggaagagttctgaacctgctcatgctgagtcacattctgaaaatgaaaataggaaagatgactgcaacgagtatgagtcaaatgttaaagtcttgcatgggaagaaagtttatactgactattctgtaattggaataccaggggatggaagatgcttgttccgctctgttgctcgtggggcctgtttgaggtctggaaagccccctcctaatgaaagcattcagagagagctggcagatgatttacgagccagagttgctgatgagtttatcaaaagaaaggaagagaccgaatggtttgttgaaggtgattttgatacatatgtttcacaaataaggaagcctcatgtgtggggaggtgaacccgaattgttcattgcatcacatgttttgcagatgcctatcacagtatacatgtatgataaagatgctggtggtttgatatcaattgctgagtatggtcaagagtacggcaaagaaaacccaattagagttctctaccatggctttggtcattatgatgcattagagattcctagaaggaagggtcctaagccaagactgtag

SEQ ID NO: 62479 - DNA, 300 bp, Glycine max
  Peptide Sequence Number=SeqID_179257
atgacgaagttgcaaggttcgatgccatcgtctctagtggctgactggtgtagggaaaacgaggagatgacaaagggcagtgaatgtgtttgggttgtggctgcgcagagttattgtgagctaagggaagtgcaaatgtggcgaaggagaacgatcttggggggaaaaagtggcgggtgggaggtggacaacggaggtaggaggccgacagtgaacatgagacccaatagagaagatgatggaagctggacaaagagcaacatgaagggggagataaagcatcatgaaggaagaagttag

SEQ ID NO: 62480 - DNA, 273 bp, Glycine max
  Peptide Sequence Number=SeqID_179258
atggaagatgctctgtttctagcatggtcttggctaaaagctagagagaaagcaccagaggtgccttgtatttttctttcatccagtaccccttgtactgtaaaaaatttaacatgggaagcaacaagaggagttaacttcagaatcggtggcatgcaaaagaatgacaaaggaagagattcaaatcccaaaagggaaaccgttgagaagcagggcgaggaggaaaagcaaacccagaaaaagcacttaagaatcattgatttctttttttaa

SEQ ID NO: 62481 - DNA, 222 bp, Glycine max
  Peptide Sequence Number=SeqID_179259
atggcatctgtgaaagagcaatctgcaatggtacaaaggatagtaaaagtgccaggatctttgctcttctatggcaaggaggatgatggaatggtaaaggaatttgctttggggcagaatgtattttggcactatcatcaattttggcaccaacatttgttgccttcggaagctctctgccactcctcaaggctcagaatgcaaaagaagaagaagcaataa

SEQ ID NO: 62482 - DNA, 279 bp, Glycine max
  Peptide Sequence Number=SeqID_179260
atggagatcataaagacttatgagcatgcttctggacaagccataaacctccagaaatcaaatgtgttttttagcaggaatgtccaacaactagatagaggggagatcttggaggtgcttggtgtgcaagaaggtaatagtaatggaaagtacttgggtctcccagctatcattggtagaagtttatccaaccttttctcgtgcaaattttgtagattaaaagattggtatatgatggaagcaaggtggaagaaatggaaaacatttttggagcaatga

SEQ ID NO: 62483 - DNA, 342 bp, Glycine max
  Peptide Sequence Number=SeqID_179261
atgtccagtgacaagtacaatgtcctcattgttcgtcttaatggaaagaactactctgcatgggcatttcaattcgagattgttgtcacagagaagaaactttggggtcatattgttggaatcgattctgctctagaaaagacacggaaggatgcacatgccaaatgggaggtcaaagacacacaagtcaaggcgtggatccttggctctattgaccctcatatcatcctcggtcttagaccatttaccacaacatccaagatgactattgtcccctcttggatgcttgtctcaatgagctacttcatgaggaacaatatctcctcactcaaacgaccatga

SEQ ID NO: 62484 - DNA, 473 bp, Glycine max
  Peptide Sequence Number=SeqID_179262
ttaaagggttggagccatcgaaatgggccaattgcatctttggtaaaggaaaggggttagggttagggctagtggagcctggtgggacaaaactagtcatgtttggggtggaaaatgctatggtagacattgttgtggacgaggtcatagtaaagatgggggttgtaatagggatcaataagggtagggtgagggaagtagaaatcgggggagtggatgagagaagggaagtcgaagcatctgtaacaattatggtggaaactagggtagggctagtttggatggccaaggagaaagatgagcagtgggcaaagaacatcgcatgctacaatgacaacatagagaaagttcttgctcctattgttgtcattgcttttgcccctaccgttgaggttcttactcctcggtgggttcaggttcctttccctaagggagttcttgctcctattattgctgctactcctgcaccttaa

SEQ ID NO: 62485 - DNA, 357 bp, Glycine max
  Peptide Sequence Number=SeqID_179263
atggatttcatcatggggttaccagcttataagggaaatacttgcatctttgtcgtggttgatcgctttgcaaaaggattacacttaggcatgctccccacacatcacactggccacaccgtagctatgtcgttcatggagatggtaggacaacttcacgggatgccgcgaagcatcatttcagaccgtgatcctctttttatcaataaattttggagagaactcttcaccttaagtggtacaaggctttgcttgagttcagcccatcacccacaatcggatgggcaaactgaagttgctaatcgcatcattgaacagtacttgagggcgtttgttcaccagaaaccatcagcgtag

SEQ ID NO: 62486 - DNA, 924 bp, Glycine max
  Peptide Sequence Number=SeqID_179264
atgactccatttgaagtcacctatggtcggaaaccgcctagctttcctcaatatatcgcaagcacctctaagatagacgccgtcaatgatatcctcaaccagcaagaagcagtgttcgagttactccgtcgcaagctgagtaaggctcaaagtcaaatgaaggaaacaacggataagcaatgtcgcgatcaagagttcgaagtgggagactgggttttggtgaaactcataccacatcgacaaacatcgacgactggttcagcatattctaagttggctaaacggtactatgggcctttccaagtcatggtgtgtatgggcaaggtggcatacaaactgctcttacctgaccattcgcgtatccaccccatttttcactcgtctctccttaaaccatacgtggcgtctacagacccaagagatatcgctgaccttccgccaatggccgttgacaaccaccctgttatcacacccctagccatcttagcatccaagataattccttctgaaacaggcccaaagcgtatggtattggtgcagtgggaagggttggctccggaagacacatcgtgggaagaatggtcagagttcaaatcgcttcaccaccttgaggacaaggtgttgtttgatgggcaggggaatgttacgaagaacattgggggtgtgccattagcaagggagcaacaggaaacaagtaacagtgagggtgtgtcattagcaagacccaggaggaagaaggttgtgcccacctacttggatgattacgttctgaataggtatgaggacatttcagaggtatatcggtatccaacacggtgcaacactggtacgtttccatttttgaagtatgggcacttcatagacgtagttgaacgtaccgtgcctaaactgtgtccagaggggtcactagaccgtttcagttga

SEQ ID NO: 62487 - DNA, 450 bp, Glycine max
  Peptide Sequence Number=SeqID_179265
atgttcccattcaggcgtaaggtttccaatgctgaatggcctgataacgcgtgtaagcttagctatgccggaggaggttcaggaagtaggtccttcgccgatgatgatggatgtggcggggtgatctctgatgctaactcatcatcctctgctaccagcagaaataatgaaggcgcacatttatgcccccgtgaatacttgtcctcacagtggaaacacaaccctttctcacggtggaccgctaactcttccggtgtaagccttttgaaggggatggaaggtgtcaaagttcatgaaggattgttgtcgttggaggccgttgtgcttgcagccggtgcgcatcgaggagtttctcctcctgcaaatgcgcataagccactgcctgaactaaggagaccagttgcaaaacttgcacttctcgacggatcgcagggctcaactccgagatga

SEQ ID NO: 62488 - DNA, 881 bp, Glycine max
  Peptide Sequence Number=SeqID_179266
atgaagttcattacggagggaaagctcgttgagttacacggggagcgcgagaaggttggtgaacctgtctctctttctcagttacaccgtcttctgcacacgagtccttctagcactttcttccatattagagtggaagcggacccacaaccagcttcaacggcacaaactcttccggagatcttcgctttaatctcgaaatactcctccttatttcagccccatacgaaccttcctccgtcgcgtcccacagatcactctatcactttgctacctaatgcaacaccagtgaatgcgaaaccctataaatacccctactatcagaaacaagagatcgaagatcaagtggctgccatgctcgcgaagggcttcattcaaccaagttcaagcccattctctttgctggttttattagtgaaaaagaaagatggattttatcggcggttcatcagaggatacgcaaccttagctaccccactcaccaagcttttgagtcatggccagtttcagtggtcatctgaagctaatgacgccttccagaagctcaaggacgccattacaacatcttttgttctcacgctacccaacttcaaagctccctttgttgtcgagactaacgcatcaggcacaggcatgggggcagtattatcacaaggtggtcatcctattgccttcttcagcaaacaattttgtcctcggatggccaattcctccacatacgttcgtgagttagcggccatcaccgccgccgtgaagaagtggcggcagtatttgctaggacatcaattcatcattatgactgaccacagaagcttgcgggaactcatgaatcaagcagtacaaaccccagaacaacaccgttatctagttcgattgttggg

SEQ ID NO: 62489 - DNA, 561 bp, Glycine max
  Peptide Sequence Number=SeqID_179267
atgtccaaatcttgtggatttgggatgaccagccctctcgatgagtcgatctcttgctttctcataagggtggacacttgggtacttgtacctatcacctttagaggactacacgtcctcgccttgagaggactacacgtcctcaccatcagagggctgcatgccctcacctccagaggactacatgtcctcgccttgagagggctacacgccctcaccttgggactacacgtcctcgccttgagaggactacacgtcctcaccatcagagggctgcacgccctcacctccagaggactacatgtcctcgccttgagagggctacacgccctcaccttgggtactagttaccctcaccgtcagaggactatacgtcctcgccttgagaggactacacgtcctcaccatcagagggctgcacgccctcacctccagaggactacacgtcctcgccttgagaggactacacgtcctcaccatcagagggctgcacgccctcacctccagaggactacaagtcctcgccttgagagggctacacgccctcaccttgggtactag

SEQ ID NO: 62490 - DNA, 453 bp, Glycine max
  Peptide Sequence Number=SeqID_179268
atggatgaattcctttctagcatttggaactctgatgataacaaccaagttaacccaccacaacccatccttgatgaagctgcaaagcataaaaaaagaaaacaccttagcgttgtggagcaaagcttggagctaggtcatgaaatgagggcttttgacgacgatgatgatgaccaccacgatgcgagtagctcagtgaaagtcattttcgagggccgcaaatcccttcatgaagatttcttatggcatagtctacctgttatctattcaggcattttaacaaagttcctcctcttcttcagccataacttcctcggtgtctatggtggggatttggagcatctcctagatgatagtcttaagggtgacattgtcagggccttcaaggatgattcctaccctgctccccttcacgttggacgcaccgtcaacgtagaggctctaccagtctag

SEQ ID NO: 62491 - DNA, 312 bp, Glycine max
  Peptide Sequence Number=SeqID_179269
atggaactccccaatatactctgggcctaccattgttcaccccagacaacaaccaatgaaactccttaccgactcacatatggcacagacaccatgatccccgttgaagtcaaggaaccattgacaaggagattgctattccaacaacaacaaaataaagaaaacatgaggatagaactcgagacaacagatgaagtccaagagatggccataatcaaagaagaagttaccaagctccgagcatcaagaagatacaatacaaaggttcaaccacaagactttcaaccagacaacctcgtatggcgagtctga

SEQ ID NO: 62492 - DNA, 864 bp, Glycine max
  Peptide Sequence Number=SeqID_179270
atgacatgcacctcaacccggaaaaatgcacttttggggtcaatggaggcaagttcttccccaagctttgccgaaaaggcgaagccgttctacaaactgcataagaaaaccaagccattcctatgggacaaaacttgcaaacaagccttcttggccttcaagaaaaccattgccacatcaccagtcctgagtcgacccaggctaggagtacccctactcctatatcttttagtagctgatgaagtcgttagctcaaccctcgtacaagaggaagggaaacaccaacttctcatctactacaccagctgcatactccatgatgccaggaagcactaccaaatgatagagaaggtgacgctggaactcatttcctcgacccgacgtcttaggccatactttcaaagtcaccaagtggtagtcaagacgaactaccccatcaaacaggtcttgcaaaaacctgaactagcaggaaggatgagcctctacgttgacggtgcgtccaacgtgaaggggagcagggtaggaatcatccttgaaggccctgacaatgtcaccctaaagaaatcccccaagctcaacttcgaagcctcaaacaaccaggctaagtatgaggcacttattgcaggtctaaaagtagagatgctccaaatccccaccatagacaccgaggaagttatggctgaagaagaggaggaactacactggatgatccctaacaagaatttcctaatttggggggtgttaccattagatgagaatgatgccctatgcttggaaaggaaggccagctactacgtcatcctagatggcgagctattcaaaagatggttgacaacacctttgttaaaatgcctgaatagataa

SEQ ID NO: 62493 - DNA, 743 bp, Glycine max
  Peptide Sequence Number=SeqID_179271
ctggttccctccgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaatgagaactttgaaggccgaagaggggaaagggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 62494 - DNA, 835 bp, Glycine max
  Peptide Sequence Number=SeqID_179272
gacaagtacgtccccagtggcagctccagaggctcatcaaacccaaggttcatccttggtgagtctcacatctctaaaggctcgtcaaacccaaggtctacccttggtgattctcacaagctcgtccaacccaaggtccatccttggtgagtctcacatctctgaaagctcatcaaacccaaggtctgtccttggcttatcaaacccaaggtacatccttggtgagtcttgtatctccaaaggctcgtcaaacccaaggtcccctttggtgagtctcgcatctccaaaggctcatcaaacccaaggtccacccttggtgagtcttgcatctccaaaggctcgtcaaacccaaggtccgcccttggtgagtctcacaggctcgtcaaacccaaggtttgtccatggtgagtctcgtatctccaaaggttcgccaaacccaaggtctgtccttggtgagtctcgcatctccaaaggcttgtcaaacccaaggttcgcccttggtgagtcttacaggctcgtcaaacccaaggtctgccctggtgagtctcacatctccaaaggctcgtcaaacccaaggtctgcccttggtgagtctcacttcttcaaaggcgcgtcaaacccaaggttcacccttggtgagtctcgcttctccaaaagctcgtcgaacctaaggtccacccttggtgagtcttgcttctccaaaagctcgtcaaacctaaggtccagccttggtgagcctcgacacaactctacaggcttgttaaactcatggtcatcccttggtgagcctcgccaaaaccctgggcgaacatgtttcttgtccaaggctcgttaa

SEQ ID NO: 62495 - DNA, 582 bp, Glycine max
  Peptide Sequence Number=SeqID_179273
atggacaagagttgtctggggtcgagagtggtaaccttgacaagtgagaaagttatgggtcttttgggcttgtcaagcccctcaagcttgataagtgttgttcggactacttctttcaagttgttcggggtggacatgcttttggttttgcaggtcatttccatcggtggttcctcggagaaggagacattccataaggcttctaacaatgaatccttttccttggacaagttgagggtttcgtgtcgtactggtggaggcatttctcgcctccatgggagggcacacctttccgctgcttccctggtaggggaacctgtcctggtcactatgattctttccccttatatttctggaggagcaaggagaagttatggtaggagcgtcagggcatctccccacgtgcgatgtagccatagtgttgggtttccatcatccctccccgttgttgctagctttgagtgggtgagggatgacattctgaaatataagtcctccatcacctctgtgtcaagtgtccttgttctgcaatgccaagtgaaattggcaagtcctgaggactcctacaagatagccgtctag

SEQ ID NO: 62496 - DNA, 279 bp, Glycine max
  Peptide Sequence Number=SeqID_179274
atggtcgagactctaggacccttctctcccagagttcccctttgtgtttctgatagacccgaattctgcttcacccttcgttccaaagatgagaaaaggggatggaatttattgctcctgaaactggttcgaaacaatgatctttaccctgttcatgcagtgccaccaaaggaccagcttgtacgattctttccagcatatttcgggtttgaagttttctctgttgctttggtgttactggtggagcctctttactgtcttgagaatttatttcaatga

SEQ ID NO: 62497 - DNA, 330 bp, Glycine max
  Peptide Sequence Number=SeqID_179275
atgatgtttacacttgttggacacattcagttctacaacactgagtcactagataaaatgaaaagcataggaaactctttgcaatatcttgtggtggcattttcaatttatgttggaaccttgttggttaatgttgtgcaccaactgactcgaaagcatggtggaattgattggttgaatgatgacatcaatgctggaagattggactactattacttcctcatggctgggttagctttgattaatctcatatatatcttgttctgtgttaaacattaccgttataaggttaatgtcgaagaaaaagttgtggagaaacttgagccttga

SEQ ID NO: 62498 - DNA, 1554 bp, Glycine max
  Peptide Sequence Number=SeqID_179276
atgaagttctacacaataaaccctaggaggaagatgatgaggaagaagccgagcctggttcaccaatcacattcataccatcatagcctggttcaccaatcacattcgtaccaccatgctacataccaccacatatgcaaaattttgaagaatccaattttcaagattttgaatacggtcatagcttgcatcgtgaagaagtccaacatccaatggggactctttgtgaaggggtgcagggcatcatacatccatgcaagtaatcggtgggaaattagaaatttttgtgaaccccatacatgttcaaatccttcaatctcacaagatcatggaaaactattgtattttctcattggtaaaagcatccataacttgattgaaaatgattcatcaacttcagtgctagccttgatagcatacatcaaaagcactaaaggatacactaccacgtaccgcgaagcatggttggaaaagcaaaaggttattggaaacatctacggaaattgggaaagattgtaccacgatctactgagattgttgcaagctatgcagaaatttcttcctcttatagtggtggagaaggaaacactgccaatgccaccacaaaaaggtcaagcagtagagggtttcatcatgttccatcgtcatttttggagttttagaccgtatatcgatgagtttcaatattgcaagctcatagttcaggtcgatgaaacatggttgtacggtaagtacaaggggatcctccttgtggaagttgcacaagatggaaacaataaaatccttccaataccctttgctgttttcaagagtgaatcaacaggagcatggttgttcttcctccaaaatctaaaaggcatgttatcccacaacatggtgaggaggtacaagaacaaccccatcaaaaaattaatcatcaatatgggtgtgctagtaaaatcaacatatgttaggtgtaacacattgttcaacaaaagagggagagaagctgtagcaatgcttgcatctggccaagtttgtacaaaagtactaaacaaggtcatcgaagatgcacggagaaagaaaaacgctcacaatattcttgagtttgatcgacgtgactcacaattcttggtccaagagacaataaatccgagaaaggttcagcctgttgtagatttcacagtcaagctagatgaaaggtggcgtgactgtggcaaattccagaaattacacaagccttgttctcatgttgttacttcttgtaagcatgctcatcgtgagtacagaaactacatatatctcatgtacatgttggaaagtgtctccaacatatacaaaggattttttggagaactgcacaatgaaacctattggtcaccgtgtcatgagtcaatgatctgccctgacccaaaaaagaaaagaagtactaagggtcatcctatcttttctcgtattcacaccaaaatggatatccaagaaccgagtcaaccaaagcgatattttgtgtgttgcatcccaggttattcaaagaaaaattgccctcactgtgtagacttaagccaacaacgatga

SEQ ID NO: 62499 - DNA, 219 bp, Glycine max
  Peptide Sequence Number=SeqID_179277
atggcacgctcagcgtgcactgcaggcctagtgcacaacacacgattagcggacagttccaggcttagcgcaggtctcgctcagcgcgtaggttcggctcagcgcaagaaggtccacgaagagaaagcccagtgcgtgcttagcgcacaaaagcacgctcagtgcgaagtcaacgtgaaaatcatgtatcaccttcttccattaacccttgaagtgtaa

SEQ ID NO: 62500 - DNA, 1107 bp, Glycine max
  Peptide Sequence Number=SeqID_179278
atggattcccatatccatcatcatcatcatcagggttaccaacaacatcagaaccaaccctcttctgggttgcttcgttttcgctctgcgccaagttctcttctttcaaatctcactccttttgtgagtgaagactttggttctagcagcttcagagagttgcaaggaaacaacaacaagggttgttctaaggatttgagttcgatgaattcgcataagggagtgtatggtggggggttgccacctcactatccaaggcatcgtggttcttcttcctctgctgctacttcgagttctgctatggaagggtcttttggattggtgggttcaatgggaatgaatcatgaaacgccgcaaaacgggcttgggtcaagtcttctcaggcatagtacttcccctgctggccttttctccaacaataacattaactttcaaaatgggtttgccaccatgaaaggtgttggaaactatggtggggtgaatggcagtaatggtgaacttagtccatgcattaacggattgaagaatcagatctccgaaatagggaatgaagacattgaggcaactagtcctgatgatgatacaaggcatgaaggtaatgatactcaacaatatggccctggattcccctatggttcttggaatgatactccacaactctcagaaaatctcagtggcttgaaaagaggaagaagtagcaatgaaaagatgttttctgatgaaattcagaatggagagctaggaaaccaagttaatatgttatcacaccacttgagtttaccaaaaacttcagcagagatgattactatgaagaagttgcttcagttccctgattctgttccttgtaaaatcagagcaaagcgaggctgtgctactcatcctcgaagcattgctgagagggtgagaagaactcggatcagtgaaagaatgagaaaattacaagagcttgtcccaaacatggacaagcaaaccaacacagcagacatgttggacttggctgttgaatacattaaagatcttcagaaacaattcaagactctaagtgaaaaacgggcaaaatgcgagtgtacaagcatgcaaaaggcagatacaaatcaaattgcttga

SEQ ID NO: 62501 - DNA, 834 bp, Glycine max
  Peptide Sequence Number=SeqID_179279
atgaaacttcctttttaccctgaattggttaaagacttttattctaacttggagattcaagaagattccttgatttccgaagtttatgggattaagatgatcatagaccagtcccttttctttgatctcactcaattatcaagtgatggtgtatcatttgagggttcatttgatgatgagtggaagtttgatttttctatgtctgattccctccaaatgtttaatgtccctcttgactctgagccctttgtcaaagtcaagagatctttctctataggtgcaaatgtagtctcttcctttggataccgcaaagagagggatggctcttgggtaaagaaggatgctccagtacaggccgctaaagaccactctccatcaccatattctcaaagagatgactcttcatctcttatgaacaacattcttgaaaggtttaatggacttcaaacctatgttggtgagaggtttgactccttggaatgtcaagtggacacacgattcgaggagatgaactcaaggattgcaaaggttgaagaagatgattgtcatcataaaaaagagggagattgtggaagcaataacttccaagattattttgatgatgccaaagaatcaagagttaagcaagttccaaagaatcaggagtcaaaaagcttcaagaatcaagtttcaaagaatcaagattcaagaataatcaagtttcaagattcaatcaagtttcaagaatcaagattcaagaataatcaagatcaagattcaagactcaagattcaagaatcaagagaagactctatcaagataagtactaaaaaagcttttcaaaacattgagtag

SEQ ID NO: 62502 - DNA, 717 bp, Glycine max
  Peptide Sequence Number=SeqID_179280
atgttgagtctcctagcagaacccacaccacaacaactagcagactattgtagggcatacattttagaactaattggtggagtgttgatgtcaaacaagtcagggaatagagttcacatgatgtatctatccctattacccaatcttgattgggctggctggtacaaccggggttcggcatatagagcgacagaggcctacggttttctggaatctcatgcggtgatgtcatgggctacagattcactacataatcttgacaaagtgcatcatactaacatgagaggacataatgacacaaagtgggtagaggaacatcaacgatggattgcaatttggaaggaaagacacaaatatgtgttaattggccaaccaattctacgaaagattaaacatatgaattggtaccaagaaaattctagaattttcctaacagggtttgcaacttatctaaacgttattgcgacatctcgtttagctccaaacatggaaattgaacaacatcctccacaagaaagtccaccagtggtttccagtatgcatgatgaaggaatgccaccacatgttcaatcatatgaatttatgccacaaccttatcatcatgaacaagattataagtacaatccacagttttttagtgtaagcggagaagactttatgagcaatcttatgggtacagatcttcgaacactggagtatgcttatgtgtacatgtaa

SEQ ID NO: 62503 - DNA, 381 bp, Glycine max
  Peptide Sequence Number=SeqID_179281
atgaaggaaggagaatttgtggatgacatgtttgggagactacaagttctcctgaacaatctagaagctctaggtaaaaccgacaccaaggcccagataaacctaaaggtgttggacaattttcccaaggtgtggggacctaagacaacaaccatcaaagagcccgagtgtcccaagccaaagaaaagaagatactcttgtaacaagaaaaagaaaagtctaatggtcacctgggacgactcagatattgagaagagtagtaatttagacaatgaacaagcaaacattttcctaatggctgacacaaacgataaagttgagatatccttggtagggaaatgtcagggtttaagctggtacctagacagtggctactcatga

SEQ ID NO: 62504 - DNA, 936 bp, Glycine max
  Peptide Sequence Number=SeqID_179282
atggagtttgggctgcgacatcaagagacaccgagtagagtgacctttttggaggttgaagtttccaaatggagggcgactgctcccactgtctggagagtggatcaccctaaagtagctagtgccaccattgcttttgctgagatcgtgaggtcgaaccaccaactatcttctaaagttggcagtgtattggccaatttgttgtgcactaggttagatgatgatgaactattcaaatgttgcaaggacttgcaggaagagaaaaaggacttggctggtagggtagaggatattgcgacggaaaaggatgagcttgccaagaaggtggcagatctcaaggcccaacttaaggagtcagagtccaggctggaggagtttgcactgcggactgctagggagagggaggatggcaaggagcttgaggagaaactgctcatttacatgaagaaggccatagaacagcatgaaaagggctttaacaaggccgtcaggcacaccgagttctttgtcaaggaccttgacttgggtctctttgaccctttcaaggatgtgaaggacaatgtactgcttgacaaagaggaaattgttatgaaggaggaggcttttggtgaggagcagggtgctgaggagaagcaagaccttgtcgatgtagaggtcttgtcacccatttggtggggcttccttttgcttggcggagcttctcccctgatgctcttgaggagtatgtttgacttgcccctagttgaaggtcttgccaaccagtctgaggataggttgcttgacctgctaagtttctcctctgatggttatgaggatgatttgacctacgaagcttaccctctgatggttatgaggaataagtatggcatccacctgattgaaggccatggggatgccttaggttttgtaggagtgatcaccaacggtggaccttag

SEQ ID NO: 62505 - DNA, 618 bp, Glycine max
  Peptide Sequence Number=SeqID_179283
atggatgcactggctattttgtctcttccttctgcgagcgatccccttgctgccctggacgaggccactcgtgaagcaggtcggtcctatgagtgggattatgtcatcgtttgttgctgctcttactgttggagaagggggtcaacatgccgaggtcaccccaatgccccttcctctattttagcaaagaggaaaaaggataatggtgttgagccgtctggccataaaaagtcgaaggcccctatgagccttcgtaccctgaggcaagctgtagggttgacgcctagtgcgggtcacccttcgatcgtgcaggatatgcctctggctccatcgaccgttaaggctcataatgttgttgtttctactcctgaggccgctcttgttactactgaagagaatgcgccagctactttggctggttctattatggcaccctcgtccgccatcgctgcacctttactgagtgctagtgtggcgaccactagtgcccatgtggtgcctttttcttcgactccaatggttcctccctccattgcattggcttccatttccacctcctctcacccccatgtttccctgaatcacatctatactgctaatgatgctgattccttgtga

SEQ ID NO: 62506 - DNA, 168 bp, Glycine max
  Peptide Sequence Number=SeqID_179284
atgttgctaaggtgggcttctgaacttcacatgttggcttcgagaggcacctttgttaagagaacaagaggagggacctgcaaaacaaaagacttcgaccctcaacctaagtctcattggtcaaatcttcatgcacttgtatcgtgtccagttctaagacgtgcgtag

SEQ ID NO: 62507 - DNA, 306 bp, Glycine max
  Peptide Sequence Number=SeqID_179285
atggacatactaggatcactgccaaagatcccaagagtagtcaaatacttactggttgcaatcgactacttcaccaagtatgacctcccatatgccattgtcatggacaatgacactaaattgaaatctcagacttatgaagatttactaacaaggctaggcatcaagcacctagtgacctctatcaaacatcctcagaccaacggtcaggcagaggtagctaacagagtcatcctcaaggccatgcgtactagactcgacaaagctaagggtctatggaaaaatgagttccctagtatactttag

SEQ ID NO: 62508 - DNA, 186 bp, Glycine max
  Peptide Sequence Number=SeqID_179286
atggagtgtcaccacatggaggagctgagaaagctaaaggctgaccacgggcggactactgatcaacatccttttatcgatcgcattagggaggctgacatacccttggggtggaaaccactcaacctcgagcagtatgacgaaaccatagatccacatgagcacccagatgccttcttgacttag

SEQ ID NO: 62509 - DNA, 504 bp, Glycine max
  Peptide Sequence Number=SeqID_179287
atggagatttttagaaagagtgtgtggaatgtatgcaaactcttggcatcgcctgtacctcctggtaaagttgagggtgtttgccctgagtattggctagtagaagccagctcgcaccactttggtggcaagggagcttcctctggcgtcgagcttcattctcgtttagtggtagttccccctgaattaggaagttcttgtaggggtcatccagcttggtttttcctcttctctggccataacttcgtcaatatctatggtgagagcttggaacgttccctggatgatagtcttgagatgcccaaccttcttggtgctggccagcttggagaacaggtctgctctggtattgctctccctaagaatatagtacattttgaagcatttgaaattatcgatgagggttttggcaatgtcgtagtacttaagcagcaccatctctttggtctgctatttattggcaacttgtccttggacaagctacgagtctatgtagtattatag

SEQ ID NO: 62510 - DNA, 579 bp, Glycine max
  Peptide Sequence Number=SeqID_179288
atgcattctaaagctgaagcactagaacatataaaaaaaagagatacaggccatcaaagtgtgtcattggagaataagacaggagattcaactgtgctgaagataggagattcggctgaagttgtgataaaacaagacatgaagggaagaaagcataaatatgggtttaacaacaataaacatgagaagccagagaacataagggtggtggatgatgaaactggtgacaaacatcagttggatgaagtcctaaggatgccatctacatatcatgggttctccacctgcctcccctcctcctcctcctcctcctcctgctccttcggacgcatcggcttcgccgtctaccgtgaagcggacatgcaagcctcacgtctacgatcgttgtctactagaccacctggtgctgacccaccagtggtccatgttgatcctgctactggcaaggccaacggtccccacaggaagaaattaagaatatatttggggattgtggtgcgtgataaagtggatgtcacctatgagaacaggaaggaggtccctactgctcagaaggacctgatttgggaggatattaag

SEQ ID NO: 62511 - DNA, 252 bp, Glycine max
  Peptide Sequence Number=SeqID_179289
cttcatcggcaacaatctatgtggtccaccactgcccataaactgcagctccaatgggaaaacccatagttatgaaggaagtgatgggcatggagtgaattggttttttgtcagtatgacaattggatttattgtgggattctggatagtgattgctcctttgctgatttgtagatcatggcgagggagagtagctgaacgtaaagaggggaaggataggaggtgtgggggaatggaactaaggataaccaa

SEQ ID NO: 62512 - DNA, 603 bp, Glycine max
  Peptide Sequence Number=SeqID_179290
atgtcctcacctcgccttgagagggctgcacgctctcgctttcagagagctacacgccctcgccttcaggggactacatgtcctcaccttcagagggctacacgcgctcgccttcaggggactacacgtcctcgccttcagagggctatacgtcctcgccttcaaagggctgcacgccctggccttcaaagggcaacacgtcctcgacttcagagggctgcacgccttctccttcagagggctacacgccctcaccttgagaggattacacgtcctcacctcaccttgagagggctgcacgccctcgctttcagaggactacatgtcctcgccttcagaaggttgcgtaccctcaccttcagaggactacgcgtcctcgcctttagagaactacatgtcctcaccttcagaggactacacgtcctcgccttcaaagggccacacgcccttaccttcagaggactgcacgtcgtcaccttcagaggactacacgtcttcgccttcaaaggactacacgtcctcgccttcaaagggctacacgccctcaccttcaaaggactacacgtcctcgccttcagagggctacacgccctttccatatga

SEQ ID NO: 62513 - DNA, 370 bp, Glycine max
  Peptide Sequence Number=SeqID_179291
atgcttccagaggaaaacacattgccaaaaagttactatcagaccaagaagatactgtgtccgatgggtatagagtatcagaagattcatgcttgccctaatgattgcatactgtacaaacatgagtttgaagaaatgcacaaatgccctaggtgtggggtatcatggtacaaagtgaaggatgatgatgagtgtagtagtcacgaaaactcaaagatgggtccccaacgaaggtgttgtgagaaaaatgtctatgctagtgtcattgggacactcattaacattcaaggcaagacgaaagatggtttgaatactcatcaagttctagctgagatggatatacgagcgcagttacatccaaggtctgatg

SEQ ID NO: 62514 - DNA, 354 bp, Glycine max
  Peptide Sequence Number=SeqID_179292
atgtccaattcaggcgcatcacatatcgagatgctcgaaattgaacaatggaagctctcgagatattcaaatggtcttgacttttcactcggatgtccgattcaggcgcttcacatatcgagatgcacgaaattgaacaacggaagctatgaagaatttccaattgtagacttttcactcggatgtccgattcaggcgcttcacatatcgagatgcacgaaattgaacaacggaagctatgaagaatttccaattgtcctaacttttcactcggatgtccgattcaggcgcatcacatatcgagacgctcgaaatagaacaacggaagctcccgagatattcaaatggtcataa

SEQ ID NO: 62515 - DNA, 294 bp, Glycine max
  Peptide Sequence Number=SeqID_179293
atgtacatcaagtatggcccaaaatacatcatgaagcatagccaacaaaacaagttgtccaatgaaacaaaaaccccccacacttattcccaaaataattccaaagctccaaaattccttaaggatatggtaatatcatggttttttcacttaaggcttgtagtgagcttcaaaacaaggaaagggaaacaaggctcaaaagggctatcaaaggaattaattcaaggacgcatcaacaagaatcaagccaaggctattgtgcaagcaatcaatggggcaaaacacaccaaatga

SEQ ID NO: 62516 - DNA, 1071 bp, Glycine max
  Peptide Sequence Number=SeqID_179294
atggggtctttaacgcggtctcatgtcatgcacgcagatgacataatgattttttgcaaggggacctccagaaatgtgcataatctcataaatttttttcagctttataaggatagttttggtcaagtgattagcaagcacaagtctaaaatctttattggatctattcctggtcaaaggctgcgtgttatctctgatttgcttcagtacttccatagtgatatccctttcaactattttggagtccctatcttcaaagggaagccaacgagaaggcacctctattgcgttgctgataaaattaagtgtaagttggcctcttggaagggctccattttgtccataatggggagaattcagcttgtcaactctgtcattcacggtatgcttctatacagtttctctgtatatgcttggcagactcatgccttctacttcctacttcctatggatgaccatttgtgggatagaagagttaccattgtttccatgcgtagtctttgcggcaagaattgtgaatcctatgatcatttaatgtcgagatacagtttcgcggatagtttgtggaattggcggggttcacttctatcttgccacatagatacacaatccagttttactatcctagcttttgaaagatcttcctggtcccctcagatgaaggacgttttcctagcatcaataagtttcgttgtgtggtgccatctgttggtccctttctcttctgcaatctccatgatttccagcaagattaagatgacaggaaatcacaccaaggcagttatgaactcctctatatctgagttccaaatcatgaagaagcttgacatcaacggtcatcccagaagagctgacaggattaaggaggtcatgtggtatctgcccaaagagaattgggtcaagtgcaactcagacgaatcgcccttgggctgtccgggggtagcgggctgggctggcatcttcagaaatcatataggtagcttcttaggctattgcacagccaacttgggtaaaaaaattcagttgttgttagagtttatggatgctatcctcgctattgaaaaagcttag

SEQ ID NO: 62517 - DNA, 339 bp, Glycine max
  Peptide Sequence Number=SeqID_179295
atgtccaatgaagctccagatgatgaggttgcccctcaagacaaagaatccgcgtccaagcagtcaacaaccttaaatgaaactacatcaagggagaagggtgaacatgatgttgtcatcatctgctccataaggtcaagacctatccctttaaactatgcatcactgactgttgtgaccaaagagcaagtgcaagatatgataggtcaagcaaaggactattttgctaaacaacaaaggcaaggaaacgaccaatttgagctctccatacaaaacacaattactactcaattttccaacctcgatgttgttcttcttcaaaatcttcaacaggcttaa

SEQ ID NO: 62518 - DNA, 1137 bp, Glycine max
  Peptide Sequence Number=SeqID_179296
atgtccaaatttctgggaaccaaagtagtgctttctagagattctattgccaaggccactgggtgccttcatgagggaagcacttatcaagaaggatgggagaaaaactataaatcccatgtggcaagggctctgtacaaagagaatattgataaagctggtgaacaaaagattatcatttacaacttgatgtgtaagagggcaaagatttgggctaacattcttaacaagagtgttctacacaaagcagggtcaaagacatctctattagatctccacaagtttgttctctcccacttgatggagaatcttccatttgacttgcctcacataatctacatcaacattctcagtcatttaaagggcttaagtggtctagacgataactactatgttgtcctaatcaacaatgtgctttgggatcaaggagtatatcatgtcttcgacaagatggacagcaactcaaagcacacaatcatacccaaagaagaaatattagtaccacaaaggttgaaagacccgggtgaaactgatgacgatgaaggacttatgcaggctgtacctaccccaaagagaacaaaggttgccaaaccagctcctgtgcccaaagaatctgtcattttgtccaccatccaaagacacatcaagacaagggctaccaaagccaatcccaagattggtaagaaagaatggatgatttccttcactgacaacaaggagaattttgcttcatcctctttagatagtgagtccattgatgacacttttgtctctcctcttcataagcatacactccctacacccaaacaacatccaccttcatgtgcaaataagcttgttcgtgctccagacacatacgatgccagaaccttttggaatcaaattatgtgggttaacaccttaaaggcctcctcatctagtcatgatggaagcgacaatgttgttcaacatgatatcattcaagtgttatgtccaattaggaagtatcactttgatgatgcttatgtgtgtttcacaaaggatgcatacatctactcattcatccaacaccttcaacgtcttcccactattcaatatgaaggaacctatgatcttttcaagatgagtgaaaaaaaggataatagatcatgtgcctaa

SEQ ID NO: 62519 - DNA, 192 bp, Glycine max
  Peptide Sequence Number=SeqID_179297
atggttcgggatagcaataaaaaaaatttttggtcgatcaacttcaaggaagaggaaggcgaagggatctcgttgagcaatggtggcggcagcacactaaggttggggtccctgccggtggaatcaatgttccatgatcatcaaagagtcaatgctaagggacacaacaacgagttagggcttcaagtttaa

SEQ ID NO: 62520 - DNA, 189 bp, Glycine max
  Peptide Sequence Number=SeqID_179298
atggaggagaaagattggaatgatgacagcctcaccatgaccatcgtttctcatcactgtttcgacaatgattctgaagcgccaagcttctccatctccatcatcgaggtgctggaacttccttgcttggcttggttgcagcaaaactcggtgcctgtgtcactcttaccgatgacttcactagattag

SEQ ID NO: 62521 - DNA, 246 bp, Glycine max
  Peptide Sequence Number=SeqID_179299
atgagagtgagagatcttgttgttccaacagtcatcgaggtcattgccagagttggattacaagaggagcttgacgatgatgatagagtcgatcttgtggtccatgagctcactgctaaggatgccattggggaagcctgggaggttcttgatgaggatgccattggggaagctagggaggttcttgatgagattgccattaggaaagccggggaggttattgacgttgttgggcatttcatataa

SEQ ID NO: 62522 - DNA, 538 bp, Glycine max
  Peptide Sequence Number=SeqID_179300
atggatcgaatcaacatgatggagtttctattagagcactacgacaatgacaatgacaatgaggagttggacgttgacgcagaggactccaaggggaggacgacaatccatatggatgatgagaaaccagatctgggtgcatggtactttgtgattaaggttgcgaagttgggagaaagtgggcgtaagattcatgaggcgcttagggagaagtatggagaggaagggtacaagaaagtggatgttaattgtttcaatatcaatttgccagataggggaaccatattcccccgaatcatctcaattggatctaagaaacaaattacgaagatcttggaatatgttcgccagttatattcctcagagttggaagagaatgcaaatgatgcttcaattggtcaaaccactcaaaatgttttggttgattggaagcttatcatactcaagctatgcaataagaaactagaactacttttgaaccttattaaggaagtccttgatatgattgagactcaggaagatatgaagtataaagaag

SEQ ID NO: 62523 - DNA, 255 bp, Glycine max
  Peptide Sequence Number=SeqID_179301
atggaagcatgtttagcagtaaaggacctattgcaacagatgatggaccaaggccggctggaagtcagcaatgaggggggtgaagagcagcacatatacatgcagtccacagatgaagaatgtcttagaaagcctaagcctttggtggtatatttcaccatagacgcagctccccaagagccccaattcccctcggtagttagacctattctgtttccgtaccaaaacaaccacgtagtttcgtggaggaattaa

SEQ ID NO: 62524 - DNA, 225 bp, Glycine max
  Peptide Sequence Number=SeqID_179302
atggctagattcacggtgttcatatctatgttgagcgttgtgcttctaaggaagtgcattcacatgtacaacgaatatgcacatccgttcatagatatggctttcgttttagtgtcgtgggtgagattttccggctcgcggcgtttccggccaaccgacgaagcggtttctggcaggattattactcccatgatgacatcaatgatgggtaggcctgatcgctag

SEQ ID NO: 62525 - DNA, 258 bp, Glycine max
  Peptide Sequence Number=SeqID_179303
atggttatgaagggccaagacatttatagtagccaagatgaggttactacttcaccttcctctagtgaaagtgaagaagcaaaaggggaagaatctagtgaagaaattgactcccaagaagaaagggaccttttaatggtcagaaggcttctaggaggccaatcttgtgacttgctggggcaattttttggcaaatgccggcttggacttttatggacgacatacgctggtgatatttttttgcttcacgtcggttaa

SEQ ID NO: 62526 - DNA, 381 bp, Glycine max
  Peptide Sequence Number=SeqID_179304
atggtagttcctgtgctcgatcttttaatgcacaagctcacctttctcaaggaaattatagtaattccagtaattcaaacaatggtaacaatgcaaacaatgacaatagattttctaactctagccgaggtggtagttgccatggaggccacaatggagaaaggcaatgctggtagaggagatagttgtggtcgtatgccttgtgtgcaaaatgttggaatccaagcaaccttcactcattcagctcatcctcaagccaacatagctactgctagctcaacaccttcaaacagatggtatccagattttggtgcatctcaccacgctaccaatgtttcccaaaatatacaacaattaacaccttttgaagggccatactag

SEQ ID NO: 62527 - DNA, 399 bp, Glycine max
  Peptide Sequence Number=SeqID_179305
atggttcaaaacacaatcttgaattggacatcttataagagcaataattttatggcatactgtgctcttcatcatttgtctcggtgtctccctaagattgttcccaaattgacagagtatttgaaggttttgactgatacacatcctaaagtccagttagctgggcaaatggcccttcaacacgttgggagtgtgataaagagtccagaaatatctggtcttgttcctactctacttaagggactttgtcatcctaaagagcatacaaaatattcccttaatattcttcttcaggtaaggcttttaatactgttttcagttgtggtatcacttgctaaacaatgggcatttgaagaaccttctgtggagacaataactggtgaaaatgttttgacatag

SEQ ID NO: 62528 - DNA, 666 bp, Glycine max
  Peptide Sequence Number=SeqID_179306
atgcagttaattagtgtagtcacaagaatagtaggttgtgcaggactgaagccaacagttgctatgataaaagcatggacagacatagctttagccaacaaagggacattgattgtgggaggtccttttgttcttcctcctcagcaacataacataaaattagttacaaatgattcagaacattatatcattttccaatgtatccaggggttaccaaagggtgcacttatgcaaataatcttaactgcatctgggggtgctttcggggattggccaattgataaactaaaagctgttaaagttgctaatgcagtaaaacattccaactgcaatatggggaacaagatagctgtggattttgctatactttttaataaaagatctagaaatttccacattgattctatgaatgacgtccttacccttcccgctttggaacaatggcttgttttctctcttgttgatacttgggaaaaatggaatgacttgccaggcttgcacaaccttgagcataaggttgcttttaatgagggagccatgctccttttgaaggcttgccatgatcacaaccttgagggaaaatttgttgtggaagagtggagtaatgtttcagcccaagaccccaataaacttgaaagcctaaatcttgtaggccccaatgtgtga

SEQ ID NO: 62529 - DNA, 453 bp, Glycine max
  Peptide Sequence Number=SeqID_179307
atggcttcctgcaagagaaaggcccctgcctcaacatcccaggcccgctatgatctctctagattcacatctcaggaggcctgggatcgctactctgatattgttattggcaggaagatccttcctaaaataaatgtcatgatatatcatacaaaatttgatgagttcaaggctgagctcgagagaaggaattggcacaaggagctgaccaatttcatggacagaagcattgatgttgcaatcattaaggagttctatgctaacctctatgatccagaggataactcacctaagcagacatggagcgttctttcattctccaacctggcccctacttctcacacttctgacatcacactggatagggccaggttgatctacgacatcattcagaagatggacatgaacttggggtattatctcaagtcatatttctatgattgcacaacatga

SEQ ID NO: 62530 - DNA, 578 bp, Glycine max
  Peptide Sequence Number=SeqID_179308
atggcgcctccgatatcaggaggcagccgtgaaagcaaagaggctcaaggcgtgctggctgtatgggcgctgccgtttgagccagatagcgttaacaagtcacccgccgtggcggcgcagagttgggtgctgaccagcgctgaagatggcgtggagaaaggaaactggaagatttcgagtgaggcgctgaaggttaaggataaaacgttcagcattgagcagaaagtgttgcacggcggcaagcaagaaggcagcaaagtcgtgattatccgcagcgaggatggcctgaccatcacgctgagtcccacgcgcggcatgaacctcctgcgggcggaaggatttggcgcgaaaatggggtgggattctccggtcaaagaggtggtcaaccccgcctttatcaacctggaaagccgcaatgggctcggctggctggaaggtttcaatgagatgatggtgcgctgcggctatgagtggaccggtcatccggtgaccgaaggagggcagatttacaccttgcacggtaaagcgggcaatacgccggcctcactggttgaggtcgaggtagcggatacggcgcc

SEQ ID NO: 62531 - DNA, 940 bp, Glycine max
  Peptide Sequence Number=SeqID_179309
tattgatcccctcttaccagagcatcgggctttgggcgccgctgctggtgctgtgcgggcgcctgctgcaaggcttctcggcgggcgcggagctgggcggcgtgtccgtctatctggccgaaatcgccacgccgggccgtaagggcttctacaccagttggcagtccggcagccagcaggtggcgatcatggtggcggcagcgatgggcttcgcgctcaatgcggcgctggaagaaagcgccattcgcgaatggggctggcgcctgcctttcctgttcggctgcctgattgttcccttcatcttcttgctgcgccgcaagctggaagagacgcaggaatttaccgcccgccgccaccacctggcgatgcacgacgtgtttaaaaccctgctgaaaaactggccggtggtgatggccggcatgctgatggtcgccatgaccaccaccgcgttttacctgatcaccgtgtatgcgccgaccttcggcaaaaaggtgctgttgctcagcgcctccgacagcttgctggtcactttactggtcgcgatttccaacttcatctggctgcccatcggcggtgcgctgtcggatcgcttcggccgcaagccggtgctggtcgccatgacgctgctggcgctggccaccgcctacccggcgctgagcctgctcgccgccgcccccagcttcagcatgatgctggccgtgctgctgtggctgtccttcatttacggcctctacaacggcgccatgatcccggccttaaccgagatcatgccaacggaagtgcgggtggccgggttctcgctggcctacagcctggcaacggcggtgttcggcggctttacgccggtgatctccaccgcgttgatcgaatacaccggcgataaggcttcaccgggctactggatgagcttcgccgcgctgtgcgcattgctggcgacgct

SEQ ID NO: 62532 - DNA, 786 bp, Glycine max
  Peptide Sequence Number=SeqID_179310
atggcatttcacagagcctcgaaggcgaagccaaaatccgcgagatcccgaattctgctcctcgcggcagcagtgacagcgattgcgcttctcttcctgttctcctctcttctttccaccaccgtctcgaaagccaacctcttacagcgacgacaacaacagcccttcgaaaagtacctctattggggcacccgcatcgactgccccggaaaacactgtggatcttgcgagggcttgggccaccaggaatccagcctccgctgcgccctcgaagaagccctcttcctcggcagaacctttgtgatgccttcgagaatgtgtattaatcccatccataacaagaaagggatccttcatcattccactaatgccagttctgaggaactgtgggatgcaagttcttgtgccatggactctttgtatgacacagaacttatgtcagatactgttcctgtgattttggacaattcaaaagagtggtatagggttctatcgactagcatgaagttaggggccagaggagttgcacatgtggaaggagttagccggtttgaacttaaagaaaatagccgctactcagatttgttgctcataaacagaactgcaagccctctttcttggtttatggagtgcaaggatcgaaacaaccgcagtgccataatgttgccatattcatttcttccctcaatggctgcagggaaactaagagatgcagcagaaaaggtgaatgaagagattttattggataatagggctgtgagatatcctgtaaatggtaaggaataa

SEQ ID NO: 62533 - DNA, 327 bp, Glycine max
  Peptide Sequence Number=SeqID_179311
atggatcccattctcctaaatggtgtcgatgatagtaatgagtggttgttagaagaaatgggtagaggtgatgaagatgctgaagatgaattggtgtttaatgatgatacctggacttggggagctgttgccaatgcaactgggattagagagcttttaacatacactaggcagcaaacaagatcaaagaagacggctgcaactgcttttagttctaggccttcaagctctaagggaaaaggaaatgaggttatacaagaagaagaatgtattgatgaagatattggagaggaggaagagatctataaatgtagttgtgaaagctaa

SEQ ID NO: 62534 - DNA, 240 bp, Glycine max
  Peptide Sequence Number=SeqID_179312
atgcctacatctccggggaaggtgcagatgacaacgttagtcactgcatactatcgggctttcagtctaccgatcgcaaatgagactttttcgaagtctcgagcggaagacgcctatatctccagggaagcaaatgagacttttttgcagtctcaaccggaagacgcctatatctctaaggaaggtgcagatgacgatgctagtcactgcgtgctattaggctttgagtctcacggatag

SEQ ID NO: 62535 - DNA, 306 bp, Glycine max
  Peptide Sequence Number=SeqID_179313
atgactaacgtcgtcatctgcaccttccccggagatcatgcagtgactaacgttgtcatttgcaccttccctggagatataggcgtcttccggtcgagactgcgaaaaagtgatgaggacatgaccaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 62536 - DNA, 292 bp, Glycine max
  Peptide Sequence Number=SeqID_179314
aaagaatggttttcctctaaattatgtttccaaaggaggaagaaataatcaaagtggctcaagcagagggagttctagtggaagaggaagcaagatatgcacacattgtggtttcatcaaccaccctattgatgagtgttacaaaaagcatggatatcctcctggacacaagctctataagcctcaaggctcaaacatcaacaatatcaatgttgtgaaagaaaagagtgatggtcttgtcctagaaaggaatcaagaggcacaaagtgatgaagtaaagcggacttcttag

SEQ ID NO: 62537 - DNA, 618 bp, Glycine max
  Peptide Sequence Number=SeqID_179315
atggcacactttcttgccggaggaattcatcctgctactttgtattgtgataataagtatgctctccacatatttgtcaatcctatcttccatgaaagaaccaaacacattgaaattgatttccatatagttcgagagaagatgatgattgggcttgtgaaattgcttcatgtctcctctgcatatcagcttgcagatatcaacaccaaagctctcatgcctgatgcttataacagtatggtaactatgaagaagaagtgcgagtgccaagcactattggccattgagaaagcaagtgataggaatctgaagaggaagaacttacttatggcaaaggaggcttccattatgcttatgatggcatatgatggtttctctgtgtctgatatttgtttgcattatctgattgcatcatccaacattaatgatgtgatgaccatgtccaaaagaagtctcatcggttttgtgtttgaattgaaggcttgtgattgggttcctaaacttgaagatgttataaaatgtcttggtttagtgcttgatgagaatttttcttcattggtgttacatccacaatttcatgaagagctgagatcaatgaaggattggttagttgtttaa

SEQ ID NO: 62538 - DNA, 216 bp, Glycine max
  Peptide Sequence Number=SeqID_179316
atgacagattggcctttgtggttgagaaataatctccttattggtagggaggggcatggggtgagttggaatctcttatttggaattgtgctcgatactatttggtggaagaggaatacgactatattccaaggtgagaagtggagtgctaaagtggtgatcaagaaggcttgtaatatggctcattcttacaaagatggcttgatgaggttttaa

SEQ ID NO: 62539 - DNA, 540 bp, Glycine max
  Peptide Sequence Number=SeqID_179317
atgactttgctagaattgcctgaagttaaagatgaatcttcctcatccctcgtagagccccttattgggtggccaatttcacaaactgatgctgagatcattgacatcaacaaaaagttcttgacgcaactaaaggctaagcttaagaactctaataatttggataagggtgagtttattagtagtttgaattcctatctagaaaacatcgagggcaaattagggattgtgattggggttgattcatcccggagtggttataccaggattttgattgataagcttggagttttcatagatagtcccttttatcgtcatccgggagagaatcctgcaactgcactagtttcacctgttcttgattcatcaaattacaattcttggagtcgattaatgctcactgcattgagtgtgaaaaataaagctgagtttgtcgatgactcaatcaaaaggtatgcattagatcatgtccttcacacggcttggaagaggagcaacaacatggttgtttcttggcttgttaattcggtcacaccttaa

SEQ ID NO: 62540 - DNA, 316 bp, Glycine max
  Peptide Sequence Number=SeqID_179318
atggttcaccactcatttccgagcattatcactgttgggaatttcgaaatcatgtctgatctgagagaaattcctttcgcatcttgttcgagattcaattctgcacagcttcaccgttgggatttgcgagataatattcatggagtgagagaaaggaatcgtacaaagacaatacaaatggaggtttcaatcccttcttcgtctctcagacgtttgggaattccgtcggagcagtcggaggaaaaactggagaaatctcagggaatcgctagagatgccgctatcgctttcggaagacacgtgagcccgcttagag

SEQ ID NO: 62541 - DNA, 564 bp, Glycine max
  Peptide Sequence Number=SeqID_179319
atggtaaaaagagaagctttgaatgtgagagctgttcttattttaccggaaggttttgaattggcaccccccgatcgtatttcgcctgagattaaagagaagataggcaatctgtcttttcaaaactatcgtcctacaaaaaaaaaatattcttgtggtgggaacaggggaaggggtcagatttatcttgacgggagcaagagtaataataatgtgtataatgctacagcagcgggtatggtaaaaaaaatcatacgaaaagaaaaagggggatacgaaataactatagtggatgcattggatgggcgtgaagtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaaggtctcttgttcttcttcgcatctattattttagcacaaatctttttagttcttaagaagaaacaatttgagaaggttcaattgtccgaaatgaatttctag

SEQ ID NO: 62542 - DNA, 1560 bp, Glycine max
  Peptide Sequence Number=SeqID_179320
gagaagcaagttgatcttcttccaaagttgaaaaagaatgtaaacactccagagggggttccacgtctttttgatttagtgaaagttcaagatgaaagaatgaagcttgctttctttgcggcacttagaaacactgtggttgctaaagatcttgaccaggcaacacgtatagcatatggtggaaacactgagtttcgtcgagttgttacccttgatggtgcactctttgaaaattctggaacaatgagtggtgggggtagtaagccccgtggtgggaagatggggacatctattcgagctacaagcatgtctgcagaaagtgttgcaaatgctgagaaagagttgtctaggttgaccaataaactgaatgacttccgccaaagaattatggctgctgtgcagcattatcaggcctcagaaaaagctgttgctgctttagaaatggagttagctaaaagtcagaaggaggttgacagtttaaaatcacaatataattatattgagaaacaacttgattcccttgaggcagcatcaatgccacaggaggatgagcttgacagaatgaaagagctgaagaagattgtttctgcagaagaaagggagattaatagacttactaatggatcaaaacaactgaaggaaaaggctttggagctccagagaaatttagaaaatgttgggggtgaaaaattaaaatctcagaagtcaaaggtccagaaaattcaatctgacattgataagcatagttcaggaataaaccgttgtaaggtccaaatagagacaggacaaaaaatggtgaaaaaactgactaaaggaattgaggattcaaagaaggagaaagaccggcttacagagcaaaaggagaagctaacacaagccttcaaagaaattgagcagaaagcatttgtagttcaagagaactataaaaaaacccaagagttgattgacaaacatacgattgtcttggagaaagcaaaatcagattacaacaagatgaaaaaagtgatggatgaattgcgtgcatctgaggttgatgttgactttaaattaaaggacatgaagaaagcttacaaagaattggaaatgaagaggaaaggttacaagaaaagactagatgatttgcaaactgcccttcgcaagcatctcgaacaaattcaggcagatttagtggatcaagaaaagctacaggctacgttggatgatgaacatcttaatgctgcttgtgacctgaaaaaagcctgtgaaatggttgctctgcttgaagcacaactaaaggagatgaatccaaatcttgattcaatttcagaatatcgaaagaaggtatcttcatacaatgagcgagttgaagaacttaatgcagtcacacaggagcgggatgacataaagaagcagtatgatgaatggagaaagaagagattggacgagtttatggaaggatttaatgccatatctttaaagttaaaagaaatgtatcaggtttgggaatctgatctctctctgagtgctgccttgcattggcagtcatggaattgtgcttcactctctagtattatgtactga

SEQ ID NO: 62543 - DNA, 321 bp, Glycine max
  Peptide Sequence Number=SeqID_179321
actcttagctcgctggctcttgtatttgctcttcatcattacaaacctaccccactctatgtaatggatgaaattgatgctgccctgggcttgcaatacattaaactcgtgatatatggtttggcagacttcaagaatgtatctatcgtcgggcattatgtgaaagacaggaccaaggatgctcaattcataatcattagtcttaggaacaatatgtttgaattggctgatcgacttgttgggatatataaaacggataattgcacaaagagcattactatcaatccggggagtttcgtgatatgcgaaaaggctgcttga

SEQ ID NO: 62544 - DNA, 162 bp, Glycine max
  Peptide Sequence Number=SeqID_179322
atgaaaacagaggcagcactggtgcaagaccagactgtatctaacattgaagaagagcacattgttaaagcaagctcaagccatctgacgcctaatcacagtagcgctttgccacgtccattccacctggtaatcaaacatgtccaatgtggtgaacattga

SEQ ID NO: 62545 - DNA, 423 bp, Glycine max
  Peptide Sequence Number=SeqID_179323
atggtcatccactttctttgccttctagagacaatcaagtccattggcatgtggagacaatcatggtcattcgccttctctgccttccaaagacaatcaagtctgctggcatgcaaagatgatgcaatcctccctaggaagggaccagtcactagagccatgagcaacaggtttcaagaggattgcactagagctgctgaagaaggccctagggttctcatgaaccttaggatagggtaccctagaaatataggatttttcagcccttggaattggaaaggaggattggtgccataccttaaagaatttgagtcaagaagcaaggggccaaccaccttaagagctattggactaagaagcactccaaatagagtgaacaccaaagagagaatagccaccacaattgaggacttttttttttaa

SEQ ID NO: 62546 - DNA, 204 bp, Glycine max
  Peptide Sequence Number=SeqID_179324
atgtcagaattcacaagtgattatcctcaaatttcagccagcatgtatcaattagaccttgcaccttacgcttcagggtcatacaatgctcaacggaatgccccagtactcctccaagataagcacctattgtgttcgagtcgtatccttagaaaaatggaggtattcttagctgatagggtgatgagtaatgagaagcgttga

SEQ ID NO: 62547 - DNA, 696 bp, Glycine max
  Peptide Sequence Number=SeqID_179325
atgatgatatggatgataaagttcaactataagcacctctatcaccaatccaccttgaccactttgaacatcaaggagaacccaccattgatcccaacctctttgaagaagacattgcaagcttatgggattgaagaccttcctccaccaacttggaagtgtcttcaccctaagatatccaagcctacatccatagcagtcctgcgcaaaatttatggtcatcaagccattccattaactaaagacgacatcttcaatgttgggatgattttaatgcagcactgtctcactaaccagaggccaagctactcctcagcaacgaagactatcactctgaagccagatgttgagttcaatcagaatgatgtcatgctcttttactttaaagagatgtacaaaaactcacgtcttgcatccacatccgagtacgacaaggaatacacatccaaccatatgcgcatgaaagaggccgaagccaagcaacaacaagagaaactcgaatttgaagagttgttcaacaaccaacatgctcatcttggacctcaagttgatgttgttaaacctccaatggttgaagtttcttctacgcccataccgaatgatgcactcaccactatcagcacttccagtatgccaagggaaatcactcctttgaatgttgttgctccaattggcttgtctgaagagaggatctaa

SEQ ID NO: 62548 - DNA, 219 bp, Glycine max
  Peptide Sequence Number=SeqID_179326
atgtctatttatagaaaagagccaagaggtgctgagaaattcgcccaggcaagttgtagctcacccaggcgaatttgtgacttagtgttgaaggcaccaattcgccgaggcaaattttcgacaacaagcaacagcggctcgtggtggccacttgctgtcgtgggtagtggaaaagaagctgttaaggtttgggtaggcatttggagaggaggagagtga

SEQ ID NO: 62549 - DNA, 711 bp, Glycine max
  Peptide Sequence Number=SeqID_179327
atggctaataagtatgctttgttaaagctccctggtcccaaaatttctgaaagaaagaaactggtttcttcaataaatagtgaaaccacccctgaaataggagacagtatttcttatgagcacagtgacaaatccctgtcaagtgactcaaatccacagaaaggttctgccagaagaggcagtgcttttgagaacgaaaatggtggtgttgtttcaagcaattatgtcgaatctattgagaaggaaataccagatgtctcatttgtaggcattgatctcggtttggacaaaagtgaagaggaagatgataatttgtctcctgttgaaaaggcttcacctaggctatatgttgatgaacagttgaatagcaagagatatgagataataaaacctgataccctgccaagtgatatcccatgtagcactgaaactttcagtcgaaagattgaaatacttgaagctttgagtgaatcaagtacaaaggaggttgctaatgaagctgacaatgtggagggtgaaggtgaaaagcccccacctttggctggggccaatgtcatgaatgttatattggttgcagcagaatgtgctccctttgtcaaaacaggtggtcttggagatgttgttggatcattacctaaggctttggctaggcgtggacacagagttatgagtatcaccatcacatatttgggaacagaacttgctccttag

SEQ ID NO: 62550 - DNA, 1530 bp, Glycine max
  Peptide Sequence Number=SeqID_179328
atggccatgaagttcaaccttgttctcaaggttgaaattggggaaatgagttgctatagtgaacctcgggagaaccacaccataaaagctagctatagtagctggagagcttttaagaagggttccacaagtgcttgggtgcctatcatcttcagaccagaaaatgttgtagtacctcggtatagtcattatgctgaagcacaagatttaggagtacggaaacgatacaaagtagatggtcaggacatggaagtaacatatttccactcttatatcgatggtgttgacttcgtttttattgacagtccaaacttccgccatttacaggataacatatacaggggaagccgagaggatattctaaaacgcatggtgttgttttgcaaggcagctgctgaggttccttggcatgttccatgtggtggtgtttgctatggagatggaaatttggccttcatcgcaaatgattggcatactgctttgctgccagtgtatctgaaagcctattatcgtgaccatggtataatgaagtacacaagatctgttcttgtgattcataacatagcacaccagggtcggggccccgttgatgattttcgctacacggacttacctgaacactacatagaccttttcaaattatatgacccagttggaggtgagcacttcaatatctttgcagccggtttaaaggcagctgaccggattgtcactgtgagtcatggatatgcatgggagattaaaacttccgaaggtggttggggtttgcatgggatcatatatgagaatgactggaaattgagaggaattgtgaatggaattgacacgaaagattggaaccccaagtttgatgtccacttgaaatcagatggatacactaactacacccttgagaccctgcaaagtggcaagcgtcggtgcaaagccgccttgcaaaaggagctcggttttcctgtccgtgaggacgttccgttactcggattcattgggaggctggatcaacagaaaggcattgatctcatagccgaatcaattccttggatagtgagccaggatgtgcagctagtcatgttgggaactggaaggccggacttagaagacatgcttaggcagtttgagtcccaacaccgtgacaaagtcagaggatgggttggcttttctgtcaagatggcgcaccggataacagcaggtgcagatatactgctcatgccatcaagatttgagccgtgtggattgaatcaactctatgcgatgaattatggaacaattccagttgtacatgctgtcggtggactgagggacactgtgaagccttttaatccgtttgaagagtcaggccttggatggacatttgacagtgcagaaactaacaagttaataaacgcgatagggaactgcttgttgaccttcaggcagtataagcagagctgggaagggcttcaacggcgagggatgacgcaggatcttagttgggacaatgctgctcagcagtatgaggaggttcttgttgctgctaagtaccaatggtaa

SEQ ID NO: 62551 - DNA, 516 bp, Glycine max
  Peptide Sequence Number=SeqID_179329
atggtgtttttcctaagctacacgaaagcaaaggctgaaaatgctcaagtgaggaatggtctcggacacggaaacgttgcgcacactccagacatcttctcaaagatcccaacggtcagatcgtggacaaggtgttacagaaggtatctactcgctcagacgagttgcttgcttagggatgaagttacatctccagctcgcccggacgaatttaggccaagcttgagaaggacttgcaaaaacaatatgatgaggatctgtataaagaggagatgctttggtttcaaaaatccagagacaaataggataaggaatagaattactgctcaaatgatagatagtgtgtggtgctcaaatgatgatattctaaaaagaaaggcccaaaaattctacaagaatctttttcagctagatgagcctagtgatccagggagtctcactttgtcaactattcctaggattggtcaacctttgtttgaagctcttatcaagactgtttctttggatgaagtgtga

SEQ ID NO: 62552 - DNA, 2349 bp, Glycine max
  Peptide Sequence Number=SeqID_179330
atggccaagtccagagaagcagcagccagaagtgtaaggaagactgcaaatgcacgccaaagatggaaagatgcaaaagatgctactaagaagggtgcaagtggactgcaagctcaactatcgcaaacattttctcgaaaaaaggacttcgtagaccctgaagaaattaaaattttgaatcaaccaactactgaaacagatattgaattgttttcacattcacatcctattacctcaaatatggttggtagttcatcagcttggccaaaggaaaagggaaaagaacccaatgatctgatgcagatgatacatgaaacaaaaaatgatccaaatattaggaacaacattcgtgtagaaatagaaactagagataaaaatgttacagcaagagtgcctaaagaaaagcaactgcatacacatagccaaatttttaagtatgcatatgctcaacttgagaaagagaaggctcagcaacaagaaaacaagaaccttaccttctcaggagtaattagtatggctaccagaagtgaacaaaggaaaaggcctttaattgaaatatctttcaaagatctaactctcactttgaaagcatacaataaacatatattgagatctgttactgggaaaattaaacctggccgcatcactgctgtcatgggtccatcaggtgcgggcaagacaacttttctttcagcaatagctgggaaggcatttggatgcaaggtgactggttccatttttataaatggaaagaatgaatcaatccactcctataagaaaattattggctttgtgccacaagatgatatagttcatggaaacctgacggtggaagaaaatttccggttcagtgcactgtgcaggctatctgctgacttgccaaaaccagacaaagttctgattgttgaaagagttattgaattcttagggcttcaatctgtacggaatcatttggttggaactgtagaaaagcgagggatatctggaggccaaaggaagcgtgtaaatgttggattggaaatggtcatggaaccttcactcatgatcttggatgaacccacgtctgggttggacagtgcatcatctcaactccttcttagagcactaagacgtgaagctcttgaaggagtgaacatttgcatggtggttcaccaacccagaaagtttagagccagggtagcccagaaaatcaaagcaatatttcaaggctgtataattcaggttttgggctatgctttggttcagatgtttgatgacttgatactcctggcaaaaggtggtcttactgtatatcatggatcagtcaagaaagtcgaaaaatactttgcagaccttgggataaatattccaaagcgcattaatcctccagattacttcattgacattttggagggcatagaagtacctagtggaagttcaggagtcagttataaagagctgccagttagatggatgcttcataatggataccctgtgcctcttgatatgcagcagaatgcagcacaatttgatatgtatgcaactgtaaacccagctaaagaaacagatcccgatagctctggccatgaagaaagaagctttgttggagaattatgggatgatgtgagaaatggtatggaactaaagagggagaaaataagactcaactttttaaaatcaaaggatttctctgaccgcaaaactcctggtatattcaagcaatacaaatacttccttatacgggttggtaaacagcgattacgagaggctaagatccaagctatagattatttaatattattacttgctggagcctgcttaggagcacttactaaagcaagtgatcagacctttggtgcagctggatacacctatacggtgattgctgtatctcttctatgcaaaatagctgccttgagatctttttctctggataaattacactactggagggagagtgattctggcatgagcagcttggcatactttctctctaaagacacaattgatcatttcaatacagtgatcaaacctgttgtttacctctcaatgttctatttctttacctatccaagatcgacttttgcagataattacattgtgctgctttgtcttgtatattgtgtgaccggcgtagcatatgcattcgcaatactctttgaacctggcgcagcccagctgtggtcagtacttcttccagttgttttcacactcattgcaacacaaacaaaagatagtaaatttttgaaggatatagcttatttgtgctactctaggtgggctttagaagcgttcataattgcaaatgctgaaagagaagtaagcaaggttgctacatctccttgggtgagagtatactctgcaaaataa

SEQ ID NO: 62553 - DNA, 279 bp, Glycine max
  Peptide Sequence Number=SeqID_179331
atgctttttgtcaatcttaaaaagtgcagtttatggaaaacagaagtggagtacttgggtcatatgattttatacaaagaggtttctatggactgtaagaaggttgaagcaattctgaaatggccaatctctaagacagtaaaggctttgagaggtttattgggactagctggagctgatgggtctagttctagccatccaacagtggagactttacctgataggaagaaagttcacggtttatacagatcagagaaagttcatggtttatacagataa

SEQ ID NO: 62554 - DNA, 666 bp, Glycine max
  Peptide Sequence Number=SeqID_179332
atggcggcagccaataaggtggctaatgctttgtcaaggatggatgaggaaaaggagttgcaaggactctattataaagggaagcttgtgttgacagctaattcagaatggattccaaagttgctacaggaatttcattcctctctgtcaggagggcattcgggagtttatctaggagcagcaaggtgtacaccatttgaagtggtgtatgggagggctcctccttccttggcaagatttattctaggagaagtgctagcagaagctgtagcacaagacttgatggagagggatgaggccttgaaacaactgaaatttcatttggggagggctcaagaccatatgactaaatatgctaatgctcataaggtatcctccaagataaaggtggggggttgggtaaatctgaagatttggccacatacagaaacttcaatgcctactaggttgcatcctaagttggcaaccagttgcttttcaattacaactgccagcataggccagaattcacctggtatttatgtgtctcaactcaaattggcaataggagaacattcagtagaggcagagcttcccacaaaattgcaagggcattccactaaactgcagccataccaggtgctggggactagagtgattgaacaagaaggggaacaagtacagtag

SEQ ID NO: 62555 - DNA, 363 bp, Glycine max
  Peptide Sequence Number=SeqID_179333
atggctggtacgttctttcttttgaaaaagcaaaatagtttagagattatgagcagtgagaaagaaatgactccgaacagagttgtgaactggccattcaggactctgtatgcggggcgagaaagtcaccagcgcacaggattttggttggcaatcaaagggaaaggaccacttcaagtcgtggcgagggcgtccagccctctgaaggcgaggacgtgtagcgctctaaaggtgaggacgtgtagtcctttgaaggtaaggacgtgtagtcctctgatggcgagggcgtgtagccctctgaaggcgagggcgtgtagccttcttaaggtgagggtactagtacctaagggtccacccatatga

SEQ ID NO: 62556 - DNA, 349 bp, Glycine max
  Peptide Sequence Number=SeqID_179334
atggagagcaccaagggatgggatctctctatggacaacatcattagagacatagaaaatggagtaactactagacactctttgaatttgttttctgagcatattgcatttgtgtctcaagcagaatccttgtctatagaagaggcagtcaaagatgagttttggataatgtacatgcatgagaagttgaaccaatttaaaagaaatgatgtaagggaattgaaaccttattctaaaaacatgaacatcgtggacattaaatgggtatttaaatataaattggatggacatggtttgatcactaggaatgaggctaggctattagccaagggctataaccaacaattgg

SEQ ID NO: 62557 - DNA, 531 bp, Glycine max
  Peptide Sequence Number=SeqID_179335
atggagatgaaggacaccttttaccctaaccttgtgaaggtgttctacaccactactcatatggatggcgaggcaaggatgattacaaatgaaaatggactcaaggatgttagggtcaagttcaacaggctgtctacttacaacaatctaatgaagaatccatcacaggcacccaagggaaaagcaaaggatagatatgggtttggggcattgaaaatggaagcaatgctattagcttatgttaatgtcgtcatggacaacattctgaagaacaagaggattgggaccattaggtgtccctatgttgtgatcatctcaaggatcctagaccacttcaaagtggacgtgacaaatgagactgaagattttgtggagcttgagtttgagttgaagcataagcctaaggaagctacagctgaagacaatgaagaaaatcctatgagcccttttgagattataatgatggctaagacggataagctaatgagggttcataaggaggactatggagagctaaaggattgcttttag

SEQ ID NO: 62558 - DNA, 423 bp, Glycine max
  Peptide Sequence Number=SeqID_179336
atggacatgcctagaatggctgaagaaaaagcgaaagacaaaaaaagtataggactatctctcaaatccgccataccaactagtgatgatagtgaagaagaagatgtagaaggatcagaggctgaaaatctaactttgtttaaacaacaaaatggagagaagaagtctaggagtcacaacaagaagaatacgacctatatagcatgggaggaaaatgcttcaagcacttcaagtggaagtagtgatgaggaggaagcaaatttgtgcctcatggccaatgaagaagttgatagctatgtaagtgcatttgattctgaatccgatgagaattatgatcaactttttgatgcttttaatgaaatgcatgaggaagcacaaaagttgtctattgctaataacttccttaaaggaaagctaaggtga

SEQ ID NO: 62559 - DNA, 321 bp, Glycine max
  Peptide Sequence Number=SeqID_179337
atgttggtggcgagtccactcgttttctccctaggagacgaacactttggcttattcattttgcttttgtcgtcccatcgtgagggagtggaggttgatctgtggtcatgttgggtctccgactcacttgataatagtgaagcctcatctagagttttctgcttttggggcacagagtgtcgtaacctacccttcggcgggagggcaaagcgagggctcacgggtgcatctcccatgggaggaagatgcacggagttgccaccaacgcttattcgaggaaaacgtcaaaaaaaccggaaaggtgtggtctacgaactttaa

SEQ ID NO: 62560 - DNA, 705 bp, Glycine max
  Peptide Sequence Number=SeqID_179338
atggcgaattcaatttgttctgcggatttcggttcgaaatcgagacaaatcaatcaccttcagaagaatcggagaacccctagttcatcatcatcatcatcatcatcatcgaattcccttcagattccaccctgtgatcgatctcgatcggcaatggttgatgttgtgatgttcattgctgttgtttgtgcctgtggctttttgttcttcccttatgtagagtttttggtgacaaagtgttacgaggttattaagggtgttgtgtttttgattaaggaggaggtttctgtggcaccttggatctatatttccatagggttgagtgttgtgtttgctgcattggccacgtgggctgtggtggcttgcaccactaggaagtgtgggaatcccagttgcaagggtctgaggaaggctgctgagtttgacattcagttggagactgaggattgtgtgaagaatttggcttctgcgtcgtcgaatgtagcgaaagatggtggtggtggaacgaagaagggtctctttgaattgcctcgtgatcaccatagggagctggaggctgagctcaagaagatggcaccaccaaatggaagggctgtgctcgtgctccgggcgaggtgtggatgttctgttggtaggcagactcttctagtagaggatgtccggaatgttacctgtggaaaaggttgctcaagctcaagcatatga

SEQ ID NO: 62561 - DNA, 360 bp, Glycine max
  Peptide Sequence Number=SeqID_179339
atggcgatacaagcggaggaaaagaaggttgttgagattgataagaagaagggcaagagtgaggctaacatagaaaagaagaaagaggctactcctattgaatgcaaggagaaactagaaattactttgccatttggagaagcacttcagcaaatgcccctctatgccaaattttttaaggatatgctaactaagaagaactggtacatccatagtgacaaaattgttgtggaaggtaattgtagtgttgtgattcaacgcaattttccacccaagcacaaagatcctggagttgtcacgataccgtgttctattagtgaggttgttgtaggcaagacttgtgagctagtatcaatttaa

SEQ ID NO: 62562 - DNA, 876 bp, Glycine max
  Peptide Sequence Number=SeqID_179340
atggaagatcttaacgtcgttgacggcattaacaatgcaggtggctggctggtgcgcaaccaggcgctgatcctcagctatgcggtgaacatcgtggcggctatcgccatcattattgtcgggatgattatcgcgcgcgtggtatcgaacggcgtcaatcgcctgctggtcgcgcgtcatattgatgccaccgtggctgatttcctctcggcgctggtgcgctacggtatcattgccttcacgattattgccgcgctgggccgtgtcggcgtgcagactgcctcggtgatcgcggtgctcggtgctgccggtctggccgtcggtctggcactgcagggatcgctctccaacctggcggcaggcgtgctgctggtgaccttccgtccattccgcaccggtgagttcgtcgatctcggtggcgtaatggggaccgtacagaatgtacagatcttctcgaccacgctgaaaaccgctgacggcaaaatcgtggtggtgccaaacggcaaaatcatcgctggcaacatcgttaacttttcgcgcgaacctatccgccgcaacgagttcattattggcgtcgcctacgatgcggatgtcgatcaggtgatcgagctgctgcgtgaagtggtggaagctgacgagcgcgtgctgaaagatctgggtattcagattggcctgaacgaactggcggcttcgtcgctgaactttgtggtgcgctgctggagcaaaagcggtgatctgcagaacgtctactgggatctgatgaagaacttcaagcgcacgctagatgcgcacggtatcggtattccttatccgcagatggacgtgcacctgcatcaggtgcagagcgaggcgcagcagcctgcgcgcagcgagtaa

SEQ ID NO: 62563 - DNA, 240 bp, Glycine max
  Peptide Sequence Number=SeqID_179341
atggcttgtcggtcatggacctattactttgcttacctttggctttggacttggtcgcctattggtcggccatgggtgaactctagaggtgatggcggtgcgtctgttgcccgctgtcggccatccccaggctgttatggtgtttcgccctgcgcctgcctggggacgcagtacttcttgatgaaagctggattagtagggggcctgatgaccttgctgggggcgacaggcactccgtag

SEQ ID NO: 62564 - DNA, 136 bp, Glycine max
  Peptide Sequence Number=SeqID_179342
gctaacgacggtgctgaatgtgttgaagaataaagatgctgtgagcaatttgcagaactgcagctatggggatggtggtgaagctacaactgaggaggtgaaaaagagttaccatgttttgagaaaaatagagtga

SEQ ID NO: 62565 - DNA, 483 bp, Glycine max
  Peptide Sequence Number=SeqID_179343
atgggcaatgtggtgatgcagattactttgcagtctattggtgaaactctaggaggatgtcgtgtcacccaatttggttattctattcggttggagaagttgatgaattttgctgaaggagttaatttccttttggcctacacttgcatgtggaattaccacaaaaagttaatctcacaaatggcaccacctctgcatacttttatctcgagctctgactctgaggctgagaatgatgtaggtgcactaagttcaaaaaatcatgttgaacttcttgaggatgtcataaaaccactttctaaatcgaaagttgatgctgataaagaggttgatgtttctagtggggaatgtaaggcattaggacaaagcaatatttggcctatgctgcaatatttgttcctggcctgtactgtgctaggcaactcttcatctaaaggaatgttcatagactcttgctatgcctattgccaaactgaaatgtag

SEQ ID NO: 62566 - DNA, 765 bp, Glycine max
  Peptide Sequence Number=SeqID_179344
atgtcagcacctaagaatgggttgctggtgaagagccttataccgactgcatataatgtgtataatgctactaggatcactttgatcaacaatctgaagaagctgctcaaagtggtgcctgtgcatgcttgtgggtggtgcagtgaaatccatttaggatctgttggacattcattcaagtcatcctatcacctctttgatcgtcttggaaaacggattactcatgaagagagattctctatccctcgaattccagcagtggttgagctccgcattcaagccagtgttgaaattccagagtttcccaccaaaaggagaagaaagcctatcatccgtatttggaggaaggaattcattgatgctgatgaaagaaactctccaagcatggaacgggtgaggaaaggtgcgaagagactaatgaggatgtacaatgtgagggtgtgtggatattgccctgaaattcatgttggtgcccagggtctcaaagctaaaaactgtgaagcccataaacaccaacaacgcaatgggcagcatggttggcagtctgcagttctggatgatttgatccctccaagatttgtatggcatgttcctgatgtaaatgcactgctagaacgagagcttaggaattcttatggccaggcgcatgtagaagtggaaatgtgcattcaggctggtgctgccttaccagaacagtataaatcgaccatgcggctggatgtggggatcccatcaactttgaaagaagctgacatggtagtttga

SEQ ID NO: 62567 - DNA, 330 bp, Glycine max
  Peptide Sequence Number=SeqID_179345
atgtgtagtgatgtgtggtggctgaggttgaagacgaaggttcttccacgagaagaaccttcttccgcgcgtgtggaaggggaagttggatattgtagcggaagaaggagttcttccgcgggctcctgcagaagaaaggtgaaacagttcttccgcgggtttcggcggaagaaggcgaagaaggttcatctgctggatccagcggaagaaggttccgcaggttcttccgtggaactttcactctctcttttcggattaacaatgcacgtagggacaacccttcccttgtgttcaagaatcctctactacaagagacccacggtctcttaa

SEQ ID NO: 62568 - DNA, 229 bp, Glycine max
  Peptide Sequence Number=SeqID_179346
atgttgatccgtacgaacgcacaaaagaaaaacgaaaacgcagccattaatggagacgcgaagcttacctcagcggtggaacaacaaaacggagctgcaggtcctcaatgccgacaacgaaccacccaatgcgtggcaaatgaacctccaaggaaaggaaataacgccaagaggagaagaagctcgaacgtcgtcgcgaaaacaaccaaacaacgcaggaaagagaaat

SEQ ID NO: 62569 - DNA, 245 bp, Glycine max
  Peptide Sequence Number=SeqID_179347
atggttagaactagagggttaggtcgtgccttaggcatggttataggtagagccctgggaaaagaggatcatcatcattcaaatgatgttctccagcgacgaaggcctacaacattcgcacgtaggcaacggaaagttgctcctattgctggggatgctcctgacgtgactgaagacgtacatgcacatgctaaaaaagttgttgatgatgctaagagatttcagtcatcgtatggaatggcgag

SEQ ID NO: 62570 - DNA, 459 bp, Glycine max
  Peptide Sequence Number=SeqID_179348
atgactccttcacttcctatgactcctttttcaatggctcttgcttttactgttgataagaaaaacccctcacggaatccccctacagccttttcctcctctaaaatttctaaattctcctccttgcatgcaagacatagccacgctcaagcatccaagaggcaccacactgctgattcttcatcttcttgctttgcatctcacggttctcagccttttctgccatggctcctagcacgccctcgatcccgattctacgagtgttcgtcacaggcttcttttttatgggtcatacgtgtcgaacggacactcgtgctgcaagttacgttaatcgcaagttcaaaaggcaaagaaatgccaaggggacttaagaatggccctcacatggctttggagtctgagggtagggtggctaatagatctaacctacaggccacaggaaagtcaagaaatggataa

SEQ ID NO: 62571 - DNA, 2331 bp, Glycine max
  Peptide Sequence Number=SeqID_179349
atgcagctccctttgttagtcaaatatcaattagcagcaatcatcttcattataatatccctaaccaaagttacctgcttatctttcaatttctctaccttcgaaagaaaggatgaagatcatttattgctgaacaacaattcaaagatattctcatcagccatccaagtgaccccagatacgcgtgcacaatcaatacataattattctggacgtgctttctacaacaagccatacaaactttggagccagaagaagaaccaaactgcttccttcaacaccacttttgtgctcaacatcgacccccaaactacccctgcaggtggagaaggcttggccttcatcttaacttcagataccaatctcccagaaaacagttcaggagaatggcttggtattgtaaatgctacttccaatggaacttcacaagctgggattctagcagtggagtttgacacaagaaacagtttctcacaagatggccctgacaaccatgttggcatcaacataaacagcatcaattccatcaaacaggctccattaatcaacactcgggtcaacctttcatcaggtgaacatgtcaaaattcacattcagtacttcaatgacacattatcagtttttggtgccatggatggagcttcagaagaatctatggagacccttttggtatctccacctcttaatttatctaactatcttcaagaagaggtttaccttggtttctcagcctcaacaagtaactacacgcagctgaactgtgtaagatcatgggaattcagtggtgttgatattgctgatgatgataataaaagcctcttgtgggtttatatcactgttccgatagtgattgttatcatcatcataggaggaatggtggtctttttcttgtattggcaaaggaagcgccatatggaaatgccagaagatgcatatcccaggatagaggaccaaattcaatattcctctatggctccaaagaagtttgagctaaggaaaataacaaaagcaacaggtgaattcagccctcaaaacaagcttggagaaggtggattcggaactgtgtacaaggggctattggacaataaagaggtagctgtgaagagagtctctaagaactcacgccaagggaagcaagaatttgtggcagaagtgacaacaattggaagccttcaccacaggaatttggtgaaactcacgggttggtgctatgagaaaagagagcttctccttgtgtatgagttcatgcctaaaggaagcctagacaagtacctctttggtgacaaaatttttggtaacaacacccttgaagaggggtgttcttcaacactgacttgggaaacaaggcacagtgtgattcatggtgtggctcaagcattagactatctccacaatgggtgtgaaaagagggttcttcacagagacatcaaggccagcaacataatgttggactcagactacaatgccaagttgggagactttggattggcaagaaccattcagcagagaaatgaaacacaccactctacaaaggagattgcagggacaccagggtacatggctccagagacctttctcacaggaagagcaacagtggagacagatgtgtatgcatttggggttcttgtgttggaggttgtgtgtggaaggaggccagggagtgtgtatgcacaagatgactacaaaaacagcattgtgtattgggtttgggacttatatgggaaggagaaagtagttggtgctgtggatgcaaggctgaagaaggaggagattaaagaggaagaagtggagtgtgttcttgttcttggcttggcgtgttgccatccaaacccacaccataggccatccatgagaactgttcttcaggttctgaatggggaagcacccccacctgaggtgcctatggaaagaccagttttcatgtggcctgctatgcctccatcattcaaagaagctgaagataactccctcatccaggcgcgcaaccttttcgctttctctctcttgttgggcagcacacttcgctccttcactactcataatttcaaaatccctaaaacactcaccctaatccatcatttacgctccattctcctcaaatctataccaacaatcggaaaaatcgtcaacaacaaccaatccgccccctacggcaccacgtcgcgcgccctatgccgcaacctcacctccgagatgctccacccctcatgcgtcagctcagagtttgggttgaacgcactttatgactccgtgaatggcggaggtgatgtttggattaacgaaaactgcttccgcatcgtgcgccagctcggagaaggtggcttcgcctag

SEQ ID NO: 62572 - DNA, 999 bp, Glycine max
  Peptide Sequence Number=SeqID_179350
atgctcgagacagttaaataccttctcggttcggccggtccaagcggcttcggctccaaaactaccgccgaacaagtcacggaaaaccacgccgatctccgctccatcaccgccattatcaccggtgctacgtctggaatcggaactgaaacggcgcgtgtgctagcgaagcgtggtgccaggctggttctgccggcgcgtagcatgaaagctgcggaagacgcgaaagcgcgcatagtgtcagagtgtcctgattcagagatcatcgttatggctcttgatcttagttctctcaattcggttactaacttcgttgctcactttcactctctcggtttgcctctccatctcctaataaacaatgctggaaagtttgcacatgaacatgctatatctgaagatggcgttgaaatgaccttcgccactaattatctgggtcattttgtgatgacaaatttgttggtgaaaaagatggtggaaacggcgaaggagacaggagtgcagggtaggatagtgaacgtgtcgtcgagcatccacgggtggttttccggcgatgcgatttcatatctggctcttataagccgcaacaaaaggcattacgacgccacacgtgcttatgctctttccaagctcgccaacgttttccacaccaaggagcttgcccgtagactccagcaaatgggggccaacgtcactgtgaattgtgttcatcctgggatcgtgagaaccagactcactagagagcgtgagggtttactcacagatttggtgttctttttggcttccaagctcttgaagaccattcctcaggcagctgctaccacatgttatgtggccactcatccaaggctcttgaatgtctccggcaagtactttgctgactgtaacgaaacttcaacctcaaaattgggatccaactcaactgaagctgcaagctgtacttctatatctggggataatacaaaactatacgagaaagttccattggagttattataa

SEQ ID NO: 62573 - DNA, 252 bp, Glycine max
  Peptide Sequence Number=SeqID_179351
atgaaagagcggcaatcattgaagaatgctttcactcaaatgacgccactcaataatgaaaacaagcgaaatgtgcttatggggtctttattatatactaatagccaccctataatgagagacaaattgaagagaaagccacttttaggtgccactaaacaagctctaactgaggtagtatcatccctccttaatcccaataatcattttttaactccatggagtaatcaccgaccatataattgtgtctaa

SEQ ID NO: 62574 - DNA, 597 bp, Glycine max
  Peptide Sequence Number=SeqID_179352
atgtcaaatgctaagcatatggtgcaagatttgcactcaataatgcttgattatttcttacaagtgagtagggcagtaatacatcctctttcttatcagcaggctagaaacttctatttccattgtgggcttgtttatgtggctgaaccaggacttgtttatctgtatctatatacacttataggtggtaaaaataagctcaaagttgacaaatgcttctcaactcctggaatggcacctaatcttggaaagataacacaatatcttagaaagcgaagactgatgccagataagaaagttagttcatcaacatttgttgccatttgtttcaagtatgagcataaatggggattgtatctaggaaatatcactatagtgatatctataaatagttattcaacatttaacatcggtgctgacgtaagcaccaatgtagaaattacatatttctacattagtgcttacgtcaacaccgatgttgaaacacatatttattacatcgttcaaaagaagcagtggatagatgaacactatgaaacactcccaatcctagaagataacaagcttgaggcgactaagatgagatatctcttgtga

SEQ ID NO: 62575 - DNA, 555 bp, Glycine max
  Peptide Sequence Number=SeqID_179353
atgtatggtttcactattcaatatactcaccttccttgccttcaagtaggaaaccaaaagaaggctaactatttacctatggaggcctgcaaaattgttgaggggcaacgttatacaaaaagattgaatgagaagcaaattacagctctgttgaaagttacttgccagagacctcgcgatcgggaaaatgacattttacggaccgttcaacataatgcttatgatcaagatccttatgcaaaggaatttggaattaaaatcagtgaaaagctagcttctgttgaagcacgaattcttccggccccttggcttaaatatcacgaaagtgggaaagagaagaactgtttaccccaagttggtcagtggaatatgatgaacaaggaatttaatccagagtctgttattcccatctacaatgccaaacctgaacaggtggaaaaagctttgaaacatgtttaccatgtgtcagggagcaaaattaaaggaaaggaattggagcttttgttagcaatattgccagacaataacgggtctctctatgcacaaggccaataa

SEQ ID NO: 62576 - DNA, 2088 bp, Glycine max
  Peptide Sequence Number=SeqID_179354
atgtgcggtgtttccaaggggaaaccttctcaaattgatttgatcatggaggagaagtatgcaaaagaagggatgcatcataagatttctgctttgcttgagttttcagcgacggatgatctaattggtttcaaagatgctgtggaaaaggagggtcatgatgttgatggggtggggttttggtatggaaggcgtgttggctcgaagaaaataggttatgaagagaggacacctctcatggttgcttccatgtttggaagccttgatgtatcaacttatattcttggaatgggttgtatcgatgttaatcgggctagtaggtcagatggggctactgctcttcattgtgctgttgctgggggttctgccgcttccgttgaggttgtcaagcttttgcttgatgcatctgctgatgttagtgctgttgacgccaatggtaaccggtcaattgacttgattgtctctgtggctaattctatcttcaatcaaaggtcaagtgtgctacaggccctcctggagggtacaagtgatgctgatcaggcatgtctctcacttccggaagtgattgaccaacttgaggaacaaaggcaagatatgaccacaccccgtgtttcaaaagactatcctattgatctctcccttccagacataaagaatgggatatatggtactgatgagtttaggatgtatacattcaaagtgaagccttgttcgagggcgtattctcatgattggacagagtgcccctttgttcatccaggggaaaatgcaaggcggcgtgatccaaggaagtatcattacagctgcgtcccttgtcccgagtttaggaagggatcttgcagcaagggcgatgcctgtgagtatgcacatggcatttttgagtgctggcttcaccctgcccagtaccggactcggctttgcaaggatgagggtggatgcacaaggagggtatgcttctttgctcacaagcttgaggagcttcgccccttgtatgcttctactggttctgctattccttccccgaggtcctattcagctagtgcttctgcattggagatgggttcagttaacccaattgcacttggttctccatctgtcttgatgccacctacctcaacaccacctttgactccatctggagcatcttctcccattgctggatccatgtggtctcaatctaatgtttcggtccctaccttgcagctgcccaaaagcagattgaagactgcatctactgtaagagatactgatttagatatggaactgcttggacttgaaacacattggcgtagacaacagctaatgatggatgagatatctgctctttcctctcccaactggaaaaattccatgcctaatagtccatcttttcgtgttcctttgaatgatcacactggggagttaaataggctttcaggggtgaagcctgctaaccttgaagatatgtttggatcgctcgatccatcaattttgtctaaataccatggaatctcacttgatgttgcaggacctcagttacagtctccaaccggaatccagatgcgccagaatgtgaaccagcagctaggaggctattcatccagcctttccactttgaatgtgattggatcgcggtccttcaggcttgatcagtctggcgaagcagcctcggtggccttgaatccaagagttgctgcctttgcaaagcggagccagagcttcattgagcgcggcgtggtgaaccatcattctgaacttccttctccaaagccctctaccttctctaactggggctcacctgttggaaaattagattgggccgtaaatggagaagagctgaataagctgaggaaatctgcttcctttggatttcgaggcagcgacactcctctaacaaagacttcaaccaaaatgtcagcaaatgttgatgatgagccagatgtgtcttgggttaactcacttgtgaaggatgctccaccggaatccggtgaatctggtgaatacagtgtggaagatcagcgaaagctactgcaatgccacaatggaacagatgcgattccagcatggttggagcaattgtacttggaccaggagcaaatggtggcatga

SEQ ID NO: 62577 - DNA, 1605 bp, Glycine max
  Peptide Sequence Number=SeqID_179355
atggcaaaaaaaggtgggaaacattgggagccgatgaaagtggagagaaaggaatctgattcgtcggaaatgaatgtaatgtttgcgttaacacggaaagactcaaagtattcctgtggatgcacagtgcagactgaacaaacaaacaaagcgaagatccctatgaatattgtttcgatttctggatcaagctccaattttgaacaagacccagaggtgggaattggggaaaggtgggatatggaagaggaagaggatcaattctacgaaactcgtgaggaattgtgttctgtgtctgatgggggttcggattgttctgaatcagatgaatctagttctggtaataacggacatgttactaggtaccaggtttgggcacaaaaccttgaaagtgttcaccagagacgcctcaatttcctgagatggatgggtttggagtctgatttgaattattcaatgaagggggaggagttgggagatcaaccttgtgggattgaccgaatcactgcaacaagtggggcagtgctgagaacttcttttgctattgaggagggtcttccctcaacctcaaaccagattgtgttggattccttgtctgatgaggcctccggctcgcaagaaaatcgtgaaaatttggcgtgtatgataaggaatttggatgatggaacggagtatattgtggataagctgggtcaggatggagctcctagcacactgcgtgttttgggttcgaaccaattgattagcttagaggagtttcagaaaaatattgggccatcgtcgttcattcgcagacatttgcagagagacactgaaaacacaaggttgttgggagttgggaaaaggaaaatgaagaggggttggctaaggaaactggattctattgcttgttttgttcataatcatgggtttgatgaaactaaatgcaaagactgtgattcagtggataggagtgggatacaaagagttcgagttcattcgtataggaagcggtttaaggagctttcctccctttacaccgaacaggagtttaaagcacataaaggtgttattttgacaatgaagttcagtcttgatggaaaatatctggctagtggtggtgaagatggtatgaagttagttaaaacagagaagttgaggagatcatctgaagcaacctgtgtgattgtcccaccaaagaccttccgcatatcagcaaaacctttgcatgagttccaagggcacagtagtgacattatagaccttgcttggtccaaaagagggtttctactgtcatcctctgttgataagacagtgcgcctatggcatgtaggaatcgacagatgtcttagagttttctaccacaataattatgttacatgtgtcaatttcaatcctgtcaatgataattttttcatcagtggttcaattgatggaaaagtgcgcatatgggaagttgttcactgtagggttagtgattacattgatatcagagagatagtcacagctgtgtgcttccgccctgatggaaagaaaaatatcttttgttttgttcctaaagtttgtttactcattcttccagggcacaattgtgggtaccatggcaggcaattgccgtttctatga

SEQ ID NO: 62578 - DNA, 1200 bp, Glycine max
  Peptide Sequence Number=SeqID_179356
atgggcaaggatggatcaccaaaacattatagtcagtttgattcaaagagaaaccgtatgacatggattttaggagttagtggactatgcattctatcttacataatgggtgcatggaagaacactccatcacccaatagccaatctgagatcttctcaaaagtggattgcaatattggttcaacttcagcaggcatgtcatcttcttcagcaactgaatcatcatcaactaatttaaattttgatagtcaccatcaaattgacatcaataattctggaggggcacaagagttcccatcatgtgacatgtcatttagtgaatacacgccgtgccaagatcccgttagaggtcgcaaattcgatcgaaacatgttgaagtatagggagaggcattgcccagccaagaatgaactactaaactgtctcatacctgctccaccaaaatacaagactccttttaaatggcctcaaagcagagattatgcttggtatgacaatattccacacaaagagcttagcattgagaaagctattcaaaactggattcaagttgaaggtgacagattcagattccctggaggaggtacaatgtttccacgtggagctgatgcatacattgacgacattaatgagcttattcccctcacaagtggtactatcagaactgcaattgatactggttgtggtgttgcgagttggggtgcttaccttttgagaagagacatcctagctatgtcttttgcaccaagagatacacatgaagcacaggtccagtttgcgttggaaagaggagttccagcaatgattggcatcatggcttcacagaggattccatacccagcaagggcgtttgatatggctcattgttctcgctgcttgataccttggcacaaacttgatggtttgtatttgattgaagtggatagagttctgaggccaggtggctattggattctctctggcccaccaattagatggaagaaatactggagggggtgggaaaggactgaagaggatttgaagcaagagcaagacgctattgaagaagtggccaaacgcatatgttggacaaaagtagttgagaaggatgacctctccatttggcaaaagcctaaaaaccatgttggatgtgcacaaactaaacagatttacaaaacaccacacatgtgtcaatccgacaatcctgacatggcttggtaa

SEQ ID NO: 62579 - DNA, 489 bp, Glycine max
  Peptide Sequence Number=SeqID_179357
atggcttggaaatcatgtggaaagaactggaatcttttcatttttttgactttgctaactttctggtggatcttgggtgtgccctcagggtttataggagtaaagggaaaggagatgatccagcataggccttacacacaaaaagtggatgtatatagctttgggattgttctatgggaactcattaccggtatgcttccatttcagaacatgacagcagtacaggctgcatttgcagttgtcaacaaaaatgttcgtccaatcatacccaacgattgcctacctgttctccgtgacatcatgacaagatgctgggatcccaaccctgatgttaggccaccatttgctgaaattgtaggaatgcttgagaatgcagagaatgagatcatgacaacagttcggaaggcccggttcagttgcaccacaactaccccggggattgacatactgcctggtttggttcaactggggcttaaatttagcaagtaa

SEQ ID NO: 62580 - DNA, 231 bp, Glycine max
  Peptide Sequence Number=SeqID_179358
atgcccactactttcagccagctcaacactttccgttatcagctatacatagttcccgaggtgctttggtggacctattttccttttgagcctcagcaagcctgtttcttccttctgtatcagtgggtttacaagacggataattcaactcatgaaactactagtgggtatacaataatatttgaaaataaaaattattgcccccatatagatgttgcactcaaaagataa

SEQ ID NO: 62581 - DNA, 150 bp, Glycine max
  Peptide Sequence Number=SeqID_179359
atgaaagaacgtagagctgttaatgggacaggcacaccaagtggaccacgtaggcatttaataatacttacttggggcaatcgatcttctacggccatgtccattcacggtcatggcaccatccttagttcctttgctatcattcagtag

SEQ ID NO: 62582 - DNA, 840 bp, Glycine max
  Peptide Sequence Number=SeqID_179360
atggatggagaattagccacagaactcaccatcaaaaccatggacacattgagaaggatgagtcatgggttccagtatttaacagagaagatttacaagaatctagacagcatgacaagactcattagattcactgtgccatttccattgtttgtgtatccaatttatttgttttcaagaagccccggaaaggaaggctctcacttcaatccctacagcaatctgtttccacccagtgagagaaaaggaatagcaatatcaacactgtgttgggctaccatgttttctctgcttatctatctctcattcataactagtccacttctagtgctcaagctctatggaattccatattggatatttgttatgtggctggactttgtcacatacttgcatcaccatggtcaccaccagaaactgccttggtaccgcggcaaggaatggagttatttaagaggtggcctcaccactgtggatcgtgactatggttggatcaataacattcaccatgacattggcacccatgttatccaccatcttttcccccaaattcctcattatcacctcgttgaagcgctcactatactatactgggagcttggtggtgaaaggggttcccaaccctcctttctaggtgtacatgctttgatacttctgacacaagcagcaaaaccagttcttggagattactaccgtgagccagaaagatctgcgccattaccatttcatctaataaagtatttaattcagagtatgagacaagaccacttcgtaagtgacactggagatgttgtttattatcagactgattctctgctcctccactcgcaacgagactga

SEQ ID NO: 62583 - DNA, 333 bp, Glycine max
  Peptide Sequence Number=SeqID_179361
atgcccttgtgcaaatcaacgcaaaccaagacttctctgaaacacaaccactttccaagagaacgattacaaaaattaacaacaattaaagcaaaatcatcgattagaagccacagacccactagatacacatgccttgcacatcaaacccaaaagcaagcaaaattcaaagagaaatcgtcaaaaacagcacgcagtgagaccgaaacaccgacaaggcacaaacgaactccagaattaaaaaaagaaaaggaaaaaaagctaaaaatagaaattccgaaacctctaaaaccagcttcgcagtcaaatctcaagcgaatattcacgaactag

SEQ ID NO: 62584 - DNA, 1644 bp, Glycine max
  Peptide Sequence Number=SeqID_179362
atgactgactcgtcaggaacgacgctcatggatctgataaccgcggatcctactccggcgccgtcgtcgtcgtcgactgcgtccgcatcttcggcgccgacgccaccggcatctctgccctcggcgttcggtaagcctcctgcggagaagaaatcgaagagagccgcgctgatgcagatccagaacgataccatttctgctgccaaagctgctttgcatccagttaggaccaatatcatgccgcaaaggcaaaagaaaaagccagtttcctattcacaactcgctagaagtattcacgagctagctgccacttctgatcagaaaagttctcaacggcaattagtgcatcatgtgtttccaaagcttgcagtgtataattccgtggacccttcattggctccctctcttctcatgcttaatcaacagtgtgaagatagaagtgttctccgatacgtctattactaccttgccagaattttgtctgacactggtccccaaggtttgagcacaggtggtgggatacccacccctaactgggatgctctggctgatattgatgcagttggaggtgttactcgagctgatgttgtgccacgaatagtagagcagcttactgcagcagccacaaatgctgaaactgaatttcatgctcggagattgcaatccttgaaggcacttacatatgctccttcatccaactctgatgttttgtccagattgtttgaaattgtatttggcatactagagaaggttggtgatgctgagcaaaagcgaaagaaaggcatatttggggctaaaggtggcgataaagactctatcatccgaagcaatctacaatatgctgccttaagtgctctgagaagactccctctggatcctggaaatccagcatttctgcattatgctgtacaagggatttcatttgctgatccagttgctgtgaggcatgcactggaaattgtttctgagatagctacaagggatccttatgctgttgcaatggccttaggaaagcatgtgcagcctggaggggctttacaagatgttctccatttgcacgatgttctcgctagagtttctctagcgaagttatgttgtacaatatcaagggctagagctttagatgagagatcagatattagatctcagttcaattcagtgctctatcaacttctattggatcctagtgaaagagtctgttttgaggcaattttgtgtgtactaggaaaatatgataacactgagaggactgaggagcgtgcagctgggtggtatcgtttgaccagggaaattcttaagttaccagatgcatcatcaaaggaaagttctaaagataaacagaagaacaaacgtcctcaactgcttattaaacttgtaatgagaaggttagagagttctttccgtagcttttctagacctgtgcttcatgcagcagctagagttgtacaggagatggggaaaagtcgggctgctgcctttgctttgggcatacaagatgttgaagaaggagcacatgtcaatacatttgctgaggctactgattataatgattcagatgaaagcacacatcccgaaagtaatgcttactttatgtgtttaatggtgcatgcttgccataatatttttaggaaaattgatccttga

SEQ ID NO: 62585 - DNA, 1635 bp, Glycine max
  Peptide Sequence Number=SeqID_179363
atggagaagaacctcatgattctaccaagtaaaccatggcctcctctgtttataccttctcactgttccatccaattggagtggcatggctcaacaagggtccttgcaaactccaacagtgtctccataacccaaaggtcaaacccaaaattgatagatacccagttgaatcagctatgtgccaatggtcccctgagtgaggctgtggcaattcttgactctctggctcagcaagggtccaaggtgagacccattaccttcatgaacctgcttcaggcttgcattgataaagactgcattttggtgggtagggagttgcatgctaggattgggttggtgggaaaagtgaacccttttgtggagaccaagttggtcagcatgtatgccaagtgtgggcacttggatgaggcgtggaaggtgtttgatgaaatgcgtgagaggaatttgttcacttggtctgccatgattggtgcctgctccagagaccttaagtgggaggaagttgtgaagcttttttatgatatgatgcaacatggggttttgcctgatgagtttttgctcccaaaggttttgaaagcctgcgggaagtgcagggatattgagactgggaggttgatccattcggtggcgattcgggggggaatgtgctcttctttgcatgtgaacaattcaattctggctgtgtatgctaagtgtggggagatgagttgtgcagagaagttctttaggagaatggatgagaggaattgtatttcctggaatgtgattataaccgggtattgccagaggggtgagattgaacaagctcagaaatattttgatgcaatgcgggaggagggaatgaaaccaggattggtaacttggaacattttgattgccagttatagtcagttagggcattgtgatattgctatggatttaatcaggaagatggagagttttgggattactccagatgtatatacttggacatctatgatttctgggtttagtcaaaagggaaggataaatgaagcttttgatttgttgcgggatatgcttatagtaggggttgagcccaacagtatcacaattgctagtgcagcctcggcatgtgcgtcggtaaaatcactaagtatgggatcagaaatccattctattgctgttaagactagtttggttggtgatattctaattgctaattcactgattgacatgtatgctaagggtggcaatctggaagctgctcaaagcatttttgatgtgatgttacagagagatgtatattcttggaactcaattattggaggatattgccaagctggtttctgtggcaaagcccatgagttatttatgaaaatgcaggagtctgattcaccacctaatgttgttacatggaatgtgatgatcacaggatttatgcagaatggtgatgaggatgaggcgttgaatctttttcaaagaattgagaatgatgggaaaattaagccaaatgtagcatcatggaattcgttaatttctggtttcctgcagaatagacaaaaggacaaggccttgcagatatttcgacggatgcagttttccaacatggctcccaacttagttacagttctcactatccttcctgcctgtacaaacttagtggctgcaaagaaa

SEQ ID NO: 62586 - DNA, 1443 bp, Glycine max
  Peptide Sequence Number=SeqID_179364
atggtgatcaaggcattaatctggatgcaaggtccatttgactcatttgatgaactagaatttattattgcatcggaactttctgatccagcttggccagcagcactattgaatgatgtactactcactttgcatgctcgttttaaggcttctccagatatggctgttactcttcttgaaattgcaagaatatttgctaccaaagttccaggaaaggttgatgctgatgtgttacaactgctctggaagacttgtcttgttggagctggtcctgatggaaaacataaagctttagaagcagtcacaattgttcttgatctaccacctccacagccagggtcaatgcttggtcttacttcagtggacagggtgtctgcgtctgacccaaagtctgctcttgcattacaaagactagttcaagctgctgtatggtttcttggggaaaatgcaaattatgctgcttctgaatatgcttgggaatctgctaccccgcctggtactgcattgatgatgttagatgctgataaaatggttgctgctgctagttctcgtaatcctactctagctggtgccttgacaaggctccagaggtgcgcattcaatggcagctgggagattcgaattattgctgctcaagctcttacaacaatggcaattagatctggggaacctttcaggttacagatttatgagtttctgcacactttggcgcaaggtggtattcagtcacagttctctgatatgcatcttagtaatggagaagatcaaggagcaagtggtacaggccttggagttttattaagtcctatgataaaggttctggatgagatgtatagagcacaagatgatttgatcaatgccaaactcattgacatctatcgtacacgccacaatattagttcatctactggtttgagtgatccagctgttgccactggtatatctgatcttgtctatgaatcccaaccaccacctgctgagcctgatacacttgatgatgacctagtaaatgcttgggcagcaaaccttggtgatgatggcttatggggaaacaatgcaccagcaatgaatagggtaaatgaatttctggcaggtgctggaacagacgccccagaagttgatgaagagaatatgatctctaggccttcagttagctatgatgatatgtgggcaaaaacacttctagaatcttctgagctagaggaagatgatgcaaagtcattgggatcatcatctccagattcaacaggatcagttgaaacttcgatatcatcccactttggaggaatgagctacccttcgctgggtagcttcagcatagagcaagtcaccaagcacaacacttttcaaatggttgatgctgagttgaatcccagccactctttggtatccactagccatgtgggctcccatgcttgtcaaagattctgccatcagtgctga

SEQ ID NO: 62587 - DNA, 1026 bp, Glycine max
  Peptide Sequence Number=SeqID_179365
atgtggcaaatggcaccagatccttggaggtttacagtctcatacgataagctagtgattgcattaggagcgcaacctaccacttttggaattcacggagtctatgagcatgcaatttttcttcgtgaagtttaccatgcacaggaaattcgtcggaagttgctcctgaacttgatgatgtctgatgttccagggattgaagaagaggaaaaacaaaggctgttacactgtgtggttgtgggaggtggtcccactggagtggaattcagcggtgaacttagtgattttattgtaagagatgtccgtcagagatatgctcatgtgaaggactacatccacgttactttaattgaggccaatgagatattgtcttcctttgatgtccgactcaggcagtatgccaccaatcaattgacaaagtcaggagttcgacttgtccgtggcattgtgaaagatgttgaagagaagaagattatcctaaatgatggtactgaggttccatatgggttgctggtatggtctactggagttggtccatcagctattattcgctctttggatcttcctaaagctcctggtggaagcaaattcttaaagttccttatgcacaggattggcattgatgagtggcttcgtgttcctacagtagaggatatattctcaataggtgactgcagtggatttgttgaaagtactggaaaaacaccactaccggctttagcccaagtggcagaaaggcaaggtaaagccaatggaggccgtgcaaacagtgcaaaagatgtagactttggggatcagtttgtttacaagcacatgggaagcatggcatctatagggagttacaaggctctagtggacctcagacagaacaaggagggcaaagggttatccctggcaggttttgtcagttggtttatttggcgctcggcatatctaactcgagtcatcagctggaggaacagattctatgtagctatcaactgggctactactcttgtgtttggccgtgatataagcagaatatga

SEQ ID NO: 62588 - DNA, 264 bp, Glycine max
  Peptide Sequence Number=SeqID_179366
gctactccagaacaagtcaagaactggtttcagagcaaccctgagtttctcaagcctgctgatccagagacatctttgtttctgaatcaaaagtctcaacttgcagcattcttagcaagctcaaaatctaaaaagagtcttgctcagaatcttaaggaagttctccaactacttcaacaggaagaagaagaagaagaaccccccaagaaggaagccgaatcatccgagaataatgatgaccaagaagatgatccattctactag

SEQ ID NO: 62589 - DNA, 1761 bp, Glycine max
  Peptide Sequence Number=SeqID_179367
atgatggtaattgaagcccctcggcaatcagacttaatggtagaactgataaagaaattgaagcctaaagtggtggtgactgggattgctcattttgaggctgttactagctcagcttttgtgcaccttttagatgcaacacgagacattggatctcgtcttttcttggacatatcagatcactttgagctatccagccttcctggatcgaatggggtcttgaagtatctttcaggaactcgtctgccctctcatgcagcaattatatgtggactggtaaagaataaggtttatccggatttagaagtagcttttgtcatttcagaagaagaatccctctttaacgccttgtccaaaactgttgaattactagaagacaatactgcattaattagtcagtactattatggctgtattttccatgagcttcttgcttttcagcttgccggccggcatgctcctgccaagagaaactgtgagaatgtcaaatcagttggtatgataggatttgctagatcagcctcatctgtccttaatactgctgagttatctattgatggggtagagaatgagtccctaatccacatggacgttgatcaaatcttcttgcctgttccatctcctgttaaggcagctatttttgaaagttttgccagacaaaatatgtctgaatctgaaactgatgtcacagcaagcatcaaaggatttgtcaagagtaactatggttttccaacagatagcagcaccgaatttatatatgctgacaattcaaaagctcttttcaacaagctggtcctctgctgcatcaaagaaggtggcaccctctgttttccagccggatcaaatgggaactatgtttcgtctgccagatttttgaaagctgacatagtgacagtacctaccaatgtcaatgtaggttttaagttcacggaaaagacactcactggagttcttgggactgtgaaaaacccatgggtgtatatttctggtcctacagtcaatccaactggcttaatttatagcaacaatgagatggtagaaattttaagcacttgtgctagatttggtgcaagagttataattgatactgcatcctctggtttagaatttgactgtgaaggctggggtggctgggatatagaggggtgtttgtctaagttgaattcttcaatcaagccatcgttctgtgtgactcttcttggtggactgtctcttaagatgctcaatggtgttctcagatttggctttcttattctaaaccagcctgttttggttgacacattttatagttatccaggattaagcaaacctcatactactgttagatatgctacaaagaaattgctggaacttaaagagcagaaaccatcaaacctatcagatgctattgttgaacaaacacagatattgaaaactaggtccaggtgcttgaaagaggttcttgagaaaagtgggtgggacgtgcttgaatcgtgtgcgggtgtgtctgttgtggccaagccctctgcctatctcaacaagactattaagctgaaaatttcacccgaaggtgaacgaagccacggaaatgccactaaggaaataaagctcgatgactctaatattaggactgtcattctcaaagccactggattatgtatcaatagtggttcgtggactggaattcctggatactgtcggttcagtattgcactcgaagaaaatgatttcaaaaaagcattggattgcattataaaatttaaagaagtcgcactgggttaa

SEQ ID NO: 62590 - DNA, 1389 bp, Glycine max
  Peptide Sequence Number=SeqID_179368
atggtcattccaagcatttttctacccgaagactggtcattcactttttacgaagggattaatagacatccagactccattttcaaggagaggactgttgccgagttaggttgcggaaatggatggatttcgattgccattgccgagaagtggttgccatccaaggtttatggtcttgatatcaatcctagagcggtcaaggtttcctggataaacttatacttgaatgctttagatgaaaatggccagctcatctatgacgaggagaagaaaaccttgctggacagggtagagttccatgaatctgatcttctatcctattgcagggaaaaagacattcaacttgaaagaattgttggttgtatacctcagggttcaatgtgggtgggattgtccaagagaaagtctaaggttagggttctaaggatgtccaaaggggggtgttttccaaacggggccggtggggaagtttacgtccgttacgagctacaacattaccagacgacatcttcttggcgtaggaggaggaacgctaagttctatggtgtggagtgtagctttgttacagcggagtgcggatctgtggtgtggagcgtggatctgtcacggcgtcacgattccgagattcttaatccaaatccagatgcaatgtctaagatgataacagaaaacgcaagcgaggaattcctgcattcattgagtaattattgttcacttcaggaccaatttggcttaggtttaattgctagggcagttgaggaggggatagcagtaatcaaaccaactggaattatgatctttaacatggggggccgcccaggtcaaggtgtttgcaaacgattgtttgagcgtcgaggttttcgcattacaaagctttggcaaactaaaatcattcaggctggtgacacagatattgcagccttagttgagattgagaagaacagcccacaccgttttgagttttttatgggactttctggagatcagcctatttgtgcaaggaccgcgtgggcttacggaaagtctggtggcagcattacccatgctttatcagtatacagttgtcaacttcgtcaccctaaccaggttaaagttatatttgattttctaaaacatggatttcaagagatcagcagctccctagatttgtcttttgaggacgattctgttgctgatgagaagattcctttccttgcttatcttgcaagcagactaaaaaataattctgattttccgtatgagccaccagctggaagcaaacatttccgcaatctcatagcaggatttttgaagacttatcaccatattccactcacttccgatgcaaaattcaatacattaatgaatgagcatgatagttcatgtgatgtagaagcaatagaaaagtaa

SEQ ID NO: 62591 - DNA, 166 bp, Glycine max
  Peptide Sequence Number=SeqID_179369
gtctgtttcagaatcatcgtctgattctgaggccatttctgcccaggtctttttggccagttttggtactctggtgaggcctatgtcttctaaggccaggagagttttatctgggtcaatgacccttcaagctttcctttctaggttgatgacccagtctgagtag

SEQ ID NO: 62592 - DNA, 450 bp, Glycine max
  Peptide Sequence Number=SeqID_179370
atgaagattgatcctcaagagtttgatgcccgtctctacatccctggtaggggttttgtgttgaatacagagggccatcctaggaagcttctgaggaaagatctctccactcttgcaaagacatggagtgtcctcttctatagcaacctgactcttacttcccacacctctgatcttaatatggacagagccaggttggtttacggcttagtcacaggcatggacatgaatatcggagccctaatctcagccttgatcacagccttatgtggagctagaggagttacctttgatagtctgacctatgagagcctgagcccagccattaacttggcctttattaagaaaaactgttggaatatggatgatctgacagttaacttcagaggggccaagaaggtaagggctcaaccagtagatgttccttcttcttctacaatgagttgctaa

SEQ ID NO: 62593 - DNA, 336 bp, Glycine max
  Peptide Sequence Number=SeqID_179371
ctttaccaagtaacacaagttccccgagagttcgatactcagttcttatcgttttatacaaattgcgtgatccggtgcacttgccgggttcaaacactcacccctcctgagcctttttattttgacacagatgcacacatggctcaggaggagggtacctccacagatcagatacctgagccatcctctgcacctgttcctgaggagacccagccatctacaccagtcacggagctagagcatcctatccaggattcatcagcagctccaggattggaatggtcagataattgttttgatcaagcttgtagccatcagaagagaatgagcatgtga

SEQ ID NO: 62594 - DNA, 183 bp, Glycine max
  Peptide Sequence Number=SeqID_179372
atgcaacaagatgtggaggaaagccgagcttggaaatgtgagttcatcatcatcagacatgcggagaaatggacaaaggagatgacaacttccttcacagtggttgagactattattctagccattatatttgctgcaacggaagaagcagaaaagagagaggtagcatcgtccaccatataa

SEQ ID NO: 62595 - DNA, 747 bp, Glycine max
  Peptide Sequence Number=SeqID_179373
atcaccattaaaggacccattgaagctcaaagatccagcctccatagatgccccacaagcaagcttctatcactacacgtcctcgccatcagagggctgcacgccctcgccatcagagggctacacgcccttgccttcagaggattacacgtcctcgccatcagagggctgcatgccctcgccatcagagggctacacaccctcgccttcagaggactacacgtcctcgccttcagagggctacacaccctcaccctcagagggctacatgccctcaccttcagaggactacacgtcctcgccatcagagggttgcacgccctcgccatcagagggctacacgccctcgccttcagaggactacatgtcctcaccttcatagggctacatgccttcaccttaagaggactacacgtcctcgccttcagaggactacacgtcctcgccatcagagggctgcacgccctcgccatcaaagggctacacgccctcgcctcagagggctacacatcctcaccttcagaggactacacgtcctcgccttcagagggctacactccctcgccatcagaggactacatgtcctcgccatcagaggattacatgtcctctccttcagaggactacacgtcttcaccttcagaggactacacgtcctcaccttcaaagggcgaaacgtcctcgctttcagagggctccacatttgcgcctttagagaactcaaggtcctctgcccttaatgcttaa

SEQ ID NO: 62596 - DNA, 1474 bp, Glycine max
  Peptide Sequence Number=SeqID_179374
atggaggataataacttgcatctctccctccttctcctcttcgtttctatagtgaccctctccctcttcgtcctcttctacaagcacaggtctgcatttgcggccccgaacctgccaccgggagccaccggttacccggtgatcggggagagcctggagttcctgtccacaggatggaagggtcatccggagaagttcatcttcgaccggatgatcaggtactcctcccagctgttcaagacctccatcctgggggaaccggcggtaatattctgtggggccacctgcaacaagttcttattttcgaacgagaacaagcttgttgcagcgtggtggcccaacagcgtcaacaaggtgttccccaccacgcttcttagcaactccaaacaagagtccaaaaagatgaggaagttgctccctcagttccttaagcccgaggctctccaacgctacgttggaatcatggacaccattgctcgaaaccacttcgcttccctttgggacaacaagacggaactcaccgtctatcccttggccaagagcattgaggacgtgaatcacgtagcaaaatttgagaacccttttcacctgttggcgtctggaatcatatcagtgcctattgatcttcccggaacgccgttcaacaaagcaattaaagcagcaaacgcaatcaggaaggagctgttgaagatcattagacagaggaaggtggatttagctgaagggaaagcatcgccaacacaagacattttgtctcatatgttgttaacatgcgatgagaagggacagttcatgaatgaattggatattgccgacaagattcttggccttttgattggaggccatgacactgctagtgctgcaatcactttcattgtcaaatatcttgctgaactccctcacatttatgatagagtctatcaagagcaaatggaaattgcaaaactgaaatcgccaggagagttattgaattgggatgatgtcaacaggatgcagtattcttggaatgtagcttgtgaagtaatgagaatcgctcctccacttcaaggaggttttagggaagctatcaatgactttattttcgatggcttttcaataccaaagggatggaagttgtattggagtgcaaattcaacacataaaagtccagaatattttccagagccagagaaattcgatccaactagattcgaaggacaagggccagctccttatacttttgtaccatttggtggaggaccaaggatgtgccccggaaaagagtatgctcgattggaaatattggttttcatgcacaacctagtgaagaggggggtctgttcctgcatggatgtcgccagaaaaattggcgacatagctattccgtcattgcagatggcgagaacgatgctgagctggagggtgtacgttggtgccgccactgaagacgagatgcatgatgatccgccaatgcagttggcgagaagcgctgaac

SEQ ID NO: 62597 - DNA, 1088 bp, Glycine max
  Peptide Sequence Number=SeqID_179375
atttgcacgaagaagtgttcatgaatatgcctcctgatttttcagcttcacaaccggacatggtctgtaagttgcgaaaatcgctttacgggttaatacaagctccacgttgttggtttgccaagctctctactactctcaaatcctatggatttcagcaatcatatcttgactactctctgttcactttgcatcgaaaagacactcaacttgtggttcttgtgtacattgacgatttgatcattgttggcaatactcctactgccatcaagcattttaagctctacctcagtacatgttttcatatgaaagatcttggtgttttgaagtattttatgggtattaaagttgccaaaaattctacaggaatttttctttgtcagcgtaaatatgcgcttgatattatatctgaagctagtctccttggtgttaagcccgttgccaccccattagagcagaaccatcacttgtcacttgctgcaggacaacttctttcagatcccgagcaatatgggtgtttagttgggcatttgatttatttgtgtttcactcggcctgagctgtcatacagtgttcacattctgtctcaattcatgcaacaaccccgaatagaacactgggaagctgcactccgagtagttcgattcttaaagggtaatccaagacaaggaatattttttgctcgtgaatgtgacttacaactttatgggtggtgcgactcagactgggccagttgtcctttgaccagacgatcagtcaccggatggctagctgagtataggtctatggcaaccactacatgcgtgttgaaatggttgaaagggatcctctccaacctaggggttgtccatgacaaacccatgactattcgttgtgatagtcaggccgctttacacattgccaaaaatccagtgtttcatgaacgcaccaaacacatcaaggtagactgtcactttgtctgggatgagattctcaaagacaatattcgccccagctatgttcctactattgctcaacttgcaaatatattcacaaaagcattgggggaaatgcaatttgaaactttccttggcaagttaggcatttga

SEQ ID NO: 62598 - DNA, 423 bp, Glycine max
  Peptide Sequence Number=SeqID_179376
atggcaaggttgaaagaaagcattgacatatcctcaatgtggcgtgagctttgtgatttcaaggaagtttacccattgaattttggggcgaattttctatttcatcacactgaaattgcatcaacttcctcaatctccattattgatgaagctaatctagagaatcaaattgacgacagaccagccaatcaaaatgagtcgctcgtagaacagattcttgatgataaggggggtactgacactaccgaagttgttgtaacagatactactgtgtttccagaacctccagatatacagatcccaaacactcataatgagaatgaaccactaggacgtggctgtcgtgtcaaatatccatccactcagttgcaagactacgtcatacacacgattcaaaagttaagtccttatattcgttcataa

SEQ ID NO: 62599 - DNA, 627 bp, Glycine max
  Peptide Sequence Number=SeqID_179377
atgactggaaccttgcaacacctatgtgatgtgaggaaagtgcctgggtgccttattggacttcctaatggacataccgccacatctactaaagaaggaacaataagacttgttggtggtttaagacttgaaaacgtgctttatgtgcctcaattgaattgcaacttaatttttatatcacaattatcagatgaatccaattgtaatgtccagtttactactaatctgtgtgtgatacaggatcgcactttgaagatgttgattagagcgggtgaacgaagggatgtactctacttcttccgggaaattccaaaagtgaaggcttgcaaagttgaaggaataactcaactagaagtatggcacaagcgtttgagacatccatcttggcaaactactcagttaatctctgatggtagtaggaacagagttagtgagtcgcataataaagtttgtgatacatgccaaaaagctaagcaaactagagaaacatttccattaaataataatcaagcttcgaatacatttgatttgatacattgtgatttatggggaccttatagaactccttcttcttgtggtgcttcctattttcttaccattgttgatgattgctcacgtgcagtttga

SEQ ID NO: 62600 - DNA, 1140 bp, Glycine max
  Peptide Sequence Number=SeqID_179378
atgggatcgaatcagggacccttgcttaagaaaaggttctatcaagtcaaaattaaaagcctagaggttgctagtttgcaagaattggggcaattgatggatcagctccaacatcaagctttccgcaaggcctatgagaagatttgggatctagctatgatagaagtctctgtcgaagccatcgcatccctcactcagtattacaatcagccgctaaggtgcttcacgtttagggactttcaactagtgccgattgtggaagagtttgaagagatcttgggatgtccgctaggaggaagaaaaccatatcttttttctgggctttatccctccaaggcgaggatagccaaggtagtcagaatctgggcgcaagagttggaccgagtaaaacaaaacagaaatgggatagtcgaaataccaaggaagcatttggaggaaaagccgaaggcgttggcagatcaaggtgaatgggcttcgttcattgatgtcttggcgctattggtatttggatttgtcctctttacaaatgtggatgggatagtggacttagcggcgattgatgccttccttgcttatcaccatagcatggagagtccgatcattgctattttggccgatgcctatgacactttcgatcgaagatgcgaaaagagtggcgcaaggattgtttgttgcacaccagctctttatgtgtggctagtcttgcacttctttcgtcatgaaggtagacccgtttgtcccatacaaggtcaccgcttgtgcgccgagaaagggaaggaaaactgggagcaactcttggctagtgtgacaacttggctaccccatgagaggagcaccgtcggaggaaagcatcacacctttcatcgcacggggtttcagggacccaatgggaggatacttcaaggagtccgcaaggcatggggcatagtgaaaaggaaagataacgagcttagggaaagcagtaatgggatcatcggcggctatcataagtggttgaaggctcagacgcaagggttggattggctcccgaagctaaagacctcaagtgaggaagaggctgaaacccctgaggagagtgaggaggtacaagccctaaaagtggaactagggcacaagcagtcaaggaaaagttcaagatga

SEQ ID NO: 62601 - DNA, 1224 bp, Glycine max
  Peptide Sequence Number=SeqID_179379
atggagtttgatccaatctttccagcagagaaaattcactacctttctagtattttctctgggatcaaaccagagatcccagcttttatccccatgtcacaagagaacaacaacaacaccaccttctgcatgtaccaaaacaatttcaaaaaccatgataatcaccaccctactgcaaactttttctcagagggttttaattcctccatccttaccccattgttctctttgtcctcttcttcaggtgactcatcataccctaatgagtgcctcaaaggaagctttgccaacgacaacaacttctaccaccccatcatgccttatgcacaaaacaacacccaaaatgaacccatgcatggccccaacagagccatatgggatttttcccagaaaattccccttcggtgctctagtgcaggtgcaggtgcaacttcacagcctcatcagcagatgcagaggaggagtaatggcgaaattcagcacaagaatatgaccaacataatcaaaggccagtggagtgctgaagaggacagggtcctcgtccaattggtgaaacgcttcgggctcaaaaaatggtctcacatcgcaaggttgctgaatggaagggttgggaaacagtgcagggagcgatggcacaaccatctccggcccaacattaggaaggagtcatggaacgaagaggaggacagaatcctgatcgaagctcacaaggggattgggaacaggtgggccgaaatcgctaggagaatgcccggcaggacggagaacaccatcaagaaccactggaacgcgacgaagaggcgcctaaacgccaagaggctgaggaacaagcgcaggagttctaaggggccgacgcttctggagagttacataaggcaagtcactgcagaagaagatgcggaaaaggagctgatcaagaactccatgaacaacatgaacctgaagggcgagcgtagtagcaacaccaccaacaccaaaaccaaatatccgcgtctctttcgagttcggtacgatagctcagagggtggcttcagttctgaggaggatgaagttgggcggggtgtgcagcagctacatggtggtggtggtgcctatgtgcctacgatggtaaatgctgctgtggaagatggcacaatgggttatgatgttgcgatggagatggcgccggaggttcagatgaagaaggaaatggatctcatggagatgatctatagaaaagcttaa

SEQ ID NO: 62602 - DNA, 954 bp, Glycine max
  Peptide Sequence Number=SeqID_179380
atgagttcgtcttcggcagatgtttttccagcaattctggaagtcatgctggagttccgtgctggcaaaatgtttcttgaggaaaaaagggttgttcctgatacacggaaaggacttgttcgaattgctaggggtgaggagggattagtccattttcagtggcttgatcgcacacaaaatattgttgaagatgtatcctttgttttcagtggcttggttaatcaaacatccggaagggtttacatattgaagtttaatagcgatgacaggaagttcttcttctggatgcaggaatcaaatgctgatgatgattcacaactgtgtagctcagtgaatgattacattaatagaccattagagttgcttggtgaagaggagcctgatggatcccttccacttcaagtttctgaagatatggctgaggatgacatctcgtctagagctgcaaacttaggtatcccaaacttgggcgtggaagcaacgagtgatgtaacatcttctggtccagttaaattggaagatctccaaagaatattgagtaacattgggcctgcagatagtattgttgatcctgatggaggcttgggacttggggatatattgaagcctgatctaataatgccattgatggatacattacctttggagcagcgtttagctccctacttacctgagggtgaatggtctccagaagagatattggagttgttgcagagcccacctttccgtcagcaagtagattcgtttacttatgtacttcgaacaggacagatagacttgtctcagtttggaattgatccaagtaaatcagacaagttcacagttttgtcttttcttgaggctcttgaggattctgtttctaagtcggttgagtctgaagaggctaggcaagatgatcgggatttaagatctcaatcttgtaaccgtcatgacccaatggatgaatctcagtag

SEQ ID NO: 62603 - DNA, 162 bp, Glycine max
  Peptide Sequence Number=SeqID_179381
atgcatagtgacacatcaacattagttgttggcggaatagatgagtgggatccttggggtgttccagatgattacagatgtgaggtgattgagaatgatgcaccagttcccaagcatgttcctctccttatagaatttgacaagacgctagaggcactttga

SEQ ID NO: 62604 - DNA, 1077 bp, Glycine max
  Peptide Sequence Number=SeqID_179382
atgtacacagtggaattccaaaaacgaggacttcctcatgtccatttatttttatttttacatgccaacaacaaatatccatctccaaacgatattgatcatattatatcagcagaaataccttcacagaaagatgatccagaactctataaattagtgcaaaatcacatggttcatggtccatgtggaattttgaggcccgcatctctatgcatgaaggaaggcaaatgcagtcgattttatccaaaaaagtttcagcccacaactcttgtagatggagatggttatcctgtgtattgtagaagaaacactggtcagacaataaccaagaatggtattataattgataatagatgtattgtaccctacaatccaaaattgttgaaaaaataccaagcacatataaatattgaatggtgtaaccaaagtacttctatcaaatatttattcaagtacatcaataaaggatatgatagagttactgctatcatggtacatgatgacaatggaacagttccccatgcaaacactccgaatgatgaaatcaaggaatatctggattgcagatacatttctccatgtgaatctacttggaggatctttggttttccaatacatggtagaaaaccttttgtggagaggctacagttccatcttccagggcaacatagcattctctaccaagaccatgatgatattgatgatctcctctctaacccaagcatttctgaatcaaaatttatagcttggatgaatacaaaccaggattttgttgaaggtcaaagcctgacatattctgaatttgcaactaagtttgtgtataaccagaaacaaagatgttggcaacttagaaaaaagggttataccattggcagacttcaatgggttcccccaactatatgggaattattttatttgaggatgatgttgattgtctatagaggaccaacctcatttgaagatatcagaatagttgatggtgttgaatattctacatatagagaagcatgttttgctatgggttttttacaggatgatagagaattcgttgctgcaatccaggaagtaaaagactag

SEQ ID NO: 62605 - DNA, 1986 bp, Glycine max
  Peptide Sequence Number=SeqID_179383
atggttcgagtgcttgtggcgacctcaattagagaagctgctgctggtgctgaagatgatgcattgataaagctcatggatgccacatgtaggcgtgctactgctcctcccgcaccccctgatggtttatgtctagttgatggcgcgcacgccgcccctagtgcctatagctcttcactagctatggcactaagcggttggcattcttggataatactattcatctacctttcaccacatctcattgttcttccttcttttggagcttctgactctgaattgctccttaacgtcaagcaaaacttgcaaaccaacaatcaacaactgtcctcctggaacgcttcggttcctccttgttccggtggccattccaattggcgcggggttctctgctacgaaggaaaagtgtggggcattaagcttgagaacatggggctcaaagggctcattgatgttgactctctcaagggcttgccttatctcagaacgttgagtttcatgaacaatgatttcgagggtgcatggccagagattcaacatttgattggtctcaagtctatttatctttccaacaacaagttttctggggagattccttccagaacttttgaagggttgcagtggctgaagaaggttcatttgtccaacaaccatttcaccggtgctgttccaacttccctcgtgttgctgccgaggctcatagagttgaggttggagggaaacaaattcaatggccccattccatattttagttcccataacaaattgaaatcatttagcgtagctaataatgagttgagtggccaaattcctgcctcccttggagccatgccagtttcttccttttctgtgattatgatcgcagcagtagtattattcagccttcacagaagaagaaaaaatcaagtgtcagtagagaatccagcctctgggttcgggggtaataaaggacgtgtgagggaattgggtagtgaaagtatgaggtcaacaaggtcaataagctccaaccacagcagaagaggggaccaaatgaagctgtcttttctgagagatgataggcagaggtttgatatgcaagagttgctcagagcctctgctgagattttgggtagtggttgcttcagctcttcttacaaggctgctttgttgaatggcccaacaatagtggtgaagaggttcaagcagatgaacaatgtcgggaaggaagagtttcaagagcacatgagaaggatagggaggttgacccatcctaacttgcttcctcctgtcgcttactattatagaaaggaggagaagctcgtcgtcacagactacgttcagaatggtagcttggctgttcgccttcatggacaccaatccattggagaaccaagccttgattggccaatccggttgaagatagtgaaaggcatagcaaaaggtcttgaaaatctatacaaggacatgccaagcctaattgcaccccatggaaatctaaagtcctctaatgttctcttgactgaatcatttgagccacttctcacagactatggcttagtcccagtgataaaccaggatctggctcaggacatcatggtgatatacaagtctcctgagtatttgcaacaaggaagaatcacaaagaagactgatgtgtggtgtcttggaatactaattcttgagattctaactgggaagttccctgcaaacttcttgcaaaaaggtaaagggagtgaggtgagtttggcaagttgggtgcattcagttgtcccagaacaatggacaaatgatgtgtttgatcaagaaatgggggcaacaatgaacagtgagggagagatggggaagcttctcaagattgccttgaattgtgttgaaggggatgtggataagaggtgggatttgaaagaagcagtagagaaaatcctggagatcaagcagagggataatgatcaagaagatttttttacttcttatgctagtgaagcagacatgaagtcttcaacttga

SEQ ID NO: 62606 - DNA, 738 bp, Glycine max
  Peptide Sequence Number=SeqID_179384
atgaacaaacctgaacaagtgtgggaaaaaacttggcattggttaagtgatgatattgtatatagtcattgcagatcattaaacactccaggattacatattgatgactccaatctgatgaatctggtattgcttgaagttgaacagctgttacaggccaatcaaagatcacttaaagactatccttccatgtcatatcctgagaacgcaaatttactaacacatgcagacaacgacctcattttgtctgagctcaatttcaacaacgaagaacttagatcagaattcttgaaccttttttctcaaatgacagaccaacaagcaaaaatttataaccaaattattcaggctgtcaataaaaatgaaggtggaatgtttttcttatatggatatggaggaacaggaaaaacatttatttggaagacacttgcagcctcattaagagctgacaataaaatagttattatggttgcttctagcaacatagcttctttgttattgcctggaggaaaaacaacacattcaaaattaaaaattcttgttccgatatttgaagactcaacatgcaatattcatcaaggaacacaattggctgaattattgaatgaaacaagtcttatcatctgggatgaagcccccatggctcacaaattctgttttgaagcacttgatcaaagtctaagagatgttattaaggcgaaatcaagttctgataaaatctttggtggtaaagttatg

SEQ ID NO: 62607 - DNA, 2370 bp, Glycine max
  Peptide Sequence Number=SeqID_179385
atgtcaaggttgattcaagagaagaagctaggtgcaggacgtgttgtggcagtggcaattgaaaacaacaaaacaagccaatatgcagcgaaatgggcagttgacaatcttcttccaaaagaccaagctctcctattggtccatgtcaggcaaaaagcatcttccattcctacgccaacgggaaaccttgtatcccttgatggcaacgatgatgtgaccagagcatacatgcaacaaatggacaatgaatctaaggagcttttcgcttcatttcgtgtcttctgcaatagaaagagtatacaatgcaaagaaatcttattggaggacatggatataagtaagggattaatagaaggtatttctaagtattcggtggagcttctggtactcggggcagcttcaaggagtggtcttgtgagaagatttagaatatctgatattccaagtgccgtgtccaaaggggcaccaccattctgcactgtgtacattattgccaaaggaaaaatctcatctgtgaaaacttcaaccgctccactaactgctaaaccttcaacccgtaacaatacaatgcagccgctgcagtctttccaaactcctgagagaatggatacacaaataacacgtaaccccatcccaccacgatcatcaacggagaagccatcatacatcgttcgccagctaccatcaaatgaagacgaaatcatatcaccattcacaagaccaggtagaggaaattgcagatacgagtccacaatccccgactctgatatttcattcgtgagcagtggaaggccaagtgttgataggctgttcccttcaatgtatgatgatatggactctggaatgaacactaggctttcaacaggctcagattttgatgtcagaagctttggttcttcattctcaggagccaagtcaattgatcatggtgactactcattcagttcacaagacagtgggacatcgatgtcatcgtcaatgttttcagcttcggaggaagtggaagctgaagtgaggagactgaagctagaactgaagcagacaatggaaatgtacagttctgtatgtaaggaagctacgacagcaaagcaaaaggcactagaacttcagcgttggaaagtggaagaacaaaggaaattggaagacacacgattagctgaaggaacagcattggcaatggctgagagggagaaagtaaaatgtatggctgccatgaagtcagcagaaacatctcgaaaaattgcagagttggaagcacaaaagagaataagtgtagaatctgagcataagaagaagaacgtggatatcctttcacatagtccagtcaggtacagaaaatacaccatagaggagatagaagaagcaacaaaattcttttccaactctctcaagatcggcgaaggtggttatggaccagtctacaggtctgaactagaccacacgccagttgcaataaaagtgttaaaaccagatgcagctcagggacgttcacagtttcagcaggaggttgaagtgctaagttgcataaggcatccaaacatggttctcctccttggagcatgcccagagtttggctgcttagtgtatgagtacatggctaatggaagtttggatgattgcctcttccggagaggcaacaaaccagcccttccctggcaactaagattccgaattgctgcggagattgccaccggactccttttcctacaccagacaaagcccgaaccactggtgcatcgtgacttaaaaccgggaaacattttgctcgaccgtaactatgtgagcaagatcagtgatgtgggattggcaaggcttgtccctcctaaagtcgcagacacagtaacacagtatcgcatgacatcaaccgctggaactttctgttacattgaccctgagtatcagcaaacaggcatgctgggaatcaaatctgatgtttactcacttgggatcatgcttctgcagatgataacagcaaagccaccaatgggtttgactcaccatgttggaagatctattgagaacgggacttttgcggatatgcttgacccggccgttgaggactggccagttgaacatgccttgcatttcgccaagctttcattggcatgtgcagagatgagaagaaaagatagacctgatcttggaaaagttgtgttgcctgagctcaataaactcagagattttgctgatgaaaacatgcccatgatgatgttgtttggtatgcccactggattcactcccagaaacaactacaattactcaaactcctccttttcctcagttcaagactccatgagtgaatcccagtcgatgtcaggaatgtccggatatgaaagccactcaagctcatcgtcagtagggagaatgtaa

SEQ ID NO: 62608 - DNA, 204 bp, Glycine max
  Peptide Sequence Number=SeqID_179386
atgtggttgcagtcatggaagcgcagcccaatttgcgacaaagacgaactcaagcagaaggagaaacaagaagaacgccctgggagtaccctttccgggactctttcctttcctagttttcttcgacctgcgaaatcacggaagcgcaggccagtttgcgacaaaaacgaactcaggcagaaggagaaagaagaagaacgatag

SEQ ID NO: 62609 - DNA, 3342 bp, Glycine max
  Peptide Sequence Number=SeqID_179387
atgatcacgcaaccaccagacgctgcccccgccgtcgcacccaactccggcgaaggaggagagaagaaaagcataaacgctgagctctggcaagcttgtgcggggccgcttctcaacctgccttcgcctggaactcacgtcgtttacttccctcaaggccacagcgaacaggtcgcagcgtctttgaagaaagacgtggatgctcaggtcccgaactataccaatctcccctccaagataccctgtcttcttcacaatgtcacacttcatgcagatccagacacggatgaagtatatgctcagatggcacttcggccggttccttcttttgatacggatgcgttgttaagatcggatatttctctcaagttgagtaagccacaacctgagtttttctgtaaacaactgacggcaagtgacacgagtactcatggaggtttctctgtaccccgccgtgctgcagaaaagattttcccccctcttgattactctttgcaatctcctgttcaagaactcgtggcccgggatttgcatgataatgtttggagattccgccatatatatcgtggaaaaccaaaacgtcacttgcttacaactggatggagtctatttatcagtggaaaaaggcttttagcgggagactctgttttgtttgtaagagatgaaaagcagcagcttcttttgggtataagacgagctaacaggcaaccctccaatttatcatcttcggtactatcaagtgatagtatgcacattggagttctggctgctgctgctcaagctgttgcaaacaatagtcccttcactgtgttctataatcctagggctagtccttcagaattcgttattcctttagccaagtactacaaagcagtgtatagccaccatatatcacctggtatgcacttccgaatgacgtttgaaactgaagactcaggaacaagaagatatatgggtacaatcataggtgtcagtgatctggattctgtgagatggaaaaattcactatggcgtaatttgcaggttggttgggatgaatcaactgctgaggataggcgtagtagggtctcagtctgggaaattgaacccgtgactactccatatttcatctgcccacctcctttcttcagatccaagagacctagactactgggaatgccagatgatgagccggatttcaacaaccttttcaagagtacagttccttggcttggtgatgatatgtgcataaaggatccccaagctctccctggcttgagcttagttcaatggatgaacatgcagcaaaatcctgctcttgctagctcattgcagccaaattgtgtgccttccatgtctggattggttctgcaaaatcttcctggtgcagatattgcaaatcagctggggttttctacctcacaaacctctcaatcaaacaatgtatctgtcaatgctcagaatatacttcagacttcccagcaacttgatcacattcagaagctaccatgcccatccagtgcattgggagcagttacacagctgccgcagcagttggctgatatcactcaacaaccaaggaacttgacaaatcaaactttaccacagaatgaagctcacacccaacttctgaattcccagagagttgtccaaactaacaatattcttcaacagcaacaatcgtccattcaaaaccatcaactgcttagaagcctgtctcagaacccacctcagaaggatcaacaaactacattcggtcagaatgaacggcaaaatgtgtttcaatcccctatgcctgatcattttaatcaacagttacagatgtctgacaatcaggttcggtttcagttgttacagaagcttcagcagcaacaacagacactcttggcacagcagtctgcattgcagcagcctgctctaattcaagttcaagaccagcaaaggcagcttttagatgtaacaaataactctagttccttaatttctggtcaagtactggaaaatcctcctacacttcaaaactcactccctgaggctaattctgtcacccatcagataacaatgcctagtagccagaaaaattttcattactctcatctatctcagcaacctgccttgctgtctgaaatgtctggccatgctggacttctccctacagttacaaccaatccactttctgcttctggtggaagtatactgactggtgcagggcaatcagtaattactgatgatgttccatcttgttccacttcaccttccacaaataaccgtgccagtgcacttcccccagtggtaagttcccagatccataggagcacaacaataggggatgatatggctcagtctgctgtcacaatctcgggtccaagtaccctagaaaccttgtcatctaatgcaaacatggtaaaagatgtacggccgaagtatgaagtaaagccttcttcaaatatttcaaaaaatcagaatcatggaaatgttgcccgtcagatgtacttgaatggcgttgtccagacagactatttggattcatcatcttctacaacatcactttaccattttcagagtgatactcatatgcatcagaataacaacccattttcttacaatccacagttgatttattgtagagacaatagtcaaaatgttgaagttcaggctgatgctaggagcaatgttccgtttgtcaatgacattaatggccaaatgggaatgccatcgaatctagattctcttttaaccaatggcactgtggggctggggaaggatttgtcaaataatttctcttccggaggcttgcttggagacttagaaaataacaaaggtgttcagccagaactttcatcttcaatggtttcacagacatttgaagttcctgatatgagtttcaattcaattgattctacaatagatggtagtagcttcttgaataggggtccatgggatctgccgccaccacctccacctcctcctcctcctcctcctccaccaccaccacaacaacaacagcagattcagcggattagaacatacaccaaggtatataaacgtggagctgtgggaaggtccattgacataacacgatattcaggttacgaggagcttaaacaggatctagctcttaagtttggtattgagggacagctggaggatcgagaaagaattggttggaaacttgtatatgtagatcatgagaatgatgttttgcttgtgggagatgacccttgggaggaatttgttaactgtgtccgctgcattaaaatactttctcctcaagaagttcaacaaatgagcttggatggagattttggcaatggtggccttccatatccagcaggcagcagctctggtggtgggaatgcttaa

SEQ ID NO: 62610 - DNA, 1047 bp, Glycine max
  Peptide Sequence Number=SeqID_179388
ggctgcacgccctcgcctacaaaaagactgcacgtcgtcaccttcagaggactacacgttctcgcctttagaggacaacacgcccttgccttcagaggactacacatcctcgcctttagaggactacacgtcctcgcctttagagggctacacgccctcgccatcagaggactacgcgtcctcgccttcagagggcaacgcgccctcgccttcgtagggatacacgtcctcaccatcagaggactacatgtcctcgccttcagagggcaacacgtcctcgccttgggtactagtacccccaccttcaatgggctgcatgccctcgcctacaaaagactgcacgtcgtcaccttcagaggactacacattctcgcctttagagggcaacacgcccttgccttcagaggactacacatcctcgcctttagaggactacacgtcctcgcctttagagggctacacgccctcgccatcagaggactacgcgtcctcgccttcagagggcaatgcgccctcgccttcgtagggatacacgtcctcaccttcagaggactacacgtcctcgcctttagagggcaacacgtcctcgccttgggtactagtacccccaccttcaatgggctgcatgccctcgcctacaaaagactgcacgtcctcaccttcagaggactacacgttctcgcctttagagggcaacacgcccttgcctttagaggactacacatcctcgtctttaaaggactacacgtactcgcctttagagggctacacgccatcgccatcagaggactacgcgtcctcgccttcagagggctacgtgccctcgccttcgtagggctacacgccctcacattcagaggactacgcgtccccgcctttagagggctacacaccctcgacatcagaggactacacgtcctcgcctttggaggacaacacttcctcgcctttagagggctgcatgccctcgcctttagagaaccacacgtcctcgccatcagaggactacacgtcctctccttcaaagggctgcacgccctcgcctaa

SEQ ID NO: 62611 - DNA, 359 bp, Glycine max
  Peptide Sequence Number=SeqID_179389
gtatgccacttaccaggcaccctttagacccagataagtctaacagggccttgggttttccagcattgatcacgggtctcttccagtggtttggggttcccgtcacacctagtaaggccctagatgcaccattgccacctcatcaggctgatccagctgggtcatttgacaaggagcggtatttacggcttttggttctccagcaggcggccaaccacaggggacaggtgcagacccatgagtgtctctaccagctcaacctcagtttgcagagccagggtttcactccttttgcgtgccctactccagatcaattcagggcagatgtcacatggcccggagaatggtctaaggcctag

SEQ ID NO: 62612 - DNA, 186 bp, Glycine max
  Peptide Sequence Number=SeqID_179390
atggccatgagccatgggctcttgtatcaacaaagaatgaagaatgcgttcgacaagaagggacagaatcatcttaggccgtggtcagatgccgggaataagctgaaggcagaaaccaatcaaggtaagatggtaacacggccacagtttgccgcacaatgtcgtttcctactttcaggtacttag

SEQ ID NO: 62613 - DNA, 333 bp, Glycine max
  Peptide Sequence Number=SeqID_179391
atggatacctcaaagccctacactggggcaatgagaggcattgtgcatgagcctcaagcgaaccttggggcagatctaaaatttcctacatctaatgaatttgggatgaccggccctctcaatgagtcaatctcatgttttctcataagggtggacgcttgggtactagaacctgtatcctttagaggactacacgtcctcacctttcaagggctacatgcccttgccatcagagggctacacgccctcaccctcagaggactacgtgtcctcgccttcagagggctacacgctctcgcctttagtaggctccacatccgcaccttaaaataa

SEQ ID NO: 62614 - DNA, 168 bp, Glycine max
  Peptide Sequence Number=SeqID_179392
atggctcatttgcctcaaaaggtgcaccttgactggatggtcaatggcggcgatggccagcagcagcggtggaggaggatgatccctttcgcttctttgatgattcttccatttgatgaagttttagtgaatttcaatcggtggaatttaaagaggagtgaaaaatga

SEQ ID NO: 62615 - DNA, 1050 bp, Glycine max
  Peptide Sequence Number=SeqID_179393
atggagcatgaaatggggcaagaagctgtttgtcttcactgtggcgacagaggctttccagaaacattggttttttgcagccagtgtaaggcttatgcgctgcataggtactgtttaaaggggcctgtgatttttactgatgctgttacatggttttgtgaggattgtgcaacaaagctatgggtgccacctgctcttgaccaatctacacctatctcatctgtaacaagaaaaaattgcgtactgggagtgaagaaacacaataaacagcaaaaaaagaaggttaaaaagaagcagaaggaaggaaaagctaactctgtcttagttgctgaaacaaaggttgtattatctggtagtcacagttcacctgggcctgagcatcctcaatgtagcaacagaggtgaagaatatgaggtgaaaaatgactgtggaccagctccaagggatgtagctaattttgttgttggtgaagaagaaagtgtggcaagggatttagctaattctgatgaaggtttcaaatctgttccagtttctcaaggagctaacaatagtgattcaggttgtgtagaattagatggttatgtttatgcacagcctactattaatccaatctggaggggaagtatgtatttctgcaatgaaactaatggtactgtcaatggacttctggctcatatgtctgatttagcgtgttccaaagttgtggaggagacaggtcatttccctgaagtgcttcatgctgaattgcttcccagagataaggtgtggcctgaaagtttcaagagtaggaggccaactgatcaggacattgctctttttatctttcctgacggggaaggatctgaaaaggactttgataaggtggttgaagatatcatgatccatgagcatgccataaaaattgtggctaaaaaagcagagcttttaatttttcattctatcgagcttccaatcaaatattggagatttgaagccaagtattatttgtggggtgtcttcagacgaaagcaaatttcagaagagacaaatgatgctgtgtgcagagattga

SEQ ID NO: 62616 - DNA, 618 bp, Glycine max
  Peptide Sequence Number=SeqID_179394
atgtcaccttctggtctgacagggggtaatgagatgcataattatattgctcgaaatgatgaccataccggtcatcgaatgctaaaggacactaaaacacttggatctgcttatgaccgctaccttcaaagtgcagggcttacttcgtttaattctggggaagccagtgcaattggtggtgttggattgggaaggggtgttggtggattaccacgccattcactaactgatcctgctgtcatggggcatcctggtggtggtcatgatcttgcacgaaatggacggaatgtcaattatggcggtcagttaacagtagatgcagcttccatgcctggacctgagactgtacctcttcccccagatgcttcaaatatttttcgcccttttgttggatatagagaagtaaggcttgtgagcaaagaatccaaacatcgtggtggagatcctctaatcctttgttttgtggattttgcaaatccggcctgtgcagcaactgctctgagtgcattgcaaggttataaagttgatgaactcaatcctgagtctagtcacttgcggcttcagttctctcggtttcctggtcccagatctggacctggacctcgtggcaagaggtga

SEQ ID NO: 62617 - DNA, 300 bp, Glycine max
  Peptide Sequence Number=SeqID_179395
atgtactcttttgaatgtagctcaagcttttctgaaatagaatgcagcttcaagcattcaaacctctacaccagcatgccttgtcacctcatttgccacatggtccccattattggtcatgaggctcactatttagaggctgctgtagttgatcagattgtgtctgaggtcatggaaatcggccaggttgttaatgctcaatttatcgtcaattgtcaaaagttaggtcatgatcccatgacttgcgatcatctatttgatcataccttggacccttttccaaagtctcttttgatttga

SEQ ID NO: 62618 - DNA, 417 bp, Glycine max
  Peptide Sequence Number=SeqID_179396
atgtgtatgaccacagttctagcacgagggatgctactataccagcagggacaatggggtatcttacccctgaatatgtttattctggtgttggaagtggcaactggtagaaagcctgtggaggatggtggcaccgtggttgcagattttgtgtggggcttgtgggaaaagaggaagctcattgaggctgctgatccaagattgatgggaaagtttgatgaattagagatggaaagctgttattggtggggcttctttgtgtgctccctgactatgagaagaggccaagataaaccaagggtgagaagtaggcctatttgtcctgatgatgatacctctgatgcacagagtgttgttgcggatttgcctagcacagatgaggctccttatttgacccctagaaaccagttttactag

SEQ ID NO: 62619 - DNA, 1023 bp, Glycine max
  Peptide Sequence Number=SeqID_179397
atgaacaatctcgttgaaatccgcggattgaaggtcgaggcgaccaccgattcaggccgtcgcatcgatatcatcaagggcgtcgacatcgatatcgccgatgccgaaatcgtcgcactgatcggcgaaagcggctccggcaagaccaccatcgccctgacgctgatgggttatgcccgccccggttgccgcatttccggcggcagcgtcaaggtggcgggtcaggatatggtgcagctttccgaaacagagcgcgaaagggtccgcggcacacaagtcacttatgtcccgcaaagcgctgctgccgccttcaacccggcacagaagatcatcgatcaggtcatcgaagtcacccgcatccatcacctgatgccgccgcaggaagcccgtgcacgcgcggttgagctcttcaaggcgctctcattgcccaacccggaaaccatcggtgaccgttatccgcatcaggtctccggcggtcagcttcagcgcctctccgcggccatggcgctgatcggcaatccaaagctggtgatcttcgacgaaccgaccaccgcactcgacgtcacgacccagatcgaggtcctgcgcgccttcaaatcggcaatgcgtaagggcggcatcggaggtgtctatgtgtcacacgatctcgccgtcgttgcccagatcgccgaccggatcgtggtgctgaaaggcggcgaggtacaggaaaccggcaccaccagggatattctcgaaaatgcgcagcatccctacacaaaggaattgctgacggcatttcatgacaaggtccgcacggtcgccccgccaacgcaggagcgggcagcaccgttgctggatattgaaaatctgatcgctggatatggcaccaagggcgacaacaggatgccgctcgtgcgcgccgtggattccgtcagcctttcggtctatcccggtcgcaatctcggtatcatcggcgaatccggctgcggaaaatcgacactagcacgcgccattgccggcattcttccggcggcaggcggccat

SEQ ID NO: 62620 - DNA, 334 bp, Glycine max
  Peptide Sequence Number=SeqID_179398
atggcatattcttcttccggagcttctcaaataaaatatgttgttcatcttctttgtgatctcttgcttatctcaggattgacgggtgaaatatcagtgcaaatatcagataatattcctcaaataaagtatgatgtttttgttagcttcaggggtgaggacatccgtcacggttttcttggttatttgactgaggcttttcgtcaaaagcagatacatgccttcatagatgataaacttgagaagggagatgaaatatggtcatcacttgttggagcaattcaaggatcattgatttccttgaccatattctctgaaaactactcctcttcgc

SEQ ID NO: 62621 - DNA, 283 bp, Glycine max
  Peptide Sequence Number=SeqID_179399
cgacaagtcgtgtgacgtatacgacatagcggctataattagggtttatggtatcgaccaaatagaccgttttggagggagagaaagaaaaaaggggaatttcaatggcgtcaagggtttctctgaaggcgaaggggaagagttcaaagggatcgaaggctgcggaagatcgatccgcgagcgagtgcctgaaggagtggacgacatgggcgatgcgaaaagcgaaggtcatcactcactacggtttcatccctttggtcatcgtcatcggtatgaactctga

SEQ ID NO: 62622 - DNA, 336 bp, Glycine max
  Peptide Sequence Number=SeqID_179400
atgtcaaacttgatcaaaatagtgaaagaaatttccaatcaaaatcgcaccaaaaaactatttaatcagactttcaaactcaatgttacacgttgtgagtttgtactaggtagtttttccaacaatgttccggcaccaagagtttttcccatgggcatggcgatgctgaccaatgtcgatgaagcattccaacgagagttagataaagaagagattaagagagagataacaaccaatcaggctagaccaaatgttgctcattacaatggaaagtgcaaggcgataacatctacaactgatgacaatgagagttttcataataaggtcaagcaataa

SEQ ID NO: 62623 - DNA, 513 bp, Glycine max
  Peptide Sequence Number=SeqID_179401
atgttgttgctggcatatgtaagtataccacgctatgaaggcctagagctagatcatataatagtacaggaggatgcaaaacaactctataaatcaggggagaaaaggataggaactgatgagaagatgttcataaaaatttttagtgaaaaaagcggcgcacatttggctgcagtcaattctacctacatagcttcatatggacactcgctagaaaaggcaataaagaaggaaacatctggcaattttgagagtgccctcttaaccatactgcgttgtgctactgatcctgctatgtactttgccaagattctgcgcaagtcaatgaagggtgtgggaactgatgatagtagactaataagggtaattgtgacaaggactgagatagacatgcaatttataaaaatagcatattataagaaatatggaaaaccattaactcatgctgtcaagtcagacacatcaggccattataaagatttgcttctaaatcttttaggttctgattattag

SEQ ID NO: 62624 - DNA, 2472 bp, Glycine max
  Peptide Sequence Number=SeqID_179402
atgcctggaaatttttatgctggggagcatcaaacccaccattggaagaggttttgctcgcctcctgttattgtacttgcttctgcactgtatgagaccatgactagttctcctcttttgaatccctcctaccattattgttttaacagtacctacctaaggttagaggttttccacttcatttatacatatgctataattgttgatatttgccccttcacccttgatgagtttgttcaagcctttcatgataaggactcaatgttacttggcaagattcatgtggcccttctcacacttcttgtgtctgacattgaagtggagcttactaatgggttttcacctcatttaaataaatcgtgtaactttcttgcattgcttcactcggttgaaagtcaagaatattccctggatttctggagaagatctctaaattctcttacctggatagaaatactccatcaagtgctggttgcttctggatttggttcaaaacaaggttccttacgtggagaggtccttaacaaggaattgaatcttcttgtaaactatggtctatgccctggcaccttgaagagtgagttgtttaacatcttgtcagagagaggaaacattggatgcaaagtagctgaactggcaaagtcaatgcagattgctgaattaaaccttgccagcaccccagaggaactcgagtctttaatatgttccacgctttcaagtgatattactttatttgaaaagatttcgtcaactgcataccgtttgcgtatgagcactgttatgaaggatggtgatgaatctcattcagatacagaggactttggtagtgttgatgatgaacttaatgacactgatacgtgtagcagtggtgacgattttgaaagtgatccaataaactccagtataagaaaattgaagcgtgcaagcagtcataaaaataatatgctgaaagtatacactgaaattgatgagagccatccaggagaagcgtggctattaggactgatggagagtgaatattcggacttgaacattgaagaaaaattgaatgcattggcggctttaaccgatcttgtttcatctggatccagcatcaggatgaaggattcgacaaaagttgcagctgattgcaattctagcattcaattacaagggtctggagctaaaataaagagatcagcagtaaagaaacctgggccactttggaaccagaaattacacttgaattctgatccctgtacagtcgattcctcatcgttaatctcaagactccatagtcgtgaagcttcctttgaaaagggaaaagggtcatctatttcgcaccctattcaatcagtgtttttgggatctgatcgtcggtacaatagatactggcttttcttgggtccttgtaatgtagatgatccaggccacaggaggatatactttgaatcttctgaagatggtcactgggaggttattgatactgaggaggccttgtgtgccttattgtcggttctggatgatagaggaaatcgggaggctcttcttattgaatctttggaaaggagacaagcatcactttgcagatctatgtccaggattaatgttaatagtactggaaagggttctatgtcacattctgatcaatctgaactggatatggtcactgatgacagttattctcctgcatctgatgtagacaacctgaacctgactgagactgctaaagactctctgccatctgctggggctgtggtaattaaagctggaaagaaaggagaggaacaaattaaaaaatggatccgtgttcaagaatatgatacttggatttggaattccttttattcagatctcaatgttgtaaaatatggtaaaaggtcttatctggactctcttgccagatgtaagagttgtcatgatctatactggagagatgagagacactgtaaaatttgccatatgacatttgagctagattttgatctagaagaaagatatgcaatccacatagccacatgcagggagaaagaagacagcaatacatttcctaatcataaagtgctaccatcacagattcaatcactgaaagctgcagtttatgctattgagtctgttatgcctgaagatgccctggttggtgcttggaggaagtctgctcataaactgtgggtgaaacggctcagacgcacctcaactttagtggagcttttgcaggttcttgctgattttgttggtgccatcaataaggactggttgtttcaatgcaaatttccgcatgggctggttgaagaaatcattgcatcttttgcatctatgccccatacatcatctgcccttgctctgtggttagtgaagctagatgccataattgctccctacctggacagagtccatcttcagaagaaacagggaaccatgattcgtactgttgtggtgtcattagagatcttatcagagaaaagaaaacttaaaaatgctggtggaatgtaa

SEQ ID NO: 62625 - DNA, 231 bp, Glycine max
  Peptide Sequence Number=SeqID_179403
atggagtgcaacatctctggtgtaaaaataaaatctgatggacctgcagagagaggagctagaagtggcatctgtagaggtactgaaaaagaagaaggtattggtgcctctgatgctgaagtggaagtatttagcttctcaaagaagcctcttgagaaagcttctcaaagaagccacgaggaagcttatggaggaagcctcttaatgaagcttctagagaaagctacatga

SEQ ID NO: 62626 - DNA, 2310 bp, Glycine max
  Peptide Sequence Number=SeqID_179404
atggcgtgcttctccattctctctcctcctcatcccactctcactctcactctcctccctccctcccactctcaatgcggcggcttcaccgttagagttagtgttgctctcaccgaaaggctctcccagcaccacaagaccaattccattattccttcaactcgcgctgctgcgaatggtggcggtttcgagacagaaactgcggtggtggaaaagcctcaattgaagactctcttccaagcttccagaggctacccttccccctttggtgccactgttcgagacggtggggtcaatttcgccatttcctctctcaacgcactttccgccactctctgtttctttactctctctgatttccagaataatcgagtgacggagtatgttcctcttgatccgttgattaataggactggaggtgtctggcatgttttccttaaaggagattttagagatatgctttatgggtacaaatttgatggcaagttttctcctctagagggacattactttgactcttctcatatactactggacccgtatgccaaagcagttataagcagaggggagtttggggctttaggacctgatggtaactgctggccccagatggctggcacggtaccttctgaggatgatgagtttgactgggaaggagatttgcctctcaagtatccacaaaaggatcttgttatatatgaaatgcatgtgcgtgggttcacaaagcacgagtcgagcaataccaagttccctggtacataccttggtgtggtggagaagcttgaccacttaaaggaacttggagtaaattgtctagaattaatgccatgtcatgaattcaatgaactggaatactatggtcacaattctgcacaaggagactacagggtcaatttttgggggtattcaaccatcaattacttctccccaatgatcagatactcatctgctggcatacgaaactgtggccaggatgggattaatgaaattaaattcctgatcaaagaggcgcacaaacgaggaatagaggtcatcatggatgttgttttcaatcatacagctgaggggaatgagaatggtcccattatttctttcagaggtgtcgacaacagtatgtattacatgttagcacccaagggggagttctataactattcaggatgtgggaacacgttcaattgcaaccatccagttgtgcgacaatttatagttgactgcttaagatattgggtaacagaaatgcacgtggatggttttcgctttgatcttgcttctattatgaccaggagtagcagtctctgggatggagctaatgtatttggtgctccaatagaaggtgacttgttgacaacaggaacccctctaagcagcccaccattaattgacttgatcagtaacgatcctatactttgtggagtgaagcttatagctgaagcctgggatgctggtggcctctatcaagttggcactttccctcactggggtatttggtcagaatggaatgggaagtatagagacacggtgcgcctgtttatcaagggtacagatggctttgctggagcttttgctgaatgcctttgtgggagtcctaatttatatcagggaggaggaagaaaaccgtggcatagtattaactttgtatgcgctcatgatgggttcactctagctgatttggtgacctataacaacaagaataatttgtcaaatggagaagacaataatgatggagaaaatcataataatagctggaactgcggacaggagggggagtttgtcagtacctcggtgaagaaattgaggaaacgacaaatgcggaatttttttctttctctcatggtttcccagcataattacttccaatgggacaaaaaggaagaatcctcatcagacttcttcagattttgtcgccttatgactaagttccgccaggaatgtgaatcgctaggcttagctgacttcccaacctctgagaggctgcagtggcatggtcattttcctggaaagccagactggtctgaaaccagccgttttgtggcttgtaccatggtagattcagtgaagggagaaatatacattgctttcaatatgagtcatttacctttcacagttaccttgccggagcgtcctggatacaaatgggaacctcttgtagacaccagcaagcctacaccatatgatttcctcactcctgaccttcctggaagagatattgccatacaacagtatgctcagtttctggacgccaatatgtatcccatgcttagttattcttccattatcctcttgcgcattccagatgaaaatctgtag

SEQ ID NO: 62627 - DNA, 342 bp, Glycine max
  Peptide Sequence Number=SeqID_179405
atgcaacagccttcactacaaccgatgcctcttctactactcttatttatggggatcagaatccgccttgctccagtgctaactttaacccctgaaatggttcaacaaatgattgtttcaacattttctgctttaggtctttcagttggtcaattagttgataatgattgtcgcaacgtgccctttcgcgggcgagcgagggcgaggctcacgggtgcgctttccaaagaaggaaagatgcgcggagtcgccaccaacgtttatttgtggaaaacgttgggaaaactgaaggaaaccggtcaaaatgaaaattctaagttcgggagttgtatttacgcttga

SEQ ID NO: 62628 - DNA, 465 bp, Glycine max
  Peptide Sequence Number=SeqID_179406
atggcgggtgcgatgaatatgaaagtcgacaagattcgtcaaatcgtgcgtctcaaacagcttatgacgcgctggaagcacatcagcctccgccgccgctccgacgacgaaccctccgccgcgcgccgccctccccccggcttcatcttcgtctatgtgggcaccgaacgcactcgcttcgccatccctgcgcgcttccttaacctcgcgctcttcgatggcctcctcaaacaaaccgaagaagagttcggactccgaggtaacggcggtttggtccttccctgccaggtcgcgttgttcactaacgtcgttaagtatctccacaaggacgaacacaagtacggaaaactctctctcgaagatttcgttagcatggtttcggatgacactgacgtggcagcctccgattcctgtaaggaaaacgtcgtcgtttttgcccctctgctccagaaagcggaggtttga

SEQ ID NO: 62629 - DNA, 366 bp, Glycine max
  Peptide Sequence Number=SeqID_179407
atgacatatatgttagatggttacgggttgagaagcaatatgctttgtttgttgacaaaagaaaagaaaaagaaagacaaaaaatggtgcaagaatgagatatttcttggcttgtcccctacggccataaagggacatacaaatacaagaaaagttggaaggggagtaacttatggtttaagtgttgtaaaaaacgagaggaagagtgctagaaacaaattgcgtgttttcattccaccagataagatggtggctgttggaccagaaattgcagattttgtcattgaaatttctattgttgttcaaaagcttgctccttttaacattgataagtggaagcaagttctggaagctacaaaagaatag

SEQ ID NO: 62630 - DNA, 240 bp, Glycine max
  Peptide Sequence Number=SeqID_179408
atgggagcaaagaggtcttctacttgctcctttgggagtgtgttcaaggcatgtttctcaagtggtggtagctatgatgagtactgggaaggcagtggcagtgggagaaggatatttgcaagtgatgaagatagagggcgttgggttgctgagcctggcattgacagaaaagcctctgatttcattgctagatactacgcctcgcgagtcaccgactctgaacgccaatttgcatcttga

SEQ ID NO: 62631 - DNA, 450 bp, Glycine max
  Peptide Sequence Number=SeqID_179409
atgtctacctttgaacaacatgctaccaacgcctctatccattttcctgaaccagagccttattccaccactaataccttcacgtctatgatgaatgctatcaagagtgtttcatgggtcctcgcaatctcatcgaagtatgttcataaatttccctccagtttctgcacttggcctagacccattttagaataccaagcttggttgaagagggtattggctacctacaaggatgagtggaaggattggggaatctatgacatgatcatgctttgctttgtccttccaaaagctatggttggtccaaccctgcttgatgtggttgccatcttgagcctgccaatctatggtgaggagctactgtcactatatggaaaccactattccaccactcccaacactcatggcattaagttctccaaagatgacttggatattccaaattcatga

SEQ ID NO: 62632 - DNA, 201 bp, Glycine max
  Peptide Sequence Number=SeqID_179410
atgttccccctccacccctttcatattttcgtacaggggttgctcgcccaggcgagctcagctcgcccaggcgaaacattaaacatgcttcccccccttacggcgacgtcctccgcttgcccagcaccgggaaagggacgacgatcggtcggtcgtgaccctatcctccatttgcatccgtccctaagtacctgcaagtag

SEQ ID NO: 62633 - DNA, 954 bp, Glycine max
  Peptide Sequence Number=SeqID_179411
gttggacccttgggtactagtacctattgcctttagaggactacacatcctcgactttagagggctacacgtcctcaccttcagaggactaccggtcctcaccttcagagtgcttcacgtcctcgcctttagaggactgctacatgtcctcgccatcagagggattcacgccctcaccttcagagggctgcacatctttgccttcaaaggactacacgtcctcgactttagaggactgcacatcctcaccttcagaggactacatgccctcgccgtaagagggctgcacgtcctcgccttaagagggctacacaccctcaccgtaagagggctgcacgccctagccttcagaggactgcatgtcctcgcctgtaaagggcttcacgtcctcaccatcaaagggctagggctacacatcctcaccttcagagggatgtacgtcctcgcctttagagggttacacgtcctcacctttaaagggtttcacgtcctccccttcagagactacagagggatgcacgtcctcgcctacagagggctacacgtcctcgccttcagagggcagtacgtcctcgccttcagaggactgcacgtcctcaccttcagagggcttcacgtactcgccttcagagggctacacatccttacctttagagggctgtacgtcctcgccttcagagggcttcacgtcctcgccttcagagggctacacatcctcaccttcagagggttgtacgtcctcgccttcacagggttacacgtccttggctttagagggttgtacgtcctcaccttcaaagggctgcacgcccttgccttcagaggattgcacatcctcatcttcagagggcttcacgtcctcgcctttagagactacagagggttgtatgtcctcgcctttagagggctacacgtcctcgcctttagagggttgtatgtcttcgccttcaaagg

SEQ ID NO: 62634 - DNA, 201 bp, Glycine max
  Peptide Sequence Number=SeqID_179412
atggaaggaaaggggcaaaaagaccatgattccagcatctggttgtggagaagcaaatggtgcttaagcctggagttgttggcacttaagcgccacaagcaagaggttgacaaagaggaaaagcatctagcactgaagcgtcagttccctgcacttaagcgccaatcaggaagtaacaagtttgattttcatggcacttaa

SEQ ID NO: 62635 - DNA, 165 bp, Glycine max
  Peptide Sequence Number=SeqID_179413
atggttcaaggaaaatttgtcccaaatttgggggaggcactgggtatggaagctaagtgcctaagaaaaaagggcaagtatggggaaggaatgaatgaaaaagtgaaggttattctatggatgaatgctctcctagaacctaagcttttgaatcctagaaactag

SEQ ID NO: 62636 - DNA, 194 bp, Glycine max
  Peptide Sequence Number=SeqID_179414
cgatcgcagagggtggtggcgctttggtgaatctctcacatggaatggcagatcttgttagctacaggaatgccgaccgtgacatcgaccaagtcattattgctttatcaactgccttggaatggggtgacttgaagggggaagatagggcatgcttgtctgtgtttgaatggaatggactgatgggacttgaa

SEQ ID NO: 62637 - DNA, 2011 bp, Glycine max
  Peptide Sequence Number=SeqID_179415
atgggttcaagagattacggggctgttttccaacgatatctgcgtcctgagaaggactatctatctttttcacttatttataacaacgggaagcgatcccttgatttgatttgcaaggataaagttgaggtagaagtgtggattgctggtcttaaggcgctgatatcttccggtcaaggtgggcgttccaaaattgatggatggagtgatggaggcctacatcttgatgacagtagagacttgacatcaaatagtcctagtgaaagttcagttagtgcttcacgagacctcagttctccagacgtttatgttagtctggcaaatacttctccacattcctttcactctgagaatactttaaattttgaaaggtcacatgcaccatcaaacccatcaaatatgcaagtgaaaggatctagttcagatgtttttcgtgttagtgtctcaagtgcacccagcacatccagtcatggatctgcacctgatgattatgatgctcttggggatgtatacatatggggggaggttatctgtgagaatgttgtgaaagttggtgctgagaaaagtgctagttattttagcccaaggacagatattctcctccccaggccattggagtccaatgtggttttagatgtgcttcaaatagcatgtggtgttaaacatgctgctctagtcacaaggcaaggtgaactttttacatggggtgaagaatctggaggacgccttggccatggtgttgggaagaatgtggttcaacctcgtctagttgaagcaatggcttctacaactgttgattttgttgcctgtggggagttccatacctgtgctgttacaatggctggggaactatatacatggggtgatggtactcataatgctgggcttcttggtcatggcactgatgttagtcattggataccaaagagaattgcaggtccactagaggggcttcaagttgctttagtcacttgtggtccatggcacacagccttgataacttcaactgggcagctcttcacatttggtgatggaacatttggtgtcttaggccatggagatagggaaaatgtttcgtatcctagagaagtagaatctttatctgggttgaggacaatagctgttgcttgtggagtgtggcatactgcagctatcatagaggttattgtgacacaatcaagtgctagcgtatcatcaggtaaattgtttacttggggtgacggagataaaaaccgccttggacacggagacaaggacgcccggcttgaaccaacttgtgtaccttcacttattgaagacaattttcatagaattgcttgcgggcacagtttgacagtaggcctgacaacatctggacgtgtttttacaatgggaagcactgtttatggtcagcttgggaatccccagtccgatggaaaactgccgtgtttggttgaagacaagtttgcaggagaatctgttgaagaaattgcatgtggagcttatcatgttgctgttttaacatccaaaaatgaagttttcacttggggaaagggtgcaaatgggagattgggtcatggagatgttgaagatcgaaaatcacctactttagttgaagccttgaaagatagacatgtgaaatatattgcatgtggttcaaactactcttctgccatatgccttcataagtgggtatctggtgctgagcagtctcagtgctctgcttgtagacaggcatttgggttcactagaaagaggcacaactgttataattgtggacttgtgcactgccattcatgtagttctaggaaagcattaagagctgccctggctcctaatcctgggaagccatatcgtgtttgtgattcttgttttgtaaaattgaacaaggttgcagaattgggcaacaataatcggaggaatgctatgcctcgtttgtcaggtgaaaacaaggacagattagagaagcctgagctaagattgaccaagacagcagtcccttctaatatggatttgataaagcaacttgata

SEQ ID NO: 62638 - DNA, 961 bp, Glycine max
  Peptide Sequence Number=SeqID_179416
agctccaagacctgttctgacatcatctggagtgagttccaggtctgtgtcccctttctctagaagaccaagcccccctcgttcagctacacctattccaacaacatcgggactttccttctctaaaagtattactgatagtttgaagaaaacaaatgaacttttgaatcaggaagtgttgaagttacgcggtcaggttgagaccctgagacagagatgcgaactgcaagaattggagcttcaaaggtcaacaaaaaaagctcaggaagctatggcagtggctgcagaggaatccgcgaaatctaaggctgcaaaagaagttataaagtcacttacagcacagctcaaaaatctgtctgagaggcttcctcccggtgcttatgatgctgaaaacatcagaccagcttacctgccaaatggtttggagccaaatggcatccgctatccagacttaaatggtgaacaccacaccagggcagagtcaatcagtggctctagtttggcttccataggacttgaatcatccctgatgaatagaaccgatggcactttgcctggaagctatggagctaatcattaccagcaaaaccggggatctgtgacctctaatgggacagatgattacccgaacgttaaattgccaaatggcagcggcatgattcagccaagcagcagtactgtgtcagatacggttgatggtggtagggattctggagatttccaagatgatgagagtggtttgagatcaaggaacgccatagtgcctgctaatagtaatcaagttgaggcagaatggattgaacaatatgaacctggtgtctacattacactggttgccttgcgtgatggaacaagagatctgaagcgagtgcggttcagccggcgaagatttggagagcaccaagcagagacttggtggtcggagaaccgtgatagggtatacaaaaggtacaatgtttga

SEQ ID NO: 62639 - DNA, 375 bp, Glycine max
  Peptide Sequence Number=SeqID_179417
atgggtgaccaagaggaagtacaggaacagatgaaagccgacatgtcggctttgaaagaacaaatggcttccatgatggatgtcatgctaggaatgagacaactaatggagaataacgcggccaccgccgtcgctgttagtttggctgccgaagcagacccatctctcccagctaccacgcaccaccctatcccaaacgtggtaggacgagaaagaagcacactggggcacatcaacaaccccgatctggggtacaaccgagtggcttacccctatggattactacctgattacacaccgccagtcatgcatgacgatgcgggtcatgtccctcccctcatccttgaaggggagccttctcgacagatggacgag

SEQ ID NO: 62640 - DNA, 249 bp, Glycine max
  Peptide Sequence Number=SeqID_179418
atggccaacaaaacatattaccaaaagcatcagcactggaaccaagttgagtgcgaagagtggcttgtttgtgaagcatatgtgaaagagtggaaatggtattaccaatattacaatatagaacgacgccggtgtgtgcggaaacatggggggagtaaatgctatgtcatgttctttaagatttggctgttgggggtgatatttgtgttaggcttttggtggcttgtagcaataaatgagacaacttga

SEQ ID NO: 62641 - DNA, 591 bp, Glycine max
  Peptide Sequence Number=SeqID_179419
atgggctggagtggcactatactgagggacttgttgctgagtataaaatggagagatatttcaccttctggtctgacttcagggggcaatgagatgcataattatattggtcgaaatgatgaccatactggtcaccgaattctaaaggacactaaaacacttggatctgcttttgaccgctaccttcaaagcgctgggcttacttcgtttaactcgggggaagccagcgcaattggcagtgttggtttggaaaggggtgttggtggattgccacgccattcactaactgatcctgctgtcatggggcatcctggtggtggtcatgatcttgcacgaggtggacggaatgtcaattatggtgaccagttaccagtagatgcagcttccatgcctggacctgagactgtacctctacccccagatgcttcaagtactttatatgttgaaggtcttccatctgacaatatttttcgcccttttgttggatatagagaagtaagacttgtgagcaaagaatccaaacattcatctaataggaaattaggaatcctcacagcacaagggttacttgatggaggttctgaaaattga

SEQ ID NO: 62642 - DNA, 468 bp, Glycine max
  Peptide Sequence Number=SeqID_179420
atgagcgaggtggtgttgttgttggtgcatgtggtccatgcagcaggggagaagggttcgctcggagcggagccattcgttttcggttcggaggcggttcaggtggtgcaggaagaactgcaaccggttaccgagttcccggttttcgaccctgcacttgttcaactggttccgaagattctccaggtgtctctgtttccgcatcctggacctgcgggccgattcccggttcgatatcatgcggcgccgtttccgctcgtccatcatcaccgaggacgaggcgcatacgtgttcggttgggttcggttcggatttatagtcagaggcggagctagaagcagagaccggtttgggggagaagagggcgtgggaatcgtcgttgtcatcccacggcgtgaagccggcggagaagggggagaagggagagaaggggtcggaaggagtgagggcggagagcatggtggctaa

SEQ ID NO: 62643 - DNA, 414 bp, Glycine max
  Peptide Sequence Number=SeqID_179421
atggtgaacttgagaggatcagtgggagggaaatatggagccaacacacacttctccacacacctacggcggaggatcttgcaggcagcacaagggctaaccaccaccggtggcagaggcggcggcggagacggtggagcagcagagggagagcccagagagggtgaagggaaaggagtgggagattgtgaaggaggtgaagaagatgaagatggaggagagtttgacagcatagtgggaacatggattgggattggtggagaaggtgttgatgttgtggttttcactttgtactccattgtgtctttgtgtaaaacgggttttgtattgctgttaatcattgcacggtcaagcaatggtcaacgaacttaccgtgtgtgccagtttttgggtgctgggggaatgagtgggtaa

SEQ ID NO: 62644 - DNA, 741 bp, Glycine max
  Peptide Sequence Number=SeqID_179422
atggggaaaggaggtggttgctttccaagcaagacaaaggcaccaatttctggagcacaaaaggatccagttagcgttgaaagtctaatcccaagagatgatccaagtaacacaagtcaagaggtgccagcaccagcacctgaagcagtgaaaaagctgaaagttttcattgtgttctactcaacttatggccatgtggagtcattggcaaggtccttgaagaaaggggttgattcaattgaaggagttgaaggggtgttgtaccgtgtgctggagacactgccaaaggaggttctggaactcatgaaggcacctgagaaggatgagacagtgccactcatatctgcagacaagttgttggaggctgatggcttgctgtttggatttccaacaaggtatggcagcatggcagcgcagatgaaggcgtttttcgattcgactggtcagttgtggacagagcagaagctggcaggggtgcctgctggcttctttgtcagcactggcactcagggtggagcaatcacacagctagttcaccatggtatgctctatgttcccattggttataccttcggtaccggaatgttcgaaatggactcagtcagaggtggatctccatatggtgctggagttttagctggcgatggatcaaggcaagctagtgaaacagaactggccctagccgagtatcaaggaaggtacatggccacaatagtcaagaagttaggccagaaaagctag

SEQ ID NO: 62645 - DNA, 1287 bp, Glycine max
  Peptide Sequence Number=SeqID_179423
atgtcgaagttaatcttcgtgttccttgcactaattcctcttctctgcacctccttctcgccagagaaaccctcagatcggcgcatcctcgttttgctcgatgacttcgccatcaaatcctctcactctctcttcttcaactccctcaaatctcgcggcttcgatctccaattccacctcgccgacgaccccaaaattgcgctccagagatacggccagtacctctacgacgccctaattctcttttcccccaccattgaacaaatgggtctcgagggttttggaggatccattgacgcggctgcaattttggattttgttgattcgggtcatgatttgatcgttgctgctgatagcaatgcatctgatttaatcagggaaatagccaccgagtgtggagtggactttgatgaggatcctgctgctgtggttgtggatcattcggcatatgcagtctctgctactgaaggagatcatacattgattgctagtgatgattttatcaagtctgacgctccagtacttttccaggggattgggcattcactaaatcctaccaatagcctggtgttgaaagttctctctgcatctccttcagccttttctgctaacccaaaatctaaagcaagaaataatgcccggatattgatctctggctcattgagcttgttcagcaaccggtcaggtgtgcagaaggctgggagtccaaccaaacatgagaagtcaggtaatgagcagttcttgaatgaacttagcaaatggattttccatgaacgaggtcacctcaaggcggtgaatgtgcaacaccacaaagttggggaagctaatgaaccagccatctatcggatcaatgataatttggaatactctgttgaagtttatgagtggtctgggacagcatgggaaccttacgtagctgatgatgttcaagtgcaattttacatgatgagcccctatgtcttgaagactttatcaactgatggcaagggccgttatttcacatcatttaaggttccagatgtctatggggttttccaattcaaagttgagtacgaaaaacttggatatacaagcttatctttatcaaagcagctttattggaccaaagacaccgacgccgatgctctcgtcctccgaatcaagaagaaggacaagcaggagtcttccgccagtacttctagcacgacgccaataagatcgaatagtgcagaaatgagattgagttccatgccatatccggtggcagcgaaatctcacgctggtggtcggcaccatcgcacattctga

SEQ ID NO: 62646 - DNA, 411 bp, Glycine max
  Peptide Sequence Number=SeqID_179424
atgcgtgatgtggccaaaggtggagaagagcatgtggaggttcgagtttgtgagggagtagtcgatgatttgggtttcaagttgttgttgttgagtgattggggttggctttcacaaaggaggggtcaacttggacgaaggtggtgttcgaggttttgggatcgcaggagaaggaggaagatcagggaaagacaagaagaggggaagaaagaaaagggaaaaaaagaaaaagggggtctggcgcaagcggcgcatggcagtattagtaggggtcatgccaacatcgttaatggcgcaggggtgcaggggtccctggtttgtgtgcgagaagaagtgtttcgtcgtggaaaggtcgtgcgcatcagatctggaggtggaggaggtggcagggttggcgcaagaccagattga

SEQ ID NO: 62647 - DNA, 300 bp, Glycine max
  Peptide Sequence Number=SeqID_179425
atggagtcaggtgacatgcgggggtaccgtatggttatccgcacctttcgtcaaccaggggcaaacgagcccattgacgcacagagactaacatcgtcttctgcaccttttgtcatcctaaaccatggagtcagggacagcgagttaggtggtaggcacagataccttatggccatccgcacctttcgtcagccgaggggaatgaattcgacggtttttactctcctcgtccggagacattcaagcccaacaacacacgagattcttctctgctgggcggggacgatcaagttcgatggc

SEQ ID NO: 62648 - DNA, 711 bp, Glycine max
  Peptide Sequence Number=SeqID_179426
atgaaggtcacagctctcaaacaaaccagccacgatatgattgcacacataggtaaagctcgggcagcagtggaagaattgaagaggttccttgtggctgaatcgttggaggaagtgaatagaaagctagataagttctatatggttctcatcttgagaagtttacattcagactttgatcacgttcgtgatcaagtcttagctggagatcaggttccgtcgatggattctctcatcactaggctgcttcgtgttccccatgcattgaaagaagaaaatccggctgatgtagtggagacgtcagccatggctgcacctcgtgggagagggggaggacgtaacagtagaggaggccgtggtgggagaggtggacgtcctcaatgcacatattgcaagaggatgggccacacacaagagacttgctactccttgcatggcttccctgacaaagtagctcagcttaaatctgagaaatccagcagccagacttcatcttcctctgtaccatgttattcaacagcatgtatttctcaatctattgatggtctcagtccttggatacttgattcaggtgcctctgatcatatttctggtaacaagtcttcctttacatccatttcttttccaaaaattcccatcttgttactgtggctaatggttccaaagttgcagctcaagggagtggtcacgtgtctttatcttcctcattga

SEQ ID NO: 62649 - DNA, 1497 bp, Glycine max
  Peptide Sequence Number=SeqID_179427
atgggttccaatcctttgtctgcattgacttccacaatgcccgcgccaatctcaacccaagaccatgacgaccaagaagactctccttcatcaaaagctcttctttccttcagcaccgactcttcttcttctttttcttcttcttcttcctcttctcacaaacccctcttcatcaccctcatcctcatcactttcattgccttatcaacatccttcgccttcgcctttctctacttctcttcaaaaccaccactttcaccttctccttcttctctctctctcttctcatcaaaagctcgtcctctctccaaactcaaacgccccgtcgtcctcctagtctcctccgacggctttcgtttcggttaccaattcaaagccccaactccccacatttcccgtttgatcgctaacggaaccgaagctgaatccggtttgattccggttttcccctctctcactttccccaaccattactccatcgccactggcctctaccctgcttaccacggcatcatcaataaccacttcaccgatccactctccggggaacccttttacatgggtaacagccatgaccccaagtggtggctcggggaacccttgtgggaaactgttctcaaaaacggattaaaggctgcaacttatttctggcctggttctgaggtaaataagggtccttggacttgtcctttcaatttttgtatccgctataatgcttctgtttcatttgaggatagggttgatgcggttttggggtactttgatttgcctagtgatcagattcctgatttcatgacgctttattttgaggaccctgatcatcagggtcacaaggttggtgctgatgatcctctgatcactgaggctgttgctaggattgatagaatggtggggaggttgattaggggtttggaggaaagaggggttttcgaggatgttagtattattatggttggagatcatggaatggttggtacttgtgataagaagttgatttttcttgatgatttggctccttggattgatgttcctaaagattgggttgtcacgcatactcctgtgcttgcaattcgtccgccttctggtaatgatcctgcggatgttgttgctaagatgaatgaagggttgagctcggggaaagttgacaatgggaagtttttgagggtgtatttgaaagaggatctgcctagtcggcttcattatgctgcgagtgatcggattgcaccgattattgggttgatcgaggaaggttttaaggttgagcagaagagaacaaagcgccaagagtgtggcggttcgcacggttatgacaatgcggttttctccatgaggactattttcattggacatggtcctcgatttgctagagggaggaagataccgtcgtttgaaaatgttgagatttataatttgattacttctattctcaagataaagggagcacctaataatggctctgcctcatttgcagagtctgttcttctatctgctgcataa

SEQ ID NO: 62650 - DNA, 441 bp, Glycine max
  Peptide Sequence Number=SeqID_179428
atggttccatctcagttatccaagtatggtctcctcttcatttcttgcacctttttccttatcaacttcttaaccattcccatttcttccctcaacataggagttgaaaccaccggaatcactgtctctgtgagcaaagagtgcagcagaacatgtgagtcaagcttctgttcagtgcctcctttattgagatatggcaagtactgtggacttctgtatagtgggtgccctggggaaaaaccttgtgatggccttgatgcttgttacgactacctaagccaagagtgcagccaaacattcatcaactgcatgcaaaagtttaagaactcaagagctcctacattcaagggaaacgcatgtcaagtggatgatgtaattgaagttatcaatgttgtcatggaagcagctctgctggctggaagagtcttacacaagccctag

SEQ ID NO: 62651 - DNA, 495 bp, Glycine max
  Peptide Sequence Number=SeqID_179429
atggctttgcaatatgcaaatgatttagtaatatctcccacagaacttattgaatatgatagggagggattcgaacccacgacccctccctcctcccttcaaccaccaagccaatcaccatgggcaaataaaaagggaaatatttttcttccaatctctgcttctcacactcttgttacacctcttggcaagctgttgctcacttatgatggaaagttgattgagaatgaatatttgggtctgaaaaatggcataatggaccaatcagctattttgctttcaagccatggttgtttgatgtgcatgaattgcaagaccaaagattataaacttatttaccaaccaaaggttctagaatacaacgagagtgggcagccaaaagcaaccagaatattgttggcactttcggggttgaagcaagctttgacgaataaccctggatataacaagcgagttgtagagtgtcgagaggccgcacaaattcttcttgagtga

SEQ ID NO: 62652 - DNA, 495 bp, Glycine max
  Peptide Sequence Number=SeqID_179430
atggcttctcgctgctggccttccgatgccgagctaaatgagttgagagagagagtttcgaaaataggggatctgaataaagaggaagttcgagttgtggtatctccctatcgaatatgtcctttgggggcacacattgatcatcagggtgggatcgtttcagctatgacaatcaatatgggagtacttctggggtttgctccttctggcagtaaccaggttgtaattcgctcaggacaatttgagggagaagttaagttcagagttgatgagattcagaagccaaaagataaaaatttggacaaagattcatcagagctacaggaacaatgtaactgggggcgttatgctagaggagccgtatatgcactaaagagtagcggaaacattctttctaaggtcagatataatgccggaggttcacctttctgttcatcacttgattatgctgagtttgtgctatatgtatatcagatggatagcagctctatatga

SEQ ID NO: 62653 - DNA, 330 bp, Glycine max
  Peptide Sequence Number=SeqID_179431
atggagaagatgcagcacacggaggagcttgtgagggagtttctggtgttccacggcttcaccaacacccttgaatcctacgaggctgaattgcgcactgacattggaaaaggattcgagactctcttctacgcttctaggtcgcccatgccgtctagtgcaaccacaacgacaaagtcgtcgacttcttcacgctttacgacatcgaattgctgcagaggtcacaagattggactaactggttcggagtggtatcaggctttacatctttcttatagaaacttcttctgcaaagtcttcaatgctactcatatccttcatagagtttaa

SEQ ID NO: 62654 - DNA, 829 bp, Glycine max
  Peptide Sequence Number=SeqID_179432
tgagggaaatgagccagtactatctgatggctcaatcaatccttttttggagttggaggattttgagatacatggcttgttgctagatgatactcttattcctatggttgttgttggcattctccttgtggcatttgctagcaagtttggccgacttcctaatgctgagaaaaggatcactaagctgtacaagcctctagcaaagcaagcacgtcatttgaaaccattgtatatgaaggcaatgattaatggaaaatcgattagtcaagcctttctggacattggatctttcttgaatgtgatgtcattctccattgtcaagaaagattggctgcattcaaacttttgtgtgccatctacccttcatcaagttctaattttctgtgttgatgacaaagtggaagtgatgtcagatgaccaccagccattttctaaagatgaagcgtccatagaggccatcttctactccccatgcatgcaaccaattatggacatagctgctgtgcaagaattctatgaagttgaggtcaatttgatgaaacggatagacaaagacttctttgaaagcatggttggggaagtgcaagagaaaggacttgggaggaaacctccccaaaagattgaacaaactgccataaaaaaacttatacctccattaaaagcatgggatccattgttggaagtcaacctaggatcggccgacgacacacggctgaccaagatcaattaccctgaaatgccggggttgtccagagagttggttgagcatcaactgcctttgaaagaaggattcttgcctctttccccaaatctggatacaaatgattaa

SEQ ID NO: 62655 - DNA, 567 bp, Glycine max
  Peptide Sequence Number=SeqID_179433
atgtatttcccaatgtttgaggccaaacagccgaaatcgactaaagcactggatcaccatgccaaagatcctactctaagcgagtcccttcagatcaaaggaatccgcttgccgatttggaagctaaagtactacaatcggcaaactggggtagcatcccgtccactagagacttgctttatggagtcaagactacttccagtttggcatcactcaacaccttcccatggcctttctgaccatgacctcacatacttcttgtcctccattgtttgccggcgagtgaatgatcatgttcaatcacatccaattgctaaaactccaagccaaccccaaccttctcctcatctggattgtattttggctaagaagaagaaatgttcctcaattggaatcaccattaatccttcactagctcgacaaacagccaaacatcaaattgaaaccattgatctggaaaatatggaagaggacacttctccagactctgcccctttgactttcaaaaagattactaggtttactgctactcagaaatcgactattcctgaacctcattcagcttag

SEQ ID NO: 62656 - DNA, 204 bp, Glycine max
  Peptide Sequence Number=SeqID_179434
atgggagcctgtttctcaagtgggaatagatatgatgactattgggaaggtagtggcaatgggagaaggatatttgcaagtgatgaagacagagcacattgggttgctgagcctggcattgacagaaaagcctctgatttcattgctaaatactacgccacacgagtcactgactctcagcgccaatatgtgaacaccttataa

SEQ ID NO: 62657 - DNA, 315 bp, Glycine max
  Peptide Sequence Number=SeqID_179435
atggaagaaacagaggttgataagaaaatcgccatcacttttgatcatcctacactcgaaatgatcaaacacttgaagcctatatatgttagagcccagataaatggtaaaaccttgttgagagtgtttgtggatgaaggagccattttgaatatcatgcctttgaccatactaaagaagatgaccaattttactagaggagccactccaacattaggagttttggtagccaaaatcacagttggacccaaaaccatgtatcatgccttcttcattgaagatgccaagccagcttattctgtgttgctcaagtag

SEQ ID NO: 62658 - DNA, 750 bp, Glycine max
  Peptide Sequence Number=SeqID_179436
atggcgatgaacatgactgaaggaaataagccgaggttgaagaggaggatgcggtggacagcagtaatgctaagtggagccggtaacggtacggggtgttgtggcatgagtgcggggtgtggcagcgaagttggcatggtcatgggggcggtgagcgtgggtgacagagttggctggagcagcaaagtcagcggcagaggcagtagcgtggtcggtatcgggacgactggtggcggtgactgcagagggaaggaagacggagaggagtgtgggagaagagtaggggtggctggttctcggaggcaattttcgaagaagtgcatccaattgggagtcgaggtggcgttgagccacatcaactttggccaaggcggcctcaaggcggtcatcggtaacgagagaaaattcgaggtggtttggcggttattgtgggtggtagtggaaggtggtctggcagccatggaagctccgtttggtagtcgagaagccatggaaggcagccatggaagctccatttggcgagtagtgtgggtggtggtcgtgaaaggtggtctggcagctatggaagctttgtatggcgagtggtgtgggtggtgccatggaaggcaaccatggactctcaacaaaagcaccaaattgttacgtgcagcgaaaatggtagctggtttcgagggtccagcacctccagaagaagaagaagagaagaagatagcgcttggaattcgaggaccaagctgcctcctaaagtaa

SEQ ID NO: 62659 - DNA, 171 bp, Glycine max
  Peptide Sequence Number=SeqID_179437
atgacggttgatgaggttgatttagggcaatttgggaaaaagacaatggaacaacctgctaagaaatcctcaagccatcgcacctatactatagcaggtgttacacaagctaataccctggtaatgtctaccgcaaccactactgctcatcctggaagactacatagatag

SEQ ID NO: 62660 - DNA, 204 bp, Glycine max
  Peptide Sequence Number=SeqID_179438
atggctgtgaacaaaatgaagcagaaacttgcaatgattgcaaatatgaaagctaggggaaaaggagaaatctcaatgagtcaagtagccattgcattggaccagctttcaataggatactccttactagaggcctggttgaatgatgacgattttttaggtgttgagatttatgctataagcttgatacctaaggagttctag

SEQ ID NO: 62661 - DNA, 336 bp, Glycine max
  Peptide Sequence Number=SeqID_179439
atgggtccagacctctggcatcattatggatgttgcaagcctcccactgcttgtgggtacaattatgtaaaccccatactatggacaaaccctgtgaaccctatggctgattcagattgctacttgtggaacaatgaccagaatcagctatgctacaattgtaatgcgtgcaaggctggtctattgggtaacctcagaaaagaatggaggaaagcaaatatcattctcattgtggcagtggtggtcctcatatgggtctatgtcatagcttgtagtgccttcaggaatgcccaaacagaaaacctcttcgaccgttacaaacagggttgggtttga

SEQ ID NO: 62662 - DNA, 704 bp, Glycine max
  Peptide Sequence Number=SeqID_179440
atggcggagtccgccgccgtgaccctcccggaactccttcccaccctggtccccaccgcccagcccctggccccctccggccgcatcttggtgggcgtgaacctggagttccctgggctccccctccaccactccgtccacgccgaacagttcctgatcaccaacctctccctgaatgcagagccccacctggtttcccttgccgtctccgccgccccctgcgggcactgccggcagttcctccaagaactccgcgccgccgccgacgtccaaatcctggtaacctcggaggccacagcagagttcgggccactctctgacttgctccctcagaggttctgtccccacgaccttctcccccttgaagctccccttctcttggaaccccaccacaacaccctcaccctcaccctccaccaccaacaccttcccaattataagttgaagactgcggctctggaggccgccaacaaatctcatgcaccctacagtggctccccctctggtgtggctcttctcgactgccatggcaatgtttttaaaggttcctacatggaatccgccgcctttaatcccagcttgggccccgttcaggcagccctcgtcgcattcgtctccggcggcggcggcgactacgaccagattgtgggtgcggtcttggtggagaaggagtatgccgtcgttaaacaggagagcacggcgag

SEQ ID NO: 62663 - DNA, 483 bp, Glycine max
  Peptide Sequence Number=SeqID_179441
atggctttgcgaaacatcaaacaagaaggttacaattacagtagtcaagtcactccttcaaacaagctaagcctcctgtgctccaaataccttaatttggaacaaaaagaaatctgtcagagttggttgccatcagaggtttgggagcgagagataaggtggtggtgcatggtggtatggtcgtgtggtgccatctgtggttctggggaggaaagagagaaagaaaagagaaaagttgtcagaaaatgcttcccgtggtggtgcgtgatgattggagggcaaggtggagaagaaaagaaaataaacaagatgtcgctgccaaaaatcacctctgacgacagtgcaaggtggtctgccgcggaggtcacagtgttaatagtgtcaactgggttccttgtgcacagcatgagtgagagtgaaaaatgggtgggggtagcagatgaggtaagggccaaatcggaaaagacaataaaagtaaaatag

SEQ ID NO: 62664 - DNA, 627 bp, Glycine max
  Peptide Sequence Number=SeqID_179442
atggagcacggccccggtggcatccgcgacgcccttccctgccttcacgccctcgccgccgcgaacaccgccgccatcctccgcgtccctgaatccaccgccgcctgggccaagaaagccctcgacctcggcccgcagggcctcatgttccccatgatcgaatccccattatccgcccaggacgcagtctcctactgccgctttccccccaccgggctccgcggcgcggcccatcccatcgtccgggcctccaagtacggcctggacgacgagtatctcggtaattacctcgacgagcttcttatcatgtgccaggtggagtccgaggagggagtggcgaacactggcgcgatcgccgccgttgatggcgatgctgagaacaaggtgttggagagccgaaacgacgacgttgagattggggcttatctcgcaggtttcgccacggtgtatgatggggcgagggatttgaggtcgcgtgggtatcacatggtgagtggcgccgtagacgtggggctgttccggagcgcagcggtggaggatgtgacgcggttcaagatgggcggggatgggtcggagagtgatgagggggaggagaaagagggtgatgagaagtactggagtgagtga

SEQ ID NO: 62665 - DNA, 1791 bp, Glycine max
  Peptide Sequence Number=SeqID_179443
atgaagttaacgtcacctgcgcttctcagccttctcattctctgcgatctgcttctctgtcttccctcattcactttctctctcctcgccgctgacgccgacctcgatacggagcttctcctcgccggagacaacgcgaccgccctccttaatgcctcgcttgcgagatccgacgatggtagcttcgccaacatgattgatcgggctctcgaaagagagttccccgataatgagcagaatgaaggtactgatcctcgtggtttcaacaacagtgttgctgaacagcaggctgttttggaaactgttgccagagttaagcccaagaaaaatgagagcaaagaggaaaagtcatttcagttccatgatgtttttaatttggataatgagaatagggcagaggatatgccaactttaatagatcgaaaggacaatgtctttatcatatccaatcccaagtcaaagtatcctgttcttcaattagacttgagattgatatcagatcttgtagttgtcattgtctctgcaacctgtggtggcattgcctttgcttgtgctggacaaccggtgatgactggatatctgctagcaggatcaatcattggaccaggaggtttgagttttgttagtgaaatggtccaagttgagacagttgctcaatttggtgtcatctttttgctctttgcattgggcttagagttttcaacaacaaagcttcgagttgttcgagcagtggctattcttggaggcctactccaaattttcttatttatgtgcttgtgtggaataacggcttcattatgtggtggtaaatcatctgaaggaatatttgttggtgcatttctatccatgtcttcaacagctgtggtcttgaaattcttaatggaaaggaatagtgtcaatggccttcatggtcaggttacaattggaactttgatactgcaggattgtgctgttggattgctctttgcactgattcctgttttgggtggaacatcaggtgttcttcagggagtagtatccatgactaagtcgttggtgatcttaattgcatttttggccattttgaccatattatctcgtacttgtgtgccatggctccttaagcttatgataagcttatcctctcagaccaatgaactttatcagttggcatcagtggcattctgcctacttgttgcttggtgtagcgataagttgggtttaagccttgaactaggttcctttgctgcgggagtaatgatatcaacaacagatcttggtcaacatacacttgaacaagttgaaccaattcgcaacttttttgctgctctgttcttggccagcattgggatgcttatacatgtccatttcctttggaatcatgttgacattttactggcagctgttatattggtgatcattataaaaacaattgtaactgcatctgttgtcaaggggtttggatacaacaacaagacttcacttcttattagaattatggttattaggctatctatatccacgatgaagtgcttgcaagttgcacttgcacccagtttcatgggtaatctagatgtgttgagtattaagtgctcaatatttttagagattttgaagcttacacaaacagaaatagtgcaggtgactacacctttgctcttcaagctaattcctgctgttgtccatcttggtgcattgttgcggtggttccctcctgatagtccgggggagattgcatttaaaggggacagctttcgcgcagacagtgctaagcgtattcctttaatggttcaaggctctcatgattcatga

SEQ ID NO: 62666 - DNA, 804 bp, Glycine max
  Peptide Sequence Number=SeqID_179444
atggggaggaagtgctcacattgtggaaccataggccataactcaaggacctgcacatctttgagaggggctactactagtttcgttggacttcgcctcttcggcgtgcaattagacagtactaattgtgttagcatcaagaaaagctttagcatggactccttaccctcatcatcatcttcctcattctcttcatcaagactaaccattgatgaaaattctgaccgaacctcttttgggtatctctcagatggtctcttagctcgagcccaagagaggaagaaaggagtgccatggacagaagaggaacacagaatattccttgttggacttgagaagctgggaaagggtgactggaggggaatctctagaaactttgtgactacaagaaccccaacacaagtggcaagccatgctcaaaagtactttcttcgattggcaactatagataagaaaaagcgacgttcaagtctctttgacttggttggtagcaacaaagcaggttctaattcagtttcggctcatcaaaaggatgagtctaaatgtgaagttaagaataatgatgctgccactttgtcgttgctagggcgtataacttactttcaacaagaaaacaaatcatcagagtataagcaagaaacatttgataattgctcatatcaaagtcaaccaggtgaagagcatcaagtcgcagttcttaatctggatctcactcttgcagcccccaaggcaaagaccctgcaggaacaaaataagtcatctccttctgctccatttctgcttgggccaattagcgtgacttaa

SEQ ID NO: 62667 - DNA, 444 bp, Glycine max
  Peptide Sequence Number=SeqID_179445
atgatttggcgtcatgaaggcaagttcaaattggtcatggctaaagctaatatgcctgacatagacactctttattttcttgaagtagcgcttgaaaaggacattcctgtcatctttatctactccggacaatttgatgacgtcagttggaaagctttagctacgggattatgttatttccttcaggaaccaattcgtttaaatgatctcaagtatgtatggcaacatgtgtatcacttaaaatcctattcagcccaaaaaactaaaattgcatactttcaagacatggtgcgtcatgcaaaaggactacaaagcaccaagatgaaacaggttcttgaagcaaatggagaaagaaaccatgaggataatgagggcaagttaaaaggtaagagaacaattgatgacctcacaatggcagattccttgacaacaacacaatgtcag

SEQ ID NO: 62668 - DNA, 465 bp, Glycine max
  Peptide Sequence Number=SeqID_179446
atgcaacataagctgaaagtagttagaacatatttggatacaaagaaacacagatcgcggttgaaacataaagagaatgctcacaatactaatttgccttcactaagcacatcatcatccttaagccacaaagccaagtttcccttaccacccaaagagtccacttcaggagcaaaagaacataagagagcattcgatccaagtgtctcaacaccaaaggcttccttcaatgagaaccacaaccaaaaccagttttttgtgaacaacattggaattgaagaatcaaatattcttccagtggatcaaaaccaacctgctatcgagtacaatgatctcataaaaaagtttgtagaagactgtgacaattttgatttgtttgaaaacgaaactaatcccgatgatgttgatcaatactctgagatgctaagaacaattctagatggtagcagttccagtccttggtaa

SEQ ID NO: 62669 - DNA, 723 bp, Glycine max
  Peptide Sequence Number=SeqID_179447
atggcgaaagtcaagatgggtcacccaccggagcgccatgacgccatgaccaaacccaacactttctttcacaatctaatcaagcccttcaaattcagctccagcaaagagggacaaaccgaagaaaacgaaatacagaacttagctgcacaggagcagaagatcttcccctacgaaacattggttgctgctaccaacaaatttcatattcttaacaagctaggtgaaggaggatttggacccgtctataaggggaaattgaatgatgggagagagattgcggtgaagaagttatcgcatagatcgaatcaagggaagacgcagttcgtcaacgaggcaaagttgttggcacgtgtgcagcaccgtaatgtggtgaatttgtttggttattgtacccatggctccgaaaagcttcttgtttacgagtatgtccgtcgcgagagcctcgacaagcttctcttcaaatcccagaagaaagagcagctagattggaaacgtaggtttgacataatcactggggtggcaagagggttgctttatctacacgaagactctcacaactgcattatacatcgcgacataaaggcaagtaacatcttactggatgaaaaatgggtccccaagattgcagattttggcctcgcacgcctcttccccgaagaccaaacccatgtcaacacccgtgtggctggaaccaaatttgaagaaaaatttccagcttaa

SEQ ID NO: 62670 - DNA, 438 bp, Glycine max
  Peptide Sequence Number=SeqID_179448
atggctaaacccaaccccagtgcgcttagcgagcttagcgtgagattgacgctaagctcaaattcacttacttgtgctaagcgcgagaatggtgctaagcgcgatgtcgagatcaggaagccctttttaagcctgatttgcacagaattaggggggagccaagagaacggttcattactgagaggtttgaagaatgtgaattttagagagcatagagcagagcaaggggccaagttttcatcttttagggagattagtgagtttttgagagattgtgagtttcctagaggtgaaggagacatccccactccttttttctatctatgcttattgtatgcatgcttgtggcttgatcacccatttgtatgtgctgttagggactttagcattgggaaatgtactgtttccttagaacttgatagagcagggactgaataa

SEQ ID NO: 62671 - DNA, 567 bp, Glycine max
  Peptide Sequence Number=SeqID_179449
atgacgtccgctatgccgtctagggtttcctcggggggaacgccaacaattagtgatagcaacgatcgtagtcgcaagaaagcgaaaatggagacaacaccaacagaaaatgtgcaacctattcagagcatcaatgacacggtggtctcggaaacacctatgcctggggcccatcctatagggaatacgaattgtgtctcttacgaagatatatttattggggttaatggtgcagacaaggagaatgaccctactgaccatatggactggatttttgatagtgactttgatgaggaggatagcattgaagaagaaccagttggtatggatccaatagagtactatgataagaagattttgtggactattggggacaccttggggagaaccttgaaggttgatgctaatacatcaagaagggcgaatgaggagcttggagatgtgtttgttaccgaacggacaaagtttgctcgcctgtgtattgatgtggatttgaacaaaatattgcgttcacagttcgaacttaataataaaacatactctgtggaatacgagggtctacagctg

SEQ ID NO: 62672 - DNA, 357 bp, Glycine max
  Peptide Sequence Number=SeqID_179450
atgacggcggtgcatattattcagaatgcgacttctatgtcaaagtttttacaaactctcatcaatcatatagggttttgtgtgaaggggcgcgagtgtaacatagggggtatgagtgtagggatcgtgaagagactaggtggcattgtaataagttcaaaggacatgaaaggcgaatcttctgctttcaccatgatcgttgcactctcaatggctgagatttgttcgtcttatccaacttctggtgggctttattattggagtgccaagcttgctgggcccagatgggcaccctttgcttcctggattactggctgcatgactaagaagataataaggaaaatgaattacaagtag

SEQ ID NO: 62673 - DNA, 210 bp, Glycine max
  Peptide Sequence Number=SeqID_179451
atggctcatttggttgataaggatgctatcaaggacaaacatcagaagttcgaagaaagtcctatgaaagtagatactgacctgttccaaaatcaagtcacatttgttgaacctgtacaaattatgatggtcgacattattgaggatgtcaactcaaggcacattagaactctaattgctgaggagaacgcaaacaaggatttggattaa

SEQ ID NO: 62674 - DNA, 366 bp, Glycine max
  Peptide Sequence Number=SeqID_179452
atggctaaaccaagcagccccgcaaacttggcatcagccatcatttgtttctttgcctcaaagaagttcccccatagactaaaagcatcaccgggaaggtttgcaaggcaaaacccttcaccacacccttccgtcatggtccatgttcatggatttttcaaagcggtgttgtcctttgctgaggtgttgttggctgattcacgattcactcgaccggatatgggttttcacccgacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 62675 - DNA, 486 bp, Glycine max
  Peptide Sequence Number=SeqID_179453
atggggcatgaagtcgaaaaagaggtagaatctatggaagatgtaaatccccctcaagaaacacctatcaaactagatcaagtgaggcaactattcaagttcaggaaatcaccaagaatcccttcttattattcagcaagggttctgacaccagcatgcccaaatcaacttcgaaccaagttcttgaacaagcaaatgctgattttcgatggcttgcttactctcaaccttttgaaattaatcttgatatacctagttacattgaacaggatcttaaatccaaggaagaaaggcttaaaacttctattgaatccaattcaaaaactggaaagtgatctcatagaagcttcaaggacattagccttatccattaatgagcaaatcaaaaagaaggagaaggctaaacgagaccttattgccattactccaaaaatggctaagttacttgttgatcacactaccatccagaaggctcatttttcttga

SEQ ID NO: 62676 - DNA, 438 bp, Glycine max
  Peptide Sequence Number=SeqID_179454
atgtacaattacacaacatgtagtggtcatacgtttggaagagctcgttgcagtacattcattaaccgattatacaacttcaacaacactggaaaccctggtccaactctgaacacaacttacttagaactattgcgtgcgagatgcccccagaatgcaactgagaataacctcaccagtttggacctgaccacacctgatcaatttgacaacagatactactccaatcttcagcagctaaatggcttgcttcagagtgaccaagaacttttctccactcctggtgctgatactattcccattgtcaacagcttcatcagtaaccagaatactttctttgccaactttagagtttcaatgataaaaatgggtaatattggagttctgactggggatgaaggagaaattcgctcgcaatgtaattttgtgaattactga

SEQ ID NO: 62677 - DNA, 1122 bp, Glycine max
  Peptide Sequence Number=SeqID_179455
atggggagtcatatgagcaagaggatccctgaaacttcttcttctattggcctcagcaccgaattgcactacaaaactgagttgagttcctatgaagctgcttgcaagcttgattctgatttgcagttctttgacaccacacttcaagctagagcaaatcaagttatcaacactcttgctgttggtgttgaagttcgagccctttcattcgattctctaaagcaaatcacagaatgccttctggagatgaaccaggaagttgtcaaggtaatcttggactgcaagaaagacatttggaagagccaggaactgtttgaactggttgaggaatactttgagaatagtttgaaaactttggacttctgcactgtattggagaagtgcctaaagcgcgctcgcgacagccaattgcttattcatgtagctgttcaacagtttgaggaagaatcaggatcaggagacaatcgctatgcgaggacattgcaagaatttaagaatttcaaggcagctggtgaccctttcaccgaagagtttttccagatatttcagtctgtttacaagcaccagatactcatgcttgaaaagttgcaacttaggaagaacaagcttgataagaagctaaaatacatccattcatggaggaaggtttcgagtatgatctttgtggctacatttgctgcagtcttgatctgctcggttgtagcagcagccattgcagcaccacctgttgctgctgcgatagctgctgctacgtcgatcccaatcggatccatggggaagtggattgactcgctctggaggaactatgaaaatgcattgaagggacagaaggaagtgattagctcaatgcaggccggtacctatgttgccataaaggacttagacaacattaggattctcattgataggcttgaaattgagattgagtctctattgcataatgtagattttgcaattgaagaagaagctgtgaaggttgcaatagaggagatcaagaagaagcttggagtgtttatgaagaatgttgaagatttggcagttcaagctgatatgtgtagccgtgacattaggagggcaaggactgtggtcctgcagagaatcataaagcatccccacaattga

SEQ ID NO: 62678 - DNA, 198 bp, Glycine max
  Peptide Sequence Number=SeqID_179456
atgagtataagcgaaatgaaacacgcccagatggagattttggaaaagtccaaacctttgaaagcgattgaagacgaggaatccgggacaaggacaatgaaaagcgatggagctaaagggtgtttccaaaggccacctgaaaacacgatgtatgagtcaactggaacaaaggtgtccactaatctttacagtacttaa

SEQ ID NO: 62679 - DNA, 1377 bp, Glycine max
  Peptide Sequence Number=SeqID_179457
atggaaaatggtgatattgtgacagcatgttcagatggagtagtacgcatttggaccatagatcaggataatgttgctgaccagctagagcttgagttatacacttcgcaactttctgaatacaaatctagtagaaagagggttggaggattgaaactggaagagttaccaggcttggaggcactgaagatcccaggaactactgatggccagacaaaagtagtcagagagggggataatggggtggcatatggatggaacatgaaagaacaaaagtgggataaaattggtgaagtagttgatggaccagaggaatcaaatcgtcaattttttgacggtattcagtatgattatgtgtttgatgtggatattggagatggtatgcctacccgtaagttgccatacaatcgatcagataatccatatgatgttgctgataaatggctactcaaggagaatcttcctctttcttttcgtgagcaaattgtacagtttattcttcaaaatactggacaaaacaatattacttttgatgcttcatttcgtgatcccttcactggctcccatgcttatgtaccaggacaaccttcacgcatgtctgatatatctgcaaaacctactttcaagcatattcctaagctcatgcccagttcttacttctgttgtcagaaaggaatgcttgttttcgatgcagctcagtttgacgggatccttaaaaagattactgagttcaataatgctttacaatctgaccaggaaaagcagaacttgtctttgactgagctcaatgtttccagactgggtgccattgttaaaattctgaaagatacttcacattatcattctagtaaatttgcagactctgatatagctttgttactgaatctgcttcggtcgtggccaatcgcaatgatttttcctgtcattgatattgtaaggatgctagttcttcatcctgatggggctgttttacttcacaagcattttgaagcagaaaatgacatactaatggaagtgattaagaaagtcactgtaaatccaacaatccctgcaaatctgttgaccagcattcgtgttgtaactaatctcttcaggaatttgtgctactacaactggttgcaaaaacatcgtagtgagattcttgatgctttctcaagttgtagttcatctccaaacaagaatttgcagttgtcatactctaccttatattctagtcttttcaagactctatttgaagctctctctctctctctctcttttggttgtgttaattccaaattccaaatagaagatacagtgtccttgttaaggtgcagaaatgctccagtgctttctgggtttttattactctcgctccctctcccccaccttaaatag

SEQ ID NO: 62680 - DNA, 760 bp, Glycine max
  Peptide Sequence Number=SeqID_179458
atgactcttgatatccttcaaggtaaagatatgatatcctcaactttctcccagagtccagctgttttgtgtctgcatcagtacaagaaacctggtggccagagtaatttctttatgaagtctgtgattgcttttgatattatcgcctatggctgttcttacacccgtaagttcttgctttggagcaaagtatcaggctctagcaccattgagaattttaagggcgtcagttacagcaggagagcaacttcctttatctttggtgcttggttagccttgtggccttttctatttgaaaagatcaacaagactaaagttgtgttttctggagatattgttccttcaagagaacgaatcttattgatcgcaaatcatagaactgaggttgactggatgtatctatgggaccttgccttgcggaagggatgccttggatacataaaatatatacttaagagcagcttgatgaggcttccagtttttggttgggcatttcacatactagagttcatcccagtgaaaagaaagtgggaggctgatgaatcaatcatgcgccatatgctttctacattcaaggatcctcaagatcctctctggcttgcgcttttcccagaaggcactgatttcactgagcaaaagtgccttcggagtcaaaaatatgctgctgagcataagttaccggttctgaaaaatgttttacttccaaggacaaagggcttctgtgcctgcttgcaagagttgaggagctctctcactgcag

SEQ ID NO: 62681 - DNA, 882 bp, Glycine max
  Peptide Sequence Number=SeqID_179459
atggcctgcacttacacaactcaactccccctcatcaaggtttcaagaaggcctaagttgtttcatagatggtcatttttgcactctgctgaggccatacgtaagcaggaattttcagaatcgttgcccagaccatcaatccaagatgttagtactatattgatgggagctggatacgaggtattcttgaaaggaccatctttatatgcttttcaaggacttgctggtcgtctggcccctgttggagtccatatagcattgctactgataatggctggaggaactcttagtgcttgtgggagcttcagaggttcagtcactgtgccccaggggctgaattttgttgtatatgatgttctggctccttctggctttctatcctctccaaccgatgcttttaatacagagattcatgtcaacaaattctacatggattattatgagagtggagagtccttgcaaattgcaattgaattctgctgtgtattcacaacatttcagcctgaaaaggtttcacagttccacactgatctttcccttcgtaacatggatgggaaagaaacagattggagtatttccgctctgcaaattcttaaggacaatgaaggaccttataacttagctatggcacctctacagatcaatggagataagcaactttttggtacttatctaccggctggagatattaactctcctgacgttaagggaatatctatgcttgctcgtgacctgcagtcaattgtcctttatgataaggaaggaaaatttgcaggagttacatggccaaattcaaagctcccaatcaatattgatggttcagaaattgtcattgttgatgcaataggaagtagtggcttggacttgaaggtgccaccttaa

SEQ ID NO: 62682 - DNA, 315 bp, Glycine max
  Peptide Sequence Number=SeqID_179460
atgtcgcagactcatagcgtattgggaaagaaaggtacgaacaatgtcgcagactcgcagcgtgctcctgggtgtggaggaggtagcggcgctcgccggtgtcgcaggggtcacatccttgccggggtgttgcagcctcgcaggtgtgaagagcagcaacatgctaggcttcagtgtagcggcacgaaaatccggtccagatcccgcgccactctgccacgctccgccgtgatagcagccgcgccaaccgtgatgttgaaccacgccgctacgtccatccccgtcgcagatgggagccgcgacgcccgcaattga

SEQ ID NO: 62683 - DNA, 549 bp, Glycine max
  Peptide Sequence Number=SeqID_179461
atggcagtcagggccaagaatcgcgatctttcatattgtaaaatagtggaggtaattgcagagacaaatgcaccactgagtcccatggaggaacttcttgcaaagataccttctcaacgcccttacatttcttcacccaaggaaccagatattgcagcagtgagtgttccagatccctctgctaatgttgtggctgcggaacctagcgtcgccactcagaaagaaactgcacaacctaaaccagtggcaaatcagccactttctccctatactgtctatgatgatttaaaagccaccatcatctcctccatctcagcctggtggtgggaaacaaacaaagatcaatatcctgacttaaagcctccaacatcaccatctcctaatgcaccaactatatcagtttccacatctgctgaagaaggggtgccagagatagccacagtttcaagcaatggaccagcaccagcccaactttcaatagcagatgaaccaaaggaagaacatctccctgaacccaagtcaagaccactttcaccttataccatgtga

SEQ ID NO: 62684 - DNA, 1494 bp, Glycine max
  Peptide Sequence Number=SeqID_179462
atggacgattacgcgagcagcgacgaggattaccattacgactccgatcaggaggactccgtcgaggcctacgaaaacgacgagaattacgccttgctttcttccaagggccccactactaaggtatacgatacgccgttttggggttattccaatttttattcttcttcttcttcttcttatgtgaaaaaccctcacttattgaattttcttctcgcgatgatttacgtccgtgtttgtttatgtgattacaaaggaatcactgctggctgcacaggtttttctgagatcacaacccacatttttttgcagaaggaggatttgcgcagagtgatggacatgctatcggtgagagagcaacatgctcgtactctgcttatttttcatcgttgggatgtggagaatctgtttgaagtgtatgtagacaaggggaaatcatttctctttgctgaagctggtgttagtgtggatgaacatcgtgactctgactcacctgttcctcctgatttcatgtgcaacatttgtatggatgaagttcctagtagcaaaacaacgagaatggactgcggtcactgcttttgcaacggctgttggatagagcattttattgtcaagataaatgagggtcaaagtaagcgcattagatgcatggaacacaagtgcaattccatatgtgatgaagctgttgtaagaactctactcagtagagagcactctcatatggctgagaaatatgaacgctttctgcttgaatcttacattgaagacaataagagagttaaatggtgtcccagcacacctcattgtgggaatgcaatacgggttgaggatgatgaactgtgtgaggtagaatgttcatgtggtgtacaattttgttttagttgtttgtcagaagcacactccccttgttcatgtctgatgtgggagctttgggctaagaagtgtcgagacgaatcagaaactgttaattggataactgttcatacaaaaccatgtccaaagtgtcacaaaccagtggagaagaatggtggctgtaacttggttagctgtatctgtggccaagctttttgttggttgtgtggtggagctaccggccgagagcatacttggtcaagtatagctggtcatagctgtggtcgctacaaagagcaagaaaaaacagctgaacgtgcaaagagggatctatatcggtatatgcactatcataaccggtataaagctcacacagactcctttaagattgaaagtaaactgaaagagactatacaagggaagatttccatttcagaagaaaaagattctacactcagagattatagctgggtaaataatggactctccagacttttcagatctaggcgagtcctatcatattcatatgcatttgcattttatatgtttggagatgagctttttaaggatgaaatgacagacgctcaaagggaaataaaacagaacttatttgaggatcaacagcaacagcttgaagcaaat

SEQ ID NO: 62685 - DNA, 1727 bp, Glycine max
  Peptide Sequence Number=SeqID_179463
gttcaacgaaatctagtacgggtagtgcagaggggatttctgagaaaacagattccaaggatgacaacttagtatttgttgccggtgctactggtagagttggttcacggacagtgagggagcttataaagcttggatttagagtcagagctggagtgcggagtgctcagagggccggtgcattagttcagagtgttgaacaattgaagcttgatggtgcaagtggagggggacaagctgtagagaagcttgaaattgtggaatgtgatttggagaaaccagaaacaattggatcggcgttaggggatgcgtcaacagtgatatgtagcattggtgccagtgagaaggaagtttttgacatcactggaccctttcggatagattatcaggccaccaaaaatctaattgatgctgtcctagtttggaaaaggaaggcagaagaagcactgctggccagtggacttccatacacaatagtgagacctggaggtatggaacggcctactgatgcttttaaggaaactcataatataaccctatcaacggaagatactttatttgggggtctggtgtcaaaccttcagattgctgaactcttggcagtcatggccaaaaatcgtgatctttcatattgtaaaatagtggaggcaattgcagagacaactgctccactgactcccatggaggaacttcttgcaaagataccttctcaacgtccttacatttcttcacccaagaaaccagatattgcagctgtcagtgttccagatccccctgctaatgttgtgactgtggaacctaaagttgccactcaacaagaaactgcacaacctaaaccagtggcaaaacaaccactttctccttatatcgtttatgatgatttgaagccaccatcatctccttctccatctcagcctggtggtgggaaaccaacaaagatcagtgagacagtgccaaaaccaagtgcttcagatactccaagtagtgtgccaggagtagatggcatctctcagacaacatcgtcatctaaagtggagaagcctctttctccttatgtagcatatcctgacttaaagcctcccacatcaccatctcctaatgcaccaactgtatcagtttccacacctgctgcagctggggtgccggagatagacacaatatcaagcaatggaccggcccaactttcagcagcagatgaaccaaaggaagaacatctccctgaacccaagtcaagaccactttcaccttataccatgaactatggaagattcggcaacaccttcaactgctttggcttacctcaatccttcctattgggacgaaaggttctcgaaggaggagcaatacgagtggttctaggattattcctattttcgccacttgattcaaccccatctggaactatggatgtattgttcgtggacagtggtaacccatggaatccaaagcctgaaactatatccaaggtcatggccacgttgaaaggtgttcacggggttttgaaagctggtggcacatttatctcagtaacttttggacagccacatttcaggcgccctatatttaatgcaccagatttcagctggtctgttgagtggactacttttggtgaaacctttcactattttgtctatgttctgaaaaagggacagagatcgtcacatgatgatattccacccgttaagaggtttgaagcacgcctattaatttacttcatgaagagttag

SEQ ID NO: 62686 - DNA, 522 bp, Glycine max
  Peptide Sequence Number=SeqID_179464
atggcttctgaaaccatgttattgatagaaagggttttggtacgagctagagatgatgaaattattggatgtttcccgactgttactttctgtgtgattgatatggctaaagtgacacatcattttgtgagaggaaataatccaaagaagtttgcttctactctatgttatcctggtgaagatgatttggccattgctcgggcagttttaaggtacttgtcttcaggtaatttgaaagatgcgaacatactaatggaagagataaagaagcaaactgaatcggctgaggttgcatttcctaagacagagttgatgcaatttatcgcatatcttttgcaaacgttggagagagatgctttgcctctttttagtatgttgagagcaaattttaagccaagtattgagagggagcctgcgttcaatgagatgctagatgatattgcggagaggttctttggagtacagcgaaggaaccccatgggaatgtttggagatatattcaagttgatgggagctgagtaa

SEQ ID NO: 62687 - DNA, 351 bp, Glycine max
  Peptide Sequence Number=SeqID_179465
atgagtagcaaagggttgctgagaggagcttcgttaactgcaaacgcagtgtggcatagaagcagtttcttcccaaaggtaacggttagcgtccaccgcaagttggtgaaatttcgaagcttctcattaaccaccacttgctcctctcttctacctccggatttgccgcgtttggcaaaaacggctcaaatttcacttaccccaaacgaggttgaagaaattgctcccaaaattcaacaagttatagaatggtttggacagcttcagggtgttgatcttgaaagtgttgaaccctcgatcagagcaggttctctacgaacatatattatcactttcatcatctatcaatga

SEQ ID NO: 62688 - DNA, 219 bp, Glycine max
  Peptide Sequence Number=SeqID_179466
atggagtggagcggagtgaagtgggtactgtcttcgcgaatctttcaccccgactttttaacatgtcttccgaattcgaagttaatttgcaagatggctaaggaaaaggctcagatcaacattgtggtggttggtcatgtggaccctgaggaggcaaccaccattaacgagctgaagaagcctgttgtggagaaagaagctccagggcatgccatatga

SEQ ID NO: 62689 - DNA, 207 bp, Glycine max
  Peptide Sequence Number=SeqID_179467
atgtcaaaagaagaatcaaacaaagttgcttcaaaggataagcatggcttcaagattaatacaagattgcttcaacaaacaaagccttgcttcaagattaactcaagatcaagccttgccttaaaacaaagtgctttcaagacattcaaggctctgataatcgattaccagcctatccctcttaagttattgaggccacaaggttga

SEQ ID NO: 62690 - DNA, 387 bp, Glycine max
  Peptide Sequence Number=SeqID_179468
atggccctacaaattggccaccaaattgactgggctcatcttgttcgctaccatatgcataaggcattacgggtaaatgcacctctcccttatccccacctagttactctgattctgcagcacttcagcattcctcttgctaatgaaccttttgtcaaggttaaatgttcatttgccattggagccactgcagttgaatcctttgggtataggaaagatctagacggtcaatgggttcgtaaacaggatctcccaactaatgctccgaacgaatgcattccatctccaccaccaagagatccatcctcttcgttactgaatgatgtccttagtgagctttgggatcttcatgcctttgtcggagaaaggtttgattcaatggattga

SEQ ID NO: 62691 - DNA, 231 bp, Glycine max
  Peptide Sequence Number=SeqID_179469
atggtagtgacaattgatgataatggtggtggcaatgacaatcatggtggggttgcattggtagtcgtggtggtggcagcaacggtgatgaaggtgatggcggtagacaatggtggtggtgacgtgaatactaatgctactaatgtaaaggtgaaggcaatgatgagagaccacggcaggtctaccattgttggaaaccaatttttcacctttagatacagtcgctgttaa

SEQ ID NO: 62692 - DNA, 1221 bp, Glycine max
  Peptide Sequence Number=SeqID_179470
atgtcaactaggcagctgcatcatacaatctttgaatgtcattggcagttggggggaagtaaagagggagacgacagaggaagcggtggagggaaggaatcaagaggtacacttggccaggggcttgaaacaagcacctacactggggaggttgtcttttcaatagcactagccatagctggccttatcctatttgcacttctgattggtaacatgcagcttgcctccaaagtcctaagagttataacgagtctgtttgtaagggcagctagaggtgatatatcttctgatacatatcttcagtctcttacaattagacttgaggaaatgagagtcaaaagacgtgattcagaacagtggatgcatcatcgcttgctcccacaagagcttagagagcgtgtgagacgatatgatcaatacaagtggttggcaacacgtggtgtagatgaagaaagtttggttcagagtttgccaaaggatcttcgaagagacattaagcgtcacctttgtctggctctagtgagaagggttccactatttgagagtatggatgagagattgcttgatgccatatgtgagagactgaagccatgcttatttacagagagtacttacattgttcgtgaaggagatccagttgatgagatgctcttcatcatacggggtcgccttgagagtgttactacagatggtgggaggagtggattcttcaatcgtggttttttaaaagaggccgacttctgtggggaggagcttttgacctgggcactggatcccaaatctggctctaatctcccatcttctactcgaacagttaaagctttaacagaagttgaagcttttgccttaactgctgaagagttaaagtttgttgccagtcagtttaggcgcctgcacagtagacaggttcagcacacctttcgcttttactcccaacagtggaggacttgggctgcatgctttattcaagcagcctggcgtcgctattccaaaaggaaaactatggagcttagtcagaaggacgaacctgaggagtcagaaggaactcgtggcaatgccagtggcagttcgtacagccttggtgccaccttcttggcctccagatttgctgcaaatgctcttcgtggtgtacatcggaatcgggaagccaagagtgccagggagttggtgaaactacagaaacctccagagcctgacttcactgctgatgatgcagactaa

SEQ ID NO: 62693 - DNA, 405 bp, Glycine max
  Peptide Sequence Number=SeqID_179471
atgtcagaaaatctatctatagcagttgtgaatgtaagtgacaagtttagattgtctcttaactgcaaaatttctataaacatacaggctgggagaaggctgaaaatgaagggacaaaatagaacagcattgctggttacctcaaacttgaagagtgcaattgatgaatggatagcccagaagaaagcaaaccaccaaggtagaggtagagtgttgaatgctaaagtccccagcggtcacgaacctcgacggtggtcacgaccccaacgacaacgatggtgtggaggagaccagagcgaccttctgtgtcttcacgatgagagagaaagaggcttttgtgtttctgaaactaagctagtgcgcgcggggggagaaccttctggatgggttttaatttatctttaa

SEQ ID NO: 62694 - DNA, 864 bp, Glycine max
  Peptide Sequence Number=SeqID_179472
atgactaatgcaaactgtccgcaagagtcattgcattcaatctcaaacgggaatctaaggaaaatagataatataagtgcgagagccaaagggcaggaagatgaagacaatctctggacattgtgttccggtaaaagacatatcagtttcgaaagcagcttaaattctcacaaactcaaacacctctacaacgagcttggatcatgtgactctcataacaagcacaaaacgcacagaacagagaatggtaatgacagtgggaaggtagtgggaaattctgttcaaagtgttgatattaacaacgagttgagccttcaacatgtgaaatttgatcagttcaaaaggcaaaaaagtggtagtgggaatgctgatggtgaaaattttagtcaacaagaagaagaagaaaatgtggatgggggtgaaatgcataagaagaagaaaaagaagaagcaggaagttgagtccttgcacgacatacatagcaccgttaaatttggagtgagggaagctgatggaaatcatgttagttctaggaaccctacaattgagaaatgtagttctatgttagataatcttgtgggctcactagatcttcataagattaaccaaatcagctcactagttcaactgaactgggtcactggtttaaccattgattgttcgggtcaaatagggacacatatggcaaacttactcaatcagacctctgattcagagtcgaattggtccgtgacgacgacaacgatcatggcagcagtggtagtgacaactgatgacaatggtggtggcaacgacaatcatggtgggggttgcaatggtagtcatggtggtggtagcgacgttgacgaaggtgatggcggttga

SEQ ID NO: 62695 - DNA, 567 bp, Glycine max
  Peptide Sequence Number=SeqID_179473
atggaagacgcacccttggcccgcacaagaggcctttttgcgcccacgccggagggcagtttgcgaaattgggcggataatgcctttctggttctgaatggggttgaaggtgaatgtgatgatttgtgggttgagagggtggtagtgattgagctttatggtgacatcctttcgaagaaaacaacaaagctgaggatggtagagaaggtgcaagtgagaatggggcctaaagccttgagccactggactcttaacaccacatttgcatcgctcagaggaaggaggtgcaatgtggcccaaaagggaatggaagctgatttgggccagagtggggtttgggtcatcgggcgtttgagaggaatagggttaagggatggcaattttaagggcgtggggagcagcgacgggcttggagtgggtgaggaaattgcagagctccaggggattggtgtggggagggtctgggtcaccataggtgaaggcgcgccaaccccgccgcctgagccaccatcaagggttggagatcttggacttcccgacgtatctccggggacattctcgagatga

SEQ ID NO: 62696 - DNA, 1194 bp, Glycine max
  Peptide Sequence Number=SeqID_179474
ggctacacgtcctcgccttcagaggactacagtccttgacttcagagggctacacgtcctcgcctccagagggctgtacgtcttcgacttcagagggctacacgtcctcgacttcagagggccacacgtcctcgcctccagagggctgtacgtcctcgcctttagagggctacaagtcctctccttcaaagggctacacgtcctcgccttcagagggttgtacgtcctcgccttcagagggctacatgtcctcgccttcagagggctacacatcctcaactttagagggctacacgtcctcaccttcagagagctgtgcatcctcgcctttagagggctacatgtcgtcgcctccagaggagggctacacgtccttgcctttagagggctatacgtcctcgccttcggaaggctacacgtcctggccttcagagggctacacgtccttgccttcagagggctacacgtcctcgccttcagagggctacacgtcctcgacttcagagggctacacgtcctcgactttagagggctacacgtcctcgcctctagagggttgtacgtcctcacctttagagggctatatgtccttgcctttagagggttgtacgtccttgcctttagagggctacacgtccttgcctccaaagggctggatgtcctcgccttcagagggctgcacgtcctcgcctttagagggctgcacgtccttgccttcagagggctacacgtcctcgcctttagaaaactcaagttcctgggccacccccctaatcttggaggagggccaactgtgcgagcacagccagaggaggaggttatcgcgcagctattatgcatatcagggcaagatttcgcccagaccgctgattgtgcccacaagacactcagtggacccggagaagtccaacagggccctggggtttccagctctaattacgagcctctgtcagttctatggagtgcccgtcaccccaacaaggtgatcaggccctctactaaccgagctttcatcaagaagtactgcgcccccaggcaagcgcaggacgaggcaccacagcggcctggggatggccagcaatgggcaacaaacacaccgccaccacctctagagcccctcagctcatctacaaaggctgtagcgttgcctaagactcgtggccgaccagtaggcgaccaagtccaaagccaaag

SEQ ID NO: 62697 - DNA, 477 bp, Glycine max
  Peptide Sequence Number=SeqID_179475
atgttaaaaataaagggatacggtttaactgagtctgcagttacccgaaccactccagaggaggcaaatcaggtgggagcaacaggtaaactgataccaaatatagaagccaaaattgtgaacccagaaacaggggaagccatgtttcccggtgaacaaggagaactctggatcagaggaccttatgttatgaaaggttattctggtgacccaaaagcaacttcagcaactttggtggatgggtggttaaggactggggacctctgttattttgatagcaaaggtttcttgtatgttgtagataggttgaaagagttgattaaatacaagggctaccagatcagaattagggtaagggttaaggaaaatggcataaataaaacttcaattttgatggcagaatcacgttgctccggcagagctagaagagttactcctatctcattcagagataatgatgctgcagttattccgtaa

SEQ ID NO: 62698 - DNA, 399 bp, Glycine max
  Peptide Sequence Number=SeqID_179476
atgtaccctcccttgttctctttaaacctagtagatgtatcctccactagaactgatccacaagagatgtaccctctcttgttctcagtcaaacccaaggaatgggatgattcaaaagaattctcggactgtgtcattttgaattctttgacaagggagaagggagacacaaaagaattcaggcggttaatcctttgttcttttggaaaagggagaagagagacacaaaaacaattcaggcggttagtccttggcgaattctttttggcaaagggagaagagaatgaaaagatgaatagcacaagttttcaaggtttggaaaaccagaaaacttcagaaagcttttggtacaaagaagaagaagaagttcaaagagattcaaggcttgtaaaggattga

SEQ ID NO: 62699 - DNA, 147 bp, Glycine max
  Peptide Sequence Number=SeqID_179477
atggtaaatagagtgagagagtgttgtgaggaaagggatgaattgggtggtgctggagagtcatcagaagcaccgtgtcggcattggcctgcagtggcagtggaggaggatgagccctttctcttctttgatgattctgtcatttga

SEQ ID NO: 62700 - DNA, 192 bp, Glycine max
  Peptide Sequence Number=SeqID_179478
atggcgacatcagatcacatcgacacaattgttgctgcaaagtgcggtggtggccagagagcaagcgcccacaatggagtcgatatgtttgtgggaagtgcgtttgagaagcccaatttgtactggaacatgaaatgtaatagtgtccttaatgccgttaatttgtgtccaggttatgcaagttgtgtttga

SEQ ID NO: 62701 - DNA, 255 bp, Glycine max
  Peptide Sequence Number=SeqID_179479
atgtttcttaaagcacttcacctagtcatatgctctcccgaacacaaagttcaagatcatcataggatccaaacacaaacaacacacagggagtcactctcactaagtaagatcatagggagaccagtcagggtcacgatgttctgcgagaatgttccaactatatgggatcaacataggcttaaaggagcactcaaacccagtgactcccaaggcctacacttcgaagagtccatcagggcctctccctcctga

SEQ ID NO: 62702 - DNA, 201 bp, Glycine max
  Peptide Sequence Number=SeqID_179480
atggagaaacattccacactaaaagaaggaaaaccagaggcatcaggtagcaagaaaagaaaaaccagagaagaaataagaagcaaagcttacctgcgcggggaaggaaacgaatgcggcaatggaggcgcttgcgggaacaagaaggagaagacacagaacggcagaagaggtatttttttggtaagcattttaaaataa

SEQ ID NO: 62703 - DNA, 189 bp, Glycine max
  Peptide Sequence Number=SeqID_179481
atgggtgccaagtacctcgaagtggtcaaacgagggtcgcatcccaacaacggatggtccctaacctattgtcgccaagcgcaattccttacggccataactaaggtcgataaagctaagcgccagtcatggaagctaagcgagattcattgtggcaattttagcgctaagcgagaacctctcagctaa

SEQ ID NO: 62704 - DNA, 297 bp, Glycine max
  Peptide Sequence Number=SeqID_179482
atggggatccatgagaacaagctcgtccttgtcacgtgcggggggaccataggagtcaaagcggaagatgagtttgcccttgcaatcgtagacatcgaagccatcactgttgaagaagagggatgttttgagcactgtgatgttggggatgccgttgataccgagggagtggagcatgttgagagtttccttgtcgacctcgatgtggtcggtgtttatggcagagacatcggggcgaagtccgacgcccaagctcatcctcgatgcagcacttcttgctatgtgagggaacagtga

SEQ ID NO: 62705 - DNA, 309 bp, Glycine max
  Peptide Sequence Number=SeqID_179483
atgaagagatcgtcgatcatcggaaggtcgaggacgagcgtggccatggaggtgtacgatagccccagtgtggagtacctcattgaagggtgcttcccgcagtggtgttgcaaggttttcaatgccgctaaggaacttgtggctgagattcaccgcaaagtggaccccaccactagcgttatgctcgggaaggaagtcttttggctttgcatcaagcctgcttttgatgcagcctctgaaaagttgagttgtgtaatatttgttaatgttcataataactggagctatgatgagtctatgatgctttaa

SEQ ID NO: 62706 - DNA, 1212 bp, Glycine max
  Peptide Sequence Number=SeqID_179484
atggtaggctgcgcttcaaatccaaacaggaagagtaatgtccaaaaaagagaaaacaaaaaatttagaaaacatgcttcacttgctgacatgccaaagaaaaggcatagcaatgctggaagccgtgtgggagactatcccgttggtgactttattaacctggactttgagaagggtgcttcagccaagggccggaaatctgatgtttctaacatgaaattgtgtctcgcccaactccaacaccacaaccatagtaaaaaagatgcaaatggaaaaacccatgaggatgcctggtttgactcagttagcattatagaatctgaatcagatgatgattttattagtgtacttggagatggttttccctttgtcactaataatgctttgggaagtgtcccaaacacccagttactccaacatgaaaatgcatcatgcttggtagattcagggtgtaaatatgatcggttatgtgatagctacttcaaagcagataagcaaaagtgtcctgctccagattttagcccttatataccaataggtgttgatttatttgcgtgtccccggaaggtaaatcacattgctcagcatctagaacttccttctgtcaaagagcatgagaaagtaccttccctccttattgttaatatacagttgccaacatatgctgctagcatgttccctggtgatgctgatggggaaggcatgagccttgtattatactttaaattgtctgagaattttgacaaagatacctctcctcactttcaggagagcatcaagagattagtagatgatgagatggaaatagtgaaaggtttaacaagggaaagcttggttccctttagtgaaaggctaaaatttttggtaggggtggttaatccagaggaccttcagctaaaatccgcagaaagaaagcttataagtgcctacaatggcaagccagtgctttcacgccctcaacacaaattctttaagggacctaactattttgaaattgacttggacatacatcgctttagctatatatcaaggaaagcacttgattcactacgagaccgtacaaagaatgtagtacttaatatgggcataactatccaggcacagaagcaagaggaactgccagagcatgtcttatgctgcttacggctgaataaaattgattttgctaacaatggtcaaattcctactattgtggctcttgatgataattaa

SEQ ID NO: 62707 - DNA, 483 bp, Glycine max
  Peptide Sequence Number=SeqID_179485
atggacggccatatgggaatgaggaaaatcagttctcactgctctatccctgatttggatgattccgatctcttacgtttgcttgagaaaccaaagttgaacattgagagacagagatcgtttgatgagaggtcactcagtgaactctccattggtcttgcgagagcgggcttggataactatgacacttattcgccagggggaagatctggttttaacacacctgcttcgtctacacggaactcgtttgagcctcaccccatggtcgccgatgcctgggaatccctcagaaaatctctagtctattttagaggccaaccggttggcacaattgcagctgttgatcatcaatcagaggaagttctaaactatgatcaggtgaattcctcaaactatactgaaatgtcatattccaattttaggggtgtgtacaatttttttgaaaaatgcaatgtatggaaactgaatggtctagagctatga

SEQ ID NO: 62708 - DNA, 174 bp, Glycine max
  Peptide Sequence Number=SeqID_179486
atggaggaaggtggaaaaagatcaggatgtaacagtgcttcaaatgggattttgggaggaaggtcgacgaaattggaaaccatagtggaggagaagtttgagggactcggagctagagtcagaagtgaaattgatgatcatgctagagagagccaatttgaaggtggaaagtga

SEQ ID NO: 62709 - DNA, 267 bp, Glycine max
  Peptide Sequence Number=SeqID_179487
atgagggctggagagccagggcgtggcgaggtaggtgccgtggagaatcctgcatttggaaaccacggcgtcgtagaattgggaagcgggatggtagcgcttggaagaggagacagtaggggttgccggtggtggtggtggtggtggaagaacacgaccaatccaaatccatggaagaaaagaagcaaggaaaatttggattgcgttgtgtatgagaggtgtgagcgtgaaagtttaatcagagacctctctgctacgtccacgtga

SEQ ID NO: 62710 - DNA, 1470 bp, Glycine max
  Peptide Sequence Number=SeqID_179488
atgaagggtaacttgttagggcaatatttattagaaggaaaactgtgtaaagacaattctttcaaggacgatatggaagattcagaggaggatgagcttttgaatcttagcctttcagttgctgctaatagggaaaggaaaaagaagggaaagactacgattagggaacatcacgtttccatgactactactactacaactaggaattcctatgaaagctaccatgaagggaagatctttaggcttctccaaatgagggagcagatgctgagacaagaccataggaggaaaggtgttgtggaagatggcaatggcctccctttgatccatttgttgctctcaaccgcaacttcagttgatgacaacaacatggactcatccttagagaatctcactgatttataccaaaccgtttccgtaactggtgactcggttcaacgtgttgtggcctatttcgttgatggtttggcagcaaggcttctcacaaagaaatctccattctatgacatgctcatggaggaacctacaaccgaagaagagtttcttgcattcacggatctctacagggtttcaccttacttccaatttgcacatttcacagcaaaccaagccattttggaggcctttgagaaagaggaagagaggaacaaccgtgctttgcatgtcattgactttgatgtctcctatggcttccaatggccctctctcattcaatctctttcagaaaaagcaacaagtggaaaccgcatatccctgaggataactggttttgggaagagtctcaaggagcttcaagaaaccgagtctaggttggttagtttctcaaagggttttggaagcctcgtgtttgagtttcaagggcttctaagaggctcaagggtcatcaacctaaggaagaaaaagaacgagaccgtggctgtcaacttggtttcttatttgaacactttgagttgtttcatgaagatctctgacacattgggatttgttcattcccttaacccctccattgttgtggtggtggagcaagaaggtagcaggagtcctaggagcttcttgtcgaggttcacagactccttgcactactttgcagccatgtttgattcacttgatgattgtcttccacttgagagtgctgagaggttgagaattgagaagaagcttttggggaaagagatcaaaagcatgctcaacaatgatgtggatggtggtgtggattgccccaagtatgagaggatggaagcatggaaggctagaatggagaatcatgggtttgttgccacaaaaataagctcaaagtctatgatccaagcaaaactgttgctgaagatgaggactcatttttgtcctcttcagtttgaggaagagggaggtgggggtttcagggtttctgaaagagatgaaggaagggctatctctttagggtggcaaaataggtttctgcttactgtctcagcatggcaatcagtctga

SEQ ID NO: 62711 - DNA, 1227 bp, Glycine max
  Peptide Sequence Number=SeqID_179489
atggctatcagattagaaacctctagcctaagtacaaatacaattccacggttgatctttcggacttatgtgtctaatcatggtacagtttctgctggtgctatccatatggaagatgttgtttctacagatgaatccactcccattgttgtagtaattcctggtctaacaagtgactcttcatctgcgtatctcaaacatcttgcatatcatacagcaaagtgtggatggaaagttgttgtcagtaatcaccgaggacttggaggtgtttcaatcacgtctgattgtttctacaatgctggatggactgaggatgtccgcacagtggttaattatctacacaaagagaacccaagggcacctttgtttgttgttgggactagcattggagctaatattctgataaaatatcttggtgaggatggtgagaatattcctgtagctggagctgtggctgtttgctctccttgggaccttttgataggagacagatttataacccgtaggcatgtgcagaagttttatgataaagcacttgcaattggacttcaaggttatgcaaaattacatcagcctcatttttctcgccttgctaattgggaagggattgaaaagtcaatttccattcgagattttgatcatcatgccacccgcattgttgggaagtatgagactgttgacacgtactatagacgctgcagcagttctacttatgtgcaatctgtttcgattccacttctctgtattagtgctctggatgatccagtctgtaccagggaagccattccctgggatgaatgcagggcgaataaaaatattgtcttggctactgtaaaacatggaggacatctggcattctttgaagggataactgcatctggcctttggtgggtaagagctgttaatgaattccttggtgaattacgtgctagccattttatgcatgtacagaagaagatcactaaaccaaccataccattggactcgtcaattgatcaaggcccttatgttaatgttaaggaagatggaatggatacagataatgacggtctagagatgattccagaagaaaaagtggttaaacaagatgagcttgagactaatgcaaagattcgaggttctcctggcattgctcaagcttgtgttcatgatgcagcagtgcatatgtataagaatatacacacatcatttctttgccctgcaatcgggggaaatctgcatttctag

SEQ ID NO: 62712 - DNA, 438 bp, Glycine max
  Peptide Sequence Number=SeqID_179490
atggcagaaaagaagaacccagaacaagaagaacaacaccgattcccagttctgacagtgctcaagaacaacgcaatcctcaagaacatcttcatcgtactcgatgaacacgacgaggatcagacggttctgattggacgacaccctaactgcaacatcgtcctcacgcaccccagcgtgagccgcttccacctcaggattcgctccaacccctcttcccgcactctttcactcgttgatttggcttctgtgcagggtacgtgggtgcgtgggaggaagctcgagccaggagtgagtgtagaattgaaggaaggtgacaccttcactgttgggatttccactaggatttatcgtctcagctgggctcctcttacccaattgggtgtcgttgtgccccaacaacatcaaaaagaagatgaacaagaaaacataatcaag

SEQ ID NO: 62713 - DNA, 192 bp, Glycine max
  Peptide Sequence Number=SeqID_179491
atgaggcaatcccaattagtgaaggtcaagtcgttgctaccaccaacaaccctactctttcgtctcattctcttgcctaaatctttcctctccctcccaacatttgcagcgatggcgacaacttgcaaggtgggtagctttggtgtgtggtggcttgcgacgacagtagctagctgggtgtggctctcgtag

SEQ ID NO: 62714 - DNA, 1419 bp, Glycine max
  Peptide Sequence Number=SeqID_179492
atgcccatgcccaagtattcaccactgggccttgacaccaacaccttggccctaagcaggcttttgggtttctgctcccaccctcatcagggaagcctcacctatgcatgcagagtctttgaacgcattcaccaccccacactttgcatatgcaacacgataatcaaaaccttcctcctcaatgggaacttctatggcacctttcatgtcttcaccaagatactgcagggtggtttgagccctgacaactacaccatcccttatgtgttgaaggcttgtgctgcccttagagattgttctttgggtgaaatggttcatgggtacagctcaaaattgggtcttgtgtttgatatctttgtgggtaatagtttgatggcaatgcacgtgtttgatgaaattcctaggttgagtgcagtgtcttggagtgttatgatatcagggtatgccaaagtgggtgatgttgattcagctaggttgttctttgatgaagcacctgagaaggataggggaacttggggtgccatgatttccgggtatgtgcaaaatagttgcttcaaggaaggactccatttgtttcgtctgttgcagttggctcatgtggttcctgatgattctatatttgtgagcattctttctgcatatacttatctgaatcgaaaaacagtgccattgagccttcgtttgagtactagtttgctagacatatatgctaaatgtcggaatttggagttgactaaaagattgttcaactcgatgccagagagaaacattgtgttttggaatgccatgatttctggtttggctatgcatggagatggagcaagtgcactcaagctgttttcagatatggaaaaggctgggataaggcctgataatatagcattcatagctgttttcactgcttgtaggtattcaggaatggcacatgaaggtttgcagttgctacataagatgtgtagtgtgtacaaaattgagcctaagagtgaacagtatggttgtctagttgacttgttaacccgagccgggctttttgaagaagcaatggttatgatgagaaggataacttctaactcatggaatggctcagaagagacattggcttggagagcatttctgagtgcatgctgcaaccatggacatgctcaactagcccaatgcgcggctgaaagactcttgcggttggaaaatcatagtggggtctatgttttgctttctagtttatatggagcatctgggaaacacagtaattccagaagggtgagggatatgatgagaaacaaaggggtggacaaggcacctggttgcagcacggtggagagtgatggggttgtgaatgaattcattgctggtgaagaaacgcactcacaaatggaggaaatacacccaattttggagaaattgcatatgcagttagactag

SEQ ID NO: 62715 - DNA, 3612 bp, Glycine max
  Peptide Sequence Number=SeqID_179493
gatgagaatttggaacacactgcagaacaagatattccgatgtctgaagacattgtttctgtttgttgtgatgaagaaaggaagatccattctgaagatgaggcattgggagtacccaatggaactgaaacatcatgttttcctacaaactcttgtgttgaaaacataatttgtgactgtcaattatcacccccatacatacaatcacccccttgtgcacaaccggttgatgagcttgataacaccaagaaaattgaagctcgtctcgaagtggagatgcctggagaaactaatttgctttgcacattgagggaatatttgaaacacaacatatgtctgccagttgtggaagcagtccaggggaccaagatgcagcaatttcaagccccacatgatacttttaccggacaaccaccttccttggaaatgcattggtccagctttcaaataaatattgatccttcgtcttttgatgaaaaacatgctgctgcagtgcctgtaatacctacagaatctgaatttggatgcacacatggagatattgacaaggttgaaggtattttaactactgcaccaagaagtttcaattctgagaacacatgtttgatagttgacgaagatatccctgattctgaatttcataaaatggaagttgttgaagaagtttctgtggattcagtacctgatggagaaaaacaagatgaaatgcatgggtcaagctcacctacaaatcttgatcccgcgtttttagatgaaaaacatgttgctgcagtggctataatacctacagaatctgaatttggatgcacatacggagataatgacaaagttgaagatattttaactactggatcaagaacattcaattctgagaacacatgcttgatagttgacaaagatattcctgattctgaatttcatcaaatggaagttgttgaagaaatatctgtggattcagtacctgatgaaaaacatgttgctgcagtggctgtaatacctacagaatctgaatttggatgcacatacggagataatgacaaagttgaagatattttaactactggatcaagaacattcaattctgagaacacatgcttgatagttgacaaagatattcctgattctgaatttcatcaaatggaagttgttgaagaaatatctgtggattcagtacctgatgaagaaaaacaagatgaatgcgatgaagagaacctgaatggtaaatcttgccgtgaggaagggtactctctagatgaagtagttgaagataatggaaacaaatgcattaaaaacatagatcctgcatcttttgatggaaagggcttgactgcagtaactgtaatacccacagaatttgaatttggatgcacactcggagataatgaaaggattgaagatattttagaaatggagtcaagaactatcaattctgagaacacatccttactggatgagaaagctattgctgttaccaaatttcaactagtcaatattgttgaggaaggggggtactcactggatgaagtagttgaagataatggaaacaaatgcattaaaaacatagatcctgcatcttttgatggaaagggcttggctgcagtaactgtaataccctcagaatctgaatttggatgcacactcggagataatgaaaggattgaagatattttagaaatggagtcaagaactatcaattctgagaacacatccttgctagatgagaatgctattgctgttaccaaatttcaagtagtcaatattgttgaagaagttgctatggattcaatatctgatggaaacaaatgcattaaaaacatagatcctgcatcttttgatggaaagggcttggctgcagtaactgtaataccctcagaatctgaatttggatgcacactcggagataatgaaaggattgaagatattttagaaatggagtcaagaactatcaattctgaaaacacatccttgctagatgagaatgctattattgctgttaccaaatttcaagtagtcaatattgttgaagaagttgctatggattcaatatctgatggagaaaaagaagataaatgtgggaaggagttggagtcaaagttgccggcttccctgaatgcgaagtcctgtcacgaacaaggtaagtctgtggctgaaatagctgaagatactggaaaaaaatgtgcaagcagcatctcctccacatcatttcaagtagaatcaccaaattcttcgatgcctcgggaacagacccctcaatctctcactgctgtgacaagatgctctggaggggagttccttgaaaaccatgtcaaaccaacagagaaaagctcagcctttggcagtatctggtcaaggtgtaagcctgctagtgctcccctagttcaagccagaaagagtagatttatgagcacagctaaggttggcactgaagttaaaaggagtaatgagaagaatgttgtcataaataaattaatgccgaaggatctttctgctgtttttgatgaggagaaagaagcattcattctaaataaggaaaatttaagcccaaatacctatcacttgcagtttatgagaaagaaagataagccagaagaaattaaacattccatatcacaaaggtcacccaatttgagctattttagtcccaggatctatttagacaaaagaataagcagtgtttcaaacaaagtgaaccagactccaaaagtagctcaagaatggaagtcacaaagaaagcctcttcaatgtcatatcaacttggtccatgagcaagatatgatggagttaaaaaagaacagagtggaaaaggtagcatccttcccatcactaatgaactcaggagggaaccataaatcagtgactgtttctgctgcaaaaagcattgatgatgtgcctatttgtggacagatttcaaataagtgcactaaaacttctcatactagtagagaacaaaagaggagctgggacatggttgtagacactgcttctcttctgaacaaggagtcaaggaaagctttgcagcttctacaaggcctcaaggggactcgtttaatcattccaagtttggtcataagggaactcggcagcatgaagcaaaaatttagaattttcagaacaacttcagaggcttctttggcattagagtggattgaagaatgcttggagaaaacaaggtggtggattcatatccaaagctcaatggaggagttcaggctgacagctctaacccatcatgcttctcctcagactcggtttattgaagagagttgggcttttcctggtttgaataccttgaagaaatgtgcttcacctaaagttgaagatcacatccttgactctgcccttcaatatggaagaaaggagaatgttggacaacttgtccttcttagtagtgatgtctcattgaaaataaaatccatggcaaaggggttgctatgtgagacagtgcaacaatttcggcagagtttagtgaaccccttctctgagaggttcatgtggccaaagagctctcctcgaggactgacttggtcttgccaagatgatttagttttaagggagaaatattgtggattgccatcaaaagctggtttgaagctcattactttccatgattag

SEQ ID NO: 62716 - DNA, 569 bp, Glycine max
  Peptide Sequence Number=SeqID_179494
gagggctacacaccttaaccttcaaaggactacacgtcctcaccggcaaaggactacatgccctcaccttcatagggctacacgccatcaccttccgagggctgcacgcccttgcctctagaggactacacgtcctcaccttcaaaggcttgcacgtcctcaccttcaaaggactacacgtcctcaccttcaaagggttgcacgtcctcaccttcaaaggactacacgtcctcacctttagaggactacacgtcctcaccttcagaggaggactacacgtcctcaccttcagaagactacacgtcttcaccttcaaaggactacacgtcctcacctttagaggattacacgtcctcaccttaagagggctacacgctctcacctttagaggactacacgtcctcgccttcagaaggctacacggtttcgccttcagagtgctacacgtcctcaactttagaggactacacgtcctcaactttagaggactacacgtcctcgcctttagtgggctacacgccctcatcattaaaggtgatggaatcctatcccgcaagggcattgggtag

SEQ ID NO: 62717 - DNA, 924 bp, Glycine max
  Peptide Sequence Number=SeqID_179495
atggaattagcatccccaaactccaaccatcaccatgaaaacaacaacgacaacaagcttgacgatgaggaggaggatcagccatatgcggagttttggatgggcagccacgtgtctggaccctctttcattgttttggatggttcagaacaaagagtgacccttaaatcttggcttttggagaatcctaacgtgcttggaccaaaggttgtggagaagtggggtggtgatcttcccttcttgtttaaggtgctgtccgtggacaaggccttgtctatacaggctcaccctgataagaatctggccagaacattgcttaagttgcaccctgatgtttacaaggatgggaatcacaaaccagaaatggctctggcagggacagagtttaaggttctatgtggattggtcactcttaaggagcttaaggccgtgcttactgtccctgaggttgtggagctggttggtgttgaaaatgttaacttggtgttacaaatcactgatgaggatggtgaagagaaggttaaggctattttgcagtctcttttcactgacgtcatgtcagaaagtaaagagagtgtaactggtgcagtagacaaactgagaaatcgtctgcataaggaaagtcagttgacagataaggagcaactggtactgtggttggaaaagcaatatccatctgatgttggtgtcatagcagccttctttcttaaccatgtgaaactcgctccggacgaagccttattccttggagcaaatgaacctcatgcatatatctatggtgagtgcattgcatgcaaggcaacttctgacaatgttgtaagagctggcctcactcccaaacacagagatgtccagactctttgttccatgctcacatacaaacaggtaaatgataaaggacaaaatttaaatgaagttccttag

SEQ ID NO: 62718 - DNA, 675 bp, Glycine max
  Peptide Sequence Number=SeqID_179496
atgtctgttgatggttctacgagtgctgtgaggaaggctattacacatggggcatgtgattattggaccaagcctttcagtgagaaccaattcaagattatgtggaagcatgttgctatgaaagcctggaatgaaaagaagctacaaaaaaaagatttttctgaatttgcttcttctgttcttgatgcaaacttgaaggaccaaaaagagatcagttccaattccaaagaatctgatgttgatgattgtgatgcacaaccaaagaagccccgtatagcatggaaaggagaactgcattgccaatttgtcaaggcagtgatgcatattgggcttgacaaggcacagccaaagaagattcttgaagtgatgaacattcctggtttgacaaaagaccatgttgccagtcatttgcagaaatatagatttgatttgaagaaatctaatgaagtggctgtgcaacagaatgagatgcaattgccaaacagtatacaatcaacagaacctattgattggtttaatcctgagggttggaccagtcaacctgatgaatctatcttggaaagtgtttctgttcaatctcagaatcagcaacaaggaggaggatctttgcatgtcttgccaccaccactagatggatttcgaattcaaacagattggtgtaatatgaatttctga

SEQ ID NO: 62719 - DNA, 498 bp, Glycine max
  Peptide Sequence Number=SeqID_179497
atgaatgaagacccagtactccacgatcctctgccgcgagtccaggatcatcttggtgcagtccatctccaccagcatgctctcgatctccctcttcatctgctccatcctcacaaacccgtcgtggaggaccttgatcgcgaccaccatctccgccaccgcatcgctctcgctgttatgctccctgttgaagtcgtcatcgtggaaattgaggttgttgttgtcggtgtggagtccatgggtttgaagtggactgtgaggaagggaataggtgttgttattgtcgaggcgttggatttcagtgcagcacttcacgacggttttcgccgtggtggaggcgttggggcactgcgtggtgatggatgtggaaaagtgaagagagacaggagagaggatagatgggtattagacgtgttgcatcttcattggacagatatcaataacataagtttagatttatctaaacttaacttaggaaataaaagtcacacattataa

SEQ ID NO: 62720 - DNA, 318 bp, Glycine max
  Peptide Sequence Number=SeqID_179498
atgaagactgatgtggagactcagatgaagaagactatgactgagataactgagtatttggtaaaggagaagtggaaaggggggattagtggtaactgcaggtgggtatggaaaaagttagggaaatctcaactcattaaaaatgacatctttagagatgaagagctttccagtaggggaataaccaagaaaaaggcattcatgggacctgaaattgagttcgtgatgcagattctctacgaaagttctccaatcacatttagtgagctagcagaagagcttcaacttcttcaattggaagaaacctactttctataa

SEQ ID NO: 62721 - DNA, 219 bp, Glycine max
  Peptide Sequence Number=SeqID_179499
atggccgttttaagttttgctaaaaacaagttcccaaaatttttgtctctctcaaatactgccacactaagtgctcctgtgcaaaatcagtcgctaatcactgttcagcactgttcacagcaaaacacaaatctgaaacagtcgctgaatcagtcgctaaaaatagttgctaaacagggaatgcaactgaaatgcaaaacagaacgctacacaaaataa

SEQ ID NO: 62722 - DNA, 252 bp, Glycine max
  Peptide Sequence Number=SeqID_179500
atggctatagcagaagtcttaaacggccaaatgttggaagaggatgaagatgttgttagtcttttggtgcaaagtaaagataacaatccaaaagaagatgctcatgattcttatcaactgtcataccctaattttgtccggggaccatccgttgttgggatgcgaccctcgtttgaccactttgagttaaaaggaagtgttagtgcgcaatccgtaaagttccgtaacattccgaaaggcaaaaaggggatg

SEQ ID NO: 62723 - DNA, 258 bp, Glycine max
  Peptide Sequence Number=SeqID_179501
atgagagggagagaatggagagatagagagagaaacagaagaggtagagagagaaacaaaataggggacccaagacatatctacaacggtaaatggtacaactggggagcatgcttgcacggtgacggaagaggcaaaaacagtagagagggcgtgaaacactggagggatgctccagacatccagtcattctacttcactcggtttccagaggaaatgggggaggagatgtggatgcagtttaacaagtggggagat

SEQ ID NO: 62724 - DNA, 222 bp, Glycine max
  Peptide Sequence Number=SeqID_179502
atgctccaccctgcagcaaccattaacgaaggaggagaagcttacctcaatggcaaaagtggtggagacgtctcaacggaagcagccaatgcgcggaaaatgaaccaacaagtagcggagatgtcctccaatgctcacgctcaagaagagaagaagccaacaggtcaaaggcgcaaagaagaaaaggaagcggtgcaaggaggagctggacgaacacactga

SEQ ID NO: 62725 - DNA, 387 bp, Glycine max
  Peptide Sequence Number=SeqID_179503
atggagaaaggcaaggaacccattgtaagccataaggatttgttggcattggttgttgaggactcagacactgaacaagagtctcaatgttatgaagatttgcttggaatggttgtggaagactcgctagagtctgaacatgtcctccccttctacttgaaccattcaaatgcgccgtcatcttcaagtgcagcaaaaatggttgaaggttcaagtgtggcgtcgtcttcaagtgcagcgaaaatgattgaaggttcgagtgcgacgtcatcttcaagtgcatcatcattggttagtaacgaagtgctcttattcgatcttaacaagttcccagaggaagagtgtgaggatgatactaaggaagagaaaaaaaaacttgttgagtga

SEQ ID NO: 62726 - DNA, 399 bp, Glycine max
  Peptide Sequence Number=SeqID_179504
atgcatccaaaattccctgatgaggatattatggccttgtttgaagaggacagggataagtgggttgtgtggtttaatgatgcatctaatgcactaggccatgggattgggacaatgttgagaggaaaactagatggccgatgcccttgccactctgtcatccatgttcaaagtgagtccacacagagattttccatacatcgaaatcaatgtcgtgttgagcttgaacattgttgtttgatagaagcaagccactcgcctgggcgagttgataccttcaaccctaagcatgcaacttgcctccatgcaggagaagagaagaaaagatccagcagcttgaaaaacgtagaagaaaaagaagaggaggaaaagtggagccgagttgctacagagttgtga

SEQ ID NO: 62727 - DNA, 561 bp, Glycine max
  Peptide Sequence Number=SeqID_179505
atggtggctcttaaatgcttagactccattgaagagaagagaggtatcctactcttcataaacaccatgaacaatgagggtgtgaacttggatttctacttgaatgtagtcccagaaacaaagaacaaaaatgaaggtccattattgaatagtgatgccaataatgtacaatcaaaatcctcaaattctattgatttgaatattgtatccatgagtggtgatggagcaaattctcaacaacccatcagtggtgagggaaatcaatctcagctgttggacttgaatgatcttccaagcgttgaaatggactttgatatgagtgttgacaaggaagaagatggtatggatgacgacactaaagatgcaagcttacacggggtacaacaaagaacattgccacattgtactgcgtttcaagaagggtcatacaacgtatatggtgtcaacttagggaaaccggagaaacattgcacaagaagaccaaaatttgtggaaggaagaggattggattggatattgaaagaattcgtgagattcctctttcaaagtggactactttaa

SEQ ID NO: 62728 - DNA, 447 bp, Glycine max
  Peptide Sequence Number=SeqID_179506
atggaggaaacatcctcaaaagaggaagatgatgaagaatccaacatatgtttgatgggggacaccgattcagaaaactcagaaaaagaacaagatgaagacgaggcttttcaaaagaatactcagggagcttgcaaatacttagagaatattggttgtaggagcctgtggctaaccgatcattgtgcagagcacaagactaccaagagaaatgacaaaggaagtgatccacggtatcaacttgcccaggcgagtggtttgcttagggactcacaggcaagttgcatgcttagggttgaaggtatcaactcgcccaggcgagtggcttgcttctatcaaacaacaatgttcaagctcaacacgacattgatttcgatgtatggaaaatctctgtgtggactcactttgaacatggatgacagagtggcaagggcatcggccatctag

SEQ ID NO: 62729 - DNA, 1029 bp, Glycine max
  Peptide Sequence Number=SeqID_179507
atggcttccgcctccatggttttcgctccccaaaccttctcttccgctatctcttgcatgctcaccgacgacaactttctcacctggatgcagcttgccgaatccaccatcaaaggtcaccgcttgaaacaacacattgttggggatcacacgattccctcacagtttctcaccaaagatgaagcaaccgattccgtcaaccctgcctatgaaaacttcgagcagcaagataatcttctcaaatcttggcttcttgaatcgatggacaaccaatttcgcgttcgcgtcgttgtgcgaatcaagcagcttcgcattcaacttcgcaacaccaagaagcaagggtcaatcagcgagtatttggtccagatcaagcagatcgtagaaacccttggcgcaatcagctctcccttaacagataaagaacacatttatgcaattttttatggtctccctgaagaatatgatgggctcatcacctcgtgtctcatgcgatctgaacccttcactgttcctcaaattgaagcctccctcatgcatcaagaaaaaagattggagcatcataaacaaaggggcacaacccccattcaagcacacactgtgcatagtcagacccaatcaagaagagggctttccaacccttctcgcggccatggtccaggtagatcaggaactcgtggtagagggagcggtggcagatccacttccatctcttccactcaaggttgtggtccaaagcttcaatgccaactctgtggccgtgttggtcactctgcattccactgctggtaccgctttgatgaaaatctcatcgaaccaacaccccatgcgacccacagcccaaatgacaactccaccaaccactctgctcaggctatgcttgccactgcttccaatcaagctgatgattcttggtatcctgacactagtgccactcatcatctaacacatgatcttggtaatctcatgataaagaatgaatacaatggaggaaacccagcaggttcttcttcaaggtcatctcaaggataa

SEQ ID NO: 62730 - DNA, 1113 bp, Glycine max
  Peptide Sequence Number=SeqID_179508
atggtagaattacaattcaataaaaagatcaaagctctgcaaactgatggtggcaaggagtacctagtgctgactaagtaccttgcagatcatggcatcagacatcgcatatcttgtccccatacacatgagcagaatggtgctcctgaaagaaagcattgccacttgactgaaaccggtctcactttgctagcagcctcttgtcttccttccaagttctgggcagaagcattcagcattgccactttcatcataaatcacattccctctccagtaatccactataagtctccctttgaggttctttttcacaaaacacctgactactccatttttaaaccatttgggtgcctttgctatccttatctacgaccctacaccaaaaccaaacttgagtttcaatccacctcgtgcatattccttggctacaacaccaaatacaaaggctacaaatgtatcactaactctggaagggagtatactgttagacacattatatttgatgaaacacaataccctatgatagcaaatccatccttctttactccaaacaccattgtttcccccactcagcctactctccctccttctatagcaaccatcaatcctatcaatcctcctgctccaacaccagctgtacccatcactcccataccagatcccattccccccacatctatcacacctgtcactgagcactctactcctcctaaccctgcaaccaatacccatcctatgactactagagctaaatctggcatcttcaaacccaaagccttactgacagagatgactccaaggtgtaccaaggatgcactgcaaaatcctcaatggttagctgcaatgaaggcagaatatatggcacttatgcagaataacacatgggatttagtccttttgccccctcatagaaaggctattggctctaaatggatctatcgtttgaaatacaatgttgatggctctatagccagacacaaagctcgaatggtggctcaagggttctctcaaagaccaggccttgattacaatgagatattcagtcctgttattaaaccagccattattcgcacagtcttgagcattgcagtcaccagaaaatgggatatctga

SEQ ID NO: 62731 - DNA, 261 bp, Glycine max
  Peptide Sequence Number=SeqID_179509
atgggtgccaagtacctcgaagtggtcaaacgagggtcgcatcccaacaatggatggtccccggacgaaattatggcacagaatgaccataatttgtctctgcgtgtctttggacgcgatcgagcctgggcgacaaggcgcagaatgaccataatttgtctctgcgtgccaccggatacgatcgcctctagatggagaaaaggtgtacggaatgaccataatttgtcttcgcccacctctcgacttactgtccccgaatga

SEQ ID NO: 62732 - DNA, 348 bp, Glycine max
  Peptide Sequence Number=SeqID_179510
atgcctgaaagtttgtacacgagggttagattgtctctccaagttgaaattatcaacgaggagaacttcgaagctccggaagaggatgaagaagtccgagctctaaaaacagaactaggaaaagcaagacttgccaaagaaaaattcaagttagtcgctacagatgtccagaaagagtgtgccgggttacgagaagaaaatgcagctaccgcaagagcccttgaacgggaaaccaagagggctcgcaaggaagagaaaaacgccataactaaacgcgccccaaggcatccctatcgcaccagatccaaatctaggatgatgggttaccaagaggagatacaggaatag

SEQ ID NO: 62733 - DNA, 555 bp, Glycine max
  Peptide Sequence Number=SeqID_179511
gctggatgatgctctttgggcgcataggactgcctacaaagcacccataggaatgtctccttatcaggctagagaggaaaggaagttgcaactaagtgagctagatgagatccgtttagaagcctatgagaattccaaattctacaaggagaagaccaagaagttccatgacactttgatagctaagaaggactttgtggttggacagaaagttttgttatataactctaggctcgaactcatgagtggtaagttgaggtcaaagtggattggtccttttgtggtaactaatgtttttccttatggtacagttgagatcaaaagtgaatccacagataagagcttcaagggtacatcctttgtggtacaagtagaggttacatctacttgggttgttgtgactgagaacaagagagggtacatctcttgtggatcagttctagtggagggtacatccactaggttgttcaaagagaacaagggagggtacatcccttgtggatctttgcttgtaaaggattttacaaggttgaaaagaaatctcaaggaccgcag

SEQ ID NO: 62734 - DNA, 1325 bp, Glycine max
  Peptide Sequence Number=SeqID_179512
aagaattggagagaagaaaatgggatgaggagttgaccagttttgatgaaggaagcattgatgttgccattgtgaaagaattttatgctaacctctatgatcctaaggataaatcacctaagcaagtgagggtgagaggtcatttggtgaagtttgatgaggacacattgaataccttcctgaagacccctgtgatcattgaggagggggagacattagcagcttattctaggtttgcactcttgaggcctgatcctcaagagttagctgctaacctctgcatcccagggaggggatttgagcttaatgttgatggtcagcctctaaagatcctcaagaagaacatgaccacacttggtcagacatggagtattctttcttactccaacctgatccccacctcctacacttctgacatcacattgaacgacgccaagttgatttatggcattattatgaagatggacatgaatctgggctacctcatctctcaccagatttctatcattgcccagcatgactcctctaggcttggatttccaaccttaatcatagctttgtgtaaagctagaggggtcacatcatattccagatccttggagagccttagccctgccattaacttggcatatataaagaagaacagttggaatctagatgatccaacagtgacattcagagggccaaggaaggccaggggtaatagatctgaggctccccttacttcaacaacaccaaatgctcctgctccttcttcatctattgtaccagatcctactacaacagcatttgtttcttctactccagctactcctgctcacataccaactcagtttctagcttcttctgctcctgcatcaaattttgtgtttactctagagatacttcactctatgatgcagagcctccacagagggcaggtcattatcatgcagagtcttcagagctcaggcctgccatctattatgagcacagatgagttcttgactcaggtggcttggccaggagtccagccttctccttctggagggggtaggacctttgcagcccaagagtctatgccaggagaggagcctatgccagatgcagaggatgagcctgttcctcttgagccatttatctttgagactgatccagtcgctcatgaggaagcagcaactcaggagcttacttctccagttcatacctctccagcacccatccccgaggattcccagccatctgcactagcatcggagccagagcaacctactatacaggatccatcagctgctccggtgttggatcttaatgagcatgcagaggatcacccgcaggaggattga

SEQ ID NO: 62735 - DNA, 111 bp, Glycine max
  Peptide Sequence Number=SeqID_179513
atggccccgacggatgcagagaaacgtgaggaactggaaccaaaaaacggcatgcaaaccgagagaaagtgggcccttcttgctccactcaaatggagacatgtggcatag

SEQ ID NO: 62736 - DNA, 497 bp, Glycine max
  Peptide Sequence Number=SeqID_179514
agattcggtggtcccgtgttcggtatttgaagttttgttagtggttgttcttcctattttgtcggaggcactgaggcctattccggaagaagttcttccggaaaacacttccggaagcacttattccggaatgggtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtggagtgaatgaatcacatgtcgattgtttaaatgcttttaatacatctcaggtattcgctactcgagatgatgttttgcaatgggctcgaatagttgcccatgaaaatggatttgttgcagtgattatgagatctgacacagagaccgggagtaggaaatgtggttgtcccttcaggcttcgtgggaaaccagtgcgtggaggggaag

SEQ ID NO: 62737 - DNA, 1252 bp, Glycine max
  Peptide Sequence Number=SeqID_179515
cgccctcgccgcagtcttcatcgaaggaacaatcttcctcctcgtctcggcaatcgggcttcgcgccaagctcgccaaactcgtccccaagcccgtgagaataagctcctcggccggaatcgggtttttcttagccttcatcgggcttcaaaacaaccaaggtatcgggctcatcgggtacagcccatccaccttagtcaccctcggcgcctgtccaagctcctcacgtgcctccctctcacccgtcttaacggcggctaacggcaccgttagtttactacccggcgggagcgtctcgggtgatatcctctgcctgaaagacaggatggaaagcccaaccctctggctgggcctcgtgggcttcgttataatcgcgtactgtctggcgaagaacatcaaaggcgcgatgatatacggcatcgttttcgtcacggttgtgtcgtggttccgtggcaccaaagtgacggcgtttccgaacacggacgcgggtaactccgcgcacgagtacttgaagaaggtggtggatgttcacacgataaaaaccactgcaggggcactgagcttcaagaacattggaaaagggtatttttgggaggccgtggtgactttcttgtacgttgacattctcgacacgacaggaacgttgtactccatggcgcgtttcgcgggcttcaccgacgagaagggggacttcgagggacagtacttcgccttcatgtcggacgccacgtcgatcgtggtgggctccttgctcggaacctcgccggtgacagcgtttatcgagtcgtcaacggggatcagggagggtgggagaacggggatcacggcgttgacggtggcggcgtatttctttttagcgtttttcttcacgccgttgctggcgtcgataccggcgtgggcggtggggccgccgttgattctggtgggggttttgatgatgagatcggtggtggagattgattgggaggacatgagagaagcgataccggcgttcgtgacgctcattctgatgccgttgacgtattcgattgcttatgggcttattggtgggattgggacatacattgtgttgaacctttgggattggggatgggagggtttggggcactttgggcttgggaagaaaacaactacagcagcagcaatggcttcggatgaggattcccatcatcatcatggggtcaatgggatactacaaaatcaacattctccacaaaatccaactgctaaagcactacaactagagccttag

SEQ ID NO: 62738 - DNA, 848 bp, Glycine max
  Peptide Sequence Number=SeqID_179516
atgctagggcgtgtggtcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacttagatatgggttacaatttcttctctttttcgcggtcttctatttaattagtactaatattaatatggcttcggtggacacattcgagagtctggtcaggagacttgctttctacctcggcaatcaagccttatctaggctattgcttcagaggggatgctccgtaggtctgaccgtggccattgctgtgctttttggggacacgccatcagtagggaataacatgatggacccctcggggtcttccggttcgtcaggagggggtgggtctgaatcctcgtggacgggtgcccttctatcttcggaaacgctttcaggaacgggatccgttaatcagcccgcggagggaatgcctgttcctcccgcaaatccggtcgtggagcaagccggtccggcaaatccggaagataccactgaaatcataggtggagactctattgactcgataaggaaccgcctcttacagtcatacgggaatccttcggcggagcaaatctctcgcgcctc

SEQ ID NO: 62739 - DNA, 857 bp, Glycine max
  Peptide Sequence Number=SeqID_179517
gcatcccagcgggcgtggttattggcaagaacttattgaatccattgtttgggctcataataaattaaaagttgctcctgctactcagcctagagccttgagcattgtacaaggacgtgctgtaggagtaacacattaccttctaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagg

SEQ ID NO: 62740 - DNA, 433 bp, Glycine max
  Peptide Sequence Number=SeqID_179518
attggttgcaaaaggatacaacaaagaagaaggaattgactatgatgaaacctatgctctagttgcaaggttagaagctataagattgctacttgcatttgcttgtattatgaatttcagactttttcagatggatgtaaaaagtgccttcctcaatgggcgcattgaagaagaagtgtatgtagaccaaccaccaggatttgtggatcatgaacatcctgactatgtctacaaactaacaaaggcactatatgggggtttagcctctcatagccatgagaggttttacacttcgggggctaatatggatggaagaagggctctgaaactcggtgtgtctttgccttctgcttcctactccttttataggcctaagcacgatgttcacgctaagcatgaccttgggctttctcgtggaccttctttgtgctaa

SEQ ID NO: 62741 - DNA, 576 bp, Glycine max
  Peptide Sequence Number=SeqID_179519
atggcttatatgctaaggacacttttgaacgctaggaataaatctgcagccgcagaatgctatacaagaacagagaaaaaaattacagaacttatggatgacattcgtgagaatgtctctgtgttgacactacttgctgaggtcttgtgcttgctggatatgactgtaaattcatttgctcatatgatatcaactaagcctgttgatcgatatacaagaccagaatttacagagaatgggccgttggcaattgactctgaacaggctattaatcatattaagaggaagtatgagttggagaatatggaaattgtgaacaaggaaaaagaaaaggttcgatatgatttcctggctgacaaagccattgcagaaattgaggcaaagtgtggccaaaaaattgaagaattcaaagaagaacaaaggcagcagttgatgcgcattgaagatgaacacacgttgctctatttgttagagatgcaatataaagccattcatgtatcgttacctagcagcttgagctttttggatagtttgttaatgacatggtacggaattctctatgactatgtggtctag

SEQ ID NO: 62742 - DNA, 159 bp, Glycine max
  Peptide Sequence Number=SeqID_179520
atgaaatacctgaaaaggggtgagacaactctaagagagagaggagggcttcaggcttcaagaacacaacaagttgaaaaatggggaatctttacagagacggagagaagggtgcagagcaagagcgtggcaatgattggccctgaccccagagagtga

SEQ ID NO: 62743 - DNA, 489 bp, Glycine max
  Peptide Sequence Number=SeqID_179521
atggtcattatgcgccttttgtcatccagaggcggcaagcccaatgacatgtggagacaaataatggtcattccgcaccttttcgccatccggagacgatcgtgtccgatggcacgcagagacaaattatggtcattctgcgctttttgtcatccagagacggtgagcccgatgacatggggagacaaatcatggtcattctgcatcatttcgccatctggagacgatcatgtccgatggaacgcagagataaattatggtcattttcgccttttgtcatccagaggcggcgagcccaatgacatgcggttacaaattatggttattccgcaccttttcgccatccggagacgatcgtgtccgatggaacgcaacttatcaatggcagcggaatggagagggagtaatgatgattggagatgctacttcaaggagaagatgagtcaagaacaagctcaccaacatagaaagccatggataagagcttga

SEQ ID NO: 62744 - DNA, 270 bp, Glycine max
  Peptide Sequence Number=SeqID_179522
atggactcatacttagcccatgggtccaaaatctaccctaaggctcatgagaaccctagggccttctcttgcatctctggcccaatcttcttggagtcttctatccaatgcccttggggggtaggattacatcagttgtcgtgggatgctaccgtgtttggggtgtgtaatgataactcccccttgtacataaagcaccaagatctttctggaatagcacacggtggtcaatttctaagcatctctgttatacaattgtggattctgtaa

SEQ ID NO: 62745 - DNA, 336 bp, Glycine max
  Peptide Sequence Number=SeqID_179523
atggccctcgccctgaaagggctacacgtcctcgccttcagaggactaggactgcacgtcctcgcctttagaggactacacgtcctcgcctttagagggttgcacgcccttgccttcagaggactgcatttcctcgccttcagaggactgcacgtcctcgccttcagaggactgcacatcctcacctttagaggactacacgtcttcaccttcagagggctgcacgcccttgcctttagaggactacacgtccttgctttcagagggctacacatcctcgcttttagagggctccacatctgcaccttcagaggactcaaggtcctctgcccttaa

SEQ ID NO: 62746 - DNA, 348 bp, Glycine max
  Peptide Sequence Number=SeqID_179524
atgctggaaagttttaaacaacaacaagaaatgtcagttctagaattgtacatagaaaaggatgtggctggtggttcaatgtttcattctacaaattcccttacatcatgtggaaattatttatctaatgatgagacacaaccgccaacaaatatgaacaatttacatattgacgaagatgatgatcatgatgatgatgtttatcttgtgtctaactcatacgttaaagagtctttagacgaagatgacagtgttgacggtatatcagatacagacaatgaagtccccgacatgattccaccagtaatggatatttgtagatgttctacgttaccgccatggatctaa

SEQ ID NO: 62747 - DNA, 189 bp, Glycine max
  Peptide Sequence Number=SeqID_179525
atggatacctcaaagccttacactggggcaatgaaaggcaccatgcataaacctcaggtgaacctaggggcagatcagaagttctcacccaataggttccctgctacaagaaaaaagggggacaaaccctgggagttcaatgggttgattaaacgactacattgccatcactccaaaattgtcatgtga

SEQ ID NO: 62748 - DNA, 627 bp, Glycine max
  Peptide Sequence Number=SeqID_179526
atgttggtggcgactcccgtgcgttttcctttcttggaagacgcacccttgagtcttgtctcgtcctcccgccgaaggcttgattgcgaagtgattgtgatagaaaaaggaagagttgaaataagggagaccaagctcctcgcaagcagagaaagagcaatagaaccacacttctgcccccaattcaataaacactctctttccaaactcccaaacaataaaacccccaaaccctcttcactccgttgccatctcaaacctgaatccaaatccaaatccaaatccaacacgaagtcgtaccgaccttccgccaacgccaggaccgaggttcgtcggaatcgctacaaggttgttgtggacgccgatgaaggtcaccgacgccaagaggataccatggtggagatccgaaagaaccgtagggaagagagtttgcagaagaagagatgtgagggtctccaatcccagcagattccttcctcacttcactctactgtaattgagaagaagcgggttttaggaattaggacaacggataagattatgattgaagggagtgatttagacgtagcgggtttatatggcaattggcaagaagggatggaactaaatttgtacatctttgattga

SEQ ID NO: 62749 - DNA, 180 bp, Glycine max
  Peptide Sequence Number=SeqID_179527
atgatgctcttctttggtcttctggtaaaatgtctccctcatcggacttgttttctgttacagaatccgaatgttttaatttgcacacccaactttactattggctcaagtaggagttgcaattttgtgttgaagtatcagactataagtgcaaatttgtgcaagatcaagcacacgtag

SEQ ID NO: 62750 - DNA, 480 bp, Glycine max
  Peptide Sequence Number=SeqID_179528
atggtcattcctctgaagttcaaagcaccaaagtttgataagtacgtggggactgcttgccccgagaatcatctaaaaaggtgctatcggaagatgggggcatatgcgaaagatgaaaagttgctaatgcatttctttcaagagagtcatactggggcagccgtcacatggtacactaatcttgaaccttcccgagtccattcttggaagggcctaatggttgccttcattaggcagtatccgtacaactctgatatggctccggataagatgcagctacagagcatgtgcatgagggggcatgaatccttcaaggaatacgccccaaaggtggagggacctggcaactcaagtagcacctccaatgacaaagaaagagatgatcacattgataggggacacattaccaagaaaactggggcaaatggagagaatgagatagaaggaggaacccgtgctgcgattaccgttcctacatga

SEQ ID NO: 62751 - DNA, 441 bp, Glycine max
  Peptide Sequence Number=SeqID_179529
atgaagaagatcctaggcctacaagctccaatgcagcttacatcactaaggaaattagcgagtggtcacccgacatttagagcactcatttgggatagggaactcacaagcctcactttgctactcttgacgggctttgataccatgctttctgagttgggagcttggggatcaatgagtagaggacccacctctacaaccaaaaactttcaagtatcgataacgttgaggacatcaatgcccttgcaagcctggcgtagttcacatagggaatgggtatggccatgtgaggagcgccaaggacaaggattcacgcaagctgtggcggagaatggtggcatccttcttggaagatctcacatcgataagttgcttataaatgattatattaatatcacatacctcggttatcctttagtgggtccactcaatgaaatgtaa

SEQ ID NO: 62752 - DNA, 270 bp, Glycine max
  Peptide Sequence Number=SeqID_179530
atgggtctctgtcagttctacggagtgcctgtcacctccagcaagggcatcaggccccctactaatcgagctttcatcaagaagtactgcgtccccaggcaggcacagggcgaaacaccacagcagcctggggatggccagcagcgggcaacagacgcactgccatcacctctagagttcacctcagctcatccacaaaaagctcaagacgttaaagaagcgctactaggaggcaacctagtaccttttaaatctctgcttgttatttga

SEQ ID NO: 62753 - DNA, 168 bp, Glycine max
  Peptide Sequence Number=SeqID_179531
atggacagactgtcgtctgtaatgtatgcaactgcacattgttcactcacttgcatcaacaaccacattaatgcgaatcttaataattcgcataggctcagtgcgcgatacgagaaaaacaatgtaaagcccaagaagcaaattgaagatataaagctgctcgcttag

SEQ ID NO: 62754 - DNA, 531 bp, Glycine max
  Peptide Sequence Number=SeqID_179532
atggccacctccaacttctcaattgttctctctctctccctagccttgtttctaatgctactcaccaaggcaaactcaaccaacaccgtttctttcaccaccagcaagttttccccacgccaacaaaaccttatcctccaaggagatgctgctatctcaccctccggggtgttacgactcaccaaggttgacagctacggcgtgccaacgtcgagatccctaggacgtgccctttatgctgccccaatccagatttgggacagtgaaacaggcaaggtagctagctgggctacatcgtttaaattcaacgttttctcgcccgacaagacggccgacgggcttgccttcttcttggcccccgtcgggtccaagccccaatacaaagcagggttccttggtcttttcaacagtgactcaaagaacatgtcactccaaaccgtggcggttgagttcgacacttactataaccatgggcggtttcaaggcccggctaccctgcgcaattgcccaggctctggcccaaagacatag

SEQ ID NO: 62755 - DNA, 246 bp, Glycine max
  Peptide Sequence Number=SeqID_179533
atggacaaattgcttttcttaggaacacatattcgttaccacaaaaaggataatgatatcccttcaacacaacataggtcatcgaaaggatctcgaagacccaccaacgcacgaaagccgggatctttcagaaaatggattcctattcgaagggtgcataaccgcatggataagctcacactaacccgtcaatttgggatccaattcggttccttaggaggtatcgggaaggattttggaatgtaa

SEQ ID NO: 62756 - DNA, 294 bp, Glycine max
  Peptide Sequence Number=SeqID_179534
atgaggttcttcatagtcatccacctaatcatctactcccaagaatatagagttcgagatcatcataggatccaaacacaaatagcacaaggggagcgttatgcaacagatacactaagactcaatcctatctgcaatgtgggagaccagtcagggtcacgctgttttgcgagaatgctccaaccatatgggatcaacataggcttaaatgaacactcaaaccgggtgtatttacccccaaggcctacactccaaagagtcagtcaaggcctctccctcctgattcaggtctaa

SEQ ID NO: 62757 - DNA, 213 bp, Glycine max
  Peptide Sequence Number=SeqID_179535
atggtgggtcagttttgctctgactggcgacacgtgacagcgggggattggacatgcccgcggctgggcgtcacatatcacgctctgcacgcaggtgccctgctgacagacgcgttgactagcgctgctgctgttgaccgaagcgcctcgggtcgcgcccagacccagacgcttccaggtgcccttaaagtgtggtccccccccgccccctaa

SEQ ID NO: 62758 - DNA, 270 bp, Glycine max
  Peptide Sequence Number=SeqID_179536
atgctaggcgcaccatatccacggcaacttccagcctctgtcacacaatgcctaatccactgtggtgatcatatgacaattctcagaagattcggacctccactgcaatggaatgtagttgggctcgacaaagacattggtgataagtatgtcagtctcccttggtataaattccttcaagaaggtgattttaaccatggagacgagctctcattctactataggcgtgttgagaagatctgggaattgattgggatgatagtgatatag

SEQ ID NO: 62759 - DNA, 714 bp, Glycine max
  Peptide Sequence Number=SeqID_179537
atgcatcaatcactgatcggggaagtatctttccaaagctggtgcatcaacaagaggaataaacttttagctcaatttggacaagctttccataaagaaggagtttggagcaaggtagggaagcaggattggaatttcattaataacccaaatactacaaattctaaaactctcaaagctaaatatttttcaaatattcgatacttggatgccaaactaaggcataaaccaagctatgcatcgcatagtatttttgcttcacatatattggtcaaggatggtattctgtggagaattgatggtagctccatcaatatttggagccaaccttgggtgcaagcatcaacaagctcatatatcacttcatctaccccgctcggccttgaggatcttaaagtcagtccactcatcaaacaccaacaacaatgttggcatcaagttgtgatacgacaaatttctaatgacaatgaccagagaaatgttgcttcccaccccctgttgaacagtgaagtcgatgataaaatcatatggagattaactgcaaatggtgagtacaacatcaaatcaagttaccacaatgtcatggaaacaatgatgcaatcctaccctgcaagggcattggatagaagactccaagaagattgggccagagatgcaagagaaggccctagggttctcatgaaccttagggtagatttcgggcccatcggctaa

SEQ ID NO: 62760 - DNA, 279 bp, Glycine max
  Peptide Sequence Number=SeqID_179538
atgtttagtgacctcacagtcttgctcccaagcctaacacaactcgtagtcttgcactcagtgcagcagccaatactcgagcttgctcatccttggcccgagtgggtccaactcatgaagtgcttgctcgacaagggatacttctgtcgtgaagagggaaaaatgttatgcaatgctggtatgggcatgaaggatttcaatgtcattagaaccgtgtgcctcaattttggtagagaccactttcatcttttaaggtttggccgtgatttagaactctga

SEQ ID NO: 62761 - DNA, 123 bp, Glycine max
  Peptide Sequence Number=SeqID_179539
atgcagagaaggtggaaaaacacattaaagttgcgatttttatctcaaaacttcatgggttcagagaaggtggaaaaacacattaaagttgcgatttttatctcaaaaacttcatgggttcag

SEQ ID NO: 62762 - DNA, 474 bp, Glycine max
  Peptide Sequence Number=SeqID_179540
atgttgacctcagagatacacgaatttcgtcaaagtttgtctgtgccattttattctggtgggatgatcaatgataaagatggttctcagtcccaatctagccagagtaatgtggtggaaaaatttctacagaatgctcaagtggtcagtataggtgaaatcaacaatctcagacaggattgttactgcttaactgttggaacagttgacgaaatcattattgatgctccatggagttatgacagttgtcctaactgtacaacgacatttgatccattaaaaggtggctcagcttgccgttcttgccataccagtgtggtcgatacagttccacggtataaattaaatgttaagatggagcataatggggacaaaggaaacttccttctctgggatgcaacatgtatcaagctgtttggtaaaactgctggagaatgtcgagatgagttgatagcggttggggatgatattaag

SEQ ID NO: 62763 - DNA, 1187 bp, Glycine max
  Peptide Sequence Number=SeqID_179541
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcgccggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccagggacttgggcccgtccgccactgagacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggcatcgacaatgatccttccgcaggttcacctacggaaaccttgttacgacttctccttcctctaaatgataaggttcagtggacttctcacaacgtcgcgggcagcgaaccgctcacgtcgccgcaatccgaacacttcaccggaccattcaatcg

SEQ ID NO: 62764 - DNA, 309 bp, Glycine max
  Peptide Sequence Number=SeqID_179542
atgaaagttcgagatcatcataggcaccaatcacacggtacaaaaattgcaaagcctaagtgtgtccacatgacactttcacttaggaaaactaggcagcaagtgtcggggtcaccctgtcgcgcacaggaaactccctcccctatggcgatcaacctgagtctcaaggatcaacctgagtctcaaggaagttccaaaccgagtgacatgcccccaagtacaagtatttttcctcatgaaaaactacaaatgtctagaaaattcagtaaaaatttcagctcaaaattcgcagtgatcgattcccagtaa

SEQ ID NO: 62765 - DNA, 270 bp, Glycine max
  Peptide Sequence Number=SeqID_179543
atgcagcataggtaccataggttgcagctgaacgtctctattttcatgattactcagttggaatggatgtgggaaggcatggttatacttattattccaacaactaagcaagatctatgcccatcccttcaattattcacattaaaagagttatatcgtgacagcatccatgtagagcttggtgcaaatcagcagcagcaggggatggcaaaggttaagaaacacccatactttgctggatgtgaagtaattgttaccagaccaaagtaa

SEQ ID NO: 62766 - DNA, 150 bp, Glycine max
  Peptide Sequence Number=SeqID_179544
atgtttgtttctctgcaaactaattcaaacaatgtcttgacgagatgcaggatgtttattgaaacatgcaagaggctgaggatcatgaagagttctgatgccattggtctagctcccagggctgttgaaaaatgtaagagcagaacctag

SEQ ID NO: 62767 - DNA, 381 bp, Glycine max
  Peptide Sequence Number=SeqID_179545
atggaagcttgcttgtggggcttctatggaggctggacctttgagcttcaatggggtcctttaatggtgattttccaccatggagatgcagcggaagacaaaggaaaagagcttggagatgatgcttcaatggaggaaaagaaagagagaaggggggagcacgaaattgaaggaataaaagagggagagaagtggaactttgaaaaccctaaggccttctttatcaactctagcccaatcctcttggagcctcttgctcatggctctggtaactggtcctttcctagggaggattgcatcacaatgtttattaaatgttgcaatcatggttacaagggattggaagactttggagatcttcagagtacaatcacgtattga

SEQ ID NO: 62768 - DNA, 699 bp, Glycine max
  Peptide Sequence Number=SeqID_179546
atgagggcataccaagaagaaacagagatcgtgaacttgggtgtgggcgaggaaaagaaagaggtaaaggttggcacgggcatgaccacactggtccgagatgaattggtggttttgctacgaaactaccaagacatcttcgcttggtcgtaccaagatatgcccagcttgaaccctgatattgtacaacatcggttaccactgaatcccagttgttcccctgtaaaagaaaaactaagaaggatgaagcccgagatgtccttaaagatcaaagaagaggtgaaaaagcagttcgacgctggctttttagccgcggctcgatacctagaatgggtagccaacattgtgccagtccctaagaaagatgggaatatacgtatgtgcgtggaatatcaggatctaaaacgagccagtccgaaggataattttcccctaccacacatcgacgtccttgtggataacacttcccattttgctttgttttccttcaaggacaggttctcgggctacaatcagataaagatggcgttggaagacatggagaagactacgtttgtcaccctttggggaacattctgctacaaggcgatgtcctatgggctccaaactaagagggacctttcatcgtgtagaaagcattctcgggagaagcactggtgcttgccagcatggacgatgaagagctaccttcgcctgtga

SEQ ID NO: 62769 - DNA, 1479 bp, Glycine max
  Peptide Sequence Number=SeqID_179547
atgctcgactctggtctaatccaaccaagccatagcccgttttcttccccaatccttttggttaaaaagaaagatggtacatggcgctgttgcgtggattacagagccttgaacgctctaacggttaaagaccgttttccgatgcccaccatagatgaattgctcgatgacctgggccatgcttcatgtttctcgaaactcgatttgcggcaaggttttcatcagattagaatggcagactctgacatacacaagacggccttccgtacgcaccagggtcattacgagttccgggtaatgccctttggcctctgtaatgccccgtctacgttccaggcggcgatgaacgacactctccggccattcctgcgtaagtttgtcgcagttttcttcgatgacattctggtgttcaaccccgacttggccacccatgttacccatttggatactgttctggcaaccctctcagctcgcaagttccttctgcgacattccaaatgtgaatttgccaagtctcagcttaattacttaggccatgttatttctgcccaaggggtagccccagaccctgcaaaaatccaggccatgttagcttggccggttccaacttccccaactgctcttcgtggtttccttgggttgaccggtttttataggaagttcatcaaggggtatgctacagtggcgtcaccactcacggcccttctgcacaaagacaattttcagtggtcccaggctgtagaccttgcttttcagacacttaagaacctgatgacacaggcccctgttttgtcaactcttgatttctccattccttttacacttgaaaccgatgcatcagcttcggccattggggcagtgctcttgcaacagggccatcccattgcatactacatcaaaacactctgccctcgattgcaacattcatcggcatatgttcgcgagcttcatgcaattacctctgccgtgcgcaaatggcgccattacttgctgggcaattccttcattatacttacagaccataagagtctcaaggaccttatgtcccaagtcattcagacccccgaacaacagaattacttggtcaaacttctcggttatgactatgaaatcaaatacaagccagggtcaaccaacattgttgctgatgcactttcacgcatttctgatggtgtttgcttgtcttttttggtccctcaccttgattttcttgacaagcttcgtcatacattaactcaggacccccaatatattgaattacttcaggcgattcaatcccgaccaacagaacacccttcactttcggttcataaggatttgattttccgtcatggccgcatttggattccttttccaaacccctttacgtctatcctcctggccgaatttcattcatcaccactcggcggacatactggtgtggcaaaaaccgttcatcgcgttcgacagaactttgactggccaaacctgcgtgctgac

SEQ ID NO: 62770 - DNA, 936 bp, Glycine max
  Peptide Sequence Number=SeqID_179548
atggtgggcatcggaaaacggtctttaaccgttagagcgttcaaggctctgattggggaagaaaacgggctatggcttggttggattagaccagagtcgagcatggagggagaaggtgaatatggtgttggatggtacggggaggaggaaggggaaggtggttcgggttgggttgcaactggagtaatgtggaataaggctgataggctttgggtctgcgcaaaacgagttgcaaccactgaacacccagtactaggtcgacaccgcaaaggggaagatggagtaaatctaggggacctggggcgaaatggtgtcacactccaaggtgttgccgttcccaaccatcacgcggagaggtttggtaggggaagagggaagggcaaggaagcgagccatcctcgtttggatgaagttatgcgtactgtcgccatccacgaggatgacgagctgctaatggtgaatcgaaccaagcaatcgaaaggtctgaggggcaaaggtggaggcggcgtttgcatctgtgaccaggggaccacttgtcatcacagtggtaacataacccttggtcacggcggagggcaagctggggaactggagtggagcggaaactgcaacgacggtcaagcagtttgtcctcctgaaggcgggcaagctccaccgcttggggcagagaaactggtcgcagggcctgaacctcgcggcggagttcgggggtcagaccagaaacgaaacaactcaacaaactttaaggcaagggatggtggtggttggccgggagagatggtggagggtgagggagctgtgatagtggctagccgatcgaaaagggactcgatctgggaccctcctccaacctatccgtggttacctgtcgtgtgtgatgctccggcatcggaaaaagaaggcaggtcggaccagttgatagagaactgcaaatga

SEQ ID NO: 62771 - DNA, 402 bp, Glycine max
  Peptide Sequence Number=SeqID_179549
atggtgaaggtggatgttgaagaatttcaagatgttgaccctatagtcaccgaagaggtaccaaagggaccgaagaagcttgttgataggccaaaacctgatgatgatcccatataccagatgactttgatgatcatgcaacttttcctcaagcctatgcaggtgtcgtgggatgtaactatgcttggggtctacaatgataatattcccttatacataaagcatgaagatcttggggaaatagcacacggtggtcaatgtttgaacatcattgttatacaattgtggattatatatagaatttacaaagatgtctacctaggagccttcttgaatggggatacaatgataaacacgaaagtaaattcaaggcaaacgttaaatggattccaattaaagtaa

SEQ ID NO: 62772 - DNA, 357 bp, Glycine max
  Peptide Sequence Number=SeqID_179550
atggtggaatgtgcgaaaatgagttccgaacctgatgttcaaatttcacgacgattcaagagttatcttgaaataattttggaaagactaccggctatagaaagaacttctggtgggattcattctcagcaatcagcaaggctgctagagattgttgaatttattcaatctcagggatgtagctctgcttcagattcctcatcaagtagggtagtctctccaattgaaggagttattgaggaaatgcaatcaaagattagaaggcttgaaaggtggctagcgataaacacggttctatggacatttctgatgtctgcccttgttggttattcgctgtatcaaaggaagcgccaataa

SEQ ID NO: 62773 - DNA, 845 bp, Glycine max
  Peptide Sequence Number=SeqID_179551
atggcagaatcatcaaagaagcgaaaaggatctttcttcaccaccaccactacaggccaccgccgccaaggaacctctggaaacccacccgcaccagttcctccttctctttcatctcttagatcatccacattgttttccttggatgatcagcgtcaaaggtactactctcaattttgtaatagagtcattctagaccctaagtaccttgaccttgaattctttgatgaagaaacatttgattgttaccaagatggtattctttactctgagggcacccttgttgatgactggaaatttgattattctagtcatgatgctcgccgcatagtctgcaatgaccgacatattacttactgggatttgattctagtgtgggcctttcaaactggtcgtcagatagaatgggtccatttagttcggtaccagatgcataaggcattacgggccaatgcacctctgccttatcctcaccttgttactctttttcttcatcatttcaatgttcctttggatgatgaaccatttctcaaggtcaaaaggtctttctctattggtgctggtgcggttacctcctttggttaccgaaaggatgttgatggtcaatgggttcgcaaacatgacttgcctccacctattcctgacgagcgtaccccatctcctccaccacaacagggtgattccacttctcttctaactaaagtcctcacagaactccgtggtcttagagcttttgtgggtgaacgctttaatgcgatggatactcgctttgatgcaatggatactcactttgatgggatagatacaaggatcactcaactcaaagatgataagagcttcattag

SEQ ID NO: 62774 - DNA, 198 bp, Glycine max
  Peptide Sequence Number=SeqID_179552
atgaggacattgagtcctatgaaagataaagcagaagatgttgaaaggatgttgagtcctatggaagataaaggcgaggactttgagtcctatggaaacataaaggcgaggatgttgagtcctacgaaagataaaggcgaggacattgagttctatggaagcataaaggcgtgggcattgagtcctttgaaagcataa

SEQ ID NO: 62775 - DNA, 540 bp, Glycine max
  Peptide Sequence Number=SeqID_179553
atggctagaacacgaggtataggtcgtgccataggtagacttgtaggcagagatagacttgatgaccaggatgcagctgatgttcccgagaggcgtaggcctactgccttagcccataggcaacgggttcatcagatgactgcggatgcacgtgatatgactgacgacgtccctgatgtggctgcggaggcacctgagatgcgtgcggacgtagagggtgctgatcgtgctgaggggtcagatgctgatgatgctactgagagattccctggtgggccacgtgacccgtcagtgttgacatcatttgcggaccacgttgcacatgctgtttggagtggacaggaacgtcctgatttgaagttagtgtcacatgggaggaagttgacactgattgggaggccagtgcctgagattgaaggcctggtgggtgccacaggattaagtccactgatcgattgttcagttactactggcgatcctagacttatatccgcattcgtggagaggtggcacggtgagactagcaccttccaccttccg

SEQ ID NO: 62776 - DNA, 128 bp, Glycine max
  Peptide Sequence Number=SeqID_179554
ttgttgacattgtgcatggcacaataaacaaggaaataattgctgcctgctcgtacaaagatgctgcttccaaggattctgcagacgaatttgtgatgtccccagcacaaactggtagagacacctga

SEQ ID NO: 62777 - DNA, 106 bp, Glycine max
  Peptide Sequence Number=SeqID_179555
gtgaaggtggcgttgccgacagcggagcggcaacgaccgaggaggatcaatctgcccttcaagaggaagacgacaaccaccacccgcagctccgactcgccacttt

SEQ ID NO: 62778 - DNA, 531 bp, Glycine max
  Peptide Sequence Number=SeqID_179556
atgtctcaaaaaactcctggcacacttctttcccaaattgaagttaaacctaagaatgaggaggtgaatgttgtgagcaccaggattggaaagtctatggtagaatcgaagaagaaagagaagaaactacctcataagcttaatgacccagggagtttttcagtcccttgtgtcattggtaacttgtcctttgatatatcattgtttgacttaggaggagcattcattgatgttaaggaaaggaaattgacttggcggctaagtgataaggaggaagtatttagggtgtttggtactgctaaaagcccattctctccctcttcctgcaattttgggcaaaccactaacaagatggaagtcactatggctaagcctcacccaagtgtggggaagaaagaccctcctaggaacaaagtcattccaaaagaccttggatggaataagaaaaaaggagatgccatgagcattcaagctcttggttatggattggatgattgtactaaaggatcagtgaaacacaccatattttag

SEQ ID NO: 62779 - DNA, 174 bp, Glycine max
  Peptide Sequence Number=SeqID_179557
atggacatagaaagagggcttaacgagtacggcggtgatcaagcgcttagcgtgagattcgtgctaaacgcgcctttgggcttctttgtgggttttcttcccgttaagcttgagctcgtcactaagcgaggaggcgcactgggcctgtcttgtgctctaataaaaaaacaatag

SEQ ID NO: 62780 - DNA, 189 bp, Glycine max
  Peptide Sequence Number=SeqID_179558
atggcgtcgaccatgacgttgaagagatttcggtaccgaaccccggtggtgaagcgcgattttgagaggaatctcaaggttgaggcgataaagattgtaagggtagaggttgatgaagagggaagagtggttacttacaaaaatgccactgctttacttaggatatcgatttttgtagaactgtcgtaa

SEQ ID NO: 62781 - DNA, 345 bp, Glycine max
  Peptide Sequence Number=SeqID_179559
atggagaagtacaaccagtccaatgaaggggttttgggggaatgtgaagtgggttcgatcttgattgtggaaaatgcaaagcctatgtggcaattgggaatgtgtggtgttggggaggaatcatatccacaacgccttaatgaggttgattgcacttattatttgaggattggcttatgtggctttggttcccactaccaattcaaccatcctcgtgatcatgccgcggtaactattcttcttcttgctttaaagggttgttggagcataaaggaccgtagggcagtatccagaacaagtaggctagcctatgtgctaagtgttgtttatggttctgctaaatga

SEQ ID NO: 62782 - DNA, 194 bp, Glycine max
  Peptide Sequence Number=SeqID_179560
cgaatgagaatgttcctagcatcatggtggaggtgaaacgtgcggcaaacgggaacgcgcctagcaccaccttggaggtgaagaggaacgtgggggagaaaccaccaccatggatgcaaacaggcagacaagataatgatgacaaacaaggaatgctcgactccacctttggctgcacggaaaagatgacctag

SEQ ID NO: 62783 - DNA, 300 bp, Glycine max
  Peptide Sequence Number=SeqID_179561
atggtgctggaagatatctatgaggaccatcaagagttgagtcacatggaggggcaagaacacaagaatgaagttttcaaggtgtttgaagaatggaaaattttagttgaaactcaaacaggaagaaaggtgaagaaattaaggacagataatggacttgaattttgtgatgataggttcaaaaccttatgcaaacaaaatggtattgctatccatttaactgtgagagggacaccacaacaaaatggcttggtggagaggtcaacaaaaccatactttaaggagttaggtgtatgttga

SEQ ID NO: 62784 - DNA, 258 bp, Glycine max
  Peptide Sequence Number=SeqID_179562
atgtggatgtttaattgttctaccgcattttttttttacattctagcaagtgaaagagaaagggcgaatgagaatgtgcctagcatcatggtggaggtgaaacgtgcggcaaacgggaacgcgcctagcaccaccttggaggtgaagaggaacgtgggggagaaaccaccaccatggatgcaaacaggcagacaagataatgatgacaaacaaggaatgctcgactccacctttggctgcgcggaaaagatgacctag

SEQ ID NO: 62785 - DNA, 264 bp, Glycine max
  Peptide Sequence Number=SeqID_179563
atggatgggcaatatggtggtgacacaaaagtagagacacaaggaacgattgaggaagaaaggtacggtgaaattgcgttgaattgcttgttccaatgcgttttattttacggttattttaggcggcttaatgtaactgccctgatgcaatcctatcccgcaagggcattggatagaagaccccaagtagaatgggccaaagatgcaagagaaggccctagggttcttatgagccttagggtagatttcgggcctatgggctaa

SEQ ID NO: 62786 - DNA, 210 bp, Glycine max
  Peptide Sequence Number=SeqID_179564
atgttccccgtaatagtgacacgtggcaagggaggcgggacagggttaggaagtgctggtctgccaggcgcaaccagttgtgctggtctgccagacacttccttccacgcttcctataaaacccctcctcctccttcgttccatttgcactacgaaatcattgaagtggtttacgttcagatgagtctcactccttgctgttgtgcatag

SEQ ID NO: 62787 - DNA, 753 bp, Glycine max
  Peptide Sequence Number=SeqID_179565
atgtctcgcaaggaaaacataatctttgagttgcataccaagaaagggacttggaagatagtagtacgaatcaatgatatgtggcatgttaacaagcacaatggtagaaaagcaatagaaatggtgttcatggaccaaatgggtgcaaagattggtgctactttttcacgggaactgtttgttgaatttgagtcaaggttgcattgtggttctgcatatgtcattcagaacattaaggttgttgagaatcattctgaatacaaagaggccgagcatcctgagattcttcctggtgtctatgttattacttcatttactgatattattgttgagggggcaccacgtgacactttagttgtcattaagtgtaaaacaattaatcctacatacaaagttatagtcaagttgagggataacagctatgacagttgtgccaactgtactaccacatttgatccattgaaattaggttccacttgccgttcgtgccacaaccaagtcacttacacggttccaagtggtgatgaggtcaaggttttccctccttgtgttgatgaattattgagaaagacttgggcgctcaggttcaagtactctgtacaaattcgtcaatcatttgtcttggatgttactgaagacgaagatattattcacactatcaggtcaacaattagtctacaggatgaaccaagtatagagaagggtaaagatgttgttgctgaaacatcatcattggatttccatcctacgctc

SEQ ID NO: 62788 - DNA, 402 bp, Glycine max
  Peptide Sequence Number=SeqID_179566
atggcatggtttagtgcaacagtttcctctggggtccctcttgtttttgtcaatatccaaacagaacaaattccctccacggaggaaactcatttcttgaaaagggaaatagctactagcaagcaaaaaatcaacaatgctaaccaaataatgcatggtataaggttgtggtttttgcctggactagcagaaattttagttgtgttaatccctcaacctggcgaagcgcgctttggcatggaaattaaacgaactgaagagggctttgtgtacatatattcagtgatgaggggttcgccagctgatcgtgctggggtgagagaaatgtatgaagagttaagtgcaaatgagttccttctagtgatatcaaggttgcaatgcaagagcataatgccaatgaat

SEQ ID NO: 62789 - DNA, 1008 bp, Glycine max
  Peptide Sequence Number=SeqID_179567
aggagacaatggggaaggagtggctgggggaacagctggggaaggggaccaagaggctggggagtggggagggggggcctggggggaccgcgtcatttataaggccatggacgcgcctggccccacagcgcgacccaaggcgcttgacttaagggtgcgagtcaacacgcagagcgtgacccaacgcgcatgcagggagaaaacccaacctacccgaaaacggtgtcgtttctcggaacgttttttagagagaaaaagagagaaagagagaaaagagagagagagagagttgtgttgcggtgatgcggaaacgttgatcccaaatgcacccgtacaaccggctaccaagcagcgggcactcgacgccgtcgccgccgccgtcgccgctccgctcgccgaggctccgccacgcagggaagtccaaggccgggcgggcgttttcctcttcgctcctctcatttacatctccggaatgctcctctacatgggaacggcgtcgttcgacgtcgttccggtaattaaacaccgtcccgcgcctggctccgtctaccgtagccctcagctcttcgccaagctccgcctcgacatggattccgataattcctccgccgatgcggcttgtaaattccctcctttcagatatctacaatatggaagtatccctatagaggtggtgagtggaaaccatgctaacggtggcttaaatcagcagaggacatcggtatgcaatgcagttgctgttgctggctatctcaatgctacccttgtattccccaactttcattatcatagcatatggaaagatcccagcaaattccaggatatttatgatgaagagttttttgtcaataccttgaaaaatgatgtacgggtggttgacaagattcctgagtacctaatggaaagatttggtagcaacatgacaaacgttcacaatttcaggatcaaggcatggtcatctattcagtattacagagatgtggtactccctaagttacttgaagaaaa

SEQ ID NO: 62790 - DNA, 321 bp, Glycine max
  Peptide Sequence Number=SeqID_179568
atggcaaccactttgggggacagaagaccagcgaaggacttcacccagctggtgggagtcccagctagtggtggtggtggtggtgctcctgccattgtttctacaccactcaggtgtgggaagtgtggtcggcttgggcatattgcttgtgagtgcacagatagagaggtgactttctttaactgtctaggtaagggccacctcactaccagttgcccatattcgaggaagaaaaagaggagtggaagtttgaataacaaaagtggacaatcgaggaccacggggagtgtgttttctcttaatggtgttgatgccgcatag

SEQ ID NO: 62791 - DNA, 222 bp, Glycine max
  Peptide Sequence Number=SeqID_179569
atgggtaccccattatcctacaagcttgaaatgaggaagtgtggaagggtgagacttccttcttttattgttgaccacatagtggtacctggagatatgtcgcgggggtcaggagaccttggggacatcaggcgaactcctggcagtcaacagataaaaggaacaaagaccacaaagcaaggaggcttgtgtggtgactggccgactgtgaatcttgtctga

SEQ ID NO: 62792 - DNA, 111 bp, Glycine max
  Peptide Sequence Number=SeqID_179570
atggtgcgaaggttagtggaagaggaaacagttgtggcgaattggagtgcaaaccagctggcgcgggcacaacagtcagggctcaacaacggtggcacgacgatgccataa

SEQ ID NO: 62793 - DNA, 889 bp, Glycine max
  Peptide Sequence Number=SeqID_179571
atgctttgtgatgataaatatgaagatttgggtcgaatgtataacttgttctgtcgtgttactgatggtcgtgcaaaaatacgtgaagtgatgacttcacacattagagaatctggtaaacagcttgacacatatcctgaaaggttgaaggatcctaaatccttgaattcctcatttgaatacttcattaacttgaatcctcgttctccagagttcatttcactctttgtagataataagctttggaaaggactcaagggagttagtgtggagattactcttggcaaggtgatgatgctattctggtacttgcatgaaaaggacctgtttgagaaacatgaaaacctctctagaaacattgctgaacttttatatgccaaccaccccgagttaagcaacggtcctacgcttgccgtgcaggttttgacaacagggagattgtcctggcaaactaatatgggtacagcagacttaaaagctacctttggtaaaggtcagaaacatgagttaaatgtctccacttaccaaatgtgtgtcctcatgctgtttaacaaagctgatagactaagctacaaggaaattgagctagcaactgagattctggcttcatatctgaagaggtgcctgcaatcattggatttggttaagggaagaaatgtgcttaggaaggagcctaagagtaaagatgtaggtgagaatgatgctttctttgtgaatgatgagttatacaggataaaaataggaactataactgcacaaaaggaatcagaacctgagatactggaaactcgccaacgagtggagcaggaccggaagtcacagattgaggctgccatagtgaggataatggaatcaaggaagcaacttgatcataacaatctcatgacag

SEQ ID NO: 62794 - DNA, 405 bp, Glycine max
  Peptide Sequence Number=SeqID_179572
atgggtggagctgaatataactttaaagggtgttatgggggttctgtggattggcatatttggtttattgaagttacttaccaaatatggaaagctagaaatgagtgggtcttcttggatatcgcttggtctcactctaatatcttgaatgaggctaaagttatctttctgcagcacaagttggtcgatccaagtctggatattattcaacctaaagaaacccataggcgagtcttagttgaatgtgactctaagcttgcatcaattcttagaacttattcagctagggagcttgtgttagacagcaatgacgaattcattttggctaatacagattgtaagggggtaatggataaaattagtgaccccaaagctaatttttccgagcttgggtctattgtttga

SEQ ID NO: 62795 - DNA, 895 bp, Glycine max
  Peptide Sequence Number=SeqID_179573
gaatgaccgaagaccaaggagaaggtggctaaggagagttcaaggaaggagcccttccttttgggaccaagcacgatggacaaggctcctaatgaaccctttaggccgtggatggtggttcaaagacccactagaagtgggagaggatgccaatgaagtaggtcagaagaggcctaacaaaaatatcccagtggggaccggctacaattcgaaaaattccagagctgcgactaggaacaggggggtggttataaatgatgttggcttgttggctatgcttgagccgagagttagtggtgtgagggctgataatataatttcgaaggcaggactcaatgcttcatttaaggtggatgttattggcttctcggggggtatcttgctaatgtggaataaggatgtctatgatgttaaggtgctagaatcggatatccaatacattcactgtgatgttcgagacaataatggggcatccttcttgtttacggttgtctatgggagcccgaacatggctatgagggacaagctttgggtgagcttgtgtaggattgatgcctcagtcaggggcccttggttggtctcgggggatggatctataactgtggattttgatgagatcaagatgttggctgtggattttttcaaggatctttattctaaagagggcccttgcggctgctttccccagatttctgaggtgattgccactagacttaagtcatatatgagcgaccttgttgaccagtgccaatgtagctttgttcctgggcgtcatggcttggataacatagtcattgctcaggagatctttcatttgatggctaatatgaaagggacaaagggtggctggatggccatcaaggtggacctcgagagtttgtgcttgacaccttga

SEQ ID NO: 62796 - DNA, 747 bp, Glycine max
  Peptide Sequence Number=SeqID_179574
atggcccagggatttctcacttgtttttcgctgacgaccttctcttttgttgcaaaagcaaatattgagaagatggacattattttgaattgccttgacaccttctcgaagacttcaggagaaaattctttgtgggtttcaaagaatgttaatcaacgagtggaggagactttgagtgagatctcgggattctctttgacatctgatttggagcggtatcttggagttcctctgctgcatcggaggaacaagattgagcgttataatattatcttggattacacgcagaaaaggcttagtgattggcgagcttatagcttatctttttctagtagagttacgcttgttaaggcggtgatttcagtgcttcaaacttatactatgcaatccgttctcctccctattcacgatgaccttatccctatagtgtccaaaaatttaattgacactgaggggaattggaaggttgatctgttgcggcccttcctccctaacatgattctagatgagattatggtgtgtttccaccctagtagtgcccttgggatggacaagtttgtttgggcccttatgagtgatgggagattctctacaaagtctgcttacgatcttttaacttgccctaatgtccagagtgacccctctttgaggaattgtctgtggaaaatccctggtagacctagagctagggatttgcctaagaataagtatcgccatattcggggaatggctgagcataatgattag

SEQ ID NO: 62797 - DNA, 558 bp, Glycine max
  Peptide Sequence Number=SeqID_179575
atggcactgtttgatatgggagctgagtaccatttctatgggtttgacataacttgttctttgcctgtgaatggaaagtttacgagtgatcaatcccttatatatagtgctgtgctagatgctcataatgtcgttatatctgcaatgaaacctggaataaactggattagcagaaaaagtgattctggagtcactgaagaggggacacattttattgggtctctaggatcttttaagaagttgcatatttgtggattttggtgtagtgatgttgatgacatgatggccgcacactgggtactgcttttatgccacatggtctggggcatttccttgggcctggaaagaagaaaggaacctggattaaaatctttgtggacaatcagggatctccgggaaggaatggttatcactgtggagcctggatgctactttattgatgctttgttacttcctgccatgaatagtccagaaacttccgagttcttaaaccaggaagcaattaatagatttaaatgttttggtggagtccgaattgagagtgatgtgatcacataa

SEQ ID NO: 62798 - DNA, 294 bp, Glycine max
  Peptide Sequence Number=SeqID_179576
atggattctgctactgatgaaaacatgacacccccatcacatgtggttgcaattacaaatggtgatgcccgtcttcttgaacttggtaacaaacaagaactcaagcgtcatttttcattagctttcaccatgcttgttgcactctcaatggctgaaatttgttcttcaatccaactactggaggtctctattattggagtgccaaacttgctggccctagatgggcaccctttgcttcctggattactggctggtattgtaaaacttaatagtttaacacatgatgaaaattga

SEQ ID NO: 62799 - DNA, 150 bp, Glycine max
  Peptide Sequence Number=SeqID_179577
atgagtatgcaagataaaaacagaaaagaaaataggaaagaaaaacctggcgcgctcagcgcgacaccccctcgctcagcgcgtgtagatcgcgcgcttagcgcgcatgttgcaggcttagcgcgcacttctgttggatcatgggcttag

SEQ ID NO: 62800 - DNA, 1323 bp, Glycine max
  Peptide Sequence Number=SeqID_179578
atgggtatcaagattgagcaagagcaaccttgtgttgagctttcaagagttgcggtttctgaaactcatggtgaagactccccctattttgctgggtggaaagcctatgacgagaacccttatgatgaattaacaaactcctccggagttatacaaatgggattggcagaaaatcaagtttcatttgatttgctggaaaagtacttggaggaacactcagaggcctcaacatggggaaaaggagctcctggtttcagagagaacgctttgttccaagactaccatggacttaaatcattcagaacagcaatggcaagcttcatggaacaaataagaggagggagagcgaaatttgacccagatagagtggtcctcacagcaggcgcaactgcagccaatgaactcttaaccttcattcttgcaaacccaggagatgctctacttgttccaacgccttactatccaggatttgatagagatttaaggtggagaactggggtgaacatagttccaatccattgtgacagctcaaacaacttccaaatcactcttcaagctttggaggctgcatataaagaagcagaagcaaagaacacaagagtaagaggagtgttgatcacaaacccatcaaaccccttaggtgcaacaattcaacggtcggttctggaggagcttcttgacttcgtgactcgcaagaacatccaccttgtctcagatgaaatctactcaggctcagtgttttcctcctccgagttcgtgagtgtagcagaaatcctcgaagctcgccaatacaagaacgcagaaagggttcacattgtttatagcctctccaaggaccttggtcttcctggtttcagagttggaactatttattcatacaatgataaggttgtgaccacagcgagaaggatgtcaagtttcaccttaatatcctctcagacacagcaccttttggcgtctatgttgtctgataagaagttcacagagaactacattgagaccaacaggcagaggctgaagaagaggtaccaaatgatcattgaagggttgagaagggttggcatagagtgtttgaaagggaatgcagggttgttttgctggatgaatctgagtccactgttggagaagccaactagggaaggagaattggagctttggaatgctattttgcatgaagtgaaactcaatatctctccggggtcttcttgtcattgttctgaaccgggttggttcagggtgtgttttgcaaatatgagtgagcagacgctgggagtggcactggagagactacgtaacttcatggaacgaatgaagaaagactaa

SEQ ID NO: 62801 - DNA, 240 bp, Glycine max
  Peptide Sequence Number=SeqID_179579
atggcgtcaaagttgcagaagttgcagtccgcagcatgtcaagcatctcaatttgtatccagtcgtggaactaactactacaggcaattgctggaacagaacaagcaacacattcaggagcctcctacagtagagaaatgcaacctgctggcaaagcaattgttttacacccgccttgctagactagggatgaagtcctggaaggtgaggttgcaaggttttaacctactatgcttttga

SEQ ID NO: 62802 - DNA, 2282 bp, Glycine max
  Peptide Sequence Number=SeqID_179580
atggaattacttccggcttctgcacctccgatctcgaagaaacaaggattccgatccctcaagctcgtcaacgccgacatggaccaactcctctccgaccaacccgtcggcgtcgactacggtacactcgacaatggccttcgctactacgttcgctgcaattccaaacctcgcatgcgagccgctctcgctcttgccgtttgggccggatcagttctcgaagaagaggatgaacgcggagttgctcacattgttgagcacctcgctttcagtgccaccaagaaatacaccaatcacgacatcatcaagttcctcgagagtatcggagccgaattcggcgcttgtcagaacgccgtcacctccgccgacgacaccgtttacgagctcctcgttccagtcgacaagccggagctgttgtctcaggccatttcggttttagccgagttcagttcagaaattcgagtctcgaaggatgacttggagaaggaaagaggagctgtcatggaagagtacagaggaagcagaaatgccacggggaggctgcaggatgctcattggatgttgatgatggaaggttcaaagtatgctgaaaggttgccaattggactagagagagtgattcggacagtttcgtccgagactgtgaagcatttttacaagaagtggtaccatttatgcaatatggcggttatagcagttggagatttttctgatgcacaggatgtagttgagttgataaagactcattttggccagaaaattcccgatcctgatcctccacttataccaacaatccaggttccatcacatgatgagccacgtttttcatgttttgttgaatccgaagctgctgggtctgcagtgatgattagttataagatgccagcagatgagcttaaaacagtaaaagactaccgtaatttacttgcagaatccatgttcctctatgccttaaaccagaggttctttaaaatagcacgtagaaatgatccaccctatttctcctgttctgcggctgctgatgttctagtccgtccattaaaggccaatataatgacttcatcttgtaaaagaaaaggaactattgaagcattggaatcaatgttaatagaggttgcaagggcaagacttcatggcttttcagagcgtgaaatatctgtagttcgtgccctattaatgtcagagattgaatctgcttatttggagcgtgatcaaattcaatctaccagcttgagagatgaatatttacaacattttctccacaatgaacctgttgttgggattgagtatgaggctcaactccaaaagactcttctaccacatatatcaacattagagatctctaagtgttctgagaaattaaggacatcgtgtagctgtgtcataaagactatcgagccccaaccatttgctgtgcttgatgatctgaaaaatgttgttaagaaagtcaatcttcttgaggaagagggtagaatctctccttgggacgatgaacatgttccagaagaaattgtcactacaaagcctaatatggggcatgttgtgcaggaattggaatattcaaatattggagctactgaactgattctgtcaaatggcatgcggatctgctataagcgtacagactttcttgatgaccaggttatcttcaccgggtattcatatgggggcttatctgaactcccagagaatgagtacttctcttgttcaatgggacctactattgctggagaaattggtgtgtttggttatagaccatctgtcctgatggatatgcttgctggcaagagagctgaagtaggtaccaagattggtgcatatatgagaactttttatggtgattgttcaccttcagacctagaaactgctttgcagcttgtttatcagctgtttacaacaaatttaacaccaggtgaagaagatgttaaaatagtcatgcaaatggctgaagaagcagtatctgctcaagatagggatccatatactgcttttacaaaccgtgtaaaggagcttaactatggaaactcttatttcttccggcctattagaaaaagtgacttgcaaaaggttgatccacggaaagcttgtgaattcttcagcacatgtttcaaagatccatcaacttttaccattgtgattgttgggaacattgatcccactattgcaatgcccttgatattgcagtacctaggtggaattccaaaacctcctgaacctattatgcattttaaccgcgatgaactgaaaggattacctttcacttttccgacgtcaatccatag

SEQ ID NO: 62803 - DNA, 297 bp, Glycine max
  Peptide Sequence Number=SeqID_179581
atggctcagcggcaaccaatgaaggcttgcaatgacaatggtgactacggtgttttgagttggttgcacacatggacggtgtcacagtctttggtgatgacgatgggcactatccacccgctagattgtgggtcagccaaaccacaacggaataggaacaaaatgaggccaaatagtgtcacaaagttgccaaacaagttttgtcgaaggagaaggagcacgacggggaggttgccaaagatggcgcacgattacgagattggtgatagtggatttgctggagagaaacacttctaa

SEQ ID NO: 62804 - DNA, 282 bp, Glycine max
  Peptide Sequence Number=SeqID_179582
atgccacaacaacatgctgcttgtagtttttatgtcgaagcccacttctgtttggtgtttcttgctgctacatataactctagaatcttttgcagtattccgggtcgtaatgagtccttttggaaggaacttgattatgtcaagaatttatggaagaacaggaaagagctaaaggttgaagatgcaggcattgctgctttgtttggcctggaatgctttgcatggtattgtggtggtgagattgttggaaggggatttactttcaccggttactatgtctaa

SEQ ID NO: 62805 - DNA, 303 bp, Glycine max
  Peptide Sequence Number=SeqID_179583
atggcttccagcagtggttcctttcctccatctccaatgtttgcaggagaacattatgatttgtggaaaatagtgaaaaatggaagcaatccagctcctttacctgacaacccaacagcgatgcagataagattccacattgatgaagtggttgaagagggtagagcacttgtcatcatacaaacagcactccatgataatgttttcatcaagattgtgagtcttgaaactacaaaagaggcttgggacaaactcaatgagaagttccaaggtagtgaaagaactaggaggataaggtgctaa

SEQ ID NO: 62806 - DNA, 1134 bp, Glycine max
  Peptide Sequence Number=SeqID_179584
atgtccatcatagagctcaaccaatttgtatccgaatgtgggtttgaggataggggcgtgagtttgttactgaacgtggcagagataagggttgaacgtggggaacctatttatgtgctagacggagttcctatttctgtcaaggatgagataaattgtttgccatatccaacaacaggtagtgatgatgcctactgcgttaagcgtctaagactatttggcgccataattgttcggaaaaccaatatgcatgaactaggatctagaaccagtgggataaattcacatgatgggcctactagaaacccatatgatactaacaagattgcaggaggttcttctagtggatctgcttctctcgtgtctgtcggactgtgtcctattgcccttggtgttgattggggaggatctgtaacgatgtcagctgctctttgtggtgttgtcggtctaaataacgaaactctaatgatttgggttccaacaaatccaagaggtgcagaaagattacctcctaggatagttatttggagagaaaaaggatcatccatcgacaatgtaaaaagttttacacaatcatctaatcacaacccatcatatatggatttaacctttaagccaaagtaccttgtgactttcactgttgggtacgagcagaaaaagaatatcgttgtagctgtgaaaaaggccaagataaatcttccccgactgagcttgacaaagtccatatctgacatcaagttagccaaatataggaagctgaagaaaagcagggaagttgcagatgccattgtgaaaaataaccaagacttggttttgaggtacaaggcggtcatcaatgatggcctcaagctggatcttggccacacactttctcttgaaaagactagagagaaccataatgcaaatgattttttgaggtctgacttttcaaactctaatcacgctgtgcagtcccttgaacacgtgaccattgttatggaacaaatgttgcgcctgcttcatacctgtgccttacctctagaagatgtagacttcataaattatgatgggaagacaatgaacaagctgttgctggaggtttctgtgtttgatttagttgtccaaggaggtgactcagtttgggagggtctttga

SEQ ID NO: 62807 - DNA, 357 bp, Glycine max
  Peptide Sequence Number=SeqID_179585
atgagtcaatttagtcatttctgtcaaattggagatcacgacgttaagattcaaccttgtccgcacatcacaatactcactccctcttcccactccttaaatgacttctccttgaagccctctcactccgaggaggatccgaggttgacgatgtgtaacttgaatttggagaactcgacagtgagcaaaaggtacttctactcaatgaggagaacccgacagcgagcaaaagttgacggcgtccgccttgatgtgaacggtgtcaaacttgtggaggacgccctagatgaaggagtctgcctgaggtcacggaggtgccgttgcgagaacaccgcaggaactccatgttttgtgtga

SEQ ID NO: 62808 - DNA, 820 bp, Glycine max
  Peptide Sequence Number=SeqID_179586
gacaggtggaattgggtcttgggcagggttaattccttcatctttgtttgctatgtctgtgcagaacgcaacctgcagcgttggtcccagtttgtctgtccctgcccttccacattttcatgttgagcaaaggacagaactaagtaaaacaaaatcacagaggaaattaaaagagcttaatcagacaaatgtcatgggaagagctccatgttgtgacaaagctaacgtgaaaagagggcgttggtctcgtgaagaagatgaaaccctcaaaaaactatctcaacaaacatgccacgccacaaaaagcaggcctcatatcaagcatggagacttcactcgtcaggaagaccaacttatctgcaccctttatgccaccatcggaaccatgcacgtgtcccttattgctgctcagctacctgggagaacagacaatgatgggaaaaatcattggaacactaagttaaataaaacttttttggcagcaaacaccaatgccattgccagtactgttttctcaacttccacttctcagcctcaacttgaagactacagtgtctttgatgatcacgagaactcagctgagtatcttgtcttgggtttggagcaaacaccattgcctttaggatcagatgtttttggtcttggaagcagttgtagtgtacgactatccaatgaagcagtttcagcttccttggtaaaaaaggaaaatgagaatgagacccaatggtttgctgaagatgaatcatttttgcttgattttgtgtatgaagataatgggtttgtttctcaagaaaatagcagcgaagttccacctctctaa

SEQ ID NO: 62809 - DNA, 930 bp, Glycine max
  Peptide Sequence Number=SeqID_179587
atggatatcaacttcactcttctccattcgatgaatcagtgtattactttctccttgaaaaaagcaaatgctatatgggctggttcaacaatatatgcctctcctataccaacagtaccagagctactttgggatcatttagttcatatcagtacccaggtaactagcccctgggtagttatgggtgaccttaatgagattactcatcctttagaagttagagggagggttttccatcagatgggagaaaatcatttctatgggactttgacgcaatttggtctcattgatttggagatgataggaggcggtttacttggcggcggaacattcagggggggtggttatatcgacaaaaaacttgacagaacttatagattccccaagggttgctcctatccatggtcctctattatgaaagccttgtctgctcttagatccgggttctctattcaaataggtgatgggtcctcttccccctggttcgaaccatggctttatggggacactttgtataatggagttgaggatattcatgataggaattttcatctacgggtctatgatgtatacttagatggtgaatggcatcttgatgttctaaccaccagcattctcgatgacattctggataaactcccaatcttgttccttgaatatacgatgtcagatactatcacttggagtcattcctcttttggggagtatgataccaagtccgcttatgtgtggttaaaccgtgagctcgctggtcattttacctccgcagaatactggtcctggctttggaaaaccaagcttcttgagaacattaaacacttcctttggccaacatataagggaagccttctaactaacttcttccgctttacacagcatatttcatttgattcttcttgtttcaggtgtggagcagctacaaaaacgtga

SEQ ID NO: 62810 - DNA, 369 bp, Glycine max
  Peptide Sequence Number=SeqID_179588
atgatcaagaatgaagatgaaataaataggacgtggaaatcagggggttgccaagttgcaaggcacaatccaggtgtccaaaatgctaataagcgtgttgcgaggtgcacgtatactatttggtgtgaatcacgctacgctacagaatatgctgagtttaatattaagtaccgcgtaaaaatcaacaaccctggaaaggggaaaaagaaaacgagggtgtgcaatcactccctaatattctccgtctatctggtgcatactgacttcagtgtcaaagagtatctttatccactccctcgtccgggtgaggagaaaaatacttgtgttactcaaggagaagacccttggatcattattttgggctattaa

SEQ ID NO: 62811 - DNA, 2481 bp, Glycine max
  Peptide Sequence Number=SeqID_179589
atggaaattttttctgtcgtgatttttattgtttcttatatgctcgttccatctctcaaaatttccgcagctaccctcgatgtgtcacagtatgtcacagacggtgagaccttggtgtccaacagtggagtttttgagcttggttttttcagcccgggaaaatccacaaagcgttacctggggatttggtataaaaatattactagtgatagagctgtttgggttgcaaaccgggaaaaccctatcaatgattcctcaggcatcttaacattcagcaccacaggcaatcttgagctcagacaaaatgactccgttgtttggtctactaactataaaaaacaagcacagaatccagtagcagagctcttagacactggaaattttgtggtaagaaatgagggagacacagatccagaaacgtactcgtggcaaagctttgactatccttcagatacacttttgcccggaatgaagttgggatgggacctcagaaccggtctggaacgcaaactaacgtcttggaagagtcctgatgatccatctgctggagatttctcttggggtctaatgctccataattatcctgagttttatctgatgattggaacacacaagtactaccgcactggaccatggaatggacttcatttcagtggatcatcaaaccgaactctaaatccgctgtatgagttcaagtatgtcactacaaatgatctcatttacgcctccaataaggttgagatgttctactcgtttagcctcaagaatagttctatcgtcatgatagtcaacataaatgaaaccctatctcaaatccaaacccaagtatggtcggaggacgggcaaatatgggtgatttatgaaactaccccaggagattactgtgatgtgtatgccgtctgtggacccaacgcaaattgcaggattacagaaccacctgtttgccaatgtttaaaaggattcaaaccaaagccaccacaagaatggatcccctcaatggattggagtcaaggatgtgtccgacctaaaccattaagctgcgaagaaatcgactacatggatcactttgttaaatatgtaggacttaaggtaccagatactacatatacttggctggatgagaatattaatttagaggaatgcagaattaaatgcttcaataattgctcttgcatggccttttctaattcagacataagaggaggaggtagtggttgtgtcctttggtttggcgatctaattgacatcagacagtatccaactggcgagcaagatctatatatccggatgcctgctatggagtccatcaaccaacaagaacatggacacaacagcgtgaagataataattgctacaacaattgctggaatcagtgggatactttcattttgcatttttgtcatatacagagtccgaaggagcattgctgataagttcaagacaaaagagaacatcgagagacagctaaaagatctggatctgccattgtttgatctgctgacaatcactactgccacttacaatttctcgtcaaatagtaaaattggacatggtgcttttggacctgtatacaagggaaaattggccgatggacaagaaattgctgtgaagagactttcaagcagttctgggcaaggaataacggagttcgtaacagaagtaaaattgattgcaaagcttcaacaccgaaatcttgtaaagcttcttggtttttgcattaaacgacaagaaaaaatactagtatatgaatacatggttaatggaagcctagactcctttatttttgataaaataaagggtaaatttctggattggcctcgacgcttccacataatatttggaatagctcgaggacttctgtatcttcatcaagattctcgattaaggattatccatagagatctcaaagcaagtaacgttttacttgatgaaaagttaaatccaaaaatatcagattttggaatggctagagcttttggaggagaccaaactgaaggaaacacaaatagagttgttgggacttatggatacatggccccagagtatgctgttgatgggctattttcaatcaaatctgacgtttttagctttggtattatgttgttggagattatatgtggtaacaaaaatagagctctctgtcatggaaaccagacacttaaccttgttggttatgcatggacactttggaaagagcaaaatgttttactgttgattgactcaagcataaaggattcgtgtgtcattccagaagtactgcgatgcatccatgttagtctcttgtgtgtgcaacaatacccagaggataggccatctatgaccttcgtaattcaaatgttagggagtgagacggaactgatggagccaaaagagcctggtttctttccaaggaggatttcagatgaaggaaatttaagcacaattccaaatcatatgtcttcgaatgaagaattaaccattacctcgttaaatggccggtga

SEQ ID NO: 62812 - DNA, 1077 bp, Glycine max
  Peptide Sequence Number=SeqID_179590
atggctgaagctacacgttcgaaaaccagcatggagcgctgggaagatgcattcgcaaagctctccgtgtccatgacttcgaagttcgatgaacttctcagtcgcatgaaccagttagaaacttctcacgccaactcccatgctcctccgtcatttgttgctgcttcaacggcggccacctccaacgcagcttatagattgaagttggaggttccgcgatttgatggatcagatcctgaagggtggatattcaaggtggcacagttctttgagtatcacgcgatgccggagcatgatcacctgacgatagcgtccttctatatggaaggcccgactttagcatggttccaatggatgtatcgaagtgaccaactctccttgtggtcatcctttctacatgccatccacgcaaggttctcgtcttcagcttatgaagatcctacaggagtcttgtgcaagctaacacagagatccacggcagtttcgtttgcacgtctccatgaagaaaagcttctcgacagtcgtcggcaggggagtaaacctccatcctcgtcaactctggggatgaataccacgcgcccttcacctcccttgaatggacctctacaagaatcatcactattgccctctgcgagcagacctcgctctgcctccatccctttcaaaagattaacaccagctgagctcgccctccgccgtgaacaaggtttatgtttcaattgcgacgaaaaatattcgagaggacataaatgcgcatcctctttattcttgtttgtcataggagaagatgacgataaccgtcaaggagcaccggaaaccttgcgcctcactagtctgatccacgatcatcgagttcaaattctgatagatggaggaattggtaatggtggagaattgcagtgcaaccaggtatgcacaaatatttctgtgaaaatccagaagcatgagtttcaggtagacttccacgtcctgccaattcgaggggctgatgttgtattgggagtccaatggctcaaggcgttaggaccagtcctaacagactacactgcgcttacaatgaagttcatctacaactga

SEQ ID NO: 62813 - DNA, 447 bp, Glycine max
  Peptide Sequence Number=SeqID_179591
atgcagtcgcagatacaatcacaggaactcgcacaacctcttgaggctgaggttagttattctgccactcgtgttagcacaaaggaaagttgtgtcaatccctcagggcatgacccaaaaatgggagactcggacaaatgtgagttgtatgtcaatggcagtcctcctcgacttattgctcttggaagagtttatgaagggtcgatgactgcccacaatgttcctttgggcgatgatcaagtgaaggtgtcgtgggattctagcgtgtttggggattataatgataacttcccattgtacataaagcatgaagagttttttgaaaaagctcacaatggtcaatgtctgagcatctttgttacacaattagggattattgcacattggcaaatggtctcattttggctaaggacaatgttgtcatctgttttgttccttgcagaatag

SEQ ID NO: 62814 - DNA, 1200 bp, Glycine max
  Peptide Sequence Number=SeqID_179592
atgggtggttccgttttcactcacttcctcgttctcccctcctcttctactccttctctttccactctcttcccatccaaattccccaccagacccatcaatgaatcttttcccttcacccttacctgcaaccaattcccttccaaactcactacttcgcggccttcccaattctcagctcctcctagttactcatgctctgtaaaaaagataaaagcttcgggaagtcagcaaacaggatccattcgacatggagacaaccttgatgcaatgaatagcaggagtttgctgcagctgacattcaagctgctcaatgagtcaaccatccatgatacatcatggatagccaaccaacttgaacgacctgtgggtttagggagggaaagatcatccaaatgggtttcagcattcctctttggacaaactatatcagtgatttctcctgatgtttcatgtgcaagcagctcagcaagaataaatgagatatatgaggttggagagttgtttgatttaagcatccaactaatatacttgatattgctattgggtttgctagggagtgggactttctttgtgattcgccaagttcttgtccgcagagaactcgacctatctgccaaagagttgcagacgtatgaggttttttctctggtttggtaccataatagagcttatacacaagcacaactggacaagccagttggaactagttgttttatgatcctttgtcagtttgtccttactcattttctgccattatctcaggagcaagtaagaagtggtgatgctggtgcaactgagctttttgaacttggtgcagtgatgctgcgcaggaaattttaccctgctgctaccaagttcttgcttcaagcaattgagaaatgggatggggataatccggatcttgcccaggtttacaacgctcttggtgtgagctatgtccgcgatgggaaagttgacaaaggaattgctcaatttgagacagctgtcaagcttcaaccaggctatgtcacagcttggaacaatctcggtgatgcctttgagagtaaaaaagactacaagtctgctctgaaggcatttgaagaagtcctactgtttgatcctaacaacaaggttgcccggcctagaagagattctttgaagggacttgttgatgcaaccaaaggagttactgtcatcaagtcaacagagaagaaatga

SEQ ID NO: 62815 - DNA, 1482 bp, Glycine max
  Peptide Sequence Number=SeqID_179593
atggctcagcttctccacactcccttcatcccttcctcctcctccgcgctccgccgcgccgccaccattccccaccgcaaaacgacctctcgcctcgtcgttcgggccaagatccgggagattttcatgccggcactgagctccaccatgaccgagggcaaaatcgtctcctggaccaaatccgaaggcgacaagctctccaagggcgacagcgtcgtcgtcgtcgagtccgacaaggccgacatggacgtcgagaccttctacgacggctacctcgccgccatcgtcgtcgaggaaggcggcgtcgccgccgtcggatcccccatcgcattccttgccgagaccgaggacgagattcctcaagccaagtccaaagcctcttcttcttcctcttcctcttccgcacctgcaccagcaccagcaccagcaccagcaccagcacaagcaccgccagtggaatctcaaccggaaaaggttgcggcgccagtcgcagctgcggtttcagctccggtcattgcgtccagtcatcctgcttcggagggagggaagaggactgttgcttcaccttatgcgaagaagcttgccaaggagttgaaggagaacttttttaaaagttggagaggagaagttggttttaacttgtacgacaagtttaatttattttgccttcttattttcttctccccggcagcaccggcaccggggaagagtgcagcacctgccgggatggagttgggatccgtggtgcctttcaccacaatgcagagtgctgtgagtaggaacatgctggagagtttggcggttcccactttcagagttggttacaccatcaccacggatgcactcgatgccttgtacaagaagatcaagtcaaagggagtcacaatgacagcattgcttgctaaggctactgcacttgcgctggttaaacaccctgttatgaactctagttgtagagatggtaatagctttacatataatagcagcatcaatattgctgttgctgtggctatagatggcggattgattacaccagtgcttcagggtgctgataagattgatgtctattcattgtcaagaaagtggaaggagttggttgacaaggccagagcgaagcagcttcaacctcatgaatacaacactggtatagccagtatcctcacccctgcaggttctaaactagtcagagaacctaagaatactgagtttagaacctttagaagtactttcactctgtccaatctgggaatgtttggtgttgatcgctttgatgctattctgccacctggaactggagcaataatggctgttggagcatcggagcccactgttgtggctacaaaggatggtcgcattggaatgaagaaccaaatgcaggtcaatgttaccgctgatcatcgagtaatctatggtgctgatttggcttcattcttgcaaaccctgacccagattattgaggaccccaaagatcttactttctag

SEQ ID NO: 62816 - DNA, 352 bp, Glycine max
  Peptide Sequence Number=SeqID_179594
atgtctccttttcacgttgaggctcttcatatgacatccaagttggatagacaactaagtgccttagtcgaggttcaagcgtgtggatcaatggtaacagaggagcaacctcatgccattcccctgagtccgtcttgcatttctcctgagctttactctccagagagtatagctaacacggtgagcaagcataatgccgacaccatgcaatgctacacattgttttacactggaccaagggtaaggcaccctaacttggttcctcttttggggttctacactgggccaaggggtgagaagcttcttcttcatcccttctataggcatgggagtctcactcaatttataagag

SEQ ID NO: 62817 - DNA, 144 bp, Glycine max
  Peptide Sequence Number=SeqID_179595
atggagagtgttgaatttggggatatgggaattaaagaagaaacattgataaagaagcaaattgtttttgagttgactttgttggccagaactatagctgctgaacataggattgtatgggcagaaccagattgcaatttttag

SEQ ID NO: 62818 - DNA, 1113 bp, Glycine max
  Peptide Sequence Number=SeqID_179596
atgggggattccaatgtcaccaagaatcacctgtttgcaacttctcctcaacaaactgaggatgatgcttgcctatctgcaatgctgctttgcactaatctagtgtaccctgcagtactgaatgctgctattgagttaaacttgtttgagatcatagctaaggcaacaccagctggtacttttatatcatcccatgaaattgcttctaagctcccaacacaacaccctgacttgcctaataggcttgaccgcatgctgcgtttgcttgctagttattctgttcttactacttccactcgcaccacacaacatgcagcctctgagacagtttatggactctcacaagttggacaatactttgttccaaatggaagtagtggctatttggcttcattcacagcatttgtctgttatccaccactcttacaagtttggttgaacttcaaggaagcagtggttgatgcagacattgacttgttcaagaaacttcatggagtaacaaagtaccagtacatggaaaaggatccaaaaatgaaccaaatttttaacaagtcaatggccgacgtgtgtgcaacagagatgaccagaatacttgaaatatacactgggtttgagggaatatcaacattggttgacgtaggaggtggaaatggacaaaatctaaaaatgatattgtccaaataccctttaattaaaggaattaattttgatttgccccaggtgattgaaaatgcaccaccccttccagggattgagcatgttggaggagatatgtttgtaagagttccacagggggatgccataatactaaaggtggctgtatgccacaattggttagatgaaaagtgcttagaatttttaagcaattgtcacaaagcattgtctccaaatgggaaggtgattgtggtggagttcatattgccagaagaaccagaaccaactgaagcatctcgacttgtttccactcttgacaacctcatgtttatcactgttggtggaagggaaagaactcagaaacaatatgagaatttgtgcaagctctctggattttcaaaatttcaagttgcttgtcgtgccttctctagtctgggagtgatggaattttacaaatag

SEQ ID NO: 62819 - DNA, 570 bp, Glycine max
  Peptide Sequence Number=SeqID_179597
atggatacagaggacttcagcttccccaaaaatggtggcacttgtgcatatagcattgattcacctcctctgtggaatatatcaccaaaagacccttctaatccaaatcaagtccctagagaaggaagcaaagcagatgaaaaggattactttgaagcaaaagtggtctctaagggccacaagaagagcttttcatgtgtcgaagatcgaaagaaaataacaagattaaccgatgaagcggctccaatggacttgttgtgggaggctttcaatgaggacctgtcttcagcagtaaagttttcttcctcttcttcaagggagatggttgaattcagatgcgctactacagccttaacagttgtcaagaccaacaaggctcttcttcaaacaaagaataggcccggtatggtggtgattgtaaaagtcttaaagaagttcttttctctcaacaattctcatcttgtatgtggaaatatggttcttaagaaattgctttcgataaagtgctccaaaaagcttattcatttattgtcggaagaaatgggctctgctcccaatttgaaaggttaa

SEQ ID NO: 62820 - DNA, 411 bp, Glycine max
  Peptide Sequence Number=SeqID_179598
atgcaggctgatattgctgctgcatcatcaagtattccactgccaaatatcagattttctagtagattttcgccaagtgtagcaacagcaacatggacctcaaatcttcctcccaaacaatggatattgcactcaactgcacagatagaagatataatcacaaactacatgaggagtttaaatctttctgataatgatctgtccaagttgcttaaaaagtttccagaagttcttggatgtaatttggaggaagagttgaaaggtaatgtaaagatcctggaggagcagtggagtattaagggaaattctcttaggaaacttctccttagaaatccaaaagttttgggttacaatattgattgtaagggagactatattgcaccatgcactagatgctgggctcgcttctag

SEQ ID NO: 62821 - DNA, 250 bp, Glycine max
  Peptide Sequence Number=SeqID_179599
atggagggtgagcttttgccgaaatccttgtggtggaaggatttgaagaaaatttgtggtggtaatgggagagcgagatggtttgatgaaggaattgattggaaaatgttattggtgatatggggatgtggcgggaggataggtggaattgggagtttaattggagaagggtacaaaggaatggattggattcttggatttggaaaagctgcccctcggggagtataccacaaaatcggcatacaagttg

SEQ ID NO: 62822 - DNA, 291 bp, Glycine max
  Peptide Sequence Number=SeqID_179600
atggccctcactagaagcacagtggtattggctcttctctgcttcatccttatacaagagttggggatctatggtggagattcgcacagggttgcttccaataagatagattgtgttggaaagtgcaattacaggtgcagcaaggctgggaggaacgtaatgtgcctaagggcatgcaatgcttgctgccagaggtgcaactgcgtgccaccaggcacttctggtaaccgagatttgtgtccttgctatgctagactcaccacacatggaggacatctcaagtgcccatga

SEQ ID NO: 62823 - DNA, 570 bp, Glycine max
  Peptide Sequence Number=SeqID_179601
attcttcttgctacaacatccacagatgggaaatgcagagtattctccacctttataaaaggcgttgatgcaagggattcgaaaaagggtacttcaccagattcaaaatttggagagcaaattgttcagcttgatctctcatcgtcttggacattcggagtcaagtggtcaccaagtggcaatactctagcgtatgtattatttgtttctgagagaaaagtgataggtgtgggatttgattgtaacccaatggtttttgctgcagatgaaaggggaatttggagttttgtcagatatttggcagaacggaaagcagtatcttctggatcaagatatggctcacagttctctgaagcatttggaaagttttatggccaatcgaagcatggagtgagcaatgatacagttgaaacttcaagaactcgtggaactgttcacgaaaactgtataaattgtattatgcctcttggggatcatggcacattgctaaggcgtttcagcacatcaggattggatggaagaattgttgtatgggatttggaaaatgagcaagacctgttggaattataa

SEQ ID NO: 62824 - DNA, 441 bp, Glycine max
  Peptide Sequence Number=SeqID_179602
atgtataagatcttgaccaaaatcctacctagaggattgatgaaggtcttgccaagaatcattgaccctaaacaaagtgttttcttggagggtagaaatattctacatagcatgttgatagcaaatgaggcggtggagaaagcttatgacttggtgtcttggaatttctactattcattaaatggtagtccattagaggagtttgtcccacaaagaggcctaagacaggggaatctactagctacattcctcttcaccattattgcgaaaggattaagtggcatgatgagggagaccatctcaaagaaattatttgaagggttccatattggtaaggataaggtggaacccaacttacttcaatatgcagatgactcttttcattgggaaggcaacaaagaggaatgtggtggttatcaaaagcatgctaagatactttga

SEQ ID NO: 62825 - DNA, 381 bp, Glycine max
  Peptide Sequence Number=SeqID_179603
atggcggtgatggcggttcaccaattcgcgcaatgcatcacttgccacgcttggagccccgatcaatccatggttgctttatgtccaaacaataatgaagtgcacatctataggttggttgaagacaaatgggaaaagttgtatgttcttcaaaagcatgaccaggtaatttctgggatagactggagtgcaagatcaaatagaatagttactgcatcccatgatcggaattcatatgtctggaacctggaaggatcagaatgggtgccaactcttgtgattcttagactaaaccgtgctgctctttgtgttcaatggagtccaaaaggtttgaaacatgttgccatgtttcagtttctctatgcttctcttcttaagtga

SEQ ID NO: 62826 - DNA, 1416 bp, Glycine max
  Peptide Sequence Number=SeqID_179604
atggacttgaaggcaaagacagaggagctggtgattgctgatgtttccaatgctaacggatggggagatgatgacccaaccatctttgagatgacaatcgttgcaaccttacaaggggaattccaattgacaaatggctatgggccaaataaagctccggaaattatgaaggaacattggaacacttttattgttgaagatgatttcaagttcatgaagagtcatggattagatgctgctagaattcccgttggctggtggatagcaagtgatccatatccacccccaccttatgtcgggggttccttgcacgcattagacaatgccttcaagtgggcacagaaacatggattgaaaatcattatcgatcttcatgctgcacccggctcacaaaatggctttgacagcagctctacaagagatggttctctagagtggggaaaaacatatgaaaacatcaagcaaacagtttacgttatagacttcctaactgccaggtatgcaaaaaacccgagcctttacgcagttgagctcttaaacgagcctttgtttcctaacgtgactctagagagcttgaccaagtactacaatgatgcttacaatgcagtgcgcaggcactcttccacagcttatgtggtgttatcaaataggttggatctctcaagtcaactagaaatcccaaacaccaaggaactcttccctcttgccacaggccttaggcgatgtgtgattgatgtccactactacaatctctattatgatatatttgaagacatgaatgcgcaagagaacattgatttcatctacaaagtccgttcatcacagttggataatattacaaccgtagatggtcctctcactttcgtggtggtagatgacagtggtaatagtgatggtaacattggtggtggtggtggtaatggcaaaggtgacattagtggtggtgacaacaatggcgatggaggtggttgtggtagcgatgacgaaggtgatattgttggtggtgatggtgatagcaatgttgtggtgatgatgatggtagtgataacaatgcctgtggtgattatgatgtcaatggtaacaatggtggtgatgataacggtgttagtggtgtcaccaagtggtagtgattgtttcgacgatgatgttggtggtaacggtgacaatgacattgatagttgtggtggtagcaatgccggtggtgatgataatatcagtggcgatagtggtggtagtagcggtgaatggactgctgagtggaaggttgaaggggctaccaaaaaggattatcaaagatttgtcaaggctgaattagatgtttttgggcgagcaacatttgggtggtgttattggacactcaagaacgtcaataatcattggagtttggaatggatgatcaagaatggctacatttaa

SEQ ID NO: 62827 - DNA, 177 bp, Glycine max
  Peptide Sequence Number=SeqID_179605
atgagcagcagaaggaccaacctcagcctcaggaggtcttcaggagccatggatgaagacatgcaggagctccttcaagccggtccaaagtattgtttgatcgtgacattggctctagcagcatggacaagaccagggtactctagtcgcccaatggcagctgccagtatattttga

SEQ ID NO: 62828 - DNA, 841 bp, Glycine max
  Peptide Sequence Number=SeqID_179606
atggttcatggtccatgtggaagtctgaatcctggatctccatgcatgaaagaaggcaagtgtagtcgtttctatcctaaaatgttccagccgcatactgttttagatgctgatggttttccagtctatcgtagaagaaataatggtaatgcaattgagaaaaatggtgttataattgataacatgtatattgtaccttacaatcctagattgcttagaaaataccaagcgcatatcaatattgaatggtgtaacgaaaacacttctatcaaatatttatttaagtacatcaacaagggatatgatagagtgactgctgttttgattgatgaagataacggtcaaactgagaatggtggcactcataatgatgagatcaaagaatatctagattgcagatacatatgtccctgtgaatctacttggagaatctttggatttccaatacatggaaaaaaacctgctgttgaaagattacacttccatcttctaggccaacatagtgttctctacgaagaccatgatgatattcatgatgtattgtctaagccaagtatctttgattcaaagtttatttcatggatgaacaccaaccaaaattctgttgaagggagaaatcttacttatgcagaatttgtttctaagtttgtatacaatcagaagaaaagatgttggcaccttaggaagaaaggctataccattggcagattactatgggttccaccaattacaggggaattattttatttgagaatgatgcttactgtttgtaaaggacctacctcatttgaagatttgagaacagttgataatgttcagtattctacatataaagaagcat

SEQ ID NO: 62829 - DNA, 547 bp, Glycine max
  Peptide Sequence Number=SeqID_179607
atggcagatttagtctggataactaaagctcagaaaattagccgcaacaacaaatgtgagatgtgggataaagaaaaactaaaaagcctaattccagagctgcgaaaaaccacaaatgaacccgacattaaaaagtttatacctcatcttaaggaggttttggctactgctggcgtatcattggttgtacttccaacaccttctggatgtcgtgcgagtggtgcgacttgtttctttgaacctgaacgtgccactttaattgtaagctttagatatcttacagacgaccatttctggtttacttttttccacgaaataggtcatttagttcttcatgatgcggtaagcgttcgattagaaggcgatgtaaaactcacagcagtggaagaaaaagaagcagatcagtttgcgactaatacactaataccagaaatctttcagaaagaaattaaaaacttcggcgttaaaaactggaaagatatggttagagtttctagaaaaattggagtatctaaagggattgttcttggttacttacagcatatag

SEQ ID NO: 62830 - DNA, 339 bp, Glycine max
  Peptide Sequence Number=SeqID_179608
atgagttcgaggttgactgcaaccacaacgtgtgaaggcgtaagtagtgtgagtgctaccagggagtggacaatgtatgagcatgacaatcaaataatgccatggtggcacaaccaatgcagggaaaagaaggtctggaggtgcaacgcgaggaataagggtttgtttaggctaggttttgagttgcctgttatcggcacgatccatgggcttaacagactaatctgtgaatctaaacctgtatacccacccctacttaggggaagggttcatcaaagatggagacgtagtagggggggggggactaacatcaaggataaatgcatcatggaaatgtag

SEQ ID NO: 62831 - DNA, 897 bp, Glycine max
  Peptide Sequence Number=SeqID_179609
atggcggcgccgaggaatgtgacggcgacgagggacgaagagaagggcgaggaagacgattcgccctccgccaagaagcccaaatcggagaggttcccactgaacacgtgggaattcgccgtcgccgtcgccgtcttcttcgtgttctccaccggcctcttctgcgtttacctctccttgccctccgccgcttacaccaacctcaagctcccccgcacgctctccgatcttcgcctcctcaaggaacatctttcggcgtatgcgagtaaccaccctgcgcagttcattcttgggtactgctccacctacatcttcatgcagactttcatgattcctgggacaatcttcatgtccctcttggctggggcgcttttcggagttgtacgaggaatcttattggttgttttcaacgccactgcgggtgcatcttcatgtttctttttgtccaagttgattggaagacctttggtttcttggttgtggcctgaaaaactaaggttcttccaagctgagattgcaaagcgtagggataggttgctgaattacatgctttttctgaggataaccccgacattgccgaatctgttcatcaatttggcgtctcctattgttgatgttccctttcatatattcttttcggcgacattgattgggcttgttccagcctcttatattactgtcagatctgttgtagttgcctataggcttttgcaaggttgtgaagatcatgattttgcacctaggattgcaccattctactgtttctcttgtttctccatgctcgagccaatgcaggattgccacctgcattggactagaatcgatggggaaacttgcaaacccccagtgatttggagccccaaaaccgactgggtcagattttgccacccggtttga

SEQ ID NO: 62832 - DNA, 600 bp, Glycine max
  Peptide Sequence Number=SeqID_179610
atggccactgccactgtttcaatttcaacactatgcgctaccttcggaacccattgcgccatttcccacgaccctaaacctcttttttctcaacctttcagtctcaatcgctttccttctacctcttacaagctcactttatcgcctcgctcacctatttcaacccttcctaaggtctctgaatccgcggttgccgaaaccgaaaccggttcgtccgagcccgaaccggaccaaattgtcccggctcagcctccctcctgggaacccggtctcttcgctgtcgtaatgattggtggacgccaatatattgttcacccggggcgacatcttactgttcagaggttgaaaggtgctaatgttaatgataagattgccttacacaaggttttactggttggcactgatacatcttgctacattgggaaaccaattgtaacaaatgctgtagtatatgcaacagtggaagagcagggtctagaccccaaagtaattgtcttcaaatataaaaagaagaaacactatcgcagaaacattgggcacagacaggcctttggaaccataaatttgggaaccagatatctcattccatggcagtcatga

SEQ ID NO: 62833 - DNA, 1119 bp, Glycine max
  Peptide Sequence Number=SeqID_179611
gagagatcatcatcaattgacatggaatcatgtgtgcctccaggatttagatttcatcccacagaagacgagcttgtggggtattacctcaagaggaagataaactcgctaaaaatcgatctagatgttattgttgagattgatctctacaaaatggaaccatgggacatacaagataggtgcaagctaggatatgagcagcagaatgagtggtactttttcagccataaagacaagaagtatccaacagggacaagaactaacagggcaactgctgctggattctggaaagcaacgggaagagacaaggctgttatgtccaaaaatagaatcataggaatgaggaagaccttggtgttctacaaaggacgtgctcctaatggaaggaaaacagactggattatgcatgaatataggcatcaaacttctgaacatggccctccacaggcaagcactttgcctttgataaagctcaaagtggcaaacgcaaattacgacacgcttgtccttctttatactatctatgttaataataatacagagaacgaagaaggatgggttgtgtgccgagcatttcgaaagcctagtccaagtcacaggccaggctttgaccacccatggtgcagtactagtagtcaacaacaacactttttcagagaccaaattcaaagctattcatcaagacccttatcaattgctgacattttggatgaaacaaataatgtgcctcaccctaatgctgaaggtacaagttttagtcaccccttcagctcggatcatcagcaacacctgaataatcttctatcaaaccaaactgtggctattatggacaaacaactcattgagcttccacagctagatagtcccactgcaagtttggcaatcaaagaatgtaaccaacaacaacataatggcttaacaaatgaggaatattgcagtgatgaaaggagtaacaatagcaatgcacaagggatcgattggaagagcttggacaacttgtttgggtctcaattgagtgataatgcagcttatttttcacatccaaacttgcccttgatgatgccccataaccatgatcaagctagtcatatccttggatgcttccctgattcttcataa

SEQ ID NO: 62834 - DNA, 213 bp, Glycine max
  Peptide Sequence Number=SeqID_179612
atgtcgcaagccaagaaggaccaaaaagagaaggcggatacaatttgcaactcacatgtcatctccaagtatgcctccatgatcgttgttgagaaaaccatgtcaaaacctcactccctctctttgatcatcaagcagtctatagtttatagatataggaacctgaaacagcgaataatgattcacaacaacattcaatcttgtttccaatga

SEQ ID NO: 62835 - DNA, 321 bp, Glycine max
  Peptide Sequence Number=SeqID_179613
atggttagagattttggaattgaaactaagccagaacactacgcatggatggttgaccttcttgatcgagctggaaagttatctgaggctgtagattttatcaaatgtatgccttttaagccccatcctgccatttatggaacacttttaggtgcttgtaggatcaataaaaacttacagttggctgggtttgctgccaagtttctgcttgagcttgatccaactattgcaactggatatgttcaattggctaatgtttatgcagagcacaaaacagatgaccatctagctagtatccgaagatcaatgaaagaaaataat

SEQ ID NO: 62836 - DNA, 1008 bp, Glycine max
  Peptide Sequence Number=SeqID_179614
atgtacactagcttagagattcttgctgttggaggaaacagaaaaaaaagaatgtcttcaaagtgcaaaaatgtgatgccgcacgagactccgaacgtgaaggagcactacgtgattgggaacaaggtactaggaaaagggcacgtggcgacaacatacgtgtgcactcacaaggagacaaagaagaggtatgcatgcaaaacgatcccaaaggcgaagctgttgaagcaagaggactacgacgaagtgtggagggagattcaggtgatgcaccatttgtcggagcaccccaacgtggccagggtgcagggaagctacgaggacaaattcgccgtgcaccttgtcatggagatgtgccgtggcggcgagcttttctataggatcactcagaagggtcattacagcgagaaagaggctgccaagttgatgaagaccattgttggagtggtcgaggcttgtcactctcttggggtcatccatagggatctcaagcctgagaatttcttgtttgatagccattccgaaactgccaccatcaaggtcatcgatttcggattctctgtcttctacaagccaggacaaacgtttagtgatatagtaggaacttgctactacatggctcctgaggttttacgcaagcaaactggaccagaagtggacgtatggagtgctggtgttatcctatacatcttactgagagggcacccacctttctgggcaaaatccgaatcagcaattttccaagagattttacatggagagattgattttgtttctgatccgtggccaagtatatcagaaagtgctaaggatttgataaaaaaaatgttggataaggaccctgagaaaagaatctctgctcatgaagtcttatgtcacccttggattgttgatgatagtgttgcccctgacaaacctctggaccctgctgttttgacacgcctaaagcatttctcaacaatgaataaacttcagaagatggcattacgtaattgccggtttctatga

SEQ ID NO: 62837 - DNA, 579 bp, Glycine max
  Peptide Sequence Number=SeqID_179615
atgaaggatattgcttcgtggaacaccatgatttctggttatgcgcaagttggactcatggccgacactcggaggttgttcacggcaatgccggagaaaaactgcttctcgtggagtgccattgtgtctggatatgtggcttgtggggatttggattctgcttggagtgtttttatgctgcgcctggtagaattggcagaaagattgttccagcaaatgtcaatgaggacattggtgacatggaattctatcattgctgggtatgttgagaatgggagggcagaggatgggttaaggctattcaggacaatgtcagaaactggggttaagcctaatgctttgagcttgactagtgtcttgttgggttgtatgatacgatggatggcaggaacttcgttggttagtatgtattccaagtgtggggatctaaaggatgcctgggaattaattgttcggattccacagaaatatgttatgtgccggaatgcaatgatttctgggtatgctcaacacggggctggtaaaaaagctctttgtttgtttgatgagatgaaaaatcaaggcatgaaaccagattga

SEQ ID NO: 62838 - DNA, 372 bp, Glycine max
  Peptide Sequence Number=SeqID_179616
atgaagctggctggttatgttcctgatcttgaatttgtgttgcatgatgcgggagaggagctgaaagaacaacttcttttatggcatagtgagaagttggcaattgcatttggacttctaaaggtaccattaggggttccaatcagggtgttcaaaaacttgagagtttgtggagtttgccactctgcaaccaagtacatctcaaccatagaaggaagagaaatcacagttagagataccacgaggtttcatcatatttcaaggatgggttctgctcctgcagggattactgagcaatgctggcatgctcttcaccttgaagttgatttgatttcatcatactgtgctagagattcagaaaagtgcgcttaa

SEQ ID NO: 62839 - DNA, 177 bp, Glycine max
  Peptide Sequence Number=SeqID_179617
atgattgaaattatattggatacctttctcactcaggatgggaggattgattattcggagtttgcagcaatgatgaaaaaaggtgatccaaatatgggtagaagcagaaccatgaaaggcaatttgaacttcaatattgcagatgcatttggaatgaaagacaaagactcttcttga

SEQ ID NO: 62840 - DNA, 474 bp, Glycine max
  Peptide Sequence Number=SeqID_179618
atgtggatgcatgtgcattggggttggaagaacatgcccaaagcaacaagcaacacacttagatgtcttaagttcgagggaaagagaatttggtggtctcagaagccttctcttgtttccctttctttgaaagatctgattcagggaactgaagaaaacagaacatcttcatcatatgggtgtttgcggagcaaagccttggcagcacaagccaagaaggtgaagggtacaaagagaagtgttaggaggccaaggaggattttgatgatgaagagaagaagtggttctagaagaggatccaacaatgggattagaagacgtgtgagaaaattgaagagccttgtgccaaatagtgactctttggagttggatggactcttcagagatactgctgattacatattgtctctacaaacgagagtgagagtcatgcaggttatggtgaaggtattgacaggctctgacgacgagtga

SEQ ID NO: 62841 - DNA, 1386 bp, Glycine max
  Peptide Sequence Number=SeqID_179619
atgcagaagcatggttttgcatcaaagcgtaacgtgttgccgtatcaaacgccgaggctaagggaccactacgttctggggaagaagctgggacaggggcaattcggtacgacgtacctgtgcacccacaaggttacagggaagctctacgcgtgcaaatcgatcccgaagaggaagcttctatgccaggaggattacgatgacgtgtggagggagattcagatcatgcaccatttgtcggagcatcccaacgttgtccagatacaaggcacgtacgaggattccgtgttcgtgcaccttgtcatggagctctgtgcagggggagagcttttcgacaggatcattcagaagggtcattacagcgagaaagaggccgccaagttgataaagaccattgttggggtggtggaggcttgccactctcttggggtcatgcatagggatctcaagcctgagaatttcttgtttgatacccctggtgaagatgcacagatgaaggccaccgattttggcctctctgtcttccacaagccaggacaagcctttcatgatgtagtgggaagtccctactatgttgcccctgaggtgttgtgcaagcaatatggaccagaagtggatgtatggagtgctggtgttatcctatacatcttactgagcggggttccacctttctgggctgttactcatctagttatcttctttgtgcttgagttgcattcacttttcctattaccttcagaaaccgaagcaggaattttcagacagattttaaatggagatcttgatttcgtttctgaaccgtggccaagtatctcagaaaatgctaaagaattggtaaaaaagatgttggatagggaccctaagaaaagaatttctgctcatgaagttttatgtaacccttggattgttgatgatattgcgcccgacaaacctctggactctgctgttttgacacgcctaaagcttttctcagcaatgaataagcttaagaagatggcattacggctgactgcgtatatgcaaatgtttgcaaaagtcatagcagaaagactttcagaggaagaaataggtggattgaaagagttgtttaaaatgattgacacagataatagtgggacaataacttttgaggaactcaaggcgggtttgaaaagtgtgggctctaatctcatggaatctgaaattaaatcccttatggaagcggctgatatagacaacaatggatcaatagactatggtgaatttcttgctgctacactgcacttgaataagatggaaagagaggagaatttggttgctgcttttgcctatttcgatccacatggtagtggctacatcaccattgacgagcttcaacaggcttgtaaggacttcagcctaggtcat

SEQ ID NO: 62842 - DNA, 264 bp, Glycine max
  Peptide Sequence Number=SeqID_179620
atgtcggctccaattgcttcaacagttctcggctatatcggcgaaattttcctcgctcgtcgtactcctctagagttaacaagaattccaaagcaggacatggctcttctagtccgagatacaaatgagtatcttcatagtatcgaagctcggcacgagatgtgtatccccatgggatatagcaagctaggtcatacccgctctttctgcgagctatgccaagcccacaggcgcctcactgcacttggcatcgttagtacctga

SEQ ID NO: 62843 - DNA, 393 bp, Glycine max
  Peptide Sequence Number=SeqID_179621
atggttgtgcgtgatgctaccaaaagcctccaaaacttacagattgaagcagtgatgagtgtgccacctttaaaggccattggtggatgctaccaaatagttctttactatgagaagtttttggcgggttggattgtagagtcactggcagtgccttggtggaacaaccacttcttgcagggaggctccagtaaggacattggcaacaagggattattggagattgtgtccattgattcccgcattcgactctacgaggcacggtttccgatggtcttgttagagtttcttgccttgttgagtgaaagaaacatcttgaggctgagcttgtcttctggaaggaaattgatgagcacaatcctgagttctctcctctcttctatgttcaggtaa

SEQ ID NO: 62844 - DNA, 186 bp, Glycine max
  Peptide Sequence Number=SeqID_179622
atggtggtctcttcctccttgagtgtctcgtgcaaatggagaagaatgaaggtccaagttttgatttttggagagaaaatgtattacaacgttgggcttgacaataaaggattaggagagagggaaccgagggaggaggatagagtcaaggggaaagggagctttgagtgctatgagaggatgtga

SEQ ID NO: 62845 - DNA, 552 bp, Glycine max
  Peptide Sequence Number=SeqID_179623
atggatcaaatcaattcgatgcttcggtccttaaggaatgaggcaacaaagtcagaggatatgtttatgcaacttcaagaaattcaagaatctgtcagacttgcatttttaaattgcttcctggattttgctggtagtttagagcgtattggatttgaacttggccaacatagatcagacgaagagggctcccagttaccaaatggatatacacatgaattggaaaatgcaccttctggtcttcgtggaggtgttattgatccccatcaacagttattgattgttctaagcaatattggatattgcaaaaatgaactttcttgtgagttgtatgacaaatatagacacatctggcagcattccagggggaaggatgaagggaacagtgatttagaatatcttgtgaatagtttctcagcgcttgaagcgaaggtccttgaacaatatacttttgcaaaggtaatgagaaaaatattgttcctgtccttcaagaaaataactgggtgggaagcagatgaatatagaggctgtaatcagagttgtaacttataa

SEQ ID NO: 62846 - DNA, 159 bp, Glycine max
  Peptide Sequence Number=SeqID_179624
atggctgaacccgccattgccactggcggcaaagctggagaaaggggtgtatcgtcactgggtgctggcgaggcagccatgcttcacgtgaagttcagcttttcaggcttgcaggcttctgctctccattgtttagggatgcagcatagcattgtttag

SEQ ID NO: 62847 - DNA, 681 bp, Glycine max
  Peptide Sequence Number=SeqID_179625
gcggaatttgaaatccctgaagcttctgacagtaggacaaagaagaaaattcttaagactgtcggtgagcggtggaggcagtttaaatctgacttgaccaggaaatgggcacttgcagccgacaaggatggtgcggacgacactgtctgtgaaaaatatggcattagcaaggagaaatgggcccagttttgtcagacccgcagagacccctcgtgggaggatgtgcggaaaaaagcacaggccatccagaagcaaaacactgccccccacgtgttgtctcatggcccggattctttggtggaacaggcatcacagggatcgttcgtcccacatggacgtcaggatgtcctgactgttgctattgggcgaccaaagcatcctggtcgtgtctatgctgctggagccggtgtcaccataaagcaatatttcggatcggctccgcgaacatcacgcagttcttcctccatgcttcctgaagacctacaacagctgacccaacaaatcagggaccagctggaggagtcgatcacagaaaaaagtgactcgacaggtgatggcatccttcagccagatgtagtcccagtttcagtctcagatgcaatcacagggacttacactacctccggagccagaggttggtccctcaggtgctcgtgtcaacataaaggagagttgtgttga

SEQ ID NO: 62848 - DNA, 252 bp, Glycine max
  Peptide Sequence Number=SeqID_179626
atggatggtagtggggatgatgatccgagggaaccccctttgattaagctcaagaccttctttcgtttcttctcaaaacctagaatggagatgtttttgaacaacgaaattcaaagaaatcgccatattgagaaatcacaggtttggctaaggctaagagttcaaacatgtaaagctggagaatttgctaagcaacagtttgtggctatgtcaaattttagggagagtggaattctgaagaaaattgagtaa

SEQ ID NO: 62849 - DNA, 798 bp, Glycine max
  Peptide Sequence Number=SeqID_179627
atggttgttgagatttgctcagaaaattgtggggtgtcaatgagtccaaggatttcattctctcatgacttctcccaatcagatgtcatcccagttgagaagcaccctttgagatcaaactcatctggcttgaactcaagcattgattttgatttctgtgttcatgaaagcttagagcttgagtcctcttcagcagatgagcttttctcacatggggttctccttcccacacaaatcaagaacaataacatcaacaacaatgctattttgaagccaaaaagccaactagcaccgccaccacctcaacctcaacctcaattaccacctcccccaaaagctatttgtgacaatgcttcttccaccaccagaaaaagctcaaagaaagagagtcacaaagttggcaaggagttgaatgatgaagtggatgagaagcaaagttccaagtcattttggaggttcaagagaagtagtagttgtggaagtggatatgggagtagcttgtgtcctttgccacttttatctagaagcaactcaactgggtcttcaccaagtgttaaaaggataccactttcaaaagaggttaagcaaaattctcagaaacgttcttcttccagcacaaggttttctcagtctcaccacttggcttcacacaatcatcaaaagcctccattaaagaggagtcatgggtcttatgctaataatggtgttagagttagtcctgttctcaatgttccttctgcaaacctttttggtttaggctcaatcttctccaacaatagagataagagcaagaagtaa

SEQ ID NO: 62850 - DNA, 468 bp, Glycine max
  Peptide Sequence Number=SeqID_179628
atgtcgtacaggatgtcacgacatcacgcttcagaacatgcagattgtatgtgtccgtatgaacagattaaacaagtaaataacacaagagaattgttaacccagttcggtgcacctcacctacatctgggggctaccaagccagggaggaaatccactctcaatagtgttagttcaaggtctaacaacccctgtttacaaccttctcacctaaccactacccatataacagatttatatgtccagtattatcgggccagatgtcagaacatcgtatccgacatcttggatcctgcagcttcaatgcttcacttgacttttatcttgcattgtacagcaactccagtattctcgagcaggatgtcaggacattgtatccgacatcgtggatccttcaacttcaattcatcacttgacactttatcttgccttgtgcattatgcagcccgatcttattccttgacataa

SEQ ID NO: 62851 - DNA, 294 bp, Glycine max
  Peptide Sequence Number=SeqID_179629
atgtgcagaacacagcgtattaaagagcaagagtcttgtcagatcctgttcgaatcgaaaagaaagaagagtttattgaaagggattcacgggatcaaagaagtatttatgaagtataaggctaagacaagaaagagggcttcgaaccattgggcgattcgaactggtgtatggtcgagtcgaagtcaaggcagcaagatttctggacttagcacaatttctgacaaaacttcacaaaaatcagttcgacttcgagcaatgtggataaccgttctaaggagcagttatgtgcat

SEQ ID NO: 62852 - DNA, 264 bp, Glycine max
  Peptide Sequence Number=SeqID_179630
atgctgcctgatgtgaacatagatcaaatgatgaagggaaagaacagggttccagccttacatatacaacaacaacaacaacaacaacaaagccttatcccactagatgtgaaaagaggccaaatcagtaagattcctaaattaatggtttcaataacttcaaaaaaagaacagccagaatggctgcattttactgctatagtagctcagcagaatcatggctgcgacagaaaggcactccatggtggaagtctctgtcactaa

SEQ ID NO: 62853 - DNA, 693 bp, Glycine max
  Peptide Sequence Number=SeqID_179631
atggctgacacaaacacaaacagtaacatgtcattgccacaaactcatcaaccaaacctcactattgagcctctcttgcatgcccttgaccccatatcaatgatccttaaccagaattccaattcagacaaccctttccctctgaggctcacctctgcagacagcttcatcttggagagaggaccaaactacactgcatatgctgaactgagagaatcaaggttgcacatgaggtgtttgatgcaagagcaacaacaacaacaacaaaaggctcatgaattggaaccaagggcaaaacctgcaaccccaccaaggaagaaacaggtcaagtttcaagcttgtgggggacactcaaaagggtccttttccattgctcagtctgtgccggatttctcttccgcgttaaggaaagagaataagaaaccagtgaacaacttgccttcaatgacaccaccaagcaagagtggaaatggggtggtgttgagttcaagagggagcaagtcagtgagtggaggggagaagaagaagggtggtggtggtggtgtgatggcaaggaagagctatgcttgcattgatgagcttaagagtttttcttctgctactgccattgccatcaatggtgaaggtagaggaggaggaaggagtaacaaggtgatggggagaacaatttccgggcaccacagacagttttga

SEQ ID NO: 62854 - DNA, 99 bp, Glycine max
  Peptide Sequence Number=SeqID_179632
atggagaattggcgaacagcgctacgcaataacttcgcggggctccacactcgaagactcgttggtggaggaggatgcatgaacagcgctaggcattaa

SEQ ID NO: 62855 - DNA, 201 bp, Glycine max
  Peptide Sequence Number=SeqID_179633
atggtggtgtttccaatgccctctagggttcctcctccgattgctctattagggttttgtttgaagctgacgacgacaacgatcatggcagcagtggtagtgacaactgatgacaatggtggtggcaacgacaatcatggtgggggttgcaatggtagtcatggtggtggtagcgacgttgacgaaggtgatggcggttga

SEQ ID NO: 62856 - DNA, 372 bp, Glycine max
  Peptide Sequence Number=SeqID_179634
atggcatgcatggatattggtttgaatgcgagtcaaataatgtcattgaaatgctcagaattgtatcttgctcaattccgatatacttcacttgatcttttggcgagtggagatggtaaaaagaaagctaccattgttggtgatgtatatattcatccatctgccaaagttcatccatctgcaaagcttggtcccaatgtttctatctcagcaaatgttcgtgtaggtgctggtgtcaggttaagcagttgtatcatcttggatgatgttgaaattaaggaaaatgcttttgtcacaaactcaattattggatggaagtcatcacttggaagatggtcacatgtgcaggcaagttcagtgcattttttataa

SEQ ID NO: 62857 - DNA, 207 bp, Glycine max
  Peptide Sequence Number=SeqID_179635
atgggtctcagaatcataaacatgggaagattcgggcgcagagtagttttcctctgcacttctgttgttcttggttactccaccgccactttcaagatctcttcttgccataatttctgtcactggaggttcagtttttgtgctttgggaagtagagatgataagtggctggggactccgcaaatgggggatagataccacgagtag

SEQ ID NO: 62858 - DNA, 540 bp, Glycine max
  Peptide Sequence Number=SeqID_179636
atggatagtaaatggtcagaggttgaagttgtatcaagtcgcactaagcgtatcatgttattttctgagggcgcactaagcagatggcctctagaaaaaggaaagcaaccgtttccagacctcaggagccctatgatacgaccagattcatttctgagggcgcttgggaatgatatgagcagaacgttcactcccggaaccttcttccggagaggaacgcagcctgatgatcgcattgacatggcctgggtcaaggaattttatgccaatttatatgacccagaggaaaaatcaccctggcaggttagggtgagaggaaggttgattaaatttgatggggagatgctgaatgccttcttggagacccccgtggttttggagccaggggagcaatacaccacctactccaggttctgccacactcattcagaccctcaggagcttgcttccaagctctgcatttcagggcgcagttttgttctaaacgctgaaggagcaccctggaagctcctgaggaaggacctcaccactctggtgtag

SEQ ID NO: 62859 - DNA, 721 bp, Glycine max
  Peptide Sequence Number=SeqID_179637
atgacggctttgggatcgtgtcgcgacattgttggggtcatctctgatgttgttaggatatcctcgatggcgacatggttgtccgtggtgatgaagatctgtgctttggctatggaaaattcagagaaggtggtcgctgtgatcatggtgggtggacccacaaaagggaccagatttcgacctctttccttcaatattcccaaaccgcttttccctttggctggccagccaatggttcaccatcctatttctgcttgtaaaaagatacccaatttggctcaaatatttcttcttggattctatgaggagcgagaatttgctctatatgtctcttcaatctcaaatgagctgaaattaccagaggataaaccgcatggttcagcaggcggcctttactactttagagatattatcatggaagactgcccatcacatatctttctgttaaattgtgatgtttgctgcagctttccactaccatcaatgcttgatgcccataaaagatatggcgggatggggacaatgttggtaatcaaggtttcagctgaatctgctaaccagtttggggagttggtttctgatccaaccactaatgagttgctgcattatactgagaaacctgagacatttgtcagtgatttgataaactgcggtgtctatgttttcacccctgatatttttactgccatccacgatgtgtatattaatcaagaaggcagag

SEQ ID NO: 62860 - DNA, 2010 bp, Glycine max
  Peptide Sequence Number=SeqID_179638
atgccatcaccaacaccaataccaacggcagtgtttggtggtgtagaaactcctaatggagactcttctaacaccaagcctcatcccaaacaagaatcgcgtgacctctctccttttttgtcttgctcttaccccatcactcttaagttcattgacgtggcataccgattgaagatagaggacaaacaaaaaaacggaggcagcatcaagagattttttactccgcacgaatcatcaccgtcagatcaaggatcaagggcgggagcgtcgcaggagcgaactattttaaagggagtaacggggatagcacatccaggggagatcttagcggtgctgggcccatcggggagcggaaaatcaacgctccttaacgcgctcgcagggagactccacggacacggtctcaccggaacaatcctcgcaaactcgagcaaactcaccaaaccggttctccggcgaaccggtttcgtcacacaggacgatattctctaccctcacttgacggttcgcgagacgctcgtgttctgcgccatgctacggctcccgcgcacgctgccgcgcgcggcgaagatcgcagttgcggaggcggcgatcgcggagctagggctggggaagtgcgaggacaccataatcggaaacagcttcatccgcggagtctccggcggggagaggaagcgcgtgagcatcgcgcacgagatgctggtggacccttcgctcctaatactggacgagcctacctccggcttggactctacggcggcgcaccgcctcgtggtgacgctgggttcgctggcgaagaagggcaaaacggtaattacatcggtgcaccagccatcgagccgcgtctaccagatgttcgataaagttctggtgctatcggagggacagtgtttgtacttcggcaaaggaagcgacgccatgcgctactttcagtcggttgggttcgcgccgtcttttccgatgaatccggcagattttctgctcgatctcgctaacggtgtttgccatgtcgatggtcaaagcgaaaaagatagaccaaacataaagcaaaacctaatccattcatacaacacaatattgggtcccaaggtaacagctgcctgcatggacagtactaatgttccttcaagaaacacacaccctttgagaagcaactcttcaaaagaatttagacgtaacgacagggttagcttctttgattggttttaccaattcagaattcttctccagagaagcctcaaggaaagaaaacacgaatccttcaacactctgagagtctgtcaagttattgctgcagcactgttagctggtttaatgtggtggcactcagactacaggaacattcaagataggcttggcctactcttcttcatttccatcttctggggagtcttcccgtctttcaactcggttttcgcattccctcaagaacgtgccatcttcatgaaagagcgagcttctggtatgtacacactgtcctcctatttcatggctcgaattgttggagatctgccaatggagcttattcttcccacgattttcctcattgtgacatattggatgggtggattaaagcctgatttgtgggcttttctcttgactttgttggttgtgcttggatatgtgatggtgtcacaaggtcttggccttgctttaggggcagcaataatggatgccaaacaggcttccacagtggcagcagtgacaatgctagcatttgtgttgacaggtggatactatgtccataaggtgccatcttgcatggcttggatcaaatatatatccacaaccttctactgttataggctgctgactagaatccagtatgaggatggcaagaagatatcatatctattgggttgctatcaacgtgataagggtggttgcagctttgttgaagaggatgtggtggggcaaattggcaccctaggatgcattggggtgttgcttttcatgtttgtgttctacagattattggcctaccttgccttgagacgcatcaagagttga

SEQ ID NO: 62861 - DNA, 1329 bp, Glycine max
  Peptide Sequence Number=SeqID_179639
atgtacgtggcggggcacttaggagataccctcgaccttcgcttgttcctggcaaccggaatggtcggtagcgggatattcgtatcactcttcggaatgggatacttctggaacatacactcttttttgttctacctttcaatgcaaatgattgctggcatgtttcaggccacggggtggccttcggttgtggcggttatcggtaactggttcgggaagaggaagagagggctcataatgggggtgtggaacgcgcatacctcggtgggtaacattagtggttcccttcttgcggcgagtgttttggaatatgggtggggttggtcttttgtggtgcctggtgctttgattgttggtggtggtgtggttgtgtatttgtttctggctccttatcctgaggatgtagggttctcttgtgttcatggtggtggtgatgaagaggctcaggtgaatgatgagaaaggtggtggtgttcctactagagaagggtccgtgaatagaaaaagcgttgggcttgttgaggcgtgcatgattcctggtgttataccttttgcgctgtgccttttcttcgccaagcttgttgcctacacgttcttgtattggttacccttttacttgactcagacagatgtaaattgcatgggtcataaatctttacatcttaattttgcagaaattggtgggaagtatatctcggttaagtctgctggaaacctttcaaccttgttcgatgtagggggcattgttgggggtattcttgctggctacgtatctgataaactcaatgcccgtgctataactgcagccagcttcatgtatgcagcaattccttctatgcttttataccggcattatggaagtgtttctatgaatgccaacattggacttatgatggtgactggattatttgtaaatggaccttatgcacttatcaccacggctgtctctgctgacttgggtacacatagttctctcaaaggagattctcgtgctctagctacagtgactgccattatagatggtactggatctgttggtgcagctcttggccctcttctcactgggttcatttcaacaaggggatggaatgaagttttcatgatgctagttcttggtgcttttattgcggggcttcttttgtcgcgtttgatcatagcagaaattgcagagagaagtggcaaacctttatcaagtggacagcaaaatcctgaagccactgcatctcaaccgcttctggaggaggatagactctggaaggttccaaaggggatcagaactcacaactggggatggaactcgattccttttcatcgtgaattgattttctga

SEQ ID NO: 62862 - DNA, 186 bp, Glycine max
  Peptide Sequence Number=SeqID_179640
atgaaaagaagaatcagggattgtcaccaaagacgattgacaagagtgactacaacggtagtcatagtggtgatagtgacgatgacaaagatcatggacgtggtggtggttgatgttggtggcgatgatagtggctacaatgatggtgatggtggtggtagcgacaatcatgacaatgatgcttag

SEQ ID NO: 62863 - DNA, 174 bp, Glycine max
  Peptide Sequence Number=SeqID_179641
atggtgatggctacggtaaagtctcttagaaaatgcatcattgacttgttcattaaaagggattatgttacgctcctttctcctcctcgggtggtttttcagatctgcatcgtcaatctccgtctgcttccagatcgatgggctttgatggcactgcatatcaaagctgattga

SEQ ID NO: 62864 - DNA, 351 bp, Glycine max
  Peptide Sequence Number=SeqID_179642
atgcttgccaaaagtcttaacaaagagggaggcaacagaggaagtggtggtggaggggagaatggagtgagggttggaagtgaggaggaagcaggaaggaaagagatgtggagtgagatggagacaagaaagaatttacttgataatggttatcatcatcaaaagggggagaatttttggcctcaaacaaattattttaaacaactcaaggcactgttattgaggtcacttgtccaacacgagagacgaggaagagaagagagtggagagggaattatggttagggttaaggttgaagaggaaggggccgagagggagaaaatgggaacgagagaggagagaaagagttaa

SEQ ID NO: 62865 - DNA, 963 bp, Glycine max
  Peptide Sequence Number=SeqID_179643
atgcctcccgtaccaatttcccccatcaaagttgggcacattcctgatgtccaagagaaagacgaagtcctcactacacctctttccccacaacatagtgacatggcagtcattgatttctctaagcttagcaaagggaacaaagacgaagtcctcactgaacttttcaatgttgtaactggttgtgaagagtggggaatttttcagctaaatatttatataagcattgagaacctgagcagggagtttttcatgctacctttggaagagaaacaaaaataccctatggctccaggaacagtccaagggtatggagaagcttttgttctcttagaggatgaaaaactggacaggtgcaacatgtttgctcttggaattgaacctgaatatgttacgaacccaaatctatggccaaacaaaccagaaaaattcagcacgaagcgtggttccttaggtggtttagtgttgttctcgaatcaaagttggagttttacttcaaaaacatatgctaaccttaaatctttaggccttggtttgaaaggggatgagtttgagaagatgtttggcgaatcggtgcaagccatgaggatgaactattaccctccatgttcaagacctgaccttgttttggtgtgtgcgtggttcaattctaataatgctgcacctgcaggaagtctggacaatacggttgaaaatgattttcagaatcatcattcacaaaataaagtgactgggttagactcgcacaaggcctccgaagatgtacccgtgggagtagctttacaacatgccgcaaacggacaatggactagaactgaaactgaaagaagcaatatcattgtcaagaatgccaacaaaaggattcaacttgtagacaattgcttgattgctgaccaaccacaacgacatcgaagacacaatgaagaccccgtggatactctagacaaggaaagggatgaataa

SEQ ID NO: 62866 - DNA, 324 bp, Glycine max
  Peptide Sequence Number=SeqID_179644
atgctcggattaacgtgtagcaggctagctatcattcttataactcttctctcagcacgcatgcttgcattggattcaccttttggggtgctctctgatgaggacccaattcctatggagtctttaacatcaagcaataaggtaatcagaactggggcaacacatagtaatcttggtggcccatcttgtttttggtctaaacacactatcctccacccagttcaaaataatgagaatatgtactggttgaaatttggagcaatgatagagttgtggcagatgaagagggttatggagaagaagaaaagaaaaacattatcatga

SEQ ID NO: 62867 - DNA, 342 bp, Glycine max
  Peptide Sequence Number=SeqID_179645
atggagtggttacgagaaacagatggggtctgtgaagctgcccgggcaatttgtattgccgaagaggaagctagggatgatctcgcagaaggtaaggcagaggatgccatagatgctgtccgggcaatttgtatggctgaagatgaagctagcgatgatcttgcagaagataagacagacgatgccatagatgctggggttgatgagagcaagggtgtggattctgaaggtggtggatcagttaagccggatctagcatcacgcttgcaaactggacaaaaggttctccatgaagcagaagagattaatcttgttaagcaacaaaacatcaatagcatgtaa

SEQ ID NO: 62868 - DNA, 153 bp, Glycine max
  Peptide Sequence Number=SeqID_179646
atgggtggattttttggtactttttcatctctatctgccaccaagctaggctctatagctattgaagctgctcttaaaaaatataggaaaaggatattaaacatgttctgcttattgcagttgcaatgcttattgcacagagtattcaattaa

SEQ ID NO: 62869 - DNA, 732 bp, Glycine max
  Peptide Sequence Number=SeqID_179647
atggcggcttccaaggtggttcttattgggaataatatcactctctccttcgatgatattgaagctaattttgccccaacagtcaaaggttctggagaatatgggatcttatatttggcagaaccactggatgcatgtacagaattgacaaataaagttgaacaacttcccaatgcgagttcaccttttgctttggtggttagagggggatgtagctttgaggaaaaagtcagaagggcacaaaaggctggcttcaaagctgtaattgtctatgacaatgaagatggtggcatcttggttgcgagaaattctgctggtataaaaatacacgctgtatttgtatctaaagcttcaggtgaaatactaagcaaatatgctgggttgactaatgtggaaatatggctcattccaacttttgaaaactcagcgtggcatcgcataagaagagaaaggcctcgagctcctcttgttcgtgaatttcatggtatgagtagtcgcctagtgaaagcaatgccaagtttgatatttactgctgttttggaagataactgtacatcaagaacatgtgctatatgccttgaagactattgtgttggtgagaagctcaggattctgccctgctgtcacagcctcaagcaggatatctctttgcttggaggcttacacttatattcgagcttctcccacccttctgttcctctagaaactatggtgaagtatttagttgtttga

SEQ ID NO: 62870 - DNA, 228 bp, Glycine max
  Peptide Sequence Number=SeqID_179648
atggatggaaagcatagcacatgggaagcttccttgagaagtaaggaaggtaacttccttgggaagctagaggaagaaagcttccttgagaagctagagggggctactcacatccctccaatagctaagctcacccccatgccaaaatacatgaaaatacaatgggaagcttccttgagaagcaatgaaggtagcttccttgggaagcaaggaagaaagcttctttga

SEQ ID NO: 62871 - DNA, 531 bp, Glycine max
  Peptide Sequence Number=SeqID_179649
atgtctttactacatttaaatttctacaagactcgccatcattcccaatcaaaaaatgtgatttcgaaaacaaaactagcacacccgtgtacattagaaggaaaaacctacctgaacaggaggcgtggaagattcaaacaacaaagcatcaggcttgtcagcgagaacgggcgatttggtccacaagcagctcaagccacaagagcaagagtacaagttatccaagttatcgggaatccaacgagagcaccccacttgcgagtcccattgcctgaaggccgcgaccagattggagaagggttcggccttggacggcgtggttgtgatggggcgcgtgatgggagggaaagaggaggaggggaagtggaggaagccggagaagaagaggaggaagaaggcgaaggtgagcatgattgtgatggtgaaggtgtttatgggtttgggaggcactggcatggtggagaggaagaaaatgggggggttctatccctctcttggagtcagagaggacatggaatgggaatggactga

SEQ ID NO: 62872 - DNA, 1302 bp, Glycine max
  Peptide Sequence Number=SeqID_179650
atgaggatgaagagggttttcgttgtttacagtgttttgttgctgctggtccagttttggcttggtgaggctgagacattctcggtggatggaaaggttttggttttggacgaatccaacttcgattccgccatagcctccttcgatcacatcttggttgacttttacgctccctggtgtggccactgcaagcgtctctctcccgagttagatgcagccgcccctgtacttgcaaccttgaaggaacccataatcatagcaaaagtagatgcagacaagcatacccgccttgcgaaaaaatatgatgttgatgcatatccgaccattttgctgtttaatcatggcgtccccacagaataccgtggaccaaggaaggcagatttacttgttcgttatctgaagaaattttctgcttctgatgtttccattctggattcagattctgctgtgaatatgttcgttgaagaagcaggcacttttttcccgatttatataggttttggtttgaacagttcggtactagaaaagtttggcataaagtacaagaaaaatgcatggttttctgtggcaaaggatttttcagaggatctcatggtattgcatgactttgataagattcctgccttggtttccctgaatccacagtacaatgagcggaacacattctatggaccctttgaagaggattttttagaagattttgtaagacaaaacctgattcctttggctgtgcctgtatcctatgaaacactcaagttgatgaaagcagatggaaggaaaatagttttgacaattgttgaggatgaagatgaagaaacaacaagagagctgattaagttattgaaggctgcggcatctgcaaatcgtgacttaatatttggttacgttggagttaaacagatggaagaatttgctgaaaattttgatattgatactaaactaccaaaaatggtcatttgggataaaagtgatgattacctttcagttgttgattcagaaaccatagagggggaggaccaaggaactcaaatcactaaatttctcgaaggatacagggaaggaagaaccataaagaaaacatttagtggcccttcactaatgcgattcatccatcgatcctttgacattagaatggtgtacatcattgtttttgtggtggcagtactgatgctaattcagacattcagtaaaggaggtgatgaataccagagtgtacccaatcaagttcaaactgatcatgcaatcagttctgtttctgaagctgaaaacaatgagtataaacctggtgacaaggaagactaa

SEQ ID NO: 62873 - DNA, 387 bp, Glycine max
  Peptide Sequence Number=SeqID_179651
atggatttaaaagggtgggtggtggtgagggtgaagatgaagttggtgggtgacaaagaaagagggataaagtctctatccacctacaatgcatgccacgacatgagctccttggaagaccaatcgcatgaccaaccaggcaacctgttcgatgagacgatgaacaagacttccattaaaggtgagattggaggtgtctctgtagggatgtttgagcgtgggcgaggaagtggtcaagggaggccacgaatgaggtgcaaagagaagaaagagaattggaacaagaggagagagaaagtgaggaggaagaggaaaagggtcattcgcaaattgaatctctgccctccacgtcagttctgcataggagtgcgtgcgcttgacccttag

SEQ ID NO: 62874 - DNA, 750 bp, Glycine max
  Peptide Sequence Number=SeqID_179652
atgagtcatcgttcatctagtgttaatggtgaggatactagtcataaggaccctctatctagaatattatatgagttaagttccctcaagttagggaaagaaaaactagaaagaaaagaaaaagaaaaagagagggtagaaataagtcaagatgagagggaacaaataagggaagaagaaagaaggaaaatactaaaagagttaagaaaagaaaaatatgcctcctatagtactcatgactcttgcaagagcctaagtgaagaacttcgtggctattatgaaggaaggcataggtcacatcttagacctcactcccataggagagaaaaggaaagaaagcctcaagaggctaacattaacctcccatacttccatgggaaggacaatgtagaggcttatttagattgggaaatgaaggttgagaaactctttgcttggcatcatacaagtgaggaaaggaaggatcctttggctactcttagcttccaagggtatgccctctattggtggatttcccttccaaggattgtcaccaaacatgagtgtcaaagcaaaatatacaccaaactgattcacatggagacattcactcgtctgaaggccgcaccctactcacagacgttgccggtcgtgatcttgctctcggtgaccactttctgcggcagcgaggagtttacgaaagctgttggtatcgaagacgaggcatattccatttctcttattgatcgaggccgtacccgaatcaaataa

SEQ ID NO: 62875 - DNA, 267 bp, Glycine max
  Peptide Sequence Number=SeqID_179653
atggaaacgcaaacgacatcgagggagaagagtgcatacctcgacaattttgacacgctgaagaagaagaagaagaacaaagcaacgggccaagaagcggaggagaaaacgacgctgcagaacagagctgggtggaagaagaaaaccaagaaggaagaaggaagaaggtcgcagaacaagaagaagaagcgcggaagaagaaaagcctcgtgggtgggagctacgacggtggatagtggtggctcaacgatggacaaaggtgactag

SEQ ID NO: 62876 - DNA, 384 bp, Glycine max
  Peptide Sequence Number=SeqID_179654
ggagttcttgataagcgttatgaagtgcagggccaaaggatcccttatgacagagatacgatcaaccaatttttagggaatccattactcttggaagaaggacaacaatgtgaatacacttcaaggagagacataactataggttttgatgatgaggcaataggtgtagcaactagagcagtttcagtagcctcagctagcagcagatgctccaccaccaccacaacaacaaccatcattggagtccatcttagcacacctacagaggatggaactccaaagcaatttagagctactgttgtatggcttggagacaagcctatttttcatgaggaggtaggtcatgcagatgaccaaagggctgcacatgaccaaggaggatga

SEQ ID NO: 62877 - DNA, 882 bp, Glycine max
  Peptide Sequence Number=SeqID_179655
atgaacccaagacaactcctcctcctcctcctcttcttcttcttttctctcttagagcccacaatcactttctccttagacgaaagattcgaagcctgcgtgcccaagacatgtgggaatgggcagaacataagctacccgttttacatccaaggcaagcaaaaacccttttgcgggcagccaggcttcgagctaacgtgcggtcacaacggcttcccaattctgactctcatgtacaccccatacacaatccaccaaattttctaccacaacaactccctccgactctccaaccccatcttttcacaaccaaacgcttcttcttgtattggccccactcaaaacctcacggtcggaaggtacatattccgactggctccaaaccagagggatctgttcgtcctatacggctgcgacccagcggtgcttcccgaaagggtgcgggagcggatgatcgggtgttctgcggcggggaacgaaaccacgttggttgtcggtttggataaggatgatctggatttggttacggcgcgggagagttgtaacggcggtgcggtgaatgcgacggtggaagatttgaaaggaggggttcgagaggcgctgtggagagggtttatgttgatttggaatgcgactagctgcagggagtgcgagaacagtgaagggaggtgcggcttcgacctcgaccctctcgtctatgcttttcggtgttactgtcctgataggcctcatgttgtgaaatgtaatccagtggtgaaaataacgagaattactaaggttatatttggagtgaccttcattatgcggtattgcacattcccacacgaatccaaccaattttacaaaagacatcttgagatccttttggaaacctggttttga

SEQ ID NO: 62878 - DNA, 543 bp, Glycine max
  Peptide Sequence Number=SeqID_179656
atggattgttatcctactgacagaataatacttcaaaatgatgatgacagtcaaattcgcacagatatttatgtttcaaatcctgcgttccaaaaggtggaagatctagtggatgacaatctcgctttagaacaatacttggaggactacaatgcccaattaatggaagagttattacacaaaatgcaatatccttattatccttattatcatctagttcctccaagtcttgttctaaagcgagattgtcatccactagatcttccaccttttggaacgcaggatctgaaacataaatatctgggcgaatttaactgtcatcatcattttgaagtattattctgtcagaaggataacaatcaattggccattgggatgaacttggtaggtctaggttcagagtgtctagaatctgttttagcttcatatgccaccaagctagaggagaaaaccattctaacattgtccataaaaaatattcatctttatatggatttgtcaagatatggtatatcatcaggagctttaaggcgatgggaatag

SEQ ID NO: 62879 - DNA, 474 bp, Glycine max
  Peptide Sequence Number=SeqID_179657
atgcccaaaggaggagacacctggcagctcaagtggcacctccaaatgatggagaaagagattatcacaataatagtagacacattaccagtgttttactatgaaaaaatggtggggtacgcaccttcaagctttgcggatatggtcttcgtctgcaaaaggatcgaagcgggtctgaaaagaggcaaatttgatcatcctactttgataagtgagaaagctggggcaaatgaagaggatgagaatgagggagaaacccatgctgcgactgtcattccctacatggccaaacttcccaccagcccaacaatgtcattactcaaccaatatcagctcttctcattacccaccacccagtcatccacaaaggccatccctaaatcaatcacaaagcctgtctaccgcacgcccaatgcccaaacactacctttagcgaaaaccaaaaaggaattttgtagcaaaacgcttgtatga

SEQ ID NO: 62880 - DNA, 423 bp, Glycine max
  Peptide Sequence Number=SeqID_179658
atgagtaaggacaaaattgttgaaaactgctcagatcgaccgtcgtattatccgctgcaagttcctttagtgatatttgtgggagagattgaaaacacaagtgtgatcatcaatattgctgtgtcatgcaaagtaattacaagcaaaagagaaagaaagaaaaaaagtgaattgagatggcgatggatcaatgaagccaggttgggaagaatttacattggtggttggaatgttgtaagcttgattagtacaaaaaactctttggggtctgattatattgtattgaaagtgatagttattgtaaatgtttctacctcgtctgagttgccacgatcaggaccacctcaaactgaggttgttataagggttggaccagggttgtctctcctccaaacattggaactgtgggtttttaaaaattaa

SEQ ID NO: 62881 - DNA, 1721 bp, Glycine max
  Peptide Sequence Number=SeqID_179659
atggccaacacaagtccttctcttctagctcttgccaacactaccaattccaacctcaatcttcaaatcccttccattaatatcaaactagaaagagataattattccctatggcgatctaccattatttctgcacttgagacttttgaactagagtctttcattttgaatcctgcaccaccgatgcagattcacatcgtaaacacttctgacggtgtgtccaccactgaacccaaccctgattttgttctatggaagaaacatgatcgttttgtcctactatggattaaatccaccttatcagaaaaagccctctccttggtcgtatgtgccacctcttctcacatggcatggactgccattgaaaagaccttccaagctcagacacgagctagacgcatggcaatgcaggttcaactacaaactctaacaaaagggtctctttctatgcttgaatatattgagcgcaaacgctccattgctgactctcttgctgaaaatcttcatccaatttctgatgaggatcttattggttatattttaagcggccttgattcctcttatagtgctttctcaactgctttcatgatgaagtctgatgatgtctctgttgatgatcttgctggccttcttcttcaagaggaggctcgcttagagcaggaacatgttcgtcaagctgctgttgtttcacagcccactaacccaaccccactttttactactcctgctgtttacactacaaatcggttctcaaaacggtcctcttccaccaacaatccaaacaacaattttggtttgtttcctaggcacaacattgacaaccctcgtcgtcgtcctatctgtcaactgtgcagtaaaccaggacacgaggctattaattgttggcagcgcactaatcaaactgattacccttctagacgtgctaacccaagagtttcctctcgtcaagctaatgttgctcaaactggaacatcttccattgttatggacccgtcatggtactttgacactggtgccacagatcacgtcactccagatattagtaagcttaccattgccaacgattacaccgatgatgacaagttacaagtaggaaatggcaaacatttatctatttctcatgtgggttcatctttattacctaacctttccttgcctagtgtgttcattgttcctaaccttaccaaaaatctcctcagtgtttctaaattaactcgtgataatgatgttttcatggagttttggcctacttattgttttgttaagaattttcagggacaaacacttcttcaaggggacattagccatggcttgtatcagctgcctcctgtcaaaactaacttgacctcaactatggcacttactagtgtacgcacttctctccatggttggtatcaacgcctcgctcatccacatgagtctctcttaaggcgtcttctatcctcatttcaacttccagcaaaagaccaccttggggcagttgcagcttgcctaagcaagctgaaacttaaccctgaagtagtgagctcacctaggcgagctagtcccttacccttgaagttatttggtggcccaggcaagccaaatgcgggcatgggcgagctgaggcctaggaaaaacaaggaaaagacccttttgccctcttttcttggtatcttttgtcttcctgatcgaaacatcgaatggttccttgctttgcactgtaactggcgttcaacacc

SEQ ID NO: 62882 - DNA, 969 bp, Glycine max
  Peptide Sequence Number=SeqID_179660
gtagggttgcagtgccttgaacggcacgctgccgtgcgtgcccaggcaggcgcccgaggcgtgtcccacgccggacaccgacaggctcaatgcccctggcgaagaggcgcccagggccaggtattgcggccagaggtcggcgcaatcttccaggttgggatgctgctcggcgcggtcctcgggcgggccggccttgacaacctgttccaccagccccagcagggccgcgctgggatcgcggccgaagctgcgcttgcccggcgcgtaggcgtcgaagacgcggttccaatcgaggtattcgccgcgcagcaagtcgaaggtgtatggctcgaaatggttggcgggatgcgccccgccgcaatccaggctgcccgcttcggtcacggtcagcagcgcgcgcgacagccaggtgacgttgatgttttcttcgtcgaacccgcccagcgtgcccgcgccgggattcgtgctggtgtaggcagaggccatgcattccagcgcgcccaggctcttgcgccagtggcgttgttccagcaggtcattgacgcgccgcatgacctgcggatcgggatgacggctgagccgtggataggcaaacccggtgcgcggatcttgccacatgcggtaggccaccgcgcccgcgccgacgtccttgcccaccggcttggcgtggccggccagcttcagtgtttcatagggcgcgcgggtggcgtcgatgcccgccttgaggtcgatgtcgcccaggtcggcctgcgtggcgcgcgccttggcgcggtcgcgttcgagttgcgcggtgtcgtagccggccacgcgctgcaggtcgaagcggcgttgcttgccggtgcgggtgtcggtccactgcccgcgatagcccttctcgtcacgcgtgccttgccagctggcggcgcggtcgggcgcgtcgatcgcggccgtgtccgaagccggaggccgcgccgggtgcggttgtggtaa

SEQ ID NO: 62883 - DNA, 513 bp, Glycine max
  Peptide Sequence Number=SeqID_179661
atggatgatctccaaaatataacagcgaatggtgaaaccatatgcaaggagatgaaagtgaacaagaaagagacaatggaaaaggaagaagaggatcgtagaagagaagctgcaatggcatcctcatcgtgtctccgacccaattttaaccctaaaggcattacccaagaccaactctcaaaatttcgtgtaggagctacacaagaggcgcttgcaactgaagtcaaaatcaaagttcaaaacgaaatccaaaggttcttttcttcttttcttaattgtaatgatggggccaacaaaaagtcacatggttatggtttatcaagccaaaacagtgtaactcaaggttcaaatgttgatcacagagaatcaaggttgtggaatgattgtgaaggatttgattctagaattgaagactcaaaggatgatgtacctgtgatgtctgaaccaaagaagcaaaagttacattgggggcttgacactaagaacaggtgggagaggaaatctaacatgtag

SEQ ID NO: 62884 - DNA, 447 bp, Glycine max
  Peptide Sequence Number=SeqID_179662
atggttgcttcctctcaacacaccagccttacagagcaagatgtttttgctaacactagtatgagcacacctttgccaacaccgatcgtgtcttcaatgaaatctaaccaaggccttgagttactctcaatcactgagcatgaagaagaatgcaagaaactacaacctagcccaagctcttcattttggagaagacatttgccttggcaaatttctattggcttcaatttacaaggtgatggataccccgggacactatcaaatggagtaaaggcccgagaaggcttccaaaaagccaaggaaaagattatgttaattcaaggaccaatcgaaaaaactgagaaagctgaggcgatgctagtgagagaaaaagaagagcttatggtgctccttaagctgattcaagaagaactccgttccactcgcctcaagcttcaagagctttga

SEQ ID NO: 62885 - DNA, 741 bp, Glycine max
  Peptide Sequence Number=SeqID_179663
atgaaatattttccaagttctttaacgaaaaatgcttttacttggttcatcacattgccacccaattcaatatacacttgggcacaactcgaaagcatgttccataaacatttccttagaggagagactaaggatttagatgttagtcaagagaaggatgaaatatgtgtggcaggattacacccgagacctccttatacttgtcaaataggcatggtccaaaaggctattgataaaggtagattgaagttcgaggaaaaaacaatgaaagtggacactaacctatttcacattcaagctaactatgtagaacccatgcaaatcatgatgagtggagcctcgattgggacatcaaaagtgagcacctctctgtctaaagaagaggttaaccaagccctagaggagttcaaaaaagaggaagagttagtttttcgacttgcaagagattcattggttgattttctattgaaaaaacaaaaagatgagaacgaggttatgtcgtgtcctcgttgtagtgttatgtttgatagatcagtatccaaagcttttgagtcgttagaaattcgaaagagtttaaaaaaattgcaagaaacaaaggttaaggaaaaggagaagcaaagtgcaagcatgactgtgagccaggttcagaagtcctaccagtgtatctcagaggaagtcctacgttcatcaagcaaatgttccaacaaacaagtggtttcaaccagggaacaaaagatctaa

SEQ ID NO: 62886 - DNA, 132 bp, Glycine max
  Peptide Sequence Number=SeqID_179664
atggtggtcacaaactgtggtacaaatcccacgtccattttaactcatcgatctcttccaaaggaatcttcaggattcaaaaggaaggacgatatccctaaaaaatatctcaacttcacaggctggttgtaa

SEQ ID NO: 62887 - DNA, 438 bp, Glycine max
  Peptide Sequence Number=SeqID_179665
atggaagaatcatcaaagaagagaaagggctcatcctcctccactaccactgctggccaacgccgccataatgcttccgatgactctccagcaccacctaatccatccctttcctcaccacactctcttactctattttcttccaatgagcaatttactctgattctgcaacaattcagcattcctcttcctaatgaaccttttgtcaaggttaaatgttcatttgccattggagccactgcagttgaatcctttgggtataggaaagatctagacggtcaatgggttcgtaaacaggatctcccaactaatgctcggaacgaatgcattccatctccaccaccaagagatccatcctcttcgttactgaatgatgtccttagtgagcttcaggatcttcatgcctttgtcggagaaaggtttgattcaatggattga

SEQ ID NO: 62888 - DNA, 591 bp, Glycine max
  Peptide Sequence Number=SeqID_179666
gccaattccgccaatgaaaggcatttgagaggaatagggttaagggatggcaattttaagggcgtggggagcagcgacgggcatggagtgggtgaggaaattgtagagctcgagggggttcgtgtggggagggtctgggtcaccataggtgaaggcgcgccaaccccgccgcctgagccatcgtcaagggttggagagcttggacttcctggcgtatctcaggggacaatctcgagacgaagcaactcaagagaaagagatatggcaagccaacaatacgattcgcaaggtcctcaaactcagagaggggcaaaccgagattgcaggacttggagaaaatctggccaagaggtcaactggtcgttgctagtcctctactggaaccatgctaaacgtcaggcgttcatgcttcagtgtcgcatgatattcaaagaattgattgatcataaagatccaaccaagcggcctgtgaaaagtatcttggagggagatggtgagcttggtgatagtgtcatccagaagatcggagttggctttggatctcgtggactctgccatggatatctctcaatgaaagcaccaaaatgctaa

SEQ ID NO: 62889 - DNA, 150 bp, Glycine max
  Peptide Sequence Number=SeqID_179667
atgacgatgatcatggcggtggaggtggtcaatatagcaatgatcataccagcaaaggtggtgacaatcatggtgatgggaccagggttagaatcaacccttgcaagaagtaaggaaagggagataagtcatgcagttaacctagtctga

SEQ ID NO: 62890 - DNA, 219 bp, Glycine max
  Peptide Sequence Number=SeqID_179668
atgtcggtagtgacaacgacaacgatcatagtagcaatggtagtgacaattgatgataatggtggtggcaacgacaatcatggtggggttgcattggtagtcgtggtggtgacagcaacggtgacgaaggtgatggcggtagacaatggtggtggtgacgtgttgactacaacagtggttatggtggtgacaatgacattcatgatggtgatggattaa

SEQ ID NO: 62891 - DNA, 657 bp, Glycine max
  Peptide Sequence Number=SeqID_179669
atgggagaaatagaggaggtgcaagagcagatgaaggccgacatggaggccctgaaagagcaaatgatcacaatgatagaggtcatgatgagcatggaaaagataatggaagtcaatgtggttgtcgttgccgctacatgcactgttgctgaggtggagccgaccctcctatttggcctcaaccaaataaatcatcagacctcggatagggtaggtcaaggaagcaaagagttggtagcatttgggcccatctggggccatctagaatattctggaaaggggattgcttcaggtggaagcaacccagcttgcctgggcgagctgggcggcaaccacctcccccattttcttataaaatggcgtgagagggctgagtttgaggagttcaacaccttgatagctcataaatcacttaaaattagtgaggagaagaagaaagaagggaaaaatccaagccaagacacttccgtaacactttcgagacatttccaggatcaattccgtgaaagtttcttccgtgttcttcgtacgttcttcatcgttcgtcgagcttcaaccggtctgatttcctcaccgcaattgaggatacataggaacaaaagccccgcttttgtcgaccccaaaaagggagagattgttaaaggtccaacgccttaa

SEQ ID NO: 62892 - DNA, 189 bp, Glycine max
  Peptide Sequence Number=SeqID_179670
atgacgatggcggtcatggctgacaatagaaatgatcataccgacaaaggcggtgacaatcatggtgatggtgatggagcaatcggaggaggaaccctagagggcattggaaacaccaccattgctaatggagaacacttgaatgactaccttgagataaaggatgagttactcaaacttggggattag

SEQ ID NO: 62893 - DNA, 627 bp, Glycine max
  Peptide Sequence Number=SeqID_179671
atgtggcccaaaagggaatggaagctgatttgggccacagtggggtttgggtcatcgggtgggtcgggtggttgctcttggttgaagcacaaacctctgtctcgtcaggaggccaattccgccgatgaaaggcgtttgagaggaatagggttaagggatagcaattttaagggcgtggggagcagcgacgggcttggagtgggtgaggaaattgtagagctcgagcggcatcaaggagtttcatttcttgtaagcgcgccaaccccgccgcctgagccatcgtcaaggtttggagagcttggacttcccggcgtatctgtggggacaatctcgagacgaagcaactcaagagaaagagagatggcaagccaacaatacgattcgcaaggtcttcaaactcagaaaggattctcatattgtgaagggggaaaccgagattgcagggcttggagaaaatctggccaagatgtcaactggtcgttgctagtcctccactggaaccatgctaaacgtcaggcgttcatgctccagtgtcgcatgatattcgaagaagtgattgatcttaaagatccaaccaagcgggtcagtgccatcaaaccttggaacatccaacttcatacggtgtga

SEQ ID NO: 62894 - DNA, 129 bp, Glycine max
  Peptide Sequence Number=SeqID_179672
atggccaccccaatgagcactgcttgctacttggataaagatgaagccggtcaatcagtagatatcaagaaatatagagatatcaagccaataccaaagaatctcaccttagtgccgtcaaaagaataa

SEQ ID NO: 62895 - DNA, 724 bp, Glycine max
  Peptide Sequence Number=SeqID_179673
gtgatccagccgcaccttccagtacggctaccttgttacgacttcactccagtcactagccctgccttcggcatccccctccttgcggttaaggtaacgacttcgggcatggccagctcccatagtgtgacgggcggcgagttgcagcctacaatccgaactgaggacgggtttttggagttagctcaccctcgcgggatcgcgatcctttgtcccgtccattgtagcacccatgcaccacctgtgtccgcgttcccgaaggcacccctctctttcaagaggattcgcggcatgtcaagccctggcgggatacttaacgcgttagctacagcattgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactccagcttgacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttg

SEQ ID NO: 62896 - DNA, 785 bp, Glycine max
  Peptide Sequence Number=SeqID_179674
ccctcacctttagaggactatacgtcctcgtcatcagagggctacacgccctcaccttcagaggactacacgtcctcgccatcagagggctgcacgccctcaccttcagaggactacacgtcctcgccttaagagggctacatgccctcacctttagaggactacacgtcctcaccttcatagggctacacaccctcacctttagaagagtagacgtcctcgcctttagtgggctacacaccctcacctttagaggactacccgtcctcaccttcatagggctatacgccctcacctttagaggactacacgtcctcaccttcataggggtatacgccctcacctttagaggactagacgtcctcgccttcagaggactagacgtcctcgccttcaaaagaggactacacgtcctccccatcagagggctgcacgtcctcaccttcagagggctacatgtccttgccgtaagaggactacacgtcctcgcctttagagggctacaagttctcaccatcaaaggattacacgtcctcgccttcaaaggactagacgtcctcgccttcagaggactatacgtcctcaccttcagaggactatacgtcctcaccttcagaggactacacgtcctcaccttcagtgggctacaagtcctcaccatcagaggactagacgtcctcaccttcaaaggactacacttcttcgcctatagagggctacgcgtcctctctttcaatgggctccatagccacaccttaagagaatttaaggtcctctgcccttaa

SEQ ID NO: 62897 - DNA, 201 bp, Glycine max
  Peptide Sequence Number=SeqID_179675
atggcagaactaagatctggaaaaactgaccaaggaatcattttgatagctgtcatagatttgaagtgtatcttgagcatatctatcgacatctcgcaattaaattcacaacaaagtcaaaaaacacatgttggacacttgggctcttgttgtgaaagtgcagagagctctgagtcagcatttttggctaagatcttatag

SEQ ID NO: 62898 - DNA, 306 bp, Glycine max
  Peptide Sequence Number=SeqID_179676
atgagaaaactccgtgaaggaatttgcggtctccatacaagaggacgcttccttgtaacaaaggtggtgcgtgctagctactactggccagcactcagggcagacgcccttgacttcacaaagagatgcaaacgatgtcaagagtttgcagacattccatgcatccctcctaacaatctccacagtctaagctacccttggcctttcgccatgtggggaatgaacatattgggaccactgccaaaggccttaggagcagtcaaatactcactagtcgccatcgactacttcaccatatggatataa

SEQ ID NO: 62899 - DNA, 558 bp, Glycine max
  Peptide Sequence Number=SeqID_179677
gtggaaaatctcaaggtccagttgaaggagttagagtccatgatggaggagtctgagcagtgggcctctaggaaaaggaaggccaacaaggagcttgaggaggagttgctcgtttacaagcaggaagccatggagcaccatgaaaagtgtttcaacaaggccattaggcaggatgtgaaggacgatgttctacttgacgagcaagaaattactgcggaggaagaggctgctagtgaagaggagttgggctttgaggagaaaggcgataatgccactctttccttcgatgaggaattttgtactgtgtatctatgtcttgtttctatgcctttgtctatgcaacgctccacacttgtggtcttgtcacccctctggtggcgtttctttctactttgcggaacttctcccctgatgcttgtgaggagtatgtttgacttgcccctcgttgaaggtcttgccaaccaatttggggttcattttgttgaacttggacctttgacggtggtcgtcatagttgctgtgagtgagcagaccaaggggatgccttgggttttctag

SEQ ID NO: 62900 - DNA, 1146 bp, Glycine max
  Peptide Sequence Number=SeqID_179678
atggctacatctagatggaagaaatgtccagattcaggaacgaagtcaaacaagccagataaaaaagcgataagcgagaaggaagcaccaagatcaacttacaaagtacctattaggttacccgcgacgaaacttctcaggctggggttagacgaccaaatactgcaggacaccaagaggagcagtataggaaccacgaaagagatagaagaagagataaagggaaagatcaaggtagatagagataccagtagtagcgatgcgatcgacaacctccacaagaataggaactcgcccaacaaatcagagggtatcaacctcatcaaccaagacgaccccatggttgtctccatcatcatcgcaaacttcatggtgtccaagactagaggctacgtccacctcaagaccactttcggtcaaggacatctctctaagagcttaacagttaggaaaacactcaaagagcttagagccatcgtcttgactcctcatcttaagatcaagtttcccaccgtgacaggagagatcgtcactgtaacaccatatcctcccactagggagtctgccaagcctcaccccacaacggctgaaggtactcaggttatgagcatggacgaagggtctccaatccgagccataaccatctaccaaccaagcctggacaatgaattcgatatagatccgtgcgatgacacttctaatagaggcccaaagcccatcaaagagctcgtcaagctacagctcgaacccaaacccgggatgtgtacgcagctcagtagggagctcactagccataagcataggcgcatcgttgatctcgccatctgtctcaggccaaaccggtatcacagaagaaaaggaagatgggagaagaacgacgcaaatttatcagagaagaagtgcacaaactatactgatatgagcagtgcgtgccccaatgatgaataccctctatccaacattgacaggctagtcgatggagcgttcgagttcctggtgctaagctttttggatgcttactcccgatacaaccagatcagaatacacaccccagacaaggagaaaacaacatttatcatcgaagatgccaacttttgttccaggatcatgccctttggcctaaaaaatgcaggcactacatactag

SEQ ID NO: 62901 - DNA, 741 bp, Glycine max
  Peptide Sequence Number=SeqID_179679
atggaaggaaggcgagaggaggttgatggaggggaagaggagattgtcgtgttaccaaaagtagaggaggagaaacgaggtggaattgagacggtggaggattattggttggttggaaagaaagatatggaactcatccttaaaatggccctatggaattttaaccgtaatttggtgatcattgagaagataaagaattataagaatccaaatatggtggacctttctaagtgccccttttgggttaggatttatgatctcctaatcagccaaagaacgaagacggtggcgctcaaggtgtccctaaaaaacaatatggtgattggaggaatcaataaggaggtgtttgttgaaggagttatgaggaaattaagaaatgaaggggagaaggagcaaaatgaaggcattgataataggcaagagttgagagtgaaaattgaagacgtagctgattcactattaaaattccgattgtccaatgaggagagttacaacaagaagaatgaagtggccaaggagaaggtggtagaggaaaaagaaggtactaggtcaacaagtgctaatcccaaggaggtggcaaaaaaacataaagcaagcactgaaatcaaagaagagacacatatacatgacatgcagatccccaagactgggggaaagaaaaaagctagaaatggagctggggaaacggaagacgaaaggatggatatgtataacgatgggggactagagcaaagagactaa

SEQ ID NO: 62902 - DNA, 273 bp, Glycine max
  Peptide Sequence Number=SeqID_179680
atgttccaacagaggcagtgccttctggtggaaacaacccaactcgcctgggggaaagagggcagagcaaattcgttcaaccctcctggtatttgggattcacttgaaattagtgagaaaaattgtttccgggaagataatctaagccgaggcgcttctgtaacacttccgagacatttccatgggcgatttcgtgaaggttttccaccgttcttcattgttcttcatcgttcttcgttcgttcttcgtcgttcttcggtcttcaaccggtaa

SEQ ID NO: 62903 - DNA, 168 bp, Glycine max
  Peptide Sequence Number=SeqID_179681
atggcattagcgcgtgacttttgtattagaaatacccgaatgtgcacgtatgcaatttttgatagccaaagtgctttgagtatgcatgaaattggccccgatgaaagcttgcctcaaagaggtccaggaaagacaaggcggccgaaagaactagtttctgctccttga

SEQ ID NO: 62904 - DNA, 1041 bp, Glycine max
  Peptide Sequence Number=SeqID_179682
atggtaccgtctcggccgtccggttttgttctcaaaccaattgcaaacttatttcctatttctggtggtgaggctagccttctgagttttaaaagaaaaggccaagtttggatttgtccacaacctgcagatgtagttgaaatctttatttatcttggtgaaccttgccatgtttgtcagcttcttctcacaatatcccatggtgcagatgattcaacttatccatcaacagttgatgtacggacaggaggccatttagatgggcttaaactggtcttagagggtgcttctataccacagtgtgcgagtgggaccaaccttttaatacccttacctggggcaattaatgctgaagacatggctataactggagcaaattctcgtctacatgcccaagatgcatcacccttatcattactgtatgattttgaggaactcgagggaaagtgggatttccttactcgtgtagttgcgctaaccttttatccaactgtttctggaaggaaaccattaacacttggcgagatcgagggaaagagggatttccttactcgtgtagttgcgctaacctcttatccaactgtttctggaaggaaaccattaacacttggcgagattgaaatccttggagtttctcttccttggagtgatatatttactaatgaaggccctggtacaagattagttgagcatgtcaagaagtttgaagaggagcttaatccctttttatctggttcagatacgaatccacttaactcttcatcctcagaaaaagtgtcaccacccatacaaggaggcacttctgctgaccttttcattgacctcctgtctggggaggacccactttcgcacccacttgcgcaaccagttactgaaaatgttgtctaccaggaaagtgacccacttgatttcttggacctaagtgttgaaagccatagtgccaaaagtgatggtaaagtttcatcagaagatgccagacattcagatagtagtgctgaacaatatttaaagtgccttaaaactcttgcagggccaagtctg

SEQ ID NO: 62905 - DNA, 1077 bp, Glycine max
  Peptide Sequence Number=SeqID_179683
atggcttcttctgcttccttaatcaactcgttgacttgctcttcgcctgcacccactcagcactgtttcgccttcacccgcaccaccgccaccgctaccgccacgtcactgagacaattcaacagccaccgtccgcccccactcaccacgaggatctcctcgtcgccttccaccgttgtctgcaaagctgtctccgttaagccccaaaccgaaaccgaaggtctcaacattgctgacgatgtcacacagctcatagggaaaacgccgatggtttacctcaacaatatcgtgaagggttctgtggccaatattgctgcgaagcttgagattatggagccctgttgtagtgtcaaggacaggattggttttagtatgataaatgatgctgagcagagaggagctataacacctgggaagagtatattggtggaacctactagtgggaacacaggaattggtcttgcctttatagcagcttcaagaggatataagctaattttgacaatgcctgcttcaatgagtttagaaagacgggttcttttgaaagcatttggggccgagcttgttttgactgatgcagcaaagggcatgaatggagcatgcatgaatcctatgttcttgggaatgggaactcatgcagggtgcaccattatctccagcctccaggttcattatgagacaactggcccggagatatgggaagatactagaggaaagatagatattttagttgcaggaattggaaccggtggaactgtttctggagctggccaattcctaaaacaacaaaatccgaaaatacaggttattggcgtagagcctctggaaagcaacatacttacaggtggaaagccaggacctcacaaaattcagggtattggggctggttttgtgcccaggaatttggatcaagatgtgcttgatgaagttatagcgatatcaagtgatgaagcagttgaaactgcaaagcaattagcactccaggaaggcttgctggtgggaatttcttcaggagctgcagctgcagctgctttgaaggttggaaagaggcctgagaatgcaggaaagcttattggg

SEQ ID NO: 62906 - DNA, 2097 bp, Glycine max
  Peptide Sequence Number=SeqID_179684
atggaatcaccgggtaagccaagcaatgctggatccataccttattccgtttcatcactttcacttcccaattttcaacctaattcgtgttcgttccttctttcgttcaaattttcaggtgctttgagggacacgtcagtgatcgtggtgacgctggactccgacgaggtcttcatcatcgtgagcctctgcaccagaaccgacactcaggtaatctacgtcgatccgaccaccggggcgctccgccacgaggccaagctagggttcgatctcttcaaatcgcagggcgaggccttggatttcatcaccaatggatcgcgcttcgcgagcaagagcaggacgctcgcgagggcgattctaggctacgccgcgctgggaaacgtggcgctgctcctcgttgcgacgaggctcatcgccagtgttccgaatcttcccggcggcgggtgcgtgtacactgtggcggagagccagtggatcaggattccgctgcagaatgcggtggcgcaggggaagggggaggtgaagaacgtgcaggagttgacggagcttgatatcgacgggaagcattacttctgcgagacgagggacgttacgcggccttttccgagcaggatgccggtgaatgaaccggatcaggagtttgtttggaacgcgtggttatctactccgtttgttggtgttggcttgccgcggcattgtgtcacgctactgcagctgagagtttttgtttgtgaaaattggttcccgagagaggggtttgcagaatatcgaagttttggaagctcgggtcaactagaaggtgttgttgctcttacagctcgtcggagcagactacacccgggaaatgaagtggagtgtgagcaacttgtatgggttcccaaacgagcaggtcaaagtgtacctttcaacagatatgtgtggcgaagaggcactattcctatctggtggggtgcagaactgaaaatcacagctgcagaagctgaaatttatgtttcagattgtgacccttataaaggaagtgtacagtattatgaaagactgagtaagagatatgatgctcgtaatctggatatacgtgctggtgagaattcaaaccgaaaagctttggttcccattgtatgcattaacttgcttcgcaatggagaaggaaagtctgagtcccttttggttcaacatttcgaggagtctataaactttattagatcaattggaaagcttcctaatactcgggtccatttgataaactatgactggcatgccagtgtaaaattaaaaggtgaacagatgacaattgaagggttatggaaacttctaaaagcacccactgtatccataggtatatctgaaggggattatttgccttcacgacaacgaataaatgattgtagaggtgaagttatctacaatgatggttttgaaggtgcattctgcttaagaacaaatcaaaatgggattgtacgttttaactgtgctgattctctggataggaccaatgctgctagtttttttggttgcctccaagtattcacggagcaatgtagacggttggggatatcacttgatagtgatctggcatttggttatcaatcaatgaataataattatggtggatatattgctccactgccacctgggtgggaaaagcgttctgatgccgtgactggaaaaacatattatattgatcataatacaagaaccaccacatggatgcatccatgtcctgataaaccatggaagagatttgatatgacatttgaggagttcaagagatcaacaattttgtctcctgtatctcaactagctgacctttttctacttgctggggatattcatgctactctttacactggatccaaagcaatgcacagccaaatacttagcatattcaatgaagatacaggaggaaagtttaaacagttttctgctgcacagaatgtgaaaatcactttgcaaagaagatataagaatgcagttgtggatagctctcgtcaaaagcaattagaaatgtttcttggaatgaggcttttcaagcatcttccatcaatttcccttcaacctctgcatgtatgtgacttgccaactgtcaaagttaactga

SEQ ID NO: 62907 - DNA, 831 bp, Glycine max
  Peptide Sequence Number=SeqID_179685
atgcaaagaaaaatcaacttcattgaagccattaaacttgagattgaacgccttaagttaaatctttctgctgctgaaagggatagagccctgctatctgttggaatggatccagcaaccttaaatcctaatacactgctcgatgaagcttacatgggaagattatctaaagttgcaagcaatcttgccctgcttggagaagcttctcttgaagataaaattgttggtgctattggtcttgggactgttgatgataatccaatagatttctggaatattatcagaattggggaaacatgttctgggggtaagtgcgaggtgcgtgctgaaattagaaaggaagttcattcatctaacacaatgtcatctgctggagcttcagaaactgtattcttgtgttctcaatgcgaaaggaaggtttgcagagtttgctgtgctgggaggggggcacttctgcttataggatataattcaagagaggtccaagttgacttacctgtaaatcgtttattagctcgggatggtataatttgtaaacggtgctgccaggatgttgtgcttcatgcattgattttggactatgtgagggttctgattagcttacgaagaacagaacgtgtagaaaagtctgcttacaatgctttgaagcaaatcattggatcatcttgggattgccatctagaaaagaatcggttctctgatagcaagtctgctggcaaagcagtacagttgttactgaatggatatgaatccctggctgaatttccttttggcagttttttacacccgccacatgctgttgcatctaccaaaaatgtgcttaatccatga

SEQ ID NO: 62908 - DNA, 966 bp, Glycine max
  Peptide Sequence Number=SeqID_179686
atgcaaatgcaggttgaaacagcaacagattctgctccatttttgtcattgattgctccattaaattctggtttgcggctatcatattggaaagcaccatctattgcctcctctgttgaatttggaattgtccttggcaatatttctgatgttagtggggttatattgattgtcagcccatgtggctactctatggctgatgctcctattgtgcaaatttgggcaagtaacaaaatacacaaggaagaaagatcattaatgggaaaatgggatctgcaatctatgattaaagcttcctcagaattaaatggacctgaaaagtcaggaacagagcataaagtgcctagacatgtgaagtttcccttcaagaattctgttcggtgccgcataatttggataagtttacgccttcagcgacctggttcaagttctataaatattggaaatgactttaatctgttgtctctggatgagaacccttttgcacaagaaactcgacgggcctcatttggaggatctgcagagagcgaaccctgtcttcatgccaagaggattttagtggttggaagccccattaggaaggaagttgatcttaagccacaacaaagctctgaccagatggccatgacagggtggttggaaagagctccacagcttaatagattcaaggttccaattgaggctgaaagattgatgggcaatgatcttgtcctggagcagtatctgtctcctgcttctcccttgcttgccggatttcgtcttgatgcctttagtgcaatcaagcctcgggttacccattcacctttttcggatgcacatagcaaaaattttccatcccttgtggatgacaaatacatcactccagctgtattgtatattcaagtatctgttctccaggtatatccatggaggttctccttcgatgaattgctatgttttgcaagagctctgattttgtgcgcctaa

SEQ ID NO: 62909 - DNA, 441 bp, Glycine max
  Peptide Sequence Number=SeqID_179687
atgaatcccaaatgctctgttccgccccctcagattcgtccgtttcagtttcagaacttgaacggtctccgacaactcgccgaaacgcgtcgtttcaagggatggttgttggaccagttcggagtcctccacgacggaaaagaaccttaccccggtgccatttcaaccttagaaaatatagctaagacgggtgctaaaatggtgatcataagcaactcctcgagacgttcatcagtgactattgaaaaagtgaagggtcttggatttgatgcctctctttttctcggagccatcactagtggagaactaactcaccagtacttgcaaaggagagatgatccttggtttgcaacattgggaagatcttgcattcatttcacctggaatggccggggagcaatatctcttgaggtgggtagagcagcaatgattctagcttga

SEQ ID NO: 62910 - DNA, 795 bp, Glycine max
  Peptide Sequence Number=SeqID_179688
atggcatttctaggagaaactagcagtcagacgattgtcaactcaaggttggctttcatttatccaaatggatcgattattcacaatgatactggggtttacttccaaacttcaactccggtgcccattcgagtaccaaataggtgtgattttgcaagcctaaaaaccagaatacacaatacccttcagctatccgacaaacaatttttggatgaaattcactaccggaagccattcaccgatacaggtaaccaaattcgctttgagtgtatcaaattgataaatgatgacgatgtcaacacaatgttaatgtgtaatgatcaattttcttgtgttggtccgattgagttattatgcaccgttggaagaacaccagatggaataataaacttacttgaaggcactatgcctcgtattcatgacgcgatcctgtattacaacggcaaatggaacatgccaccgcagaacaaatttgttggttgcgcgttcacaggaaaaaatcctaagaaatttcaaattccttcaacatgtaccatcgatgaactgaagaatttaatcaagcaagttgcacctaaagggattccccctcttggaattcacgaatcacaaacggtaagacgattgtttttccgccaaccagctcggtttgagtattcagatacggttataaaatatgaaataaatgagctgatcaccaacgaagaactgctgaaggtgttagtacaatctaactactggaaaaaatatggacaaatagaaattttagctgtctttactaaatatgttgaagacgag

SEQ ID NO: 62911 - DNA, 432 bp, Glycine max
  Peptide Sequence Number=SeqID_179689
atgtctttcgaccgagactgttgcagtctccatttcttcatccagagacaaccaagtccaatggtatgcgaagaccatcatgatcacttgctttcgttgttccaagactatcaaagtcccctttccacccaaagacaagcaagtctgatggtatgcgggggcgatgatggtcatccatttctaatcgtttcttttttgagatttattgcagttccctttgccacccaaagacaagcgagtccgatggcaagcggggacagaccatggtctttcattgttctcaaaattattgaagtttcccctgctatcccgagacaatcgagtccgatggcatgcggagaccatcacagtcatctgtttttaatcgctttcaaggtttcgctgattgggctagtggttggttgggtggagaattcactcgaacgaaattag

SEQ ID NO: 62912 - DNA, 528 bp, Glycine max
  Peptide Sequence Number=SeqID_179690
atgtgtcagggctggaatcctgaccctactgatgtagagtgtactgacaaaaactctcgttcagccgcacctgacacctatgtttggcagcctactggtcagccacatgtcgtatacagcgttccaacctccgtaggtgagcagagatggactctagaggtggcggtggtctatccaccactgcctgctgctattcgtccttcgactattgtggtgcgtgcagtacttctcgatgaaagccctattaataggacgtcagatgagcttgctgggggtgacgggcactccatagaactgacagaggcctgtaatcagagcgggaaatcccagggccctgttggacttctctgggtccactgggtcagagttgtggtcgttgggcagaatgttgctaagctgcaacgtcatccagatctgtgtgagggtggtcatcctcttcatcgaagcctgaggcctgactccttctctggctatactcgcactactggccctcttccaagatcagtgggtgccccagaaactgactaa

SEQ ID NO: 62913 - DNA, 441 bp, Glycine max
  Peptide Sequence Number=SeqID_179691
ggatctagagcttatttgtggaggtgtgagtgatggatggtttgagagcttgagggagtggaaaattggggatggaagcaacactaaattttgggaggatagttggagagagtggtttgagtgggaacgtagttcggtggatgagtttcacaaaatggtcgaagatgcaaatttaattaaccaaggtgatgattgttggttgtgggtgaaagatgtattctcgttattctatgataggatatcctccaagatcaaccttgttaggagaggtgtgcaacttgacgatggaggcattacttgtccattatgccaggaggaggaggaggaaacatcacatatattgggtcattggtgggatattgcatggagtgcaattgtatggtgtatttggaaccaaagaaatgctgtcatttttaaggcaaacgttgtgaccatgatcag

SEQ ID NO: 62914 - DNA, 231 bp, Glycine max
  Peptide Sequence Number=SeqID_179692
atgactaaccgcctgagatatcttttgtttccccttacaaagattcaaaggactaaccgcctgagaattctttgtcccaacacattggaggttcaagtggaaggtacatccacttggttattcaaagagaacaaggagggtacatcccttatggatctttggcttgtaaaggattttacaaggttgaaaagaaatctcaagaaccgcaggttgcttggggaccagatgtag

SEQ ID NO: 62915 - DNA, 570 bp, Glycine max
  Peptide Sequence Number=SeqID_179693
atgccggctttcaacatgggaacgggtctggaaagaaagaacaaccgatcaaagaagcttcaggggcaaccctccaagaatctaatggcggagaggagaagaagaaagagattgaacgaccggctctcaatgctaagagcaattgtccccaagattagtaagatggatagaacatcaatacttggagacactattgattacatgaaagaacttctggagaagatcaacaatctgcaacaagtagaagtagattcaagcatggctggcatttttaaagatgtaaagccaaatgaaatcatagtgagaaattcacccaagtttgaggtagagaggagtgtggacacccgggtggaaatttgctgtgcagggaaaccagggttgttactatccacagtaaacaccgtggaagcattaggcctagagattcaacaatgtgttattagctgtttcaatgatttcacaatgcaggcttcttgctcagaggaattggagcaaagggcaatgctgagttctgaagatataaagcaagcattgtttagaagtgcaggatatggaggaagatgtttgtga

SEQ ID NO: 62916 - DNA, 396 bp, Glycine max
  Peptide Sequence Number=SeqID_179694
atggttagaattagagggttgcgtcaggttttagatagagttttagacaaagcattaggtagacatgttattggtgatgaggaagaagcccctcagcgtcgaaggcagacaacattgacacgtagacaacggaaagctgcaactattgttgaggatgttaaccatatgaatcatgctgctgacgagagtctctttgccacatacatcaagctcttcaaactgcttgaatatggcttccatctctttgattatgcagacttcgggctcagtgagaactatcagtgccaacataattcattcactcaaactcagcagcaatctggtttaacacatgccatgccaattagtctcttgtataagagtgatgttgctcatgacttctcaaacactgcatag

SEQ ID NO: 62917 - DNA, 267 bp, Glycine max
  Peptide Sequence Number=SeqID_179695
atgatagtattgactgcatacaagaaagatgacttttttgatacaatttcttgcaactctttgactcatggatcaaggaatggacaaaatcgtttctctgagagaatgaaacaggatactgagacatttggcaatttccagcagaggcctaattttactaatggtggttatggtgctggacggggtgctaatttcaggggctcaaataattggggaaggggttatggctacaatgggagagggcgtggtccaaactttcctttctag

SEQ ID NO: 62918 - DNA, 918 bp, Glycine max
  Peptide Sequence Number=SeqID_179696
atgccaattacaattagcaaagtatataataataatattttgtgcaattttcggtgtctatctctattgccatttcagcaagcggttgaccagctaaaaacaaatggaaaaggtttagctggtttttcccaattcaggatacatgcagttaggaatggtatctccttcaaaacaatgatagacatattgggaaggaagtctcaactactactactacaaaggaaggaactcaaacaaggcaccaaaaacaaccaccccatcatgatggaaagtcctcctaaatgcaaactcacattcacattaatcttcttcatcgttgtctcccactctcttggcttagtttccttcaccttgtgcatagcctccgagactaagaggaacaagaagggggatctcagatggaatgggaaactatgtcatttaccatcaagtccagcatttggattgggtattgcatctttggtttgtttggttttgtcccaaattgttgggaattctatattattcaagacttattgttcaggagggaaaagaaacgcaaagtgtgagatccctttcgttgccaggattctgcttttgatctcttggctaagctttggaattgcagttattttattaatcgttgccacaagcatgagcagaaggcaggcctatggggaagggtggttgaatggtgagtgctaccttgtcaaaggagggatttacgttggttcagccatattgatcctagtttcagtagaatcgttaatgggttcagctttgttaacaatgaagaccaatgaagaagcagatcaggaatgcagagtgggagttttgatgcaaatcaagaaagctataacatcaactactcctaaaagaggcctcacaagttggcatagggaaagattcaagcctacaatacaatctgttttgtcataa

SEQ ID NO: 62919 - DNA, 2322 bp, Glycine max
  Peptide Sequence Number=SeqID_179697
atggaggacagaactataggaagaaatggtagtagctctagaaagggtagctttaggttggggttgggaatggatgggaaaaaagatcacactgtggttgagcttggtagcattgacacacagagacttcttctaagcaatggagagagagagaaaaaattacaacctctcaccaacactctctctccaaggcaaatgaaatctctctatgctctctgtgacactatcttaccttctgtcgaccactttgttgacacttccgatgaatctgtcactaaattctatcagatttcagcttccatgaccggaacacctgaacaaattgaagcaccccttgacagggttactgaagtttgtgttatggctgttgtctacgtgaaacgccaacagattatgcgttcatggtctctcagttaccttcgtcactttagaatgctcttcaggaccatcaaacttctcactctcctaatcttctttactcagatagatgaatcagaagacaacgttgcatggaaagcaattggatactgcggacctgatccagaattcaaagctcggttgaagagccactttttagatggaacatctaaaggaggacaagaggataaggaagatgaagatgctgaagaggtgataggaccactttacaaaggtctagtccatctcaattacccacgagacatcactgcagatgctctaaaacgactcggattccctgtatcggtcatccgtcagaagcataaagctgctgcaaacttatcatctccttctttggtgatacaatgtgatgcagtggtggttggttctggctcaggaggtggagtgatagctggtgttcttgcaaaagctggttacaaagtgttggtgttggagaaaggaggttattctgctaggaacaatctttctcttcttgaaggaccaaccatggatcaaatgtacctcaatggtggtctggttgcaagtgatgatatgggtgtgttcattctatcaggatccactgttggtggagggtcagcaatcaactggtctgcgtgcattaaaacccctcagcatgtgtgcaaggagtggagtgataaacatggtctagagctgtttgagagtgaactgtatagagaagccttgaatgctgtttgtgagaagatggaagttcaatctgagattgaagatgaaggattcaacaatgcaatactaagaaaagggtgtcaagaaatggggtatcctgttagtaacattcctaggaattctgcgtcagatcactactgtggctggtgttgcatgggttgtaaggatgggaggaagaagggtacctcagaaacatggttagtggacttggtgaaatctggcaatggagcaattcttccaggttgtgaggcaataaaagtcttgcacaagaaaaaggaagggagggatagaaagattgcgcgtggagtggcttttgaatttgaatataaagggactaaagacatttgtgtggtggagtccaaggtcacaattgtagcatgtggagcactgagtactccagcattgcttaaaaaaagtggcttgaggaatcagaacatagggaggaacttgcatcttcatccagtggcgatggcttggggatacttcccagatgcacctgaatctgaggtgtggccagaggcatataagaagagctatgaaggagggataatgacagcaatgtcaactgttgttgcagagtttgaacaatctggatatggtgcagtgatccaaacaccttcattgcatcctggtatgttctcaattgtcacaccatggacttctggaatcgatataagagaccgaatgcgaaagttttcaagaacagctcatatatttgcactggcaagggatcaaggatcagggactgtaaaagccccagatcgtatcagttataagccggcaggtgtagatgaagagaatttaaagaaaggaattgagaaggtgctgagaattctggcagcagctggtgctgaagaaattgggacacatcataataagggaaggaccttaaatgtaaagcaggtaagatatcatgagtttgagaaatttgttaaagaggaaagttcaaggtcattgacagaccttacaacaccattgtgctcggcacatcaaatggggagttgccggatgggttctaatccaaagcaatcagcggtgaatcagacaggggagacatgggaagtggagggcctttatgtggcagatacaagtgtcttcccaacagcattgggtgtgaatccaatggttactgttcaagctattgcttattgcacagcacaatctgttgttgaagtacttagaaggaaaagaactaaatga

SEQ ID NO: 62920 - DNA, 204 bp, Glycine max
  Peptide Sequence Number=SeqID_179698
atgacaggatgtgggtcatccatcagcaccccattccaaaaagtccttactgtttttcttgttaagaagactgaagatcaagcgagagtgcgagacacgtacaatgttgcccttttttcaataaaagagattaatagaaaatctagccgcccttgtcgcaaacgccagcttgacttattgcagcaaagatcggtgcttacatag

SEQ ID NO: 62921 - DNA, 338 bp, Glycine max
  Peptide Sequence Number=SeqID_179699
gggaggtggttgccgcccagctcgcccaggcgagctcagctcgcccaggcgagcagggttgcttcctccagaagcaaccgccttctggaggaatcttctggagggtccaaatgggcctgggaccaaagaatggtcgcacgtcatcgagcaaaggtccccggacgaaattagggtatgacagaagggaagacattgtggaaatgtatctaagaaggttccatgagtcacaccttccctccctttcaaggttcgggttttccccgattcttaaattcgggggtgagggtggttttggtattgctgataactgccctgtccccgcccccgccccacactga

SEQ ID NO: 62922 - DNA, 504 bp, Glycine max
  Peptide Sequence Number=SeqID_179700
atgacaaggaaagatgccgctggagagggttccagtgcggccccacaagtggacgtggagtttgatggacacaggttttggagtgaggaacaccagcaccgatttgaggcgattaagggctggtcattcctcatggagaggagggtccaactgagggatcgagagtatgccaagtttcaggaggaaattgccaggaggcaatggactcagcttgtgtcacccatggctaaaggagagagtcagagacaagcactcctgggtgaggggccaaggatccccttcgatgaggatgccattaatcagtttctagggcatccattggtcttggaggagggccaacgttgtgagtttagccagaggaggagccaggcctcgaggttcaacgaggaggccatcagccagttgttgtgcgttccaggcaagactttgcccgtagcatggcagggagacaggtgtggatcatgcgcactagacttcaatgtctttcgatcaagactatcatag

SEQ ID NO: 62923 - DNA, 1004 bp, Glycine max
  Peptide Sequence Number=SeqID_179701
atgaatttgcagatcaaatcacccaccccatcttccaaatcagaagagcaggtttttagtgatccagctgttattcagtcagaatattctgggttgcgaagttctccagtgggtgagctgccaagttctccagtggctgggttgctaagttctccagtggcctcagttggtggcagaagtttgacagaatcaattcaaaggcaagatagccctgcaatatccagtaaagcctttccttctgggttgccttctcatcagtctgtaactcagctgggaccttcaaatttatctgatgctactcaagttgctagtcatccatctttttctgcagcaatgtattggcaaggtcccagtgggatatctagcagtagttatcattctctgctacagtctagttctcttcaccccacatcactggcagcatccttagttgtgcagaatcagatgcaaaatgcagaaactcaggtacctataaacgggggatggacaggtttatcagagtatggtctacctgtatcttctgccatgacttctcttgtaaatcagactcattcaccttctcttacctctttaaaaaattctgattctcttgatattccatcccttttgtctactaagacacctgtgtcatattctccatccatgacttttgatggatcaaacatgcctcagttttcttcaacactccaagacataaattctattcaagctcaaatatctggaaacatttgtcctgacccaaggccaattcatcctcaacattctgtccatcgttctgctccttcatatgtagattctacttcaggttccttgccaacagcaacttctttgttaaccccggatcaatttgcctatcctagagaacagttattgtctttatcacatttaaaccctactcagaaggacatgggttctctgactctaacatcctctggttcctctgcattaattccttctccagcatctcagcaccattgcttccactaccaacttcagtgcaaaag

SEQ ID NO: 62924 - DNA, 222 bp, Glycine max
  Peptide Sequence Number=SeqID_179702
atggcgaccgaatccggcgcgaacggtccttcgtccagttccgcggaatctttcattggttgcttcataagcttgatttccaagtgcgagattcgctacgaaggcgttctctatttccttaacattcaagattccaccatcggcttgaagaacgaacccaagataatgcacaatctgctgctccagactccagaaacggagcgtgctgcaggtgaatggtga

SEQ ID NO: 62925 - DNA, 2922 bp, Glycine max
  Peptide Sequence Number=SeqID_179703
atgggctctcaccatggccactcgaaggagtttctggacctcatcaagtccatcggcgaggcccgatccaaggccgaggaggaccgcatcgtcctccgtgagatcgaaaccctaaaacgcctcctcaacgacgccgacacaccaaaacgcaagatcaaggagtacatcatccgcctcctctacgtcgagatgctcggccacgacgcgtcgttcggctacatccacgccgtgaagatgactcaccacgacgccctcctcctcaaacgcaccggctacctcgccgtcacgctcttcctcagcgacgaccacgacctcatcatcctcatcgtcaacacaatccagaaggatcttgcctccgataactacctcgtcgtttgcgccgcgcttaacgccgtttgtagactcatcaacgaggagaccatccccgccgtgctgccacgtgttgtggatctgcttaaccactccaaggacgccgttaggaagaaggccgttatgtcgctgcaccggttttacctgaaatctccgtcctccgtttcgcatttgctttccaatttccgtaagcggttgtgcgataatgatcccggagtaatgggcgcttctctgtgcccgctttttaatctcgtttccgatgatgttcactcttataaggaccttgtcgttagctttgttaatattcttaagcaagttgcagagcataggttgccgaagacttatgattatcaccaaatgcctgcacctttcattcagattaagttgctgaaaatacttgcattactgggaagtggggacaagcaggctagtggacacatgtacactgtgcttgaggatataattaggaggagtgattcaatgacgaacatagggaatgctgttctctatcagtgcatatgctgtgtggcttctatatatcccaatcctaagttgttagaggctgctgcggatgtaattgcgaaatttttgaagagtgacagtcataatctgaagtacatgggcattgatgcccttggtcggttgataaagttaagtccacatattgcagaacaacaccaactggccgtcattgactgcttggagattaaagcggttggtgattttgacccagatgatagtctgaaacgaaaaactttcgaactgttatacaaaatgaccaagtcctccaatgtggaagtgattgttgacagaatgattgattacatgattagcataagtgatgaccattataaaacttatatagcatctcgatgtgtggaacttgctgagcaatttgcaccaagtaatcattggtttatacagaccatgaataaagtttttgagcatgctggagatcttgttaatattaaggtggcacataatttgatgcggttgattgctgaaggatttggagaggacgatgatgctgcagatagtcagttgagatcatctgctgccgagtcatatttgcgcattattggagagccaaagcttccatcagtgtttcttcaagtcatctgttgggttctgggggaatacggaacagcagatggaaagtattctgcttcttatatcagtgggaagttatgtgacattgcagaggcatattccaatgatgaaaatgttaaggcttatgcaatttcagcactgttgaaaatttatgcatttgaagtagcagctgggaggaaagtggatatcctatctgagtgccaatcgttgattgaagaatcattggcatcacactctacagatttgcagcaacgtgcttatgaattgcaagctcttataggtttggatgtacaagctgttgaaacaataatgccacgagatgcaagttgtgaagacattgaggttgataagaatctttctttcctcaatgggtatgttcagcagtctttagaaaggggtgctaaatcctatattcctgaggatgtgcgcactggaatggggaatatgaacaatttcagaagccaagatcatcatgaaactttgcagcatggtctaagatttgaggcatatgaagttccgaaggctccaatgcaaccaaaagttactccagtttcatttgcatcctcagcagacattgttccagtacccgaggttttgtcttccagggagacccaccatatctcatcagtgggatcaacatctgaggctggatcatcagagcttaagctacggcttgatggtgttcagaagaaatggggtaaaccaatgtattcgtcttcaacatcatctgcctctgtctcgtattctacttcccaaaaaccaacgaatggggcaactcaggtggatggtgctacaactgtcaattcaaaagtgcgtgatagttatgattcaagaaagacacaggttgagattactccagaaaagcaaaagcttgctgcttctttgtttggtggttcaactaaacctgagaaaagatcatctacaagtcataaggtttcaaaatctagtgctagtgctgcagacggatctcagggatcaaaggctgcggttgtacccaatgacgtagctgtggaaaaaacaattcatcaaccacctcctcctgatttgcttgacttgggtgagccaactgtcactacagctcctccttatgtggacccattcaaggaattggaaggacttcttgacccaagcactaagtctgcaacaaatcataatgtagctgctgctacaaatgcccctgatattatgtcactctatgccgagactactgccagtggtggttattctatacccgtgagtggggggtatgatgtaaatcttttatctgaattgtcaaatgcagcagcaaaagctactagtggagaaacaattgtgacgtctttgccacaatctattatgggtcgaaatgctaaagattctttggagaaggatgctttagtgaggcagatgggtgtgaatccctcgagtcagaatcctaacttgttcagtgacttgcttggctaa

SEQ ID NO: 62926 - DNA, 264 bp, Glycine max
  Peptide Sequence Number=SeqID_179704
ggccctggggtttccagctctggttacgggcctctatagtcctacagggtgcccgttccccccgacaaggtcacatcatcatagggatcgtgcctgcaagacacccagtggacccaaagaagttcagcagggtcttggagttgtcaagctctaattacgggcaggcgcagggcgaaacaccacagcagcctggggatggccagcagagggcaacagacacaccgccatcacctctagatttcacctcagctcatccacaaaaag

SEQ ID NO: 62927 - DNA, 444 bp, Glycine max
  Peptide Sequence Number=SeqID_179705
atgaaagaacattttcacaagcctgtgagatcaagaaacacaagatttcctaggatagagggaatcacaagatttcaaaggatagaggaaaacacaagaaagcaaaaatctgggaagacaatatggatgaaagggcttctcgcgatcccaaacgctcctgataaacccctcgacaatagcatcacgacgcggtcccaaacgttccttgcgtggtttatgagcctgttcttagtttccacctccacctccacatactttagtcataagatggtacttgtcgagcttgatggagtcgacgattttatgctagggagagcagatctcaacctctttatgctcacgaacctcgcagagaatctgctcgatggtgatttgaattggagcgtgggttttgtctgtaaaccccaacgagattgggaagaagagtcttttccagatttgtaa

SEQ ID NO: 62928 - DNA, 1389 bp, Glycine max
  Peptide Sequence Number=SeqID_179706
atggcgaaagccgtagtcggagaagaaacgcgactcaaattggcggaggatcgtctcagccaatccgcagttccatccgaggcactcactcattccattgtgggtcttttaatcggaaagttcagctccgctttgggccgggccttcctcttcgatctcattcccaccccacacaacgactccggcgagcccgcctgctccctcaccgagcccgacaagaagaagggccccaaatctaaatccaaatccgagctcgctgattcctcttcccttttcatcgacaaggactgggtcgccgaacatgtccgccaggtttctagaatgctcgtcggcggcatcaaggtcgttggcctatacgtttgggttagcgacgccgcgttcaagaattcaaccataatgctttgccagaccgtgaagggtgttgctgacgcagcgccgggtttggacggtaactgggatgagagactgcttcttcacatttcttatagcccgaggaggtggaattgtagaaactgctcactgtcttcgaatattacatcaagtagtttgcggccttgtgattttaagatggggaaggtcttaacttcccttcaaacgttcaagtgcatgcacaactttaacctgaggttgcccatattacgcgacagtgcctcaaagttccagacgttgagtgatgttcttcgtcatgcaatatctattcatgccaaagagcttgcaggtgcaaaggccttgattgatggtaaattggttgttgagagtgagtcatattcatcagatggtgtgcatgaagttgaattgcttctttcatttctgaacgatagttctattgaagcatgcagccaaggagatgttgttggtattctttcatttagtggcttgatatgttcgtttgcatatctaaattcaaaagagccaatttcccaagccatcactgatataaagggagatataattacgagtctgcaaagtagattggatataatctgtgatgaggtagatgctgactctggtaacaatcatgatgttggaagccaagtaagcgatgaattatcagctgaaacgcctgttccccaactagtgttgcacttattgaggttgctgtgggatctatcacctaccgttgggttgtttcaaacaactgcagctaaagtggtgatcccatgcatgaagcttccgcctttggggagggtagatatatgcagctttagttcctgcagttcacagggagatctgattaacaatttaggcagaaaaggatgcagtcttccatttcctagaagagtctttgcaccatggttagcagtggtgtataccaactgctactgtgttgggtcattttgcattacctgtattgttgctgaaaataggttctttgttgaagagttttga

SEQ ID NO: 62929 - DNA, 1152 bp, Glycine max
  Peptide Sequence Number=SeqID_179707
atggtggtgaggaaagtggggaagtacgagattgggagaacgattggggagggaacctttgccaaggtgaaattcgctcagaacacagaaactggcgagagcgtggccatgaaggtgctcgatagaagcaccatcatcaagcacaagatggtcgaccaggttcttgcaagccgtactaagatttatattatattggagttcatcacgggtggtgaattgtttgataaaattatacaccatggccgccttagtgaagctgattctagaagatatttccaacagcttattgacggtgtagattattgccacagtaagggagtttatcacagagatttaaagcctgaaaatcttttactcaattcactaggaaatataaagatttccgattttggtttgagtgcatttcctgagcagggggtgagtatccttcggacaacttgtgggactccgaactatgtggctcctgagattgagagagcagagttttcatgcccttcttggtttccagtgggagcaaaaatgttgatacatagaattttggacccaaatcctgaaactcgtataacaattgagcagataagaaatgatgaatggtttcagaggagttatgttcctgtcagtcttcttgagtatgaagatgtaaatcttgatgatgtaaatgctgcttttgacgatgctgaggaaccaagggctgatcaacaatgtgataaggaggacatgggtcctctaatgcttaatgcatttgacttgataattttgtctcaaggcttaaatcttgcaacaatctttgatcgtgggcaggactctgtgaagtaccaaacccgctttatctctcaaaagccagcaaaagtggttttatcaagtatggaagttgtggcacaatcaatgggatttaagacgcatattcgcaactacaagatgagggtagagggtatttcagcaaataaaacatcctatttctctgtcatcctggaaatttttgaagtggctcctacattttatatggtagacattcagaaagcagctggagatactggtgaatacctcaagttttacaagaacttttgtagcaatcttgaggatataatctggaaaccgcctcatgaagcaagcaaatcaaggatctccaagaccaaaagcaagagacgatag

SEQ ID NO: 62930 - DNA, 594 bp, Glycine max
  Peptide Sequence Number=SeqID_179708
gatgatggggaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagaataaagtcggtgtaacggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggatgtgtttgatgagattgcaacattaggggaatggagtggaactacaggggcgggggaagccgttacatctttacagagtataactggccaagatatagcctttccaaatatatggcgctgtgttgcaattgagacaaaacagggatga

SEQ ID NO: 62931 - DNA, 261 bp, Glycine max
  Peptide Sequence Number=SeqID_179709
atggccagcacacgcttctcccggtggaagttatcgttggaccagcacacgctcttgcgacggaaggtgacgatggataggtactgcataatgcatgggcatgtagaaagactagcaaaggcaatggttaaaggggtaagatattatggtgcaacaagtggaggcttgaatcaacaaagaactggagtaaatctctggactcttgagattattttagtcaaacaaggaattgttcatctcgaggtgcctgttcaaaagtag

SEQ ID NO: 62932 - DNA, 165 bp, Glycine max
  Peptide Sequence Number=SeqID_179710
atggcgcgtaaggacgagcttgttaatacgccatggcagccgtgtccgatcaagacactagtgtatgcactcactgtgatcgggctattccttcggcaaatattgatttgcattttgttcattgctctcgaaaccttgaaagatgccaaatttgtgacgacatga

SEQ ID NO: 62933 - DNA, 1812 bp, Glycine max
  Peptide Sequence Number=SeqID_179711
atggatttagtggcaccaaccgaacagttttgctcatttcaccccttccacataaccagagctagggtttcggataacaccgtttctcgtcctttcgttctatctcctgctagtagtgttagtcatcattttacaaaactgaaggcaactaggtctagaaagcgtttagaaaaccgcgtttctgcggtttcgaagtccgaagcttctggcatgaacggtagattgcaacaaattgttagcaccccaaacggggacttgaatggcataggcatggaatcttcttcgcccaacggggtgaacggttcccggagcttcgaggagtttgcgagtaacattcatctccggaagttggttagaaatggagagttggaggaagggcttaagtttcttgagcgcatgatttaccaaggggatatccctgatgtcattgcttgcaccagcttgattcgcgggttttgcaggagtggaaagactaggaaggcaacgagaatcatggagattttggagaattctggtgctgttcctgatgtgataacttataatgttttgattggtggttattgcaaatcaggggagatagacaaagccttgcaggttttggagcgaatgagtgttgctccggatgttgttacgtataacacgattctgcgtagtttgtgtgatagcgggaagctgaaggaggcaatggaggttcttgacaggcagatgcagagggagtgttatcccgatgtgattacttacacgattttgattgaagcgacttgtaatgatagtggcgttggtcaggcgatgaagctgttggatgagatgaggaagaaagggtgcaaacctgatgtggtcacttacaatgttcttatcaatggtatttgcaaggagggtaggttggatgaggcgattaagtttttgaataacatgcctttatatggttgtcaaccgaatgtgattactcataatattattttgcgtagcatgtgtagcactgggagatggatggatgctgagaggctgttagctgatatgcttaggaagggctgttcccctagtgttgttactttcaatatcttgattaacttcttgtgccggaaacggttactgggtagagccattgatgtcttggagaaaatgccaaagcatggttgtatgccaaattccttgagttacaatccattgcttcatgggttttgtcaagagaaaaagatggatagagcaattgagtatttggaaataatggtgtcaaggggttgttaccctgatatagtgacctataacactttgcttaccgcactatgcaaagatgggaaggcggatgctgcagttgaaatactgaatcaactaagtagcaagggatgctctcctgttttaattacttataatacagttattgatggtcttacaaaggtgggaaaaaccgagtatgctgcagaactgttagaagagatgcgcagaaagggtcttaaacctgatataataacatactctacactgctccggggacttggttgtgaaggaaaggttgatgaggctataaaaattttccatgacatggaaggattaagtattaagcccagtgctgtcacttacaatgcaatcatgttgggactttgtaaggctcagcagactagtcgtgcaattgatttcctggcttatatggtagaaaaaggatgcaaacctaccaaagctacatataccattcttatagaaggcattgctgatgaaggattagccgaggaagctttggagctgttgaatgagttgtgctccagaggatttgtgaagaaaagttcggctgaacaggtagcagtcaagatgtag

SEQ ID NO: 62934 - DNA, 207 bp, Glycine max
  Peptide Sequence Number=SeqID_179712
atgaatgatgaggttaccgagggaggcgtactgacgacgacgacgaaatctgacagatcaagagacacgtgtcatacaactgagtgtgtggaaataaccttactatgggaaacagcggtgccggaagtgcataacagaaaacagagccgcagaacacagcactttatacgttgccgtataattgcagaaatctgtcttgttccgtag

SEQ ID NO: 62935 - DNA, 1284 bp, Glycine max
  Peptide Sequence Number=SeqID_179713
atggataatggcatagtccaagttaccttatcaaatccagatggaattgtcactgggatacgatataatggtgttgacaatttgcttgaagttctcaacaaggagactaatagagggattaaaggaacgtgttttaaagttatagttcaaaatgaggaacaggtggagctttcatttgcaagaatgtgggatcattcactagagggaaagtttgtccccttaaatattgacaaaagattcataatgctccgtggttcatcaggcttctactcttatggaatttatgagcacctaaatggatggccagattttgatattagtgaaacaaggatcactttcaagcttaggaaagacaagtttcaatacatggctatggcagacaataggcaaagggttatgccttttcctgaagatcggttagcaggaagatgccaaaccttgggctacccagaagctgtcctgctagtcaatcccaaggatccacgattgaaaggagaggtggatgacaagtatcagtattcatgtgtaaacatgaataatcgagtccatgggtggatatctttcagtccaccagtgggattctggcagatcacacctagtgatgagtttcgttctggtggacccctcaaacagaatttgacctcgcatgtaggccctaccacgcttgcaatgtttcttagtagtcactatgcgggacaagatttggtgcctaaatttagaggtggtgaatcatggaagaaggtttttggtcctgtatatatttatcttaattccggagcagttggtgataacccactttggctatgggaggatgcaaaaatacagatgatgaatgaagttcaaagctggccatattctttcccagcttcagaggattttttaaaatcggatcaacggggcaatgtcagtggcagattacttgtcttagacagggatggtcccacattgtgggaaataggtattcctgatagatccgctgcagaattttatgctcctgatcccagtccacaacatattaataagctttttatcaaccatccagacaggcagtatggattgtgggataggtattcagaattgtatcctgatgcagatttggtttacacaattggtgttagtgactatacgaaggattggttttatgcacaggctccgaggaaaaaagtggataacactcttcaaggaacaacttggcaaatcaagttcgaaatctgtagtgttgttaaaggaagtacatacaaactgagagttgcaattgcatctgcaacattagctgaattgcag

SEQ ID NO: 62936 - DNA, 261 bp, Glycine max
  Peptide Sequence Number=SeqID_179714
atggaggagatgtgtgactctggaagaggtgatagaggtaactttcattatacttgtaagcaagatgggcatgctcaagacaactgctactctttacatgggtttccatataaaattgctaaggtttctcaatctctaaatctggctattgagcagaagattaagtcagagagaaatcacctgagtttgttctcagccaatgaatacaaggggtaccttcagcttaggaagcccaatgagccttttcttcagccactatag

SEQ ID NO: 62937 - DNA, 237 bp, Glycine max
  Peptide Sequence Number=SeqID_179715
atggcgttgatatgcgagatcgtgacttgttggcatagaatctctaaggcataccaaacaacttgtgaggatccagttattctagaatgtatggttgagcagcagatcttgccaacgccaaaacgagagtctggactggctttgacagaacttgttacacaatgtgcacaatgtagagttggactggctttgacaagtcaccctctagtgttgaacaaggaagaaaaaagcatataa

SEQ ID NO: 62938 - DNA, 2214 bp, Glycine max
  Peptide Sequence Number=SeqID_179716
atggggcgagtcattgggcttacaggtgtcagaaatggcttccataatatgctcctcctccaggctacgacgtcgtttgcccctggtgagtttgggactgatgacataacccaccttatggtagtcttgaatgtgtgtagaatcatgaaattttgcgcaatgtaccgtagcagacatggctcttggctcccatggatatcccctctgaaattcacaaaagcggaccctccccccgaacccctcccctcacctccgagaaaacgcaagcacatctctcacgactccgccatcgacttaatcaaacgcgagaaagatccgcagcacgccctgaatatattcaacatggtatccgaacagaatggctttcaacacaacaacgccacctacgccaccattctcgacaagctcgctcgctgcaacaacttccacgccgtcgaccgcgtcctccatcagatgacctacgaaacctgcaagtttcacgagggtattttcgtcaacctcatgaaacatttttccaaatcttcccttcacgagaaactgctccacgcgtacttctccattcagccaattgttagggaaaaaccctcccccaaagccctcagcacttgtctcaacctcttgcttgattcgaatcgcgtcgatttagcgcgaaaattgcttctacacgccaaacgggatttaactcgtaagccaaatgtgtgtgtgtttaatatcttggttaagtaccattgcaaaaatggggatcttgattctgcttttgagattgtagaagaaatgagaaactctgagttttcttaccctaatttagttacttactcgacccttatggacggactctgccgaaatgggagagtcaaagaagcctttgatctgtttgaggaaatggtttcaagggatcacattgtgcctgatcctcttacttacaatgttttgatcaacgggttttgccgcggagggaaaccggaccgtgctagaaatgtgattcagtttatgaagagtaatggatgttatccaaatgtgtataattactcagctctggtggatggtttgtgtaaagttgggaagctggaagatgccaaaggggttttggctgagatcaagggctctggtttgaaaccagatgcggttacttacactagtttgatcaatttcttgtgtaggaatgggaaaagtgatgaagctattgagttgcttgaagaaatgaaggagaatgggtgccaggcagattctgttacattcaatgtgctacttgggggtttgtgtagagaaggtaaatttgaggaagctctggatatggttgagaaactcccacagcagggtgtgtatttgaacaaaggtagttacaggattgttctgaactccttgacccaaaaatgtgagttgaaaagggcaaaggaattgttggggctaatgctaaggagggggtttcagccccactatgctacctcaaatgaattgttggtttgtctttgtaaggcagggatggttgatgatgctgctgtggcactgtttgacttggtggagatggggttccagccaggacttgagacttgggaagttttgattggattaatctgcagagaaaggaagttgttattttctattttctattccatgggaattggaggttctgctcttggaccacattttgttgcagaagcattggcacctgataatcctccactcaaggatttaatgacgactttgccttctttcacttctctaccacagataagatttgtggacaacacggatcctgctggagttgatcatcagattgcacagcttgggttggagctagcttcaacacttgtgattgtgatttcaaagagtggaggtaccccagagactagaaatggtttattggaagtgcagaaggcctttcgtgaagcaggcttggatcttccaaaacagggtgttgctattacacaagaaaattctttgttggataacactgccagaattgagggctggttagctagacttcctatgtttgattgggtgggaggtagaacgtcagagatgtctgcagttggcctgcttccagcagcccttcagggcattgatattatagaaatgcttgccggtgcatcattgatggatgaggctaatagaagtactgcgttaaggagtaatcctgcagctctgctggctttatgttggtattgggctacagatggtttaggatccaagttgagaattatgatcggttag

SEQ ID NO: 62939 - DNA, 639 bp, Glycine max
  Peptide Sequence Number=SeqID_179717
atggtaggggcatccgttaattggttcccccgatggaaggaaggaagaaccgaggttttatccttatgtgaggggttctcaaacatccccttgatgggaacaatgggttgtatcaattataatctcatccttgccataagacaacttggctaccccatgagaggagcgtcgtcggaagaaagtatcacgcccttcatcgcacgaggtttcactgaccctaatgcaaggatatttcaaggagtccgaaaggcatggaacgtggtgcaaagaaagcataaggagcttaggggaagcatcaataggatcatcgacagctatcacaagtggttgaaagctcagacgcaagagttagtttggctcccgaatctaaaggcatcaagtgaggaagaggctgaaacccctgaggagagtgaggaggtgcaagccttgaacgcggaacttgaaagggcacaagtagtccaggaaaagttcaagatgacaactatcaaggtccgaaaagaatgtgacaaatcgagagacgtcaatgtggccattgccaaagcattggaacgggaaacaaagagggtcccaaaggaagaatggggccgagacaagttccgaggggcattgtgggataacaacagtgagctcaagctttga

SEQ ID NO: 62940 - DNA, 306 bp, Glycine max
  Peptide Sequence Number=SeqID_179718
atggggggtgtaaatagcaatctgacccacttgggccttcctgaagattacaaaaagagggtggggaaggagggcagaaggaaagggttcagcccttctggtattgaggaatcactcaaaattagtgagaaaaattgttttcatggaaaaaatccaagccaaggcacttccgtaacgcttctgagacgtttccttaagcgatttcatggagattcttcaccgttcttcatcattcttcgctgttcttcggtcttcaaccggaagttcccgaaatcgaatctttcaattcattctacttacccttag

SEQ ID NO: 62941 - DNA, 291 bp, Glycine max
  Peptide Sequence Number=SeqID_179719
atggcgtcggaggacatagaaaagatggcattcgtcaccctgtggggaacgttctgctacaaggtgatttcctttaggctcaagaacgctggggcaacctaccaacgggctatggtagcattattccacgacatgatgcataaggagatcaaagtctacgtggatgatatgattgcgaagtctaaaattgaggaggaacatctcgatcaagcgatgccttatgaatccttcggtgcttgtgccacccgtgccgggaagaccccttattctatacatgactgtgctggatga

SEQ ID NO: 62942 - DNA, 294 bp, Glycine max
  Peptide Sequence Number=SeqID_179720
atgagaacggcgattctagcatgttgcactgcgcattctgctgcacctgcatggcctgtgcccctgacgcctagccctgaggcctacgtggtgggaactcgccagtcaaactggcggttccccttgctgtgcatgtcgccacttggaatgatgagttcaaggttgcatgtgcatatcgccactcgtagtggcgagtccttcaccaacagcaaacccgccagtcccattggcggtttgcttgcaccatgcatgcattttacgtccaaaagagcccccttggataaattgttttaa

SEQ ID NO: 62943 - DNA, 750 bp, Glycine max
  Peptide Sequence Number=SeqID_179721
atggggtacctcatctcccaccagatctccctcactgctcagcatgacacatccagacttggattcccgaccttgattactactttatgtaaggctaggggagttcagtctaactctagatccttggagagcctgaatcctaccattaatttggcttatattaagaagaactgttggaatcttgatgatccaacagtaactttcagaggacccaggaaggccagagggaatagatctgaggccccttccacttcagcaccatcagaggcaccaacaccttcttcttctacacttcctccctcttcctccacaaagatcagattgattcctccagcaccttcacagattccacttccagctccagtctctgtaggtccagcagattttattttcactcctcaaatgattcactccatgctccagagcatccatagggtgcagtacatcatcatgcagagccttcagggcttgggcttgccctccattataagcatagaggagtttgatgcacaggtggcctggccaggagaccaaccttcttcctctggagggggtggggcctctacagcccaggagcctatgactgaggagccaccagcaccagcaccatcaccaccagcagcagaggaggagactactctagcccagaccccacaaccatctccaccatctgcacctactcttgaggagattcagccatcagcaatggatcttaatgaagaccagccacaggaggagccggatgtttaa

SEQ ID NO: 62944 - DNA, 906 bp, Glycine max
  Peptide Sequence Number=SeqID_179722
atgagaaaacatagtgccattaatggtggtaaatatgtctccgtacatcttcgttttgaagaggatatggttgctttctcttgttgtgttttcgatggtggaaaacaggagagagaagacatgattgcagctagagaaagaggttggaaagggaaatttacaaaaccaggacgagttatacgtccaggagcaatcaggatcaatgggaagtgtccacttaccccattagaggttggcctcatgcttaggggaatgggtttcacgaagaacacatctatctttttggcatctggaaaaatatataatgctgagaaaacaatggccccactacttcaaatgtttcctaatttacatactaaggagaccctagcttctgaagaggagcttgctccatttaagaattattcttccaggatggctgctattgattacacagtttgtcttcacagtgaggtgtttgtcacaactcagggaggcaacttccctcattttctgctgggtcacagaagatacttgtatggtggacattccaagacaattaaaccagataagcggaagttggcgttactgtttgataatcccaatatagggaacaaaatcatctttgctaatgatacatttgacgctaccaaactgctggacgatgcagtttttttgttatggacatggcttcgaaacttggagaaggattttgttacccattacaaccactggtctagtaacattacaagtggttttagtagatggaaaagtctcaagcgtcaactgctgagcatgaggtcgcatagtgattccaagggagttgagctcaagagaccgaatgattctatatacagctttccatgcccagattgtatgtgccgtgccaacagaactgacgattcgagatcttcatcggcaacttga

SEQ ID NO: 62945 - DNA, 582 bp, Glycine max
  Peptide Sequence Number=SeqID_179723
atgaagccaatgtggtctcagaaacttccaaaatctagatctcttcatgagattgagccagcattcaaaaagttttcttcttctgagaaagtttcaagtttgatgcgctccttaggttacaagagacctgcagtcatgcagtcaatgtatatatttaagcaaccaggcattgggggtgaagtagtgccacaccaggataactcgttcctttatactgaaccacaaacatgcaccgggctgtggctggccctagaagatgcaaacatattaaatggttgcctttggacaattcctggatctcacaaaaatgggcttgctagaagattcttaagagatgaagatggtgtcaaattcgatcgaccatcaccttcttatgatcaaaaagattttgttcctattgaagtaaaagctgggtctttggttgtcatccatggtgatcttatccaccaaagctttgaaaaccagtctccaaaatcaagacatgcgtacagcttgcacgtggtggatatggttggctgcaaatgggcaccagaaaattggatcagacgaaaagttgagccagaaccactctttgtaagctga

SEQ ID NO: 62946 - DNA, 175 bp, Glycine max
  Peptide Sequence Number=SeqID_179724
atgggatttaaaggatgtcaaagtgggatcaatgcaagcaaacttttcttagatttttggaattgtagagaaatcattgagaatagtacttcaaactctcggggaaggaatgacatgaagaccttgaatgatgaaggaatgaaattgggggttaccaggggaggggttgattggg

SEQ ID NO: 62947 - DNA, 1014 bp, Glycine max
  Peptide Sequence Number=SeqID_179725
atgtctgattcatttggtagcacctttcactcttccactccaaactccaccctcaattcccatgcaccccccaaaatcaccacattctgctcaatagcccaaccttattgcatttgcacccactgcaaccacatcctcaccttcaaccaccatgttggtaatgtagcagaggaagggacaaatagcacagggtcccataataataatttgcagtcccagcagcaacaaagcacaaggtggagtccaaccccagttcagttactagtccttgaggaattgtataggcaaggcacaaaaacaccctcagctgaacaaattcaacaaatagcttcacagttacgccagtttgggaagattgaagggaagaacgtgttctactggttccagaatcacaaggccagagagagacagaagcggcgtagaagggaaatggaggaaaataataataacaatatttctgcttcttcttctggtgaagggttgaaagagacaggttgtggagttaaagagacaaagaagtgggcatccacttcaaactgcagtggacatgcagaggactctgctgcactggatatagcagaaaagggatctaatgggtggactcagtttgaggggaaagacagcatacaagttttgatgaggagaaacatagccgaaaaacaagctaagttgcaggaaattatggaaatgccttgtttccctcctgttactatggaagcatcaactcctacaacttcacacagaagaacaacgcattataacacacaacttttaacccctcaaaactataataatttaccatcttcagtcatcaacagagaaagtttaaactactatggtggtgaagaaaatgcagctcctcgaacccttgacctatttccacacaagagggatgaccaacatggaatttctcttgctgagaggaaatcatctatgttctgtgcaagtgcttctatggacactgaagtcacctccaacaaccagttttttgagtttcttcctttaagaaactga

SEQ ID NO: 62948 - DNA, 490 bp, Glycine max
  Peptide Sequence Number=SeqID_179726
gaacagggtcaacctgtgtgatgccggggatgtcgttgattccgagggaatgaagcatgtcaagggtttctttgtcgacttcgatgtggtcggtgttgatggcggagacgtcggggacgaagtccatgcggcgctcgcgctcctcctcctggagcttgagggagatgccgcgaacgggacccttctggatgcgcttcatgagatgcgtggagaaacccgcgatcttgttccgcagcctcttggaagggatgatggccacttcttcgagaagctttttgtttgtgtggaagatttcttcaccgtttttgttctcacgcgacccattgtgtgtggtggtggttgttcttctgttgccgccgccgccgccgctgaggagaagggtggtggtggtagtggaggaatggcaaaggacacaatggaaggggttaaggaaaaaggagacatggaggggaagggtttccaaagaagagaaatagtggcaattgggtga

SEQ ID NO: 62949 - DNA, 459 bp, Glycine max
  Peptide Sequence Number=SeqID_179727
atgggtcgcgtgagaacaaaaacggtgaagaaatcctcccgccaggtgattgagcgttactactcgcgcatgaccctcgacttccacacaaacaaaaagcttctcgaagaagtggccatcatcccttccaagaggctgcggaacaagatcgcgggtttctccacgcatctcatgaagcgcatccagaagggtcccgttcgcggcatctccctcaagctccaggaggaggagcgcgagcgccgcatggacttcgtccccgacgtctccgccatcaacaccgaccacatcgaagtcgacaaagaaacccttgacatgcttcattccctcggaatcaacgacatccccggcatcacacaggttgaccctgttcctgttcaacaggccttccccttcaccaggagagaccagtatgcagttcctaatgttgcatctcacatccttactctccccagttcatga

SEQ ID NO: 62950 - DNA, 222 bp, Glycine max
  Peptide Sequence Number=SeqID_179728
atgagtgatttgagtgtgcctaatatggtgattggcatgggaagggtggatgcggtgggtagttccaaaaatatgccagtagaagaacatacggtcactttcaaaactgtcgacaaaactgtcgacaattatcttacggtcactttcaaaaatcaatcacagtttggtagacgagatctgatgtccattgaagaacatactataaacttaaagatcaagtaa

SEQ ID NO: 62951 - DNA, 189 bp, Glycine max
  Peptide Sequence Number=SeqID_179729
atggctttatatcaaatatgttctggactcactacgaagaagttttttgactacattcagcttccaaattttgacatagttgcagatgccgcagcaacttttaaggagctaatgacaaggcataaatctactgtagctgatttccttagcaattattatgaatgggtagttttgacacttgtctattga

SEQ ID NO: 62952 - DNA, 324 bp, Glycine max
  Peptide Sequence Number=SeqID_179730
atgttgagtttgcgatgcgaactagccatggttcctttctccgaaccacgcgtcacggacaccgccatggctacgggagaagatggttatggttacgaacacgatgattcgctgaatcgaatgcggttccatgaaactaacaagatggctcgtcgtttggaagttggaggttggaactatctaactagtcacgacatggaagagagattggagagggtgctgcggggtgaagacatcggagagggtgctgtgggggtggacggcgaaggagcggcggcgagggaagggagcgaggttggaggtggcggggctgagaaaatttga

SEQ ID NO: 62953 - DNA, 489 bp, Glycine max
  Peptide Sequence Number=SeqID_179731
atgaatgattctctggagaaataccctcgccgcgttttcatcgacgtgggggtgccggagaaggacggtgggagtggaatggagtggttttcgaagaattacccgacgaggaaccagaagtttgagatgtataacatagagacggtggcggaggagtcgtcatcgtcgtcgttgtcgccggggaaggagcaaatagagatgtcggattgggttcggaagaacgtgaaggaggaggagtacgtggtgatgaaagccgaggcggaagtggtagaggagatgatgaagagcaaatccattgggctggtggacgagcttttcttggagtgtaagccaaaacgcgagaacagaagctcagggaattccagccgaagggcctattgggagtgcttggctttgtatggcaagttaagggacgagggtgttgcagtgcaccagtggtgggatggagataaaagactcaaaagagacgaagagactggtgagagctga

SEQ ID NO: 62954 - DNA, 1746 bp, Glycine max
  Peptide Sequence Number=SeqID_179732
atgccacattcatctgatagactcttaagatcattcttaaggttagacgttttatgctggtatgctgaatcatacctgcctctgggaggttctgtgtcccctgatatatacacggactcagaagaagagagtggatctgagagtgagggggcaactgatgatgatgatgatgatgatgatgatgatgattatgaagatgatgatgatgatgaacaagatgaatcaatacacgagtctgatgcagatgatgatcttgttagtgaatcgtacagtggaactgtagattctgaggccgatgatgaggaccatgatcatgctagttcaagttcgaaatcctctggtaagagtgaaaaattgaaagccactcggaagttatcatcaaagtcacttgaaggctcactgactcaacatgaagatttcaaaagctctgaactagtcactagttcaaagaagactggctatatagatcagtccaataagcctgctgatatagttggaggagtttccactaatcaagctacattgcataattcaaattctcctagccctgcttcgtgtatcaaaaaatccaataccatgtccaatggcccagcacctcggcatcgcaccacattggggcgcacctctgcaaggaagaatctttccatggaatccattgattttcctcttgaagatgaagatgaaattgaaaggcttgaagctgccaggacagaactacaaacccaaattgacgaggaggtgaaggcaaatgaaaagctgcaatctcatgtggacaaacaaaagaaagccttggaagagcgtcatctggctcttgagcaagatgtggctagactgcaggaactgttgcacaaggaaaagaattctcgggtggctcttgagaacaaagcagagcttgaggaattagctctggtagaagcagatcttgccaacttagagtggaaggttgatgagattggggtgaggcttaatgcacaaattgagcggaatcatggaagtacttcagattcctctaataaaccacgacagatatcaaatcaagaaagaaaattgaaacacaaggtagatgctgaagttgctgctacgccacaatttgacagatcaataagtaaggacactaatattggtggagcagaaaatgatattgagagaaagcctgaatcaacacctttaccaaacaaacacccaccaactagctccaagcgatctggtacaaagggtgagggagcaaattccactccttctgcactgacaaaactgacatccagactgaactttttgaaggtgggacgaagtcagactcaaaatgaactccaaagtatggataaaggccgagactcaagtcgctattcaatcaatgtggaaaaagggaaaggatatgaacgtccccaatcacttccatcccccaaactaccatctcctagacttccatctcctagacttccatctcccaaacatctatcccccaatagatttggagggtctgaagctcagtctgtgccaaacccagaaaagggtaaagggtcagaggcagttcagatttcagagaaaggactgagcaaaggtaaatcgcatcaaagttcagagaaactgaaaaaatcagatagccagccagcccatcactcagatggatggaatcaacaaccaaaacaattggagagaggaagatcagagggtcatcagacttataatgcggataaaggaaggtcagagggtcatcagacttataatgtggataaaggtcgatga

SEQ ID NO: 62955 - DNA, 645 bp, Glycine max
  Peptide Sequence Number=SeqID_179733
gatttttccaacccacccactcgtcgcaggctgcaccacccacccactcgacctcatcaaagtccgaatgcaacttcaacaaacccacactctccgcccagcctttttcacctttcacgctcccagcccaatgccgccgcctccgtcctccggccccgtctccgtcggcctccgcatcgtccagtcggagagcctcgccgcaactacaacggcgtgttcgacgcgatacggcgcatgagtaaccaagaggtcgttggtagcctgtggcgcggttcagtgcttacggtgaaccgcgcgatgatcgttacggcttctcagttagcctcgtacgaccagtttaaggaaactattctgggacgcggtttgatggaggacgggctggggacccacgtggcagcgagttttgcggcgggttttgtggcgtccgttgcgtcgaaccccattgatgttataaagactagggtgatgaacatgaatgctgaggcttacaatggagccttggattgtgctctcaagactgttagggctgaaggacctcttgccctttataaaggtttcatccctacaatttcaagacagggtcctttcaccgtcgtcctctttgtcacccttgaacaagtcaggaagctgcttaaggatttttga

SEQ ID NO: 62956 - DNA, 774 bp, Glycine max
  Peptide Sequence Number=SeqID_179734
attttcaagagtggaccacttttaatatcttctaaaggaattggatggacatcctggaagaaaaggtggtttattttaacacagacttcacttgttttcttcagaagtgatccaaatgctgtccctcagaagggaaatgaagtgaatttgacccttggtggcattgacctcaacaattcaggcagtgttgttatcaaagcagataagaaacttttgactgtacaatttcctgatgttcatgatggacgagctttcacacttaaggctgaaactacagaggatttatatgagtggaagactgcacttgagaatgctttggcactagcacctaatgctgccaatgtgacagagcaaaatgtgaaggatagagaaccagttaagtctactgtcgttggccggccaattttacttgctttggaggatgttgatggaactccatcatttttggagaaagccctaacattcatagaagagcatggtgctaacatagaaggaatcttgcgacaagcagctgatgttgatgaggttgaacgtcgagttcgggaatatgaacaaggaaaagttgagttttctccagacgaggatgcacatgttgttggtgactgtgttaagcatgtaattcgtgaattgccatcttctccggtccctgcatcttgttgtaaagcactgttagaagcttgccgaactgagcgtggtagtagggttgctgctatgcgtgcagcaataaatgacactttccctgaaccaaatcgccgcttactgcaaagggtttaa

SEQ ID NO: 62957 - DNA, 744 bp, Glycine max
  Peptide Sequence Number=SeqID_179735
atgacgaaggaagctgctgggatcttttttctcttcaaccatacatggctattcatagactggaaagtaatcttagaatttgaaccgaattgcagcttaatggtgaaggcatctacttgcccaggctatttgaataaggtagtggaaaggtttaggatgcatcaatctaaacctataagcacaccttttaagctctcaattactcaaactcctaatattgaagaggaaaggaggaagatggatactattccatatgctagtggagtaggaagcatcatgtatggtatggtctgtagtagaccagacttggcccatgttgttagcattgtaagcaaatttatggtagatttgggtcaagttcattgggaggcttcaaagtggttatttggatctctaaaaccaggtctaaagtacaagaaagcagctcaaggtggagatactattagggaaggaatgaaggaagctctatgcttaaaagggatgattggtgaatcgggaattgtagaaaactatgtgacaattcattgtgacagccaaagtgttgtacaccttgcaaatcatcaagtttaccatgtgaagacccaacatattgatgttaggcttcacttcacaagagatgtggttgaatctgaaaaagttagaattttgaagattatgcccgatgacaatcctattgatgtgttcacaaagtctctaccaaggtcaaagttcaaacattggttggacttgattaatttctcttga

SEQ ID NO: 62958 - DNA, 1006 bp, Glycine max
  Peptide Sequence Number=SeqID_179736
tgtgagagaaaatgtgattgatgtgagaaacataagagagaaaaatgtgattgatgtgagaaacataagagagaaaacactgggtacgaagagagaaacaaagaatggagatgttattcctgtggattttaatgagttttgcaagaaattgggaattaagaggcataagactatagcaggaactcctcaacaaaatggcctaaatgagagaatgaacaggtccattttagaacgagtgagctgcatgcttttaggagtagacccctatggaagtgtggagatggaaatcaataaactcttccaacttgagggtgtttgttctttggcatttgcacatgtgaaacaagaaaaactagagccctgggctgtgaagtgtatctttattaggtacatagatggagtcaagggttataagttgtggaagctagatcccgaagagtcaagatgctttatcaacagggataccacatttgttgaaaccatggtgatgatgtgcaaaaacttggaagggagaaaggagaaaacccagcttgaggtggagtctcctattcatgattcaagacatgaagcatatgaggaactaaggaacttcaaggaggctatagaggaaaaagaaagtcaatactggttaccaaccatgaatgaagaaatgtatctaggtgtggagaaggcaaggtacaaggcaagacttattatggctaagggttttacacaagtggagggagtttattacaatgaaattttctcacctgtggtaaaacactgttttataaggatcttgatggcaattataaatcagtatgatctagagttaaaacaattggatgccaagacaactttcttacatggagaccttgtagataccatctatatgcaacaacctgaggggtttgcggaagatcagatgaagatgagggatcctagtactgtaaggaggatttttgggatggatattgtttcacatttatcaaatagtttgtctccacagggactcgagtttacttaa

SEQ ID NO: 62959 - DNA, 246 bp, Glycine max
  Peptide Sequence Number=SeqID_179737
atgtgtggtgccaatatgttgaatcaggcaaagccttatttgttaattgtggggttgcaatttgggatggctggaacattcatcatcatcaaggccactctggatcatggaatgagtcgttttgtgttaactgtctatcgcaatgccattgctgcgattatgcttgctccttggtgcaagaacgttaggccgaaaatgacaatgtctgtcttcatgcaaatactagcccttggatttcttgagtaa

SEQ ID NO: 62960 - DNA, 492 bp, Glycine max
  Peptide Sequence Number=SeqID_179738
atggcatctaggaagaggaagagcactgcttctagacccacagctcagtatgataccaggcgattccaatctttggaagcttggaatagatacattgacaacattctcggctggaatatccttccagagagaaatgtgaagctttatcatactgagttcgacgagttcaaggtggagttggagagacgtaatctacacaaacgccttgccaacctccaagatggaagcatagatgtagctgtggtgaaggagttttgtgctaatctatacagcccagaggaccaagcttctaaacaagctagagtaagaggacatctgattaagatcgatgcagacagactgaatgaatttcttcagactccagtggtgttagaggagggggaatctttacccacctactctagattttgcaggttgaggactaaccaccaggagattaaagttaggctttgtattccccgcaaggggtttgttttgaatgctaagggctag

SEQ ID NO: 62961 - DNA, 774 bp, Glycine max
  Peptide Sequence Number=SeqID_179739
atgcaatacacttcggcttcatttgcatcagctatcatgaacgccgtaccttctgtaacctttgtgctagcagtaattctcaggttagagcgtctaaagttgaaggagttacacagtcaagctaagctgattggaaccttggtaagctttggtggggctttgttgatgacactttacaaaggtccccaaatcaacctatttgatcatccaaacactacccaccagaaaatagatgaaagcaattcctatcagggtcagaaacactgggtcacagggaccctatttttatgccttggttgtttggcttggtcctccttttacatcttgcagtccataacagtgaaaaggtacccagcggaactatcactgtcatcgttgatatgcttcgcgggtgctttgcaaagtgccgtggttgctctgattgcagatcatagccctcggacatgggcgatcgatttcgactacacgctctatggccctctttatgctggaataatgagttcaggaatagcctattatgtacaagggctaataatgaaaactagaggcccagtgtttataacatcttttaatccactattaatgatcattgttgctaccttgggctccttcgttctaggagaacagctctacttaagaagtatcattggtgccatcattatcgtagcgggtctttattcagtggtgtggggtaaagcaaaagactatccaatcttcacaccaccgtcagcagcaacaaaacagctcccaattagttcgtcacttcatgaatag

SEQ ID NO: 62962 - DNA, 117 bp, Glycine max
  Peptide Sequence Number=SeqID_179740
ctatgtcaaagcttagagggcaatgttggtgcactcacaaattttgaggtccttgatttcttacgagctaaaggagcttcaaaggatccaacaagagttattgccaaagtagcatag

SEQ ID NO: 62963 - DNA, 158 bp, Glycine max
  Peptide Sequence Number=SeqID_179741
gtatgccgtcaagcctctggcgacgacaacattggaaagcacggaccaaaggtgacgcagaggtagctaaaggcaccgccggtgacgggcatgtcgacggcgaactcggtgtagcagaaggcggagaggagggcacagaatccgacaatggcaattaa

SEQ ID NO: 62964 - DNA, 306 bp, Glycine max
  Peptide Sequence Number=SeqID_179742
atggtgtttgaagactttgatcctatctccagtaaacccaaagtggagtgggcttctcaaagttcttcttccttatgtccctttttccttcatgcctatgcccctgattcttctcaccttgtaattcatgtcaccaatatctatgagggctgggaaactcttctttcgctctctatgcttgaggacattagggatatggttggaatagggtgctcttggtcagactttgctaattattttgcaacatctctcaagtcccaagatcttaacctggttctagagccagattcaaattctaatgcttag

SEQ ID NO: 62965 - DNA, 291 bp, Glycine max
  Peptide Sequence Number=SeqID_179743
atgacaaaatttagcagtcatatcatatggcttgatgcctcaaagcaagacattaactccaccatcatgtcatcaccgttgtgttctcatcaccatcgtgctaccgtcaacatcaaagctgtgaacccctccagcaatgtgctctcatcattagaaggtatgaacccttttcttgcattttccttgggacttcatatgaatttcgttggggctagagtgggcatggccattgatgacattggggtttggggtgtagtgaaaggagcattggggtttagagttgttgtctag

SEQ ID NO: 62966 - DNA, 495 bp, Glycine max
  Peptide Sequence Number=SeqID_179744
atgtttgactttttgagtattaagttgccttttattgctaaccgtggcataatgtgggtatcaggtatcagaagtcaatacaaccatatatgcaccatgtttccatggagacgtgctagtcatgcttacctagagaatgtgattcgatggatcaagatcacacaattgcaattgcaagtggcccacttgacagaacaattggcttctcttcatctgcaaccacaacaccatgttcatgaagtgggatttaaggtcaatatgcttgattttgatgttgacattggacctattattgtagctgatgatgaaattgttatggatgctaatgaagaacctgatgggttgttgatatgcacgattgtagattcaaggatgaacctctacgaggaagtagggaatgatgtagaaatttggtgcaaccatgggctaagaagggatcaaagaggatgtcagggctctagtatagaaatccaccttcccaagagatctgtatag

SEQ ID NO: 62967 - DNA, 1140 bp, Glycine max
  Peptide Sequence Number=SeqID_179745
atggcgcaatggctggcccggcttgagatcctggcggccttcctcgaggtggctttcgatcatcacgccggtgatgcggcgatcgccgcggctgagctgggcggcgatgtcgcgcgccacgtcgacctggcgcaggtgcgacttgttggaattggcgtgcgagcaatcgatcatgacctgttcgcgctggccggcggcgcgcagcacggcgcaacaggcgtcgacgctggccgcatcgtagttcgggccttgcttgccgccgcgcaggatcacgtgggtgtccacgttgccgcgggtttcgaagatggcggccatgcccatcttggtcatgcccatgaaggcatgcttggcactggcggcgacgatggcgtcggccgcgatctgcacgccgccgtcggtgccgttcttgaaccccagcgggcagctcaggccggagctgagctggcgatggctgggactttcggtggtgcgcgcgccgatggcgccccaggcgatcaggtcggcgatgtattgcgggctgagcaggtcgaggaattcggtggcgatcggcaggcccaggccgctgatgtccagcagcagctcgcgggcacggcgcaggccttcgttgatgcggaagctgccatccaggcgcgggtcgttgatgtagcccttccagccgacggtggtgcgcggcttttcgaagtacacgcgcatgacgaccagcaggtcatcgcgatactggtcggcggcggcgcgcagctggcgcgcgtattccatggcctgggcgtggtcgtggatggagcaggggccgaccaccagcaccaggcggtcgtcgcggccgtgaagcacgtcggcgatgcgggcgcggctgtcttcgaccagcgtctggatctcggccgaaaccggcagttcgtcctgcagcagggcgggcgaaatcaacggccgcacggcgctgatgcgggtgtcgtccgtgcgggtgttgtcctgggtggcgtcggccgtgccgacctcgcggtcgtgcaggggatcgtcaatgcgggtcaagggaagctccgtgccatagatgcggaaaagagcgtcattatcgcaccggcgggcttcgtccgtccgggctatgtcccccacggtctaggccgatcggcggccgcgggggcgcaatag

SEQ ID NO: 62968 - DNA, 381 bp, Glycine max
  Peptide Sequence Number=SeqID_179746
atgaccctttgcttagctaacatgcacagctcatccttcttccagattcttcctcgcgctcagccgaggtgggttgcgctcagcggattgctcgctaagccaacagattggcttagcgagaagatgaaccattccttctttctggactcgtcatgctgccccaacatacacgccatcaactcatccaatacagtcatatataggataaggggtcttccaggcaccgatggcacaagcataggagggtttataaggcatcacttaatccttctgaatgccacttggcagtcgtcatcccagtggacggactggttcttacgcaatagcttgaagagaggctcacaagtggctgtgagctacaatatgaacctcgctatgtag

SEQ ID NO: 62969 - DNA, 462 bp, Glycine max
  Peptide Sequence Number=SeqID_179747
atggtcgaacaagaaaacagggaggtgaagccacaccaagaagaaacggaggttgtgagcttgggtgatggcgaggaaagaaaggaggtgaaggttgttataggcatgtccacaaacatccgagatgaattggtagctctgctacgagactaccaagacattttcgcttggtcataccaagatatgccaggcttaagtcccgacatcgtacaaaactgcgaaggatcaagctcgagatacgggttctcgggctacaaccaaataaagatggcaccagaggacatggagaaagacgatggggcaacctaccaagttatgttctttgggcttaagaacgatggggcaacctaccaacgggctatagtagcattattccatgacatgatgcacaaggaaatagaggtctacgtggatgatattattgtcaagtcaatgaccgaggaggaacaccttgtcaactaa

SEQ ID NO: 62970 - DNA, 219 bp, Glycine max
  Peptide Sequence Number=SeqID_179748
atggttagtcaaggcaacaaaaacatgtgcctcagggttcttcttggaaatgtccttggctttgtgtataatggtgttgctagtgtggtagccacggatgaagagcatgaagcagttgaccatcgacttgagtctgaggagcttggagaggtagtggtcggggtcgagaacaatgccgaagtaggaagttttgcgtattatgaattaagtaattcgtaa

SEQ ID NO: 62971 - DNA, 252 bp, Glycine max
  Peptide Sequence Number=SeqID_179749
atggcgcagaatgaccataatttgtctttgcatgccaccggacatgatcgcctctggatggcgaaaagggcacaaaatgaccataatttgtctctgcgtgtttatcacttgttgagtcctatagatagcaaaagcgtgtggatgaccataatttgtctccgcgtgtcatcgggcccctcgcctctggatgacaaaagggcgcagaatgaccataatttgtctctgtgtgccatcggacacgactgtgtctga

SEQ ID NO: 62972 - DNA, 360 bp, Glycine max
  Peptide Sequence Number=SeqID_179750
atggtgcctccacgaacacctccttttccttctcccccaattgaagcgaaaatatttctaattacgactcttcctccttttcactttagctttggttatttgtgtttgttgatcgacgactgcaagaagaatgtgtcagttgcactcatcgacatgcatagttgcagccttgaagctaaaattaaaatgaacctagatgctcaagttgtggaacaggttgctgaagttaagaagccagagaggaagaagcccaaatccaaagagcctatggtaaaaaaggctaaagttgagaaggggaagaaggtcaaggatcctaacatgcctatgcgtcctcccacaaccttctttgcattcttgtaa

SEQ ID NO: 62973 - DNA, 858 bp, Glycine max
  Peptide Sequence Number=SeqID_179751
atgggcaccaccttgatgagatgctcccacgcaaacgctctcttcagagctctcaaacccaaaccccgcaattcttcactgccactttcttcaatggccatcaacaaaggtaatagtaataaggcatatgatgcattgctgttggatgctgggggcaccctattgcaattggcaaagccagttgaggagatttatgccactattggatccaaatatggtgtgactgtggatccagctatgataaagcagggatttaagagagcatttgctgctccgtggcctgaaaagctgcgctaccaggtttatgccctacctttgatcattcttcttgtaatgttttgtgtgattgcccacttttgcatcgtaactctggaaagatggtgtatgatgggagatgggaggccattttggaaacttgtagtttctgaagccactggttgtggagatgaagattattttgaggaagtttatgagtactatgcaaaaggtgatgcgtggcatcttccagatggagcttttgaaacaattacttttctcaaggatgctggagttaagatggctgttgtatctaattttgacaaccgcttaaggaagctattgaaagatcttaatgttttaaatctgtttgatgctgtcattatatcatcagaggttggatatgaaaaaccagatccaagaatattccaagctgctcttgatgaagtaaatgtagaggcttgcaaagccttacacattggagatgatcagaaggcagataaactgggggccaatgctgtggggattgattgttggttatggggtatagatgtgaagacattctctgatatacaaattcgaattcttaattcagaggcataa

SEQ ID NO: 62974 - DNA, 117 bp, Glycine max
  Peptide Sequence Number=SeqID_179752
atggccttcataggctctttcactgctcctgtatcgcttttgaccgctctcaatcgtgcaaccacattcacttctcctaaagccagtgcctccaacaacgacttacactcaaaatga

SEQ ID NO: 62975 - DNA, 705 bp, Glycine max
  Peptide Sequence Number=SeqID_179753
atggacgtttccgagctcgccaagaagctcggtctctccgattccaaactcgttgtacggaaagctgccgagctccgtcgcctctgcgaagtccagttcgattcctccgtcattggagtcggcgaggttgcaaaatctatcatatgcttggaaatcgccgccatgagactcagcattctcttcgaccgatcctctgcggcgaggctgagcggaatgtccgaaagagcttacatcagatcctacaattcactccacaacggccttggcgtcaagatgaagttagatgtgagggaattggcgattcagtttggttgcgttcgcattattactctagttcgcgacggtcttaaattatataaggatcggtttgtttcgtcgttgccggcttctcgtcgtgcaagcgctgatttcacgcgtccagtgttcactgctgtcgctttttatctatgtgctaagaaacacaagcttaaagtggacaaacttaagttaattgagctctgtggtacatctgaatctgagttttctagtgtttctgctactatgaaggatttgtgccatgatgtttttggggttgcgaaggaaaagaaggatcctaagcaagtgcagtcaaatcgagatttgcttgatgttttgccaagtaaaaggaaagctgaggatggtggttattcatccgatgatggtccagaggaagctgttcctcactaa

SEQ ID NO: 62976 - DNA, 1959 bp, Glycine max
  Peptide Sequence Number=SeqID_179754
atggcaaaaccaagttcagctgatggtaggactagaagccatgtgcaaatctttatagtagttggtctgtgctgcttcttctatatattgggagcatggcaaagaagtggttttggtaagggagatagtatagcattggaaattactaagaaaggtgcagactgtaatgtagttcccaatttgagttttgactctcaccatggtggagaagttagcaaaattggtgaatttgagtcaaaatccaaggtttttgaaccttgtgattctcgttacatcgattacactccctgccaagatcagcggcgtgccatgacttttcctagagaaaatatgaattatcgggagaggcattgcccccctgaggaagaaaagttgcactgtatgatcccagcacccaaggggtatgtaactccttttccatggccgaagagccgtgattatgttccatatgcaaatgcaccgtacaagagtctcacagttgagaaggctattcagaactggatccaatatgagggaaatgtgtttagatttcctggtggtggaacccaatttcctcaaggtgctgacagatatattgatcaacttgcttctgtgatacctataaaggatgggacagtcaggacggcactggacactggttgcggggttgccagttggggtgcatacctctggagcagaaatgttattgccatgtcatttgcgccacgggactctcacgaagcacaagtacagtttgctcttgaaaggggtgtacctgctgtcattggtgttctgggaaccattaaattgccttatccatctgcagcctttgacatggcacattgctctcgctgcttgattccttggggagcaaatgatggaatgtatatgatggaagttgacagagttctaagacctggtggttattgggtgctttcgggtcctccaatcaattggaaggttaattacaaagcctggcagagatctaaggaggatcttgaagaagaacaaagaaagattgaagagactgctaagctcctttgctgggagaagaagtctgagaattctgaaattgccatttggcaaaaaactgtagacactgaatcatgtcgtagcagacaagaagattctagtgtaaaattctgtgaatcaacagatgctaatgatgtctggtataagaaaatggaggtctgcattactccaagtcctaaagtttatggtgattataagccatttccagagaggctatatgctatccctcctagaattgctagtggctctgttcctggagtttcggttgagacatatcaagaagatagcaaaaagtggaaaaagcatgtaaatgcttataagaaaattaacagactcctggatactggaaggtatcgcaacattatggatatgaatgctggattgggtagttttgctgctgatattcaatcatccaagttatgggtcatgaatgttgtgcctactatagctgagaaaagtacattgggtgtcatttatgagcgaggacttattggcatctatcatgattggtgtgaagccttctctacatacccaaggacatatgacctcattcatagtgatagtctctttagtctttataaggataacatgcatttaatacttgtagctgctatgataatgatttctgggccacttacattgcaaattgcaatggaatcttcactgcagtggttatgcttgttgaggacacttgttgagtctaatgtgtgcctttacatcctatgtgatacagaagacattcttctggagatggaccgaattttacgcccagaaggtgctgtaataatccgcgacgaagtcgatgtcttaattaaggtaaagaaattagttgaaggaatgagatgggatactaaaatggtggaccatgaggatggtccacttgttcctgagaaggtattaattgctgtcaagcaatattgggttgcaaatgccacatctacacaatga

SEQ ID NO: 62977 - DNA, 480 bp, Glycine max
  Peptide Sequence Number=SeqID_179755
atggattctatggatgatcacaacatgactattgatctcttggacacttcaatgagaaccattgaagaagaaggaatgattgaagaagaaggaatgattgaagaagaagaagatgaagatgaagaagaagaagatgatgacgatgatgataatggacaaaaacaagtgttaacgatcgaggaacttgaaacgaggatgtggagagaccggatgctgctgaggaaacttaaggatgagagaaaggagaaagaacaagggcaaacagtggagatgatgaagaagaaggccttgactcgtgcacaagacattgtgctgaagaacatgctcaagatgatggaggtttgtgatgtaaggggttttgtttatggcataattcctgataaggggaagccagtgagtggtgcttctgataaccttcgtggttggtggaaggaaagggttaagtttgatcgtaatggtcctgctgcaatgctgaggtaa

SEQ ID NO: 62978 - DNA, 240 bp, Glycine max
  Peptide Sequence Number=SeqID_179756
atggcggttataagcccaacaaagatctctcaacctctgtttcccagaggatacaaccccaacgtgacatgcacttatcatgagggattttcagggcattccattaagcattgtatgaccctgaaacataaggtgcaaagtctgattgatgcagtgatatgcgctcttgagtcgatctccaagtctattcaattagaaattgctcgttctccatgtttggtgagagggtgtcgtaaatga

SEQ ID NO: 62979 - DNA, 3811 bp, Glycine max
  Peptide Sequence Number=SeqID_179757
atggcgaatggaacacgtttgaaggcatcattagagcgtttggaagatgcaattgccaagctcactgcctcgcaacttgctatgaattcgaagattgatgatcttctccaacgaatgtctcagcttgaggcgaatcaacagcaaccgcagtctccgccgtcgtcatccgcaagacacacgccacagactcaaacctcttttcaccatatgaagcttgatgtcccgaggtttgatggatcggatccaattggctggaccttcaagattacgcaattctttgagtttcactctacgccggatcatgagaggttaaccattgcctccttctacatggagggactagcactcgcgtggtttcaatggatgcatcgaaacgcgcagttatcctcgtggtcagcttttctacatgctcttcattcacgatttgctacatccacgtacgaagatcctacgggattactctgcaaattgcaacagcgttcgtcggtatcgacgtatctctcagaattcaaatccttggctaacaggatagtaggattaccgacttcattcgtcttgagttgcttcatctcaggattgaatccaacgattcgcagagaagtacaagtcttacaaccgatatcgttagctcaggcagtatcctatgcacgattacaggaagaaaaacttgtcgatgctcgccggccaccgccatatcggccattagtctccacagtaccttctaacacacgttcatcatcaagcaactctacacaatccttgctaccaacaccggtacgaacttcctcctcaattccttttaaacgtttaacaccagaagaattgggctcccgtagggaaaatggactatgctttcactgcgacgagaaattctctcgtggccacaaatgcgcatcttcattgttttttttagttatggacgatgaggataccacgatcgaagaggaatctttaagagactatacaccaactcaggagttgctaccggaatcccctactcataatttcctccataatcgtgtggtactgagcttaggattacaaaccactaaaacagcaccgcttagggtcacggtggggaatggcgaggagattcattgtaatcagctgtgtacggcggtccagactctcggaccagtcttaacagactacggtgctttaacaatgaagttcatcactgggggtaaactcattgaacttcatggagatcgcgagaagggaatcgaaccagtgtcaccatctcaactacgcaggttcgtacacacaaaccctactacaaccttcatccatattcatgtcgaaacagcaaccacgcacaactcttctccaaaccatcccttgccgacaatcaacacattgatctccaaatacgcgtccctctttcgaccttctgcgaacttgccgccatcgcgatccacagatcataccatcaatctattgcctaactcaactccagtgaacattagaccatatagatttccttactttcagaagaaggagatcgaagaacaggtagcttctatgctagagaaagggttcataaaacctagctcgagtccgttttcatccctagttttgctagtaaggaagaaagatggatcatggaggttttgtgtcgattatagggcccttaatgccatcacgatccgcgatcgtttccccatacggacagtggatgagttactcgatgagctgggcgaagcacggtggttctctaagcttgatctcatgcaaggataccatcaaatattgatgaacacttttcaggccacaatgaatcagctatttcaaccatacctcaggaagtatatcatcgtcttctttgacgatatcttgatatacagcaggaccatgcatgaccatcttcttcacttggaaaaagcttttcagcttctgtatttgggacatatggtatcctcgaacggggtcactccggtgccggagaaggtacaagctgtctcacggtggccaacacctcgcacacctcgggcgttgagaggctttctaggcctcattggattttacagacgatttataaaaggctacgcagccttagcctctcccctcaccaaacttttgtgccacgaccaatttgaatggagtcaagaggccgagacagcatttcaaaacctcaagagggctctcatagaggcacccgttcttgcgttacctgacttcactacaccatttgtggtggaaacagacgcttcggggtctagtatgggggcggtgttaacccagaagcgccaccctctggcttattataacaaacaattctgccctaagctgcttaatgcttctacctacgttcgggaattagcagcaatcacggcggccgttaaaaagtggcaccaatatctacttggccaccacttcgtcatcttaacgaaccatcagagtttacgtgagctcatgaaccagactatccaaacgccggagcaacatcgttatttggccagactattggggtttgattactctattcagtatcgcgcaggaagaaacaatgtggaactagcctctctcgagacgtttcaagacttgcgcaaacgaatccaggaaaacctagcttcatatccagattatgcattaactaagggactcatcatgtacaagaaacgaatatggcttccctctaactcctctttcatcaaacaattgcttgaggagtttcaccaatctcatacgggtggccacatgggaatccagaaaactctccaaagacttcatgataattttacttgggcctcaatcaaggaagatactcgcaagtttgttacggcctgtgcaacgtgccaacacactaagtatgataaccgtaaaccagtggggctcctttgccctcttctggtgccgacactaccatgggaagatctatccatggatttcattacagggctaccctcttatcgcgacaacacatgcatattcgtcgtggtggatcgcttctcgaaagggttgcacttaggaatgttgcccacacaacattcggcacacacagtggccctgctattcatagaactggtggggcgcctccatggcatgcctaaaagcatcgcatcagacagagatctgctgtttattagtaaattctggcgtgagctcttcacactgagtggtacgaagctgcgcttaagctcatcatatcatccgcagtccgatggacaaacgaaggtcacaaatcgcattatcgagcaatatctgagagctttcgtgcatgaaaaaccagcaacgtggggaagatacctaccttgggccgaatggtcctataatacgtcttctcattccactacgggtatgactcctttcgaaattacctttggccagaaaccacccacttaccctcattatattgccggtacttctaccgtcgaagctgtagacgccatactcagtcagagggaagaagtctttgcgatgttgcggcgcaagctacttaaagctcagtcacgaatgaagacaaatgcagatcgccaccgccgtgatcaggaattccaagtgggtgattgggtcctcatcaagcttagaccacaacgacaatcttacaccgtgaaccccaccacggcgacaacaattatggatcttccacctttagcatctgataatcacccagttatcacacccttagccattgtagcttctaaagtcattccgtcggagacaggacccaggcatatggacaaggagctgctacatgggcaggggagtgctacgggagatgtaagggaaggggtgtcaatagcaagggaggtgcaagaagcaaggaatgcgagaccacgaagggaacggctcaccccagcatatctagaag

SEQ ID NO: 62980 - DNA, 315 bp, Glycine max
  Peptide Sequence Number=SeqID_179758
atggctatgcaaggttttgggtccgtccaacataatccgcaagctgtgtgggtttggacgacagggcctgcgaggcgggtgcagactaatgtattaagttcgtataagagtgcgggacagagtggtccgtctgttaccattcgcttccccgaaagacgcgttcatcgtaaaggcgacacgtggcagcacttgggacgcgccctgcgtacaggcgcgacgggtagcgctgctgcagcaggcgcgtcgggtcgtgttggagatccaggcgcgacccagttgggtcgcactttatttaatattttttatattttatag

SEQ ID NO: 62981 - DNA, 525 bp, Glycine max
  Peptide Sequence Number=SeqID_179759
atgctgaacgaaggaagcgtaggaaaactattttacaagaacgaaaaagacaacgttcagctactaatgtgtatctcacaatgtagtccaaccattaaccataataataaccctactacaagcttccaatctacaccaccatcacacgggactttatctataaatgattctgaacgttactcaaaaagacatacagtcaatgtttcttgcatccagagaaatttgatgtcatcttttgagcataaaaaaaatagaacaactgcttctacatccacatgccaaggtagtaatccttattccaatatgacacagtcagacattcatagagataaacatgagagagcaactaacactacacagcataatcaatttgtcgcccatgatagctcacattccaccgataatgatgcagttgttgcagaaatcaaactactcatggacaaatatgctgaaagaaggaagcgtaggcaaagtattttacaagaacggaaaaaacaacgttcagctactaatggtagtacttaa

SEQ ID NO: 62982 - DNA, 483 bp, Glycine max
  Peptide Sequence Number=SeqID_179760
atgcacgctgggcctgtgcttctgttggatcgggcgctgggcgcctgtgcgtctgttggatcgggcgctgggcgcctggctgggcttagcgcgcgcaacggtttccgccacgctcagcgcctccagccagtgctagatcagaacttgtacaacatggggatgaaaatgacctcaacaacgtttgcatccaccactgttaatgtcctcccggccattacttttgtaatggcactcattttcaggctagagaaggtgaacttgagaaaatttcacagtgtagccaaggtcattggaaccgtcataacagtttcaggagctatggttatgactctgtacaaaggccctgccttccaaatcataaagggtggaggagccatgagccaccatagcaactctagcagtaccagtaccaccgaaccctctgaccagcactggatagttggaactgtttatctcctatttcttcatttttttccaatctag

SEQ ID NO: 62983 - DNA, 417 bp, Glycine max
  Peptide Sequence Number=SeqID_179761
atggacaacataagattcaccgcacccttcaaagttcagaagaaccttctccaagttcctttctcttatcacagacaatggctccggaactaccccaaatatgttttattccactgcgatggcgagatacatttcatccggacacttcctgcagcagcttccaaatttgtctatggctcaaaaaaaagtattaccatccaccacggacttccaaaatccaccaaatggccactcagcatccacaatgacatgccagctattacagaaccatggttcaacctgattcatgaaaaaaatttaagacccggagatgaggtagctttttactaccgttttcatgagcatgcatgggaactgctcatcaggaaaaccatcgaatgggacaacaacaacatcgaccttgactttgacgaataa

SEQ ID NO: 62984 - DNA, 219 bp, Glycine max
  Peptide Sequence Number=SeqID_179762
atgagagagcgacgtcgaatggggaaattcattgtcaggctggatcaaagaatatgtgattgtgggaaacctcagaagctacacatgccatatgcatatgtcattgctgcattgtacacattggattacgtgtcaagtgtctacaaagtcccattagcaggcatgcatcatcatgattactggccacatatgaaagatcacaattatgtatcaatctag

SEQ ID NO: 62985 - DNA, 171 bp, Glycine max
  Peptide Sequence Number=SeqID_179763
atggctatgcaagattttgggtccgtccaacataatccgcaagctatgtgggtttggacgacggggcctgcgaggcgggtgcagactaatgtattaagttcgtgtaaaagtgcgggactgttaccattgtgggcttatgccgggcgagacggcctacttacctacacctaa

SEQ ID NO: 62986 - DNA, 1554 bp, Glycine max
  Peptide Sequence Number=SeqID_179764
atgtcatttggtctttgtaatgcatcttcttcctttcaagccacgatgaatgttctgttccgaccttaccttcgtcatttcatcattgtcttttttgatgatatactgatttacagtcattccttcaatgaccatttgactcatctcgagcaagtgtgcaaccagttgcatctcaagtccaggcaattcaacactggcctgtgccccacaccacgagagctttacgcagcttcttgggcttggctgaattctatcgaagctcaacttgcttttagcaagctaaaggaagctctatcatctgcttcggtattatccatacccaatttcactcttcgattcacagtggaaacagatgcttcagaaataggtatgggtgccattttttctcagaaaggacatcccatagccttctttagtaagccattcagctccaaaacgcttcaagcttccaccacgaacatggttgcagatgcattatctcacattttggagaactcgtcatcaaccttgctacttctgtcagtaccatgtttcacattcttggaagagcttaagagccggttggcccgagattcagtctttcagcaactccgacaagacattagcgataacccgaaagattatccagagatgttgaatgctttgttacttcatgtgttgactgccaacatacgaagtacgagaccaaaaaggtggtgggtttactatgtcccttatcggtgccatgtagacctttcgcttgacttcatcaatggattactgccatattggggttacaccaccattcttgttgtcgtggatctcgattctggaggaattatttcgtataagtggcacacagttaaggatgagctcagtgtaccatccacagacagacaaccaaacagaggtcttcaatcggcttcatggggcaaattccttcattgggtggagtggtcgtataacactttgtggcattctgggtcaaggacaactccatacgagattacgtttggcaagaagccatttaatgtttctcagtacatttccagttcttcaccggtagaggccgtcaacgatttattaactaatagggaagcaattttcaaaaaaattagaaagaagcttatcaaagttcaagaagtaatgaagaccatagctgacactaagagaagaaatgttaatttcgaaataggggactgggtcatggttatactccgaccctatcgtcaatccacggttttaggcccacattcgaagcttgccaagagattttatggcctattccagatattggctagaattggttccgcaacttacaagctgcaattaccgaaaggcgccaaaattcaccttgtgttccattgttccatgctcaagaagttccatcatccaccttctggtgatcctacaccatttcatcctttaccaactatattcattgataatcaacatgtcatcagtcccttgactatattggacactcttctggcttctgatactgccaactccaagttacaagtcttagtgcagtggcaaggattttcaccagatgacacgtcttgggaggattag

SEQ ID NO: 62987 - DNA, 771 bp, Glycine max
  Peptide Sequence Number=SeqID_179765
atggttaatgtcaatcctaccattgggagaggttcaagcccacacaaagagaagttccacaactatttggggctgagttgggaggaatttgctgcaagtcgcaaaacccttaattggcagttgcttgagaacaagctcctggaggggaaaaggaagaaaagacaagaggaagcaatgctgactgaggattcaacaatgattatcgatcctccatctcctattgaaagacatgtcaagtggaagttgacccgcacaaaacgatatgggcagatgacatttaaggcaacacaagaaatttctaataaaattggaagagcaagtcgctgttgtcatgcccataatggggttacccgccttgtcgccttgggcaaattatacgagggggtttcgaccatacaccacgtgccttgtgcagatgatgtggtcaaggttaaggttgccgaagtctgggacgctaacattggagtcccttttctcattacagaggttcaatatgtgagacaggctctcgacacattcattgcatacccgagacagatacgtccaaagaaacaggttgaacttgttcataggtcgattcccactggtggaattgatcccttaggtgatttgattaagaatttgattgatctatataagaagcctcttgagttgttttggaatggtgataaatgtttgaacatatctatattaaagatgtggatgatgtttatgaatgatttgagtataaggttaggtcgtggttctctgtatgaattcattgagccttag

SEQ ID NO: 62988 - DNA, 336 bp, Glycine max
  Peptide Sequence Number=SeqID_179766
atggcatctaaccaaccattggaccttacatcatccacattcccagtgcttttccttgaattgcttcttgagcccttcccagcttgcaaacttgaatgcattcaaagccttgatttgtcgataggaaccagatcaggtagtaacgaaagtagggaagagaaggtgatggtagagtacagtacggtaccgacaacaatggaaaaaggaggacgaggagctgagtggcgagtcaaagcagtggttgcgcagcgcaagaccaggcttgccgccggcttcgacggggatgccgcggcgcttgttggagctgcgactgcgatagaggaggacgaggaatga

SEQ ID NO: 62989 - DNA, 954 bp, Glycine max
  Peptide Sequence Number=SeqID_179767
atggtgggtgcgaaacacagttttgcatatatcatcttcatgcattcgaattgggtggtacccttgaaggaggtccaatttggagaaccaacttgcaccccccaactcatcaagaagttcatcaatggttgggataggaaagcgatatttgatgaacggactggtactggatctgatgaggcccttctgaagcatggagtcaacctgggattcaatttcatgtttctaaaaatgaggatagcgataaggtttaacattgataggctcggtatttggaatgaggaggaatatggtgggagtgggtttgggtcgaaggggccaaatgacccgagagagagtgaaaacttatttgggtcattgtcgggttcgaaggatctgacgggttgggtgaaggccctaaaaggttggcatcttcctgaggaggagtgggtagaagcggaactgaaggggacgggggtatcgcgaaaaaagatagtggggttgaactgggtggaaaatgaccccgctgtggacgaggattgtccagaagcttctcctcttggagtttgggcttggacttcatgccgaatttcgggggttaaccctgaaatgaagcagctgaagagaaatggaggcggaagaccgatgatgtggttggccaaatctttgaactccgagaggaaagttggccatgacgtgaattggccatttatcatgatacgtgaagaattggttgatcttgaagattcaactgagaggatctattccattaaaccgtggaacatccaatttcatgcaatgggggtggttaccggaaccggggaagtgattgttgttgatgatgaaggagaagaacgggagaaatcaagaggcaatggccttctcaaggcgatcagagaaaactttgaaacgggtcaactcaaccattgtaagggagacaacgagagcaacacaatgttaacactagggaactaa

SEQ ID NO: 62990 - DNA, 456 bp, Glycine max
  Peptide Sequence Number=SeqID_179768
atgtgttcaattcacaggggacaagcagagaaaattaagggtggaagtagaggctattggcaatctttggtggctgagaccacaacttttcccatacacttgatcaagaccaggctccaactccatggagactcacttttatcgagtcaccccactagtgcatttagagtaggcttgggcattattcgtgaacaaggtgctctttgcctttatagtggcttgtcgccaaaaatttttagacacatgttctacacgcttattcaaaatgtggtttctgttgataatgcttctatctctattattggcaaggctgtagttggtggaatttttggtgttgtggctcaggcagttgttgatgaatgggcatcaagtcttttctggctctgttacaaggtgttacagattagttactacactgactcagcaatgagtcagactgacaacacagatagctag

SEQ ID NO: 62991 - DNA, 207 bp, Glycine max
  Peptide Sequence Number=SeqID_179769
atggcaactcgctcatgcaagttggagcttactcttgaagtagctggctcacccaagcaagctggttacttcaccctgaagtcttttgggggcctaggcgagccagaggcaagcctgggcgagctagggtccaagaaactcaatgaaaagacccttttgcccttcttttttggtatctttcacattcttgatcaaaacattgaatga

SEQ ID NO: 62992 - DNA, 1317 bp, Glycine max
  Peptide Sequence Number=SeqID_179770
atgatggaagagagaaataatgatgctgagaaacttgatgaagttatgctaccggggttcaggtttcatccaactgatgaggagcttgtagggttttacctcaagagaaagattcagcaacgccctttgactattgagctcatcaagcagcttgatatctacaaatttgacccttgggatcttccaaagttggccaccacaggagagaaagagtggtatttttactgtccaagggacagaaaatacagaaacagtgcaaggcctaatagggtaactggagctgggttctggaaagcaactgggactgataggcctatctactcctcagaaggttccaagtgcattggcctgaagaaatccctagtcttttacaaaggtagagctgccaaaggagtcaaaactgattggatgatgcatgagttcaggctaccttctctcactgactcactctccccaaagtacatagacaagaccattcctgctaatgaatcttgggctatctgcaggatattcaagaaaatcaatgctacagctcaaagaactttatctcaatcttgggcctcttccctacctcctgatacaagaacctctgatcatcatatccaaaccaaagatcaagacagcactactcagttttgttcagacaacatgccaatgacaaataaaactaccttaaccagccagttctgtaataacaattacaatgattcacaacccttacccactaatagtagtagtagtcctctttgtcccttagatgttgcctcatacaaatccatcattaacccattgctttacaaagcctttgatcattttcccatttctaatgaagaccttagaactagcttgctattctcacccccctttgaaacatcagatgctaatcccaaatctacaatggtcgacgtttcttccatgttgttgagcttgccatcctcagtgcttggagattttaacaagactacttcagaagacacaaatacagcttcaaactttggtgtattgcaagagcactgtagtggctacccaataccatttctacctgagatgcaaaccacatttggtaaccaacaacaacaatattgtgataatattaatgcattggtaaagggtcctaatgtgaatgtgcctcgtgttgatgaccaagagttggagttggagacagtagtacaacgatccattgggtttccattaagtgctactatgcctttgaatattgtcgatgcatggaagtcaaataatctgctttgggatacttcctcttttccttgtgatatgccatctagttattattccacaactaagtgttatacttag

SEQ ID NO: 62993 - DNA, 1194 bp, Glycine max
  Peptide Sequence Number=SeqID_179771
atgttatacacattgttaaggtactccataaggcttcgaggggtgattcacaaagttgtggcaaaatcacaatcagtgtttgttggaggaaggcatatgttggatggtgtattcattgcaaacgagattatacacgaggaaaagtccaagaagaagccaactctcatctttatggttgacttcgagatgacttatgacattgtcattgtcaactgggattttcttttttctatgatggtcaagatgggattttcgaatgtttggctacgagggataagggatgccttgaatcatcatcagtttctgtgttgggatgggggtttgatcaaaggggcggtagacaataattacctccctggtgtcaagttgggatctaatgagttgtgtatatgtgtgcaaaaattcacagatgatacgctgatttctatggaaccctctttgcagaatgtgttgtcggtcaaagcgattttcaggtgctacgaggctacattggggttgagagtcaactttcacaaaagcaagctcattggaggaaacgtgaaggtctatcacagacagattgaggaggaagatggctccttggaaaagaaaattcttgtctataggcagatgggttgttccgattattacatccttgcaaaggaattttctctagggagagaaggggaggagaggaaggtggcatgggtgaaatggggggatgtttgcttactgaaggataaggggggtctaggggaggttagagggatggttgtgaagaagttcagagatggagcatcaactaggtttttgttcaatgtgtggattggtagttatgctctcaaatcgaagtatgaaaggttgtttcgactatcttatcagcatgaccttaatgtgaatgtgataggaatatgggatttatacaggttgcacaaccaattgatggaatccgttgtgggaaccaaagcgcaacatatactatatggtactacattcccaaccgcaatatctgagttcccctatgctcaaggtgttgtggagtccgaagttgaatcatcatcccatttatttttctcctccccttctcttataaggtatggcaacgctgctatagttgggatagctttcaacaagcactgtcgggtaacttcatggaccatctctggcaacactgtggtccagcatgtgttggattctgtcatattgaagtcttga

SEQ ID NO: 62994 - DNA, 174 bp, Glycine max
  Peptide Sequence Number=SeqID_179772
atggaagacgcacccgtgagtctcgcgtcgccctcccgccaaaggatggatgaaagggactttactgatcatgtaatgcaagtgcataaagctctcaaacaagaaaaggagaaatgggaaagagttgtacaagttgagcttattgcaacactagctaaggaagccattgcttaa

SEQ ID NO: 62995 - DNA, 2034 bp, Glycine max
  Peptide Sequence Number=SeqID_179773
atggatgatcaaggggtaaggaagggagaagaaattacaccaactttaatgaaggcaattcaagaatccaagattgctattgtgatcttttcagaaaactatgcatcattaactttttgtttacaagaacttgtgaagattatggagtgcttcaaacacaatgggagactggtttggcccgttttttataaagtagatcaagttgacatgggccatccgaaaggaagctatgtagaagcactagtcaagcatgaaacaagaatcagtgaaaaggacaagctgaaaaaaatggagacgctctgcagtgcaacttcttgctcgcaacctcgcacttgcactcttgctttcacactcgcaaccccttgcgcttactcgcactcacaacctcactttctctctcaagctcgtctctctcacgtgcttttctgtgtcatcgtgagagaaaccatcgaggcacatgacctagttcgttatggcggtgctgatgagggttttgagatcgtcggcatactggtacagagttttcttgttagggtagagctcgaggttgtgatatgcttctttgagctcatcgagagtttcgtctatggttttgagtcaattgtggagtgcagttgtcttgcgtttcagttgaatgacgtcgtagtggttggttttgtgagtgatgttgggcttgaaggctatgacaaagaagcagagttcgggatagaatgtaccaatatgggatcattcgagattcaagaggtctctaaaaggatcaatcgtatccctttaggtgttgctaaaagcccagttggcttagtctcgcgtgcagaagggatttatggaacaggcagaattggaaagacaacacttgcatgtgcagtgtacaatttcgtcgctgatcaatttaaaggtctctcttttttatttgatgttagagaaaattccgacaagaatggactggtataccttcagcagacacttctttctgatatagttggggagaaagacaatagttggggaataattattatcacaactagagatatacatcagctacattctcacggtgttgaaactgaaagaacctataaagtagacggattaaatcatgatgaagcccttgaattgttcagctggcatgctttcaaaagtaagcaagttaatcctagttttcaaaacatttcactgagaataatacagcattttgattgccttccattaccattggaaatactaggttctgatttatttggtaaaacagtgccggaatggaattcagcattagatgcttatgaaagaattcctcataaaagtattcagaaaatcctaatagtaagttatgatggcttagaggaattggagaaggaaatttttttagacttggcctgctactttgtaggatacaaacaaagaaatgtcatggccatactacagagtggtcgtggcatcactctagattatgctatccaggtgttgattgacaagaatcaccctcagcccggtgaacgcagtagattatggttctataaagatattgttcgtgtattaaaagagaacaatggatctgacaaaactcagatcattgtgctagacttgcccaaagataaagaggtacaatgggatggaaacacattgaagaagatggaaaaccttaaaatactggtggtaaaaaatacttgcttttctagaggacctagcgctctcccaaaacgtctaagagtgctaaaatggtctagatatcctgaatcaacacttcctgctgattttgatccaaagaaacttgtcatatttgacttgtctctgagtttctttacattcaagaatcaaggaaacatgaaatttaaatctttgacggatatgaagttaagtgattgtaaattgctagaagaagtaccagacttgtctggagcaactaatttgaagaaactgcatcttgataattgcaaggagcttcgagaaatcagaggcctgccaccaaacatagagtatctttctgctatcaattacacattgttgacttccaagtctaaggaaaggttaatgaataag

SEQ ID NO: 62996 - DNA, 171 bp, Glycine max
  Peptide Sequence Number=SeqID_179774
atgtgggacccaaggcagttagaagttagaacttataagagggacaatatgttgtgggtaggcagcagtagtgtgtatagattttacaaggagagagtgagtatcatagttagtcgagacgatggaaaatgcggtcagagaagttggaaagatgggggacatgagcagtga

SEQ ID NO: 62997 - DNA, 295 bp, Glycine max
  Peptide Sequence Number=SeqID_179775
atggtttcttctccaagcttggatttactgagaaaatcgatagactatggacatggaactcttgatgcatactggaaccggatccagagtttagatgaaaaagtgaaagtgattccagaccgtaaagaatcaggaggagaaaaatgcatcacattgaggagtagaagagggagatcatgttcagaccttgtacttgagaatctgcgcggcgaagaactcgacctcgaagtaggcggggacggggaggcggcaatcgaaggtgtgggtttgctggaattggacgagcagatagacg

SEQ ID NO: 62998 - DNA, 2534 bp, Glycine max
  Peptide Sequence Number=SeqID_179776
gaaaattgaccaatttgtcatatctagatcttgatcagaacaatttttatggacatattcctcgtgaaattgggaaattgtcaaacttaaagtatttgtggcttgcagaaaataacttttctggttccattcctcaagaaattggaaatttgagaaatttaatcgaattttctgctcctcggaatcatctatctggttccattcctcgggagattggaaatttgagaaatttaatccaattttctgcttctcggaatcatctatctggttccattcctagtgaagtgggaaaactccattctcttgtcacaatcaaattggtagacaataatctctctgggccaatcccatcttccataggtaacttggtcaatttggacacgattcgccttaaaggaaacaaactctctggatcaattccttccactattggtaacttgacaaagctcaccactcttgttatatactcaaataagttcagtggaaaccttccaatagaaatgaacaagcttaccaacctggaaaatttgcaattatctgataattatttcacaggtcatttacctcacaacatttgctatagtggaaagttgacgcggtttgttgttaaaattaactttttcacgggcccagtaccaaagagtttgaagaactgctccagccttacaagggttaggcttgaacaaaaccagctgacaggaaatataacagatgattttggtgtttatccgcatctggattacatcgacttgagtgaaaataacttttatggccatctttcccaaaactggggaaagtgctataatctcacaagcctcaaaatctccaacaataatttatcaggcagcattccaccagagctaagtcaggcaaccaagttacatgtacttcacctgtcttcaaaccatctgacaggaggcattccagaagattttggtaatttgacctacttgttccatctttctctcaataacaataatctttctggaaatgtccctatacaaatagcatcattgcaagatcttgcaaccttagaccttggagcaaattattttgctagcttaattccaaatcaacttggcaatttggtcaagttattgcatttgaatttgagccaaaataattttagggaaggtattccatccgagtttggtaaattaaagcatctccaaagtcttgatcttggcagaaactttttgagtggaacaataccaccaatgctcggagagttgaaaagcttagaaacattgaatctctcacacaataatctttcaggtggtctctccagcctcgacgagatggtaagcttgatatcagttgatatatcatataaccaattagagggttcacttccaaacattcagttcttcaagaatgctacaattgaagcgttgagaaataataaaggcttgtgtggcaatgtctctggcttggaaccatgcccaaaattaggtgacaaatatcaaaaccataagactaacaaagtcatattggtgtttttacccattggtttaggcactttaatactagcattatttgcctttggggtctcatactatctttgtcaaagttcaaagacaaaagaaaaccaagatgaagaatcaccaattcggaatcaatttgcaatgtggagttttgatggaaaaatagtgtatgagaacatagttgaagccacagaagattttgacaacaaacatctcattggggtcggaggacaaggaaatgtttacaaagcaaaattgcacacaggtcaaattctagccgtgaagaaactccatttagtccaaaatggggaattgtccaatattaaagctttcacaagtgaaattcaagctttgataaacattcgacatcgtaacattgtgaagttatatgggttttgttctcattcacaatcctcatttttggtgtatgagttcttggaaaagggaagcattgataagattttaaaagatgatgaacaagcaatagcatttgattgggatcccaggattaatgccattaagggtgtagcaaatgctttatcttatatgcatcatgactgttcacctccaattgttcatcgagatatatcaagcaagaatattgttttggatttggagtatgtggctcatgtctcagattttggagcagccaggcttcttaatcctaattcaaccaattggacctcatttgttggcacttttggatatgctgctccagaacttgcatacacaatggaagtgaaccaaaaatgcgatgtgtatagctttggggtattagcattggaaatacttcttggagagcaccctggagatgttataacttccttgttgacatgttcatcaaatgccatggtgtcaacacttgatattccttcattgatgggtaagttagaccaacgcctcccttatcctataaatcaaatggctaaggagatagctttgattgcaaagacagcaattgcttgcttgattgaatctcctcattctcgtcccaccatggagcaagttgccaaggagcttggaatgtcaaagtcatcttcagtgcattaa

SEQ ID NO: 62999 - DNA, 1080 bp, Glycine max
  Peptide Sequence Number=SeqID_179777
atgggatccgataaaactgagatcatcatgttacacttgcccaaagaaaaagaagtgcactgggatggaacagcattggagaagatgaaaaaccttaaaatactggtggtaaaaaatgctcgcttttctagaggacctagtgctctcccagaaagtttaagagtgctaaaatggtgtcgatatcctgaatcttcgctgcctgctgattttgatgcaaaaaaacttgtcatattggatttgtctatgagttccattacgttcaagaatccaatgatcatgatgaaatttaagtacttgatggaaatgaagttgagtggttgcgaattactaaaagaagtatctgacatgtctggagcaccaaatttgaagaaactgcatcttgataattgcaaaaatttagttgaagttcatgattccgttggattccttgataaacttgaatgcttgaaccttaatcactgcactagtcttagggttcttcctcgtggcatgtacttaacttctcttaaaaccatgtcccttaggagatgcacaagtctcatgagttttccagaaattttagggaagatggaaaacataaggtaccttgatttgattggcagtgccataagtgtcttgcctttttcaattggaaatcttgttgggctcactaggctgaatctgaataaatgcactgggctagttgaactaccaattagtgtttttatgctgcccaaacttgagaacttggaagctaactattgtgatcggcttgcacaagtacagaatggagaaggtcaagatcatgaaacggtgtcttcaagtgttagggatgctaattttaactattgttatctgacagagaagtttcttgctactcttcttccttgcttgtgcaatgtgacatctttatcccttaattccagcaatatcacagtccttccatcatcaatcagtgcctgtctctccttgacagaactttatttgaatgaatgcaaggagctccgggaaatcagaagcctgccaccaaacataaaatatctttctgctatcaattgcaaatccttgacttccgagtctaaggaaatgttactgaatcag

SEQ ID NO: 63000 - DNA, 871 bp, Glycine max
  Peptide Sequence Number=SeqID_179778
atgcctaatccaacattggcgtcctcctcttctttggcctatgaatggacttacgatgttttcctcagttttagaggtgaggatacccgcttgggttttaccggacacctttatcatgctctgtgtgaagtgggagtcaacaccttcatggatgatcaagggctgaggaagggagaagaaatcacaccatttctaatgaaggcaattcaagaatccaggattgctattgtgattttttcagaaaactatgcgtcatcaacgttttgtttacaagaacttgtgatgatcatggaatgcttaaaacatcagggcaggttggtctggcctgttttttataaagtggatccatctgatgtgcgccatcagaaaggaagttatgcagaagcactagccaagcatgagacaagaatcagtgataaggacaaggtggaaaaatggaggttagctttgcaaaaagctgcaagtctatctggttggcattccaatcgaaggtacgaatatgatatcattcgggacatcgttctagaggtctctaaaaagatcaatcggaaccctttacatgtagctaaatacccagttggcttagagtctcgcgtgcagaaggtaaagtcacttcttgatgttgagtcaaatgatggagtccacatggtagggatttatggaataggcggaattggaaaaacaacacttgcatgtgcagtgtgcaatttcgttgctgatcaatttgaaggtctttcttttctttctgatgttagagaaaattctgagaagcatggactggtacaccttcaggagacacttctttctgatatacttgaggagaaagacattaagttggggaatgaaagagaggaacttccaataattaaaa

SEQ ID NO: 63001 - DNA, 171 bp, Glycine max
  Peptide Sequence Number=SeqID_179779
atgaaggcagactcgatctctgtgtggcatgtgtctgagatgaaggcagaggaaatgcacacggcaacaaatgaagcaaggccaaaatacacgtgtcaacaaatgaagcaaggccaaaatgacgtggagcaaccaaagactaaagcgagaattataagcaattgggcttga

SEQ ID NO: 63002 - DNA, 789 bp, Glycine max
  Peptide Sequence Number=SeqID_179780
atggacgatgaagttgttcagcgagtgttccatgaaggaggacgcgattacttccagcaacagccttcgacttcttcttcgtcttcctcttccatcctccaatctctccctctccatgtgtcttttgatcatggatattatttgttggtaaaatctatccaagaactccgagagaaaaaggatggccttgttacggttggcattggtggaccaagtggatctggtaaaacaagcttagcagaaaaggtagcatctgttattggttgtactgttatatcaatggagaattatcgtgttggagtagatgaagggaatgatttggattctatagattttgatgccctgatcaagaatcttgaggatttgactaaaggcaatgatacatcaatcccagagtttgactatcaggaaaagaagcgtgttggctataaagcaataaagagcgcttcatctgcggtggtaatacttgatggcacatatgcattgcaagcaaaactgcggtctttactggatattcgagttgctgtggttggtggtgttcattttagcctgctttctaaagttcgctatgacattggggattcttgttcactggattaccttatagatagcatttttccattatttaggaaacacattgagccagatcttcatcatgcacagatcagaattaataacagctttgtctcatcattcagagaagcagtctacaaggttaaatgcagaagtgaggtgcaaacaagtctatctagccaagttgagcacttgaagttcaagcttggctcctga

SEQ ID NO: 63003 - DNA, 128 bp, Glycine max
  Peptide Sequence Number=SeqID_179781
atgttggtgaacgtcgttgcaaaagcaaagtctgaaggaatcttggtagccatgaagggagaggcgacggtggtcgctagtggtcgtcaacgaaaggatgccgagacggctgtcaaacagcagcaaag

SEQ ID NO: 63004 - DNA, 288 bp, Glycine max
  Peptide Sequence Number=SeqID_179782
atgtaccttagaccaccttcagctagtgaagaagcaaggataaatgattggatcaaagtgcggcagtctggaattagatattatttatcacttggtgaccagaggattgttgacaagaatttcatcatcaggcctaaagctgaatttgagggagtctgcaagaggtttgactggtattgcagaatagggattagaactgacctttgtcaacatatcaatgtttacatttttgagaaagacttcactttgaatgacaatgacaagacaaaaatcattgtattccattga

SEQ ID NO: 63005 - DNA, 558 bp, Glycine max
  Peptide Sequence Number=SeqID_179783
atgggtattaatggaccttggattactaaatcatatctggaaatgattcttcagagaaaaggtgtacctcgtcttagtacaccaccacttgtgtctaatacaactgtggctggtagtcaagaaactgtgatcgctgcaccaaagccaattcgtgttacccctaaccttgttactgggatagatgatttacctcagccgtggactcgatccccgacaaaatctaaaatggaacctgttgcggctgaatggcatttcatatcttcagattcttcccagcctgacaactcagtcctaggtattttccttgaattggagaatgtatctatttttggagataatttccttcatgcttacttaagatttccattatatcaagacttctctcatgaagcaaccacagacccttcatctttcagggatagtattaggcttgcttcaatgcctgattcatttgacttggataggggattgcttttggcagttcaagcaatacaagcattgttggagaataaaggtgtaccagtcatagttggaatcggtaatatggatgtttcttga

SEQ ID NO: 63006 - DNA, 405 bp, Glycine max
  Peptide Sequence Number=SeqID_179784
tctctgcgtgtcaacgggctcgctttcctctggttgacaaatggtgtagatgacgatgttagtctctgcgtatcaacgggctcgcttgcctctggtggacaaaagtctctgcgtgtcaatgggcttgattgcctttggttgacaaaaggtgcagataatgacgttagtctctgcgtatcaacggtgcggataaccataaggtactcccgcatgtcatcggactcgccgtctctggatgacaaaggtgtagaagacgataagtcgacgttagccactgcatgctaccagactttgagtctgacggatagtgaacgagtgtgtgcgggttatcgtatatggcatcttcgcgtgccaaaggactcacaagtcacgatagcaaaaggtggggcggttaataaaagcgag

SEQ ID NO: 63007 - DNA, 347 bp, Glycine max
  Peptide Sequence Number=SeqID_179785
gtatgccacctaccaggcaccctctagacccagataagtctaacagggccctggggtttccagtgttgatcacgggtctctgccagtcattcggggttcccgtcacaccaagtatgatacatgagtgtctctaccagctcagcctcagtcagcagagccagggtttcactccttttgtgtgccctactccagatcagttcagggctaaggttgcatggcccagagattggcctgaggcccaggaaggggaggcgcccgcagaggctcccagcgatgcggaggaggcccacatggttgaggagatgacagatttactcggtttcttgggagggagtggagccacatga

SEQ ID NO: 63008 - DNA, 729 bp, Glycine max
  Peptide Sequence Number=SeqID_179786
acgcagcaggccgagcgcgaaaaacaactcgccgcgctggatagcgaaaaacagcagcaggcgcacaacctggcgcagctgacgcgggaactggaggcggcgaagcagcaaccggccgccgcaccaaaactttctgccccgaaaagcgatgctgaacgcgatggttacacgctgggtcagttcatcgccagcaatgcggtggtgcagttgcagatggtcaaagacatcggcctcagcatcagtatggatcagctgattgccggcttaaccacccagctgcaaagcggtgattcgctgcttgatggcgaagagatggcgcgccgttacgccaccatgcaggcctccattggcaaaggactgaacgcactgattgaaaaaggttacgcgcagctggacaagaaagtggcgaagcgtaaagcgctgaagaaagatctcggcatgcagtggtttgcggtgaaaagcgtcaaaggcaaactgctgccggaccagcaggcagcggtcagcgtccgcgtcaccactctgagcggcaaggtaatcaacgatttttcgcacgatcaggtgccgttcaacgacagcctgtcgccattgttgcaggaaggcatgtcgttgaccggtaaaggcggcgcagtggaaggctgggcgctggcgaaagatatttacgagcgcgagccgctgccaccgtgggtcgcgccgtatgatgtgatccattatcagctgaccatcaaataa

SEQ ID NO: 63009 - DNA, 913 bp, Glycine max
  Peptide Sequence Number=SeqID_179787
taccctcaccttcagaggactacacgtcctccccactagaggactacatgtcctcacctttagaggactacacatccttgacttcatagggctacacgccctcaactttagaggactagacttcctcgccttcagaggactagacgtcctcaccttcagaggactacacgtcctcgccttcagaggactacacgtccttgccattagagggctacacgtcctcaccttcagaggactacacgtcctcgccatcagagggttgcacgccctcacctttagaggattgcacgcccttaaatgcttaactgagacttgcgctcccggttatgggaccaatagtttccttttattagttcctgggccaccccctgatattggagggcgaccagctgtgcgagcacaaccagagagggaggctatcacacagctactatgcataccggggcaagatttcacccgtgccgctacaaagagacgagtgcggatcatgcgcaccaacatgaccactcttacacagatatggatgacgttgctacttagcaacattccacccgacgaccataatgtcgatctcccccctacggaagtatcagttggtctgtaccgtcgtgacataggtgaggatcacgcccacgagacgcccaatggacccggagaagtccaacagggccctggggtttccagctctggttacgggcctctgtccgtcctacaaggtgcccatcccccccagcaaggggtagcacccacaagacacccagtggatccggaggagcccaacagggccctggggtttccagctctggttacgggccactgtcagtcctacagggcgcccgtgcccccagcaagttcatgccatcgtgacataggtaaggatcacacccgtaagacactcagtggacccggataa

SEQ ID NO: 63010 - DNA, 612 bp, Glycine max
  Peptide Sequence Number=SeqID_179788
atggatttcttttctgatgagagttttgaatgcattcaagcatttcagaactcaaatctcattccttttatgtctttaaaactgcctgtgtattctgaattggtaaaagcgttttattctaaccttgaaattcaagagagtatcttgatttttaaggtctttgggataaaaatggtcattgaccaatccctcttctatgatttgacccaattgtctagtgacggtgtacgatttgaaggtgcactggatgatgattggaaatttgatttttctatgcatgatgcccgctggttgagatctttcttgatcggtgctgttgtggttgcctcctttggttaccgcaaagagcgtgatggctcttgggtaaaaaatggtgctcaaccaaatgatgatgaaggacacttaccggttgaagaggactcttctctccttcatagtattttgcacaggtttgatggacttcaaacctatgttggtgaggggtttgactccttggaacgtcaagtggacacacgattcgaggagaggaactcaaggattgcagaggttaaagaagatgtcaccatcattcgcgactgctttgatttacctccagcaacaacatcagtttag

SEQ ID NO: 63011 - DNA, 369 bp, Glycine max
  Peptide Sequence Number=SeqID_179789
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccaggtctaactagcttgggttatgtgaattcctattttcagatcaagtatgtggggaatgagcaagaaaagaggagcttacagatggaaggattgaatctaatggacaaaactttgtctgttcaaggagctcgtatttcatttagaatatgggatgttgcag

SEQ ID NO: 63012 - DNA, 336 bp, Glycine max
  Peptide Sequence Number=SeqID_179790
atgaagaggaagcaattcacagcgaaaaacattcacccaagtaagagtggagagaaagaagggatgatttcctcaatgaaagaagtagtcgagtcattgaaagaatttgttgaagtgattaagaagaagatggagaacaaaaaaaagatggagataaaagaagctcaagaagtgatacatgaagtggtgaatgagctagataatatacctaattttaatggtgcacttcgacatagagaaatcgattggttgacagaaaatcccattaagtttgagattataaaagctcttccattgtatgagaaggaggatcacatctcgtcttttatgccttga

SEQ ID NO: 63013 - DNA, 573 bp, Glycine max
  Peptide Sequence Number=SeqID_179791
atgcaattgaaaaatgatgatgatgatgttaacacaatgttaatgtgtaatgatcaatactcgtgtgttggcccgattgagttattatacaccattggtagaacaccggatggtatattaagcttacttcaagtcactatgacccttactcatgatgtcctgctatattacaatgggaggtggaacatgtcacgccaacacgaatttgtgggttactcgttcataggaaaacatccaaaaagatttgacattccttcgagatgtaccatcgatggactgaaggatgtgatcaatcaagttgcacctcaagggattcccccttatgatattcatgaatcacaaacggtaacgcgattgttttttgaacaatcaggtcattctgagtatttagacaaagttatcaaatttgaaattattgagctgaaagctgacgatgacgtgctaaaggtcttagtacagtataactattggaaacaatttgggccaatagaaattttagctgtttttagtaaaccagtaatcaaaatggaagacgacatgtctcggtcgcaacatgattcaatgaaaaattag

SEQ ID NO: 63014 - DNA, 243 bp, Glycine max
  Peptide Sequence Number=SeqID_179792
atggtttccttaagatacaaaattagttgggttgattgggacatataccaaataccagttaaggtttacatacttgattccaccgacaaagtgaggtcaaatggttccaaaatacttcatgattgtctggcagagtataccattccagcaacgggtggtggtggtgatactcctcatgtccaaaaagcaaacatcccaatggaaaaaggaggtgatgaacagtatttttcgccattcttataa

SEQ ID NO: 63015 - DNA, 442 bp, Glycine max
  Peptide Sequence Number=SeqID_179793
atggccaggcatacgccagtggcagttcatcggcgacgctggacagcacaagccctgctgacccggagacaggtcatagtcctcgcgccgccatcagtcgcgtctcatgctcgtgctcttgagtacgcagatcgctctgtgcacgcgattcagaggccacctccaatctggagaaactgtcctcgatcggtgtattcaacgccgtctgatagtcgaaacccgcccgtagatgcgccggggagtcgagtgccccctgcacgacaaaagcttggccacgatttccgaccacaaggtgatccacctgactcaacccagcccgctgggctgcgatggttccggccatcgccaaacgctcaactgcctgatccggcaacccaccctgggtgcatgccagtctttctgccgcttggaaattctgcttgtagatggcatttgcctcgtg

SEQ ID NO: 63016 - DNA, 1260 bp, Glycine max
  Peptide Sequence Number=SeqID_179794
aacgccccgcccgggctgccatcggctgcccatatagccgatggcggcgcacaacagcatcgcaaaaggcggaggaacacgggtctcaagccagcgcatcgcagccctgcattcatcctgttcaccccagtgtcacacggaaatacctgaatcgcccggttggcggcacttccgtgctccaaaccgaccgcccggtatcttccgctttgacatgccgaccgctagagtggcgccaccgcgcaggaggatcgtatggcaaccacgggcttgggcttcatcggccgcacgaccctcatcatcaccgtgctgctcacccttggcggctgcgccacgttgcgccagttcgggccgtcggtgcaggtggcctcggtcacccccggccagtacatcgccctgaagcgcggcgacatcctcaccaccggcaagctcagttcggccaccatggaaacgctgcgcgtggccggtctcgacgaaggcttctgcgccaagcccggcctgccctgcatcgaggccatggaaggcagcatcgtggtgcgcgaggaggacaagcgctcaagcctggccgagctgtggctgcagcatgcgatgaccctgccggcgcccaagcgcgagtactccacctccggccgtgccaagagcgcgatcaccgagctggatgccgatttccaaccgcgcctggacgcgtggatgcaggtcgcgcgccaagcctacgcctatctgttcttcaccgagcgcaccgccaaccagcgtggtttcgaggaccgccagacccaggtgcgcgactactacaacctggccgtgcaggaagcctcggtgcagttgtacaacgcctatgccaccgggcgcgtgcacagccaggccagccatttccagctgggccgctggaccttcgtgctggcaccttcaggcgaggcatcgccgctggatacgcgtacccccaccgaactggtaccggcggcctcgctgtcgttcaccggcacgctgcgcagcgtgcatcgccgcgatggcttcggtgccgaactggtggccgtgatggaggatccggccgccaccaccgccaccacgccgccggccacaacacccgccgcgcaggccaccacaccggtcacgcagagctggagcgagatgccgtcgccatcgatgacggtactgctgcgcttctccggaaagaacctgtgggaagtgctgcacgacgacgagccggaactggagatccacgatccctaccaggtcacggaagtcaccctgcatgggcagcag

SEQ ID NO: 63017 - DNA, 1240 bp, Glycine max
  Peptide Sequence Number=SeqID_179795
acgtcctcgctatcagagggttgcacgtcctcgccatcaaagggctgcacgccctcaccttcagaggctacacatccttgccttccaagggctacatgccctcaccttcagagggctgcacgccctcaccttcagagggcttcacgccttcgccatcagaagactacacgtcctctccttcagaggactgcacgtcctcccctttagagggctacacgcccccgccttcaggggtctgcacgtcctcaccttcagagggctgcacgccctcgccttgagagggctgcacgccctcgccttaagagggctgctagtccttgcctttagagggctacacgtcctcgccatcagaggactacacgtcctcgtcatcagagggttgcacgccctagccattagagggctgcacgccctcaccttcagaggactatacgtcctcgccttgaggactgcacggctacacgccctcaacatgagaggactacttgtccacgccatcagagggctgcacgccctcaccttcagaggactacacgtcctcgccttgaggagtactcatccttaccttcagagggctacacgccctcaccatcagaggactgcacggctacacgccctcaccttcagatggctgcacgccttcaccttcataggtctacacgccctcaacttcagcggactacaagtcctcgccttgaggactacatgtcgtcaccttcagacgactacatgtcctcacactcagaaggctacacgccctcaccttcagaggactacacgccctcaccttgaggaatacacgtccacaccttcagagagctgcacgctctcaccttcagagggcttcacgccctcgccttcagaggactacatgtcctcgccttcagaggactgcacatcatccccttcagaggactacacgactacacatcctcgccttcagagggctacacgtccttgccttccgagactacacgccctcaccattagagggctgcacaccctcactatcagagggcttcacgccctcgccatcagaagactacacgtcctcgccttcatgggactacacgtccttgccttcatagaattgcacgtcctccccttcagagcgatacacgcccccgccttcagaggactacacgtcctcacctttaaagggctgcacgccctcgcattgaaagggctgcaagtccttgcttttagaggactacacgtcctcgccatcagaggactacac

SEQ ID NO: 63018 - DNA, 330 bp, Glycine max
  Peptide Sequence Number=SeqID_179796
atgaagtggaagatggtctgcactaagaaaactaggcaaatgacttctgaggaagctaaggaaattgctgacaagattgagcaagccacacaaggttcctttttcgcccatggacgtcaggatgtactgactactgccattgggcgactagaacaccctagtcgtatgcgtgctgctggagtcagtgtcacgatcaaacgatactttggatcggctccaaggacctcctgcacgtcttcatccatggctcccgaagacctggagcagctaacgcaaaagatcagggacaaactggaggagtcgatcacagaaaagtgtctcaataactaa

SEQ ID NO: 63019 - DNA, 184 bp, Glycine max
  Peptide Sequence Number=SeqID_179797
tcctttcgctaagcgcaagcctcgcgctaagcgcatctctgttcatgcgttaagccacgagtctcgagcgcttagtgcccaacccttgcatctaaggctgattcattccgctaagctagccaaggccaagttgagcctaatcgaatttgatctgagttcggctaagcgacagccaaaccgctaa

SEQ ID NO: 63020 - DNA, 142 bp, Glycine max
  Peptide Sequence Number=SeqID_179798
atgaacgaaaacgcaattcacgaggctccgaaaaaggggttgagaatggagatttgcataaagcaatcaataagctatggctcaaaactcaaaggtgtaggacacatgaacgaaaacgcaattcatggggctccaaaaaggg

SEQ ID NO: 63021 - DNA, 531 bp, Glycine max
  Peptide Sequence Number=SeqID_179799
aaccaagtcttttcactcgtttcgccacactgtctcaaccttacttaaagagaagggtgtcagcccggaactacgtgcgcagctagtcggacatgtgcgagcgaaattcaacattgctgacgggttggatgctgtcagagatgcgcttcgaaggaagcgtggcaaacaaacagggaagctccctagcgcattttttattgagggtagtggattttatggtgcgaaatttggcggcgctcaaaacgtgtctggtgaagtttactactgttttaatgctggtctctatgctgccaatgatgtcttcgcgtgggccgttgcgccagtctgcgcttgcgtaaaaagcattgagaaccgcagccatgctttcagcgctgtcaaaggcgcgaatcaggggcacgctgatgacctgcattatggtgtgaaaagcagttccggtgcctttgtgcaaggtgtattgcagtatcgcgacggttctcaaagcattatctccgcgtcgcctctggacggctcccttgttgatagcaatataaa

SEQ ID NO: 63022 - DNA, 344 bp, Glycine max
  Peptide Sequence Number=SeqID_179800
ggattaagagaccgtggttctcttgttgtaggggattctggaacacaagggaaggagcacaggtcgcttgagcaaatggaccaatggcttacactcaattctggatttacatgcgattctcctcaaatttcagccagcccgcatcaattagaccttgcaccttacgcttcaggcccctacaatgctcaatggaatgccccagggcttctccatgacaagcacacgttgcgttcgagtcgtattctcggagaaatggaggttgatgaaccttggttagggttatggctaccattgaattatcaagtagatatgggagcaagtcagcataggacactggaattggg

SEQ ID NO: 63023 - DNA, 393 bp, Glycine max
  Peptide Sequence Number=SeqID_179801
atgaaagataaaggcgaggactttgagtcctatgaaacaagccaatataggtgtcgcaacctacccttcggcgggagggcgacgcggggctcacgggtgcgtcttccaggggaggaaggcgcccagagtcgccaccaacgtttattcagggaaaatgttggaaaaaccgaaaagcgtgtgtggtctacagaacttttaatcgtgaaaggttcgggagttgtttttgcgcacgggaaaggtattagcaccccacgcgtccgtcacaaaggacgacagcctttaatcgagtgtgcaagacatgacttcaaaggtatttccctcgctcctacgtatcctcaattgcaattaggaaatcagacctacgtagttcttttagaactaaacattggttaa

SEQ ID NO: 63024 - DNA, 885 bp, Glycine max
  Peptide Sequence Number=SeqID_179802
atgattcatggtccatgcgaaattttgaggcctgcatctccatgcaggaaggaaggcaaatgcagtcgattttatccaaaaaagtttcagcccacaactcttatagatggagatggttatcctgtatatcgtagaagaaatactggtcagacaataaccaagaatggtattataattgataatagatgtattgtaccctacaatccaagattgttgaaaaaataccaagcacatataaatattgaatggtgcaaccaaagcacttctatcaaatatttattcaagtacatcaataaaggatatgatagagttacggctgtgatggtacatgatgacaatgaaacagtttcgcatgcaaacactccaaatgatgaaatcaaggaatatctggattgcagaaaaccttctgtagagaggctacagttccatcttccaggccaacatagcgttctctaccaagaccatgatgatattgatgatctcctctctaacccaagcatttctaaatcaaaatttatagcttggatgaatacaaaccaagcttttgttgaaggtaccatgaacaaacctgaagaagtatgggaaaaaacttggcattggttaagtgatgatattgtatatagtcatcacagatcatcaaacactccaggattacatattgatgactccaatctgatgaatctggtattgcttgaagttgaaaagctgttactagtcaatcaaagatcacttaaagactatccttccatgccatatcctgagaacgcaaatttactaacacatgtagacaaccacctcattttgtctgagctgaatttcaacaatgaagaacttagatctgaattccttaaccttttttctcaaatgacagaccaacaagcataa

SEQ ID NO: 63025 - DNA, 255 bp, Glycine max
  Peptide Sequence Number=SeqID_179803
atggaggagttgattaacaaaacacaactctttcccaaaataatccctacgtcatcacgttggctttgcggctccataaaagaatattacttcacgtactctactattctcattctgttcccacgaacaaaggttcatgatcatcacaggtaccaaccacacggtacaaaaattgagagggtcgacaaaagcggggctcttgctcctgcgtaccctccatcaaagaggaaatcagaccacgtagttctttcttaa

SEQ ID NO: 63026 - DNA, 487 bp, Glycine max
  Peptide Sequence Number=SeqID_179804
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtg

SEQ ID NO: 63027 - DNA, 374 bp, Glycine max
  Peptide Sequence Number=SeqID_179805
attctttagctgctcgtgtcagtacaaaggaaagatttagtgatccgtcagggaacgatctagacacgggtgactcagagaattacgggttgcacgttgaagaaaatcctccccgcctagttgccttaggaagactttatgaggggtcaataaccattcacaacatccctttgtgccatgatcaagtcagggttggtgttaaggaagttagctatgcagatgctcccattcatgtacccattgaagaggttcagcatatgactgagacaagtatgcgagcggggaatgtcgatgtgtatggattccttgagccacaatccatacaaagatctgggcaatcacaatttgaatcagaaagttatattaagaactag

SEQ ID NO: 63028 - DNA, 258 bp, Glycine max
  Peptide Sequence Number=SeqID_179806
atgcctaaatcatctcccaacatgcgtgtgaagcaagaagtatcaacaagagtcaagccaaggctattgtgcaagcaatcaatggggcaaaacacaccgaataaaatagatgatgatgactcaaattctcaccaaggagaaaaaacaaggatttcaattcacaaaatgccaagaaactcctatttcaaaaacaattacccattacctgtacataacccaaaattcaaagaggaacatgcaatgttgtacaaaacataa

SEQ ID NO: 63029 - DNA, 314 bp, Glycine max
  Peptide Sequence Number=SeqID_179807
ttcccattgaggttaccgaagagggtgtggggtttagcaccaaaagagatattgggacttcaattatattctgctggcacaatacttccgtccacaaggctgatgaggaagctactgcgatagagatgactcagactgtgagcttgaattttggattgacatttttgaacagtttcacaaaggcaacgccgttgtctaatacagtcactatctttttgtcgaaccagctgcatctgcctgttgtgtttcagtaccagattggtgagaagggtcatcttcgcttttacttgaagccaattaaacctgaatattag

SEQ ID NO: 63030 - DNA, 228 bp, Glycine max
  Peptide Sequence Number=SeqID_179808
atgctccaaccatatgggatcaacataggcttaaaggagcacttaaacccggtgacccccaaggcctacactccgaagagtccgtcagggcctctccctcctgattcaggctacaatgcgaaaggttttcctctaagctcagacataatatggaaattcccaacggtgagaatgctcggaattgggttgcgaacatggtgttcaaatttcacgacgatccaatggtga

SEQ ID NO: 63031 - DNA, 267 bp, Glycine max
  Peptide Sequence Number=SeqID_179809
atggtgaaaagtgcgggaccaaatggttcccgcatgtcatcgggcccgatgcctctggatgacaaaagggcgcagaagacgacgttagtctctgcgtgccattggacacgactgtgtctgaacggcaaaaaggtgtgtggaatgaccataatttgtctctgcatgtcatatgaccgcaaggtcagtatgacagagattgtggggcggccgacaaaagcgaggctcttgctcctacgtatcctcaatgaggaactcagacctacgtag

SEQ ID NO: 63032 - DNA, 916 bp, Glycine max
  Peptide Sequence Number=SeqID_179810
atggctaaaccaaataatgcaaaacctggttgtttctctgacttctttcaactactcttttgtgctgaggatggaaatagttctccaatgcacccttctaaccacattacaaaaccatatgcaacagaagtagtgcatagtcacaaagatgcaatggccaaaaatgcaaccaaaccaggagtggtggcaaggctaatggggcttgattcacttccaagtacaaaattggtgtcaaacacaaacaacaccccagattcaattccaagaagtaggtcagtgaactttgttgattacttgcgcaagtttgacacaacaagccaagccaaccaccaccaagtgaaaacaacctctgcatcattcagagaggttccttctttgcttcagcacaaaaacaaaaacaatgaccttgttgttttctactggaataatgagagtgaagatcaagaagttgtgtcctttttgaggaaacaagaaatggggttgggagaatctaggcagagaaagaagcaggggagcaagaacaaggagattgtttctgtgactaaggagaggagccacactaagagaaagaagatttccaagtttgagaatgagcctagagtggttcttcctcttaagcatagttcaaaggttcgaaatcaccatgaaaccaaagttttggcaccagtttctgcatgctctaagagttgtagtaatagcagaagaaaatgtggtagtggtcctagtgggttaagaccaagctcaaatttgccaaataagcagaagaaagtgttctctgaaccaaaatgcacgaaaaaaacaaaaaaacaacagtcaacaaagaagatagatactgaatgtagcacagagaatttcagtccaatttcagtcctagatgactatgactattcatttctttatggtcctgattttccag

SEQ ID NO: 63033 - DNA, 258 bp, Glycine max
  Peptide Sequence Number=SeqID_179811
atggtaaagtatcttagatgtaactatatttgcacgcgcaagtttctcgataactttgtgggattgcggaaaacgtttcaatatgttcttaactttggtttaatcaattccatatgcctttatggcaccttcagagaaaaagaggtaggagggctaggaattaaagatttaagggctttaaatttagtcctattggaagagggtctatctggtggcaggatatttggcatttggatgaggatggtaaaggggatgtag

SEQ ID NO: 63034 - DNA, 4236 bp, Glycine max
  Peptide Sequence Number=SeqID_179812
atggctcaacttgcagtaagtttcatcgtaccaagggttgcgagaaaactatccgatgtcctcattcaagaatcggcacgattggtggaggttgcggatcgaattcgttggattgtaaaagagctggagtacatgcagaaattcgtacaagaccttgaacgctccaattccaatcagttggaggagatgtttgaggagataacaaatgttgttgcgcgccaagcagaagatgtcatagacactttcctcaacaagtcagtcaatagaaggaagaaaggagttcagtatttgttagagaaatacgacattgccaaagaactggagccgatctgcgacagggtgcgagaaatctctgagagaataagtaactatttgaatgagccaatagctgtgaccattgaaactccacgagtaagagccaccacaatagtatccccagcgctggaggagcttgatcacattctgacccaaaatttaattatcctggatgaggagctgatcgagatagtagagcatgtgagagataaggaccttggcgacacacacaacattgtgtctaaattaaactcagcagaggaatccattcacagtcagagtcagagagcaagggtgtggttgaaagatatagagaacatttgtgctgatacagttgctgttgctgaaaatttcatcgccacaagaagaaaaaggctgtcaagaaccgggtggctttggcaggttttctatttttttgagcaacgtgtttccgagaggaaatttaagcagcagatggaatatatccgcactcagcttgaagatgcactttacagaaggtggactttcggagatggagggaaggacatgggagacaaaataggatcaagatcaagacctgctccgagtttgtcactagtacggttgacactggcaaaagtcccactcttccttttcaacagctcctttgcccctttgttgtttgtcgccgttataactaccatcgactttttcatgtttggtcgaaaacgcagagcaagagagcataaacttaaggagaaaaaaaaatcaagacagcttacccctttcttgtggttcgatttagttgattttatggtttacgtcttcttctatgcttttcctgccgaattatggatagtcttacaattcgtctggatagtctatacagttattcccttgtctgtgtctttggagaggagtttggacgagaatttggagacaatccgaagatacttagctctaatggatgcgttattcagtgacataaacactgaaagcgcagagggcctgaataaaagacagcaggtgtgggtgaaccaattaagactcgtggcacataaggttcattctctttctgcgtatccaaagccaaggggttggaatatcgttaacaaaattatatttgcggaggacatcaccgactttttgaatgaaattcttgatatttcagacaagaaaaacatttatggatttgcaagtatacaaggaagaaaggagttggtatcaacagtccaaaggagcgagagcaaagacattgctgaacattccggtgcccatccacagccgtatgcctcctcttcctcatatcagcgtgtcacagggctcagatcgaaataccaattaatcaaagacgaaatggacttgatgaatgcactgattgatgatgtaggagagcttggaaaactagagggaagatccgaaatctgggttgagcaaatgaaaggtattgcctcagaggccgaagctgtcatccgcgagtgtgatagtgaattggagagtaaccactatttcaaacacctgctggtgcggtataaaattatgggcaagatagaccggatcacagaggaaattgaagatgcctcgagaagaagaaacgcatatggcttggttcaacttcaatcccgagatgagtcactgtccacggttcaaatgttacgtcgaaagtcagaacaaccatctctcattggcaaagaatccataatcgttggtaaagaattcacaatcattggcttcaatgaagacgtggattttttgacggaccacttactctcgaatgaggaaagttgctgcgttacttcaatagtaggaattgaaggcacgggtaagacaacactagccagattgatttttgacaacaaagctgttgaagatggttttacttgtcgagtaccagtgtcagtgtctccaggttgcacagttgacaaacttttagaagaaatagcgaaggaggctgccacacaaattatgggaggccaacggaacaaatggacaatacaagaagcactcagagccttggggagtacaaagtatctcatacttgttgatggcattgaaacttgccagcttttggacagcttgacagaggccatacctgacaagtcaaaaggaagcagatttcttcttaccactcgcaatgcaaatattgtagcccgacaaccaggtacaagatcctttgtttaccatctacagttattggacgatgaaaatagttggattcttttcaaaaaaaagttgaaagttcccattccctcagaaccaaaactaatagaggttgcaaaaaaaattgtggccaaatgcgggggcctgccattggaaatattaaaaatgagtgaattactatcaaataaagatgtcacagaagagcagtggtcaagggtgcaagagcagcccaatccaagtcaaaacccatggtctgaaacacttagctcagtcaccatcagcttaccttcacatctgaggagatgcttattttatcttgaattattccctgctaattttgggattcctgcaagaagattggttgtcttgtgggttgcagagggtttagtgcagcatggggagaaccaagagccaccagagcaagtcgcagagagatacttgacaaagctgatagatctgaacttggttcaaattgccaagagaaggcccaatggcaaggtcaaaacatgccgtctccctaatgctttgcgtgaaattttggtggaagaagtccaggctagaaaggatttgaattcagtctcaaatatttctagaatacgtcaggtggctgatcgtcttgacagaaaagataaatgggacaaacatatgcatggtatcactacaagtgattcagcttccttgggaatctacaaggatgttttctccttcctgtcctttgattttcgagaaggaagtaaacctggccaagacataagtaactttctgaacctgtgtatttctagcaagtgtcttttactgcttcgggtgcttgatctcgaaggcgttcacaagcctgagttgcccgaaaacattaaaaagcttgctcgattgaggtatcttggcctaagatggacttatttggagtcacttccatcatctataagcaaattgctgaaactccaaactcttgatctgaagcatacttacatacatactctaaccaactccatctggaagatggaactgagacacctgttcttgagtgagacttatcgtaccagatttccacccaaaccaagagctgcaggtgattctctgtctgacctccaaacattgtggggactttttgtagatgaagagactccggtgaagggtggtctggacaaattggtcaatatcagaaaactgggaatagcatgccaatcaatgtcaccagaacaaggggcaatgcaatcacaacttgatgcagtagctgactggattgtgaaattagaataccttcaatcactgaggctaaaatcaagagatgagaaaggtcgaccttggaatttacacttgaagtctttgaaaaatcatattaatctcactgacatatatttgctgggaaacttgaacggtccatctattctgactcagttacctccaaatcttgttgaacttaccctatcacattcaaaacttgaggaagaccccatgaaaattttgaaagatcttccaaatctccgctcattgtctttacatgcagaatcctacataggaataaaattggtctgcaattctaaaagctttcctcagctttatgttctaaaagtttggaagctggaacaattgaaggactgggaagtaaagcaacaagcacttccctctcttagacaactggaaatccgatcatgtctgcgcatgacaaagcttcctgatggactaaagcatgttaacagtctccttgagttgaaattgacaaatatgccagtggaaattaatactgacaagcataacattccgcccaattgtgaagtccacagagatgactccgcccaattgtga

SEQ ID NO: 63035 - DNA, 852 bp, Glycine max
  Peptide Sequence Number=SeqID_179813
atgttgcttgctgtggtctggaatgtactggaaatccgagttctggttttattcagtttgatcttgcaaataatccttatagtttgtggcaaccaaagaaagtacaaagcaggttgggtgctacaattcggtgtgtggtttacctatctgtcagcagattgggctgcgacctttgtgctgggcattctttccaaagacagcaaaaatccttcaacagaccccaccaactccataatcatggccatctgggcacccttccttcttgtgcatcttggtggccctgacacaatcactgcctactccctcgaggataatgagctatggctacgacactttcttgggttaatctcccagctatttggagcagtttatgttgtttacagttcatggaatgacagaaaccttaactatgttaccattccagttatggtggcaggaataatcaaatatactgagaggactttgtccttgtggttgggaagcagcaaaaagttcagagaatccattcaccgtccaccagacccaggaccaaattatgccaaattcatggatgactgcactgcaaaaatagctgaaggatataaagttgaattgaaggttgaatctactcccatattgtcggatcactctctagcggcaatagcaaatgaaagtgtaccagatgctttgcgtttgcactatggattctatttccttgaaattttcgagtgcctatttgcagatctcatccttggttttcaagaactccaagaaagccaacatttctttcagaacaaatcatgggaacatgcgtataaagtaattgaggttgagcttggattgatgtatgataagctatatacaaaggcagtg

SEQ ID NO: 63036 - DNA, 865 bp, Glycine max
  Peptide Sequence Number=SeqID_179814
atgccgctcgctgttgtctggaaaatattggaacttagagttctggttttactgagtttggccttccaaataatgctaatagtttttggcaaccaaagaaagtaccaagcagatttggttgctacctatgttctgggcattctttcaaaagacagcaaagatcatccagtacacatggccatctgggcacccttccttcttgtgcatcttggtggccctgacacaattactgcctatgccctggaggataatgagctatggaaacgacactttcttggaataatgacccagatattcggagcagtttatgtggtttacagttcatggaatggaagcaagcttaattatgttaccattccagttatggtggcaggagtaatcaaatatggtgagaggacttggtccttgtggtgtggaagcagtgaaaagttcagagaatccattctccctcctcctgacccaggaccaaattatgccaaattcatggacgactgcactgcaaaaaaagctgaaggatataaagttgaattgaaggtcaaagatacttccactttatcatataactctaaaggagcaatagcaaatgaaaatgtacaagatgctttgctcttacacgatggattctatttctttaaaatttttgagcgcctatttgcagatctcatccttagcattcaagaactcaaaatcagccgaaattactttcagcacaatggcatgtcatgggagcgtgcgtttaaagtaattgaggttgagcttggattgatgtatgataagctatacacaaaggcagtggtaacatactgcggccttggctttggctttggccctggcttttgctttggccttggtcttggcctcaaaa

SEQ ID NO: 63037 - DNA, 1071 bp, Glycine max
  Peptide Sequence Number=SeqID_179815
ggttgtccggtagaagtaaaggtgtataatccacatgaaaagaatgttgatgcaagaaccattagtggtttcttcatatgctatcctaaaaagtccaaaggctgtagattctattgtcctaaccatagtacgggaatagttgagtctggtaatgctcagttcattgaaaatggtcaattagtgggatcaatcaacacccagagacaacataatattcaaatcacacgggatgatgaaccagcagacaatgtgcaagtcataaatgaagaagtgatagaagtggtgcaagaaatagcaccaagaaggtctgaaaggcatagaaggccagctatttcaagcgattatgttgtgtattcacttgaacatgaatgtgacttgagcattgatgaagatccagtctcttttagacaagccatggaaagtgaaattctgaaaagttcaaaacgagttggttgtaaatgggtctatagaaccaaatgtggctcgaagggaaatattgaaaggtacaaagctagacttgttgccaaagttttcaccctaaagaatggcaatgactacaaagagatcttctctcttgtttctaagaatgactctttgaggattgtattagttttggtggctcgttatgatttagatcttcaccaaatgaatgtaaagatcgcctttctaaatggtgacttagaggaagaagtttatatgaataaacctgaatggtttgtttctacaagaaaggaacatttagtgtgtaaattaaagaagtcaatatatggactaaaacaaggttctagacaatggtatcttaaattcaccatcacgccgtatggttttgtagaaaacaccattgatcggtttatctacatgaaggtcagtgggagaatatttgtgattttaatcttgtatgttggtgacatttttcttgttgctaatgatgttgctatgttacataatgtaaagaagtatctctctaataactttgaaatgaaagatatgggcaaggcatcctatgtgataggaatagaaatattttgtgaaaagtcacaaggattgttgggattgtctcagaaaggataa

SEQ ID NO: 63038 - DNA, 1218 bp, Glycine max
  Peptide Sequence Number=SeqID_179816
atgattggagggaagcagagagcggcaaatgcaaaaaaggaagagaagaaaggaaaagcagcagaaagtgacaaaatcccagtaaagagtgacagtgccagctccctcaagccaaagtcttgtgcttttcacatccccattttcccatttccctttctgcttcctctttcgccaaatgggtctcccataacacaatcttcaccttttttttttcctctttctttcttcttcgcttctcggtggggcttcaagtttcaccataggatgttttctaggttgatacatcctcatgaagggcaggaagacatgcagggtggctccaatcacgctcacctcggagacccttgtcttgttttaacctccgatcccaaacctcgtcttcgttggaccgctgaccttcatgaacgctttgttgatgctgtcactcaacttgggggtgccagtaaagccactccaaaagcaatcatgaggaccatgaatgtcaagggtttgacgctctatcatttgaagagtcatcttcagaagtacaggctaggtaagcaatcaggaaaagattctgatgagggatgcaaagatgtaaactttatcttacttattgaaaaaactgtgcaaggaatgtcagcttcatatcttcaagaaagccctggtactgataactcttctccaaagttaccagatgctaacgagggtcatgaagtcaaggaggcattaagagcacagatggaagtgcaaagtaaactacacttactagtggaggcagagaagcacttgcaaattcgccaggatgcagagcgaagatacatgggcatgcttgagcgagcgtgtaagatgttggcagatcaatttattggggatgtaactattgacatggacggccaaaaatttcaagggctggaaagcaaaacatccagaagttccctagttgatcacgttggcttttatccccaagcgtgtactgaggtcggcggaatgcatgcttcagtagtatcacctattcttcaacctcaaggggctgactgtttcactgaaagttgcctaacatcacttgagagtctgggagggttgacactagaaggatctcctggcggatcgaagaagaggatgctgaacttggactcgatggtagcacctttgatctggagtgaagccaacaccagaactcaaggaattcatttagccaaagttaatccttcaggaatgactaggtacggcatgtag

SEQ ID NO: 63039 - DNA, 3978 bp, Glycine max
  Peptide Sequence Number=SeqID_179817
atgcatttctttgacatataccgccacggcaatgaggcggagcagagcactggcaggctgagagaaagactactgatgaactgtgagcaaacaattatagacgtgtccgttgaaactccaggtgcagtggaacagagcaatgacaggctaagaaaaagactactactgaactctgagcaaacaaatatagacgtgtccattgaaactccaggtgcagtggaacagagcaccgacaggccgagagaaagactactactgatctctgagcaaacaaacatagacgtttccgttgaaactccaggtgcagtagccacagcgctggagaagcttgatcacattctgactcaaaatttaattaccctggaagatgtaatcaagagggtaggatatgtgagagacgacctccttggcgacacgcaaaatattatcttgtcttctaatttaagttcaacagcaggggagttgagtcagagagaaaagttgtggctggaagaggtaaaggatgtttgtgattacacggttggtgttgctgaaaaattcattgcaagaacagaaagacggttaagcatggggaggctttggaaggtcttttatctttatgggcaatatgcttccgagcaagaattttccaagcagatggagtatatcagcactcagtttggagatgcactttacagaaggtggattttcggagatagaggggacaaaataggatcaagatcaagacctgttgcatttccaagctttagcccacccgctaacctttttacagttattgccaggactgtgtctttgtggaggtctttggacgagaatttgaagacaagccaaagatatttagctctaatgagtgcgcttttcagtgatattggaagcgcggacgaaggcctgaaccagagacagaaagtgtgggtgaatcaattaaaactcgtggctcggaagggagagtctcttgttgctgcgtatccaaaggatgggtttcccttttccgtcagcagatacagatatgccaagaacatcaaccgcttgttgaatgaaattattcatatctcagacaggaagaacatctatgacattgcaaatatacaaggcgggaaacagaatgaaagcattgctgaagacaatcacaattctcccgattccatttgctaccgggataccacagaactcgatactggcgaaaagcaattgatggatgcactgttacttgatgtaaaacagagtggatatgaagacaatcacaattctcccgattccatttgctaccgggataccacagagctcgattgggaactggatttaatcactggcgaaaagcaattgatggatgcactgttacttgatgtaaaacggattggatatgaagacctagatggaagatacaaaatctgggtgaaccaaatcaaaggtattgcccgtgaaacgaaagctgtcattgatgagagcggtggccgtgaattggatcgtaagccaatgctaaacaggattagacagaaaattaaagatgcctccagaagtagaaaagcacattatggtttggttcaatgtgaatccggagctgagtcattacgtccaaggacacaaccatttttcaacgaaaacgtgaaggttttgatggcccagttactttcggatgagaaatttcgctgcattacttcaatagttggaattaaaggcacgggtaagacaaaactagccaaaatgatacttagaaacgaagctgtcattaatcattttgattatagaatctttgtgcctccaagttatgcaacagttgaacagattaaagaatacatagccaagaaggctgcagaaattattaagggagacaaacaaaacgcactcgcaaccttggcgagtaaaaaacatctcatagttattgatggcatagaaactcctcatgtcttggataccttgatagagatcatacctgacatgttaacagcaagcagatttcttcttaccactcacaatgcaaatgtagcccaacaagcaggtatgagatcctttgttcaccctttacagttactagacgatgaaaacagttggactctgttcacaacagatttgaaggtgaacattcccctagaatcaaaactgtccgagactgggaaaaaaattgtggctaaatgtggtggcctgccattggaaataagaaaaacgaggagtttgctttctggcaaagatgtgacacaagaggactggtcaagcgtgctaaagcatcccaatcttccattggaaatattaaaaataagcaaattgttttcgaggaaagatgtaacagaagaaaagaagtggtccagcgtgctcaaacatcccggccttccatcagaaatattaaaaataatcaaattgcttcgaaggaaagatttgacagaagaggagtggccaagcgtgcgtcaaaacccttggtctgacacacttaacacgatcaacatcaacttaccttcacatctgaggcgatgcttattttattttgagctattccctgctaattttgggattgctgcaagaagattagttgctttgtgggttgcagagggtctagtgcatcatggggaagaccaagagccaccagagcaagttgcagaaaggtatttaaaagagttgatagatctgaacttggttcaaattgccaagagcaagcccaatggcactgtcaaaacatgtcgtctccctcatgctttgcacgatttgttgttgagaaagcctgaagatgctagatttcctcaagtatataccagcaaagagttgattgcaaaccaaaaatatcccgaaatacgcgaggtggctgatcgtcttgatgaaaatcataactggcaccaacatattcatggtaacattaccaatgattcacctcaagtgggaacctactacaagggtgttcactccttcctgtcctttgattttcgagaaggaagtagaccaggccaagaattatgtaactttctgaacctgtgtatttcaagcaactgtcttctactattgcgggtgcttgatcttgaaggcgtttacaagcccaagttgcccgaaagcattgaaagacttactcggttgaggtatcttggcttaagatggacttatttagagtcacttccatcatctataagcagcttgctgcaactccagactcttgatctgaaacatacttacatacacactctaaccagctccatctggaacatgaaactgagacatctcttcttgagtgagacttaccggaccagatttccatccaaaccaaaaggtacaggtaattctctatctgacgtccaaacaatgtggggtcttttcgtagatgaagagactccggtgaagggtggtctggaccaattggtcaatatcacaaaactgggaatagcatgccaatcaatgtcactacagcaagaggtaatggaatcacaacttgatgcagtagctgactggattgtgaaactagaataccttcaatcactgaggcttaaatcaagaaatgaagaaggtcaaccttggaaaataaacttgaagtctttgaaaaaacacaataatctcactgacatgtatttgctgggaagcttgacaaacgcatctgttctgttccccgaaagccttgttgagcttaccctgtcacattccaaactagagaacgacccaatgaaaattttgaaagatcttccaaaccttcgatcattgtctttgcttgcagaatcctacgagggggaaaaaatgatctgcaaatctaaaagttttcctcagctttatgtcttgaaagtttggaatttgaagcaattaaagaattggttgataaagcaacaagcactcccctctctcagacaactggaaatccgatcatgtcctggcttgacaaatcttccttttggactgtggcatgttaaaagtctccttgagttgacactgacaaacatgtcaaaggaaatcaatattggcatatatcgccttccggacaattgtaaagtccgcagagataattctcagtag

SEQ ID NO: 63040 - DNA, 1299 bp, Glycine max
  Peptide Sequence Number=SeqID_179818
atggaaggtgttggcgccatcttcctcgactccaatttagaggctgtcggacttggaggtgcaaaagcaaagagagtgaaagtggtgaagggagattctgttcctgtggccaacgtgggagcttcccagaacaaaattcttgctgacataagcaacttaccccaacaaccaaagcaacacatctctgttgatcaccttctcaagtttttatttacgggggttttgtcaacttgtgtggacagtgccattatagagtcgtgtaaagctgagctgcacaagtgtcaaaccaattttcagaaactaaggaagcaaaatgcggaacttgccctcacaaatgctcaaatgctggcggagcttaattcaagtaggcagaagctaagggaacttcagcttgaactaggaagcaaaaatggtatactcaatgctatgagattagaattgacgctaaaagagcaaacagataaaacgaagcatgaaactgatgcaaatgaggtgagagcatgtcagagtaagctgtcagatcagtcattgcaagaagataacaaggggaatgcaaaaaggaagagagtgtccaaacctcaatgtagtgtagtgaacctactttcttctgcacctgctgtcattaaacaagtcaaatccactggaaaggtcgacaatcagaggtatagtttgcgaaggcaatctgcagggttgaaagctgaaaaaccagaaccaacaaaagattccttggaggtggttgaagtcaaagatgatatttcacatctacaagaaaatttggccaatgaaaatggaccaacatcattggggtcaaaggtccatgacgaagccagagaagctactgaatcttcgagacctactaacacagagcaagttcatgttaaaaagaatattgaaaagaagaggcagagtatgagaagacagactaacaggttcaggcctgggaatccagaaccagctgaagacttctttaagatagatgatgcaaaatttactgtctcccaattatctgataatatgtcagaaaaaaattgtccaacaacatcaactgtaacttctgaacaagaaaatgacgcctgtacatttgagcctcaggaaactcgtagatcatctgttgggcggccattgcgtcggacagttgagaagattgtgtcctacaaggaagttccacttaacttgaagatgcgcagagataaatcagaagcattatatgcactacatccggatgctatagtacatggtgataggggttctatggatttgtttttcaatagcttcttgtttagggctttgcatccttga

SEQ ID NO: 63041 - DNA, 135 bp, Glycine max
  Peptide Sequence Number=SeqID_179819
atgggaagcaagggtgccttcatttttgtgttgcttgtggcactggcagtggttgagttcttggtaaatgtaattaaaatggaattgggtgtgcttctctacattcctatgttgcatgctagagctttgagatga

SEQ ID NO: 63042 - DNA, 309 bp, Glycine max
  Peptide Sequence Number=SeqID_179820
atgtctctcagctgtaaacaagcagcatcaggtagtgatgagcattgcagtgttcacttgagactggtcaaaggactagtacactgggatcttaagatccaattgcaacatatgggacttgggtctcagtctctgattgaaactacgggatcccagtgcggggttcataagtctggttatcagacctaccataaagacaacacttgtaaaggaaccaacttcatctgtgaacagccgtctggcaaaaacagcctactctactatttctgcagcagtaagatgtctccgaagacccattctgcaaaataa

SEQ ID NO: 63043 - DNA, 471 bp, Glycine max
  Peptide Sequence Number=SeqID_179821
atggcgccgccatatgaaacccgcaatgccatcgctatttggtggcatttttccaaaaacccgcaatggtcacgtttgaccttctctagtcactgccctaatcaagccctttctcttgtcactcttgatgcttacttaacctgggcatcaggcatatgtaatgttatcaatcaaactatcactgatgaggatgtagagaggcttatcgagcttgtgaagggaatttcttgcaagattaatctaatctcattcaatccgcacagtggatcattcttcaaaccaaccaaatatgaaaggatgattgaattccgaaatacattggctggggcaggattgatagtatttttaagacttagtagaggtgatgatcaattggcttcctgtggtcaattgggtaagcctggcaccattcaagctccattgcttcgtgtaccagagcaattccaaatggcaattggaagttcaacttga

SEQ ID NO: 63044 - DNA, 471 bp, Glycine max
  Peptide Sequence Number=SeqID_179822
atggagagcctaggagaagaaagagacatcgatcatcatcaagaaaattgcagtttcaatgccctagtaaactttccaaacgtgatacttttagtgatggagctgagaggaattgtctcatgctattccaagtattccatagagttcaagtgccatattggatggctagaggatgaatggatgatttatgaatattccaagaaggatgcttttcaggcaattcaattagatggctcaaggcccaggaagcccattgttcttgatattgatgatgatgacgacgatgatgaagctcatattgtggagaaaacagaaaacaaatttcctgaatacctgaaagaagctaagatctattttccatcaagagatgatccagagtgtgttgaaatttgttacacagacacaaattgcctagccccagaaggctatttaacatcaactattatgaacttctacattcagtccttttaa

SEQ ID NO: 63045 - DNA, 678 bp, Glycine max
  Peptide Sequence Number=SeqID_179823
atggccacgttgatgggtaaagcgccacgaattctatacaccacccaacacttggtgaacaattctgttacgcttccgacaaactttgctgcaatggctactcactctgctgcgacggagaggacttacaaagaatcattcgattccgctgcaaacaagcgctacgctgatcacataattcctcatattctgcatctgtatggatcatctgcaacctctcgcgactttgaaatctatgccgcaaatgcttcatttgaggatccacttatgtgtgcccacggggtgaaacagatcaaatcagcattctatactcttcccaaggtatttaagaagtcaaagatagtggaatacagtatcaaagaaaatatggtttcaccaggaaaaggagagatattaattgacaataagcaatactacaaattcttggggaaggatataaatatggtatcactaatcaagttgtatattgaggagggtaaagttgttcgccatgaggactgtataaaacaatctcgggccttaatatgtaaggattatgtcaggtgggacaaaaaaccaatttcaaatagagaaacggcgaagctgccactgcttggtcgaatagcagaaatgactcgcaggggatcaatgctggcaacacatgtgcttatgagatttgggaaggacccaaatgtgtga

SEQ ID NO: 63046 - DNA, 636 bp, Glycine max
  Peptide Sequence Number=SeqID_179824
atgagtggagctgttcttgttgctgttgctgctgccatcggtaacttactacaaggatgggataatgcgactattgcagccattaaccccgagagtttgtatgcaggatctatcctgtacataaaaaaggaatttcaattagaaaatgaacccacagttgaaggtctaattgtggctatgtcacttattggagccaccgtggttactacatgctctggggccctatcagacttgctaggccgacgtccaatgttgattatctcctctatgctttattttgttagttctctcgtgatgctgtggtctccaaatgtttatatcctcctctttgctagacttttagatggtttgggaattggtttagcagttaccttggttcctctttacatatctgagacagctcctcctgagattaggggattactcaatacacttccacagttcactggttctttgggaatgtttttctcctactgtatggtgtttgggatgtcactgatgaaggcgcctagctggagaatcatgttgggtgttctttcaatcccttctcttattttctttgcactcacactgttgttcttgcctgagtctcccagatggcttgtcagtaagggccgaatgcttgaggccaagaag

SEQ ID NO: 63047 - DNA, 276 bp, Glycine max
  Peptide Sequence Number=SeqID_179825
atggaattgcttcatgtgtgggagccattcagtgggttcaaccctctcttcttgggaaattctttcatgtgtgaacaggaatgccaccaagatgagttcaattctgaagatgcgccatcaacaactaaaaagaaccttgggagagccacgccacaaaagctagcttttgtagttggtgtcttggagagcccaaggcctataaacctcacattagattcccatacttccaatgtgggactcaagtcccaaaccttggaagttggaattggatcctag

SEQ ID NO: 63048 - DNA, 227 bp, Glycine max
  Peptide Sequence Number=SeqID_179826
tagcggcggcaggaggtggagggacggtgggggctgcggcggttgcggggttcataaccggaagtgggggccacagcttctccgacggcctcgtcgctcacatccccgacatcaaccccgtcgtcgacgactgcatcaccttcgtcgagaatttccgatcagagttaggtgatgggcggcgaggatgttggagaagaggcagtggtccacgagggtggagaaaatga

SEQ ID NO: 63049 - DNA, 1045 bp, Glycine max
  Peptide Sequence Number=SeqID_179827
gtgaaatggctctactggttgagggtcttggagttgggggtgatacagccatagaagagtatataattggtccagccaatgaacttgatgaagaggatcaatccagagaaaaagatcaaattaagttgtatggaccggaacaaggtcagtcctgggttgctagacctgttgctggacaaaattctgttggccttgtatctaggaaaggaagcatggtaaatcagagcggtctagtggaccctctagtgaccctctttggtagtatccatgagaagcacccggaaacaggaagcatgcgaagcaccctttttccacactttgggagtatgtttagtgttgggggaaatcagccaaggaatgaagattgggatgaggaaagcctagccagagagggtgatgattatgtctctgatgctgctgctggtgattctgatgacaatttgcagagtccattgatctctcgtcaaacaacaagtatggataaggacataactcctcctgcccatagtaacctttcaagcatgaggcaaggtagtcttttacatggaaatgcaggagaacccactggtagtactgggattggtggtggttggcagctagcatggaaatggtctgaaagagagagcccagatggaaagaaggaaggtggattccagagaatatatttacaccaagatggtggttctggatctagacgtgggtctgtggtttcactccctggtggtgatttaccaactgatggtgaggttgtacaggctgctgctctggtgagtcggtcagccctttataacaaggaccttatgtgtcaacggccagttggaccagctatgattcatccgtctgaaacaattgcaaaagggccaagttggagtgacctttttgaacctggagtaaagcatgcattaattgtgggggtgggaatgcaaattcttcagcaggactgtgagggtttaagggcgagccctggtgcagcggtaaagttgtgccttggtgacttgttggtcatgggttcgaatccggaaacagcctctttgcatatgcaagg

SEQ ID NO: 63050 - DNA, 768 bp, Glycine max
  Peptide Sequence Number=SeqID_179828
atgaagaacttggcacttgagttgtaccaaaatcaatgtagaatgaatgagacaattgtgatttgccacagtgaacctggtgcttggtaccctctactgtctgaaacctttccatgccctccatcttcttaccatgatttcaagtctctgattggcaggactatgtttgagactaatagagtgaatgatgaacacatggaacgctgtaatataatggactatgtttgggttactacagagtttcacgagtctacatttgtgcaaagtggaattgatccttccaaggtggtgaagattgttcaacctgttgatgtgaagttctttgatcctgtgaggtacaagccattggatcttgcttcgagagctaaacttgtcttaggttctggtgaattctcaaaggatgattgggttgctttgtacttgttaacaaatccttatcatactgacatggatttcgggaacaagatattggattttatggagagttctgatatggtagaaccagttagtggttgggctccagagcatgtgattgatactcacatagcattgaggaagtttccgaggttcttccttccagaggggaggatgggggagaccactggtggaggccatgtcaatggcattgcagtaacagaaggtccattcaagggacatctttgggctgaaccttccgaggataaacttcaggttcttatgagacatgtgatggataatctcactgaagctacagctaaaggcagaaaggcaagggaggacatgatatga

SEQ ID NO: 63051 - DNA, 757 bp, Glycine max
  Peptide Sequence Number=SeqID_179829
aaaaaactcctttaactccaaagctgaggcaatttgtaagatcaagctaagcattttcctaaaaagatctgctttttggtttggaagttgtctaatagcaggtggagttactatagagtcacatttctctggtataaatggggtcctctactatacacctcaaattcttgagcaggcaggtgttggttatcttctttcaagtctaggccttggttctacttcttcgtcctttcttattagtgcggtgacaaccttgttgatgcttccttgtatagccattgccatgaggctcatggatatttcgggcagaaggactttgctgctcagtacaatccccgtcctaatagtagctcttctcatattagtcctggggagtcttgtggatttgggaaccactgcaaatgcatcaatctcaaccattagtgttattgtctatttctgtttctttgtcatgggatttgggccaattcctaatatactttgtgcagagatcttccccactcgagttcgtggcctctgcattgccatttgtgctcttaccttttggatctgtgatatcattgtcacctacacactcccagttatgctcaattctttaggcctcgctggtgtttttggtatttatgctgtcgcgtgcttcatagcatgggtgtttgtctttttgaaagttccagaaaccaagggcatgccactggaagtgatcattgagttcttctctgttggagcaaaacaggttgacgatgccaagcacaactga

SEQ ID NO: 63052 - DNA, 1152 bp, Glycine max
  Peptide Sequence Number=SeqID_179830
actgatcttccctcgttccggcggccggacttgagctccggcagcctattcgatccgaatctactggcggcgttcgagcatgccgtgaaggaacatgctagaatgaccgaagaacagaggagagccagagtcgaagaagagtcttcacagaaagtggaagatcatgaccctgaccctgaccctgaccctgaccctgatcctttgatgttctttgaagagaagtgtccacccgggggcgatggcacagttattttctacaccacgacgcttaggggaatccggaagacattcgaggactgcaacaaaattcgcttcctcctgcagagtttcaaggttttgtattttgagagggacatttcaatgcacaaggaattcaaggatgagttgtggagcagtttggaggggaaatcactgcctccaaggctttttgttaaggggaggtacattggtggagcagaagaagttttgagtttgcatgaacagggaaagctgaggaaaatcttagtaggggttccaatggattattctaatggtccttgtgatgcatgtggagggataaggtttgtgttgtgcttcaagtgtaatggaagccacaaggtcgtggaggaaaatggagagagcaatcagtgccttcagtgtaatgagaatggcttgattttcgatgacaaattctacaacctaattcaggtatcacagaaagagtaccagcattgcacttcacttgaacctctaaggatattcaatagtagcccagtaattcttccactgagggagagaggtgtgttgttcttcatatgcaacatcccaaactactgttgtctaggccagaagattgtgatttctgtccataaagattccttagaaaaaaccccatcaccatcaccttctcaagtgccaatcacaatctctccacatccatcatcaccaaatgcttctgctcctcaaccccatggatcttctagtggcatgagtagccctccatctcctactacaaacacttcaggaggtaatggtgggaactctcctggaccatcttcaactcaagagggaaagtctaatgcagtggcattggtaggtgggagaagtttcactgtatctctggggcaactcttatctatgcttggtgctttctttggattatgggttatgtag

SEQ ID NO: 63053 - DNA, 441 bp, Glycine max
  Peptide Sequence Number=SeqID_179831
atgttggtatttttaaatacaacttttgtaattggcttggtcttcttacttgtcaccatagcttttgcatgtgtgcgtcttcgcatggctcgtggtcctaacatgctaaacattttggctggtattccaccatctcgccaagcacgatcagaagaagattcagctgaacaggggcttcatcacattgacacaagttttgagagctatccgaagttgctttactctcaagtagagaagggttcaagtagttcaagtgttgtttcttctagctgctccatatgcttaggtgactacaaagaaagtgacacgttgaggttgcttcctcactgtgaccatcttttccaccttgcttgcgttgatccttggcttaggttgcattcaacttgtcccatatgtagaaaatcatctattcaagcttcacatagtgactccaatatttag

SEQ ID NO: 63054 - DNA, 144 bp, Glycine max
  Peptide Sequence Number=SeqID_179832
atggtttctcgtcagaaaattgagttgaccggaggagttacagctggcgtcttcatctatatccagatgaggcttttcgcaacacaatcagaatatgctgatcgcctcgctgcagctgtaactcaactcctctgctcatattaa

SEQ ID NO: 63055 - DNA, 441 bp, Glycine max
  Peptide Sequence Number=SeqID_179833
atgaatagttcagaggagactgtgttattgcttgtgagctttattgttctaacccttatagttacactcacagcttatgtgtgctctaataacattccacgcactattccatctgtgcctggtggtgccacacactccaacaacaaccacaccataatcactgtggagacacctgagccacgcttagatcacactagtgtcagaagctatcctagtctccaattctccaaggccaaattgtgtagtagcaatagtaatagtagctcttcaagttgttccatatgcttgatggattacaaagagtgtgattccttgagagtgcttcctgcttgtgctcacttcttccatgtcaagtgtgttgatccttggttgagaatcaatttgacatgcccggtttgtaggaccccaatagccctcccagatatatgtaaaaatttgtaa

SEQ ID NO: 63056 - DNA, 3208 bp, Glycine max
  Peptide Sequence Number=SeqID_179834
atggggtatttgtatctcttgctgatttcatatttgtctgccttgttgtatgctgcttctgcattgaactctgatgggttggctttgttgtccctcttgagggactggactattgtgcctagtgacataaactccacatggaagttgtctgattccactccgtgctcatcttgggcaggagtgcattgtgataatgccaataatgtggtttctctaaacctcactagttattctatttttggtcaattaggacctgatcttggacgtatggttcacttgcaaaccatagacttatcatataatgatctatttggaaaaattcccccagaattagacaactgtaccatgcttgagtacttggacctttctgtaaacaactttagtggaggaatacctcagagcttcaaaaacttgcaaaatttgaagcatatagacctttcatctaatccgctgaatggtgaaattcctgaacccttgtttgacatttatcacctggaagaagtgtatcttagcaacaacagtttgactggttcaatttcctcaagtgttgggaatatcactaagcttgtcacactggatctttcttataatcagctgtcagggacaattcccatgtccattggaaattgtagtaacttagagaatctatatttggaaaggaatcaattagagggagttattcctgagagtctaaataatctcaaaaatcttcaggagttatttctcaattataataaccttggaggcactgttcaattgggaactggaaattgcaaaaagttgtctagtttaagtctttcttacaataacttcagtgggggtataccatcaagcttggggaattgtagcggtctaatggagttttatgctgcacggagtaacttagttggcagtataccatcaaccttgggcctcatgcccaacctttctcttctaatcattccagagaacctattgtctgggaaaatacctccacagattggtaattgcaaagcactggaagagttgcgtttgaattccaatgaacttgagggagaaattcccagtgaattgggaaacttgagtaaattacgcgaccttagattgtatgaaaaccttttgacaggagaaattccacttggcatatggaaaattcaaagccttgagcagatctatctgtacattaataacctttcgggggagctaccttttgagatgacagagctcaaacatcttaagaatatctccttgtttaacaaccagttctccggagtcatacctcaaagtttaggaatcaatagcagtttggtggtgttagacttcatgtataataatttcactggtacccttccaccaaatctttgttttggaaagcaactggtgaagctgaatatgggtgtcaatcaattttatggtaacatacctccagatgtgggaaggtgtacaactcttacaagggtgagacttgaagaaaatcatttcactgggtctcttcctgatttttatattaatccaaatctctcttacatgagcatcaacaacaacaatatcagtggagcaattccatcaagtttgggaaaatgcacaaatctctctcttttaaatttgtccatgaacagcttgacgggtcttgtaccttcagagcttggaaaccttgagaatctccagactttggatctttctcacaataacttggaaggtcctttgccacatcagctgtcaaactgtgccaaaatgatcaagtttgatgtcagattcaattccttgaatggttcggttccatcaagttttcggagctggacaacattaacagctttaattctctcagagaatcattttaatggtggtatcccagctttcttgtcagaatttaaaaagctcaacgagttacaacttggtggaaacatgtttggaggaaacattcctagatcaatcggagagctggtgaatttgatatatgaactaaatctaagtgctactgggctgataggtgagcttcctagggagattggaaacctgaagagtctgctaagcctggatctatcttggaacaatttgacaggaagtatacaagttcttgatgggctcagttcattatctgaattcaacatctcatataattcttttgaaggtcctgtgccacaacagctaacaacattaccaaactcttctttatcatttttgggcaatcctggcctgtgtggctcgaatttcactgagagcagctatttaaagccttgtgacacaaattcaaaaaagtcaaaaaagctcagtaaagttgcaactgtgatgatagcacttggatctgcaatatttgttgttctgctgctgtggttagtatatatattctttatcagaaaaattaagcaagaagccataatcattaaggaagatgattctccaacccttcttaacgaagtgatggaagctacagaaaatctaaatgatgagtatattattggcagaggagctcaaggagttgtttataaagcagcaataggtccagacaaaacattggctataaagaagtttgtattttctcatgaagggaaaagctcaagcatgaccagagaaattcaaacccttggaaagattaggcatcgaaatttagtcaaattggaagggtgctggttgagagaaaactatggtctaattgcatacaaatacatgccaaatggaagcctacatgatgctttgcatgagaagaatccaccatactccttagaatggattgttcggaataacatagcacttggaattgctcacggattgacttatctccattatgactgtgatcctgtcatagtgcacagagatatcaaaacaagcaacatacttctagattcagaaatggagcctcatattgcagattttggtattgctaaacttatagatcagccttctacctcaacacagttatcatctgttgctggtacacttggttatatagcaccagagaatgcttatacaacaacaaagggtaaggaatctgatgtatacagttatggggtagttttgctggagctgatatccagaaagaagccattggatgcatcatttatggaaggaacggatatagttaattgggcaagatctgtctgggaggaaacgggagttgttgatgaaattgttgatccagagctggctgatgaaatttcaaattctgaagtgatgaaacaagttaccaaggtgcttttggtggctttgagatgcactgaaaaggatccac

SEQ ID NO: 63057 - DNA, 636 bp, Glycine max
  Peptide Sequence Number=SeqID_179835
atgcctttggttaggtatgaaggccagcgtgacatgctgtacaatcagacgttcaatctcgatcaagttcaatttgctgctgagggcattaaagatgctcaacaaactatgacagctttgaagtctgccaacaaggagttgaagggaatgatgaaaactgtgaagatccaagacattgataacttgcaagatgagatgatggacctcatggatgtaagtaatgaaatccaagagactttgggtagaagctataatgtgcctgatgacattgatgaggatgaccttatgggtgaacttgatgcattggaattagacatgggaaatgagactgaagctgatggggtcccatcctacctccaacctgataaagaacctgatttggatgcagaacttaacttacctccagctccaacaggacaaacagctgtgccacctggcagatccaatgcgcagttgttaactgtacttaaaatgagggggttggtttggaggggggacttagtcaagtctcattgtgaaaaacttggtgttaaaacaggttcatatacaaatgcaggaattagaatattgaaaattagcatagcagggttgctagaaattgaagccgttgacctcaagcacttaaactggctgtaa

SEQ ID NO: 63058 - DNA, 576 bp, Glycine max
  Peptide Sequence Number=SeqID_179836
atggctaatgaattttatcttatctcagtaaatgttgttgaatggcgacaccattgccgccatgcggaatggcatggcggatgttttgccaaccgccataggcaatttatgagtggaggcctgctatggtggcaccataggtttcaatggcatgttcatatgacagaattttgcccttctgccatattccgccattgggtaacaaataacattctagaatctctaaccttggatatcttcatcataacaccaatgataccacttgttactaacggaaaattgattcatagcttaaataaaaatgagcatgctcttgatatggctgctcctgttcatgagagattgggtgatatggatggtcctactgacgacaattcctcattgaagaagagaaccaatgttctcctcctcggtgatcacactggagacttgggaatgtctgatggtttgaattatgagactcgaatatccatgggattcctgaatcacaacgttgagaactcacttagctgctatcaagaagcttttgatgttgtttttgtggtgactactgtttactcttgcggtggtatttga

SEQ ID NO: 63059 - DNA, 1371 bp, Glycine max
  Peptide Sequence Number=SeqID_179837
atggtttctggactcaaaattaactttgcgaaaagctgtttcggtgcatttggaatgacagataggtggaagattgaagcagtcagttgtttgaattgtagtttgctgcccatcccgtttgtttacctaggcatacccataggggcaaaccctagaaggtgtcacatgtggaatcctatccttgaaaagattcttaagaaagtggtggagaagttagtgtctatacaacgaagattcctatggggaggtggcacagatcaaaacaagattgcttggatcaaatgggagacagtatgtctcccaaaagacaaagggggactaggaatcaaggacataaacacattcaacatcgcattgttaggcaaatggaggtggaatttatttcagcatgaaggtcaactgtgggctagggtcctcgaatctaaatatagaggctggaggggattggatgaagcacatcgagacaaccatgagtccatttggtggagggatctaaagctggtctttcaaaacttacagggtgtggagatgcacaacagcattgagtggaggcctggatgtggagatagaatcaaattttgggaggataagtggatggatggagaagaatcacttgcagcaaaataccccagattgtacctaatctcgtgccaacaaaaccaaattatccagcacatgggaggctataaggaagcagattgggagtggaactttttatggaggaggccattgtttgacaatgagataccaatggctgttaattttttacaacatattgaaagcaagcctatccagatacacaaaagagatgagtgggtgtggacagcagatccaaatgggacacaggacagggcttttgaggagctgtggaagctgaaggttccaatcaaatatgcagtgtttgcttggcggttgcttagagataggttgccaactaaagtaaatctactcaggagacaagtagagatcattgataggacctgcccatttttcagaagcgcggaggaggaagtgggacacttattttttcactgcagcaaaatcatccctatttggtgggaatccttgtcttgggtgaacactgtgggagttttcccacaagatccaagacaacatttcctccatcatggatcaatagtggctgatggattaaggattaatcggtggaaatgttggtggctggctgtgacctggactatttggatgaaaaggaatgacataatattctccaatgactctttcgacaacaacaaaatgatggatgaggcagctttcctcatgtggacatggctcagaaatttggagaaggattttgtaactcatttcaaccagtggtctagtaaccttagagaagggtttgtgtatcaatag

SEQ ID NO: 63060 - DNA, 867 bp, Glycine max
  Peptide Sequence Number=SeqID_179838
atgacaaatgatattattcggggtctgatcacaaaagtaatctggaatgtattggaactcagatgcgtggttttattgagtttcttcttgcaagtattccttatattttttggcaacagaagaaagtacatagccaatacatggctacatgtctgtgtctggttgacctatctgttggcagatttggttgctacctttgcgctgggcaagctttccagagacataaatccttcaacagaccccaatttcgtaatctgggtacccttccttcttgtgcatctcggtggccctgacacaatcactgcctacggcctcgaggataatgagctatggctacgacacttgcttgggttattctcccagcttgcagtagcaagttatgttgtttacagttcatggaatggcaacaaccttaactatgttaccattccagttatggtggtaggaataatcaaatatggtgagaggacttggtccttgtggttgggaagcagcaagaagttcagaaaatccattctccctcctccagacgctggaccaaattatgccaaattcatggataactacactgcaaaagaagctgaaggatataaagttgaattgaagggggaatgggaatctacgcccatactattggatcacccaccagggacaatagcaaatgaaagtgtaccagatgctttgcttttacaggatggattctatttccttgaaattttcgagtgcctatttgcagatctcatccttagcattcaagaccaccgaagcagccaacatttctttcagaacagatcatgggaacatgcgtataaagtaattgaggttgagcttggattgatgtatgataagctatatacaaaggcagtg

SEQ ID NO: 63061 - DNA, 2787 bp, Glycine max
  Peptide Sequence Number=SeqID_179839
atggctgctgctgaaattgcagtggataacatcgtgtcaagggttgtacgcaaagtaaacgatgtactcactcaagattgggcactactgaataagaaggaaagaaggatgcttaaatggcttcgaacagagctgagcgacatgcaggaattcatacaacaccttgaacgctctgattccagtcagttggagtattttgagggtaaaataaaggacgttgctctccaaacagaaagaatcatagacaccttcatcaaatcagtcgagaggaggaggaggagagaattaaacatttttcgttgttttgacgacaagattgagaaacagctgaagcaagcgtctatcactgacagcattgaagacatctctgacgaaataatgaagtatgaatccagacctgggtcattgtcggaatatcaattagaccgaaggggagaagtctggccctggcaaccccgcatcatctttggatttgatggagacgtagagactttgaaggacaagttactctcagtctcagacgaggaccctcgctgcattatttcaatagtggggattgcaggcacgggtaagactgctctagccacattgatacgtaacaatgaagacatcagagatggttttaagcacatattgaagaaatgcttgaagaaatatctaaaggctgccacacaaattatgggaagccaacaagacacctctctagaagccttggcgagtaaaaagaatctcatagttgttgatggcgtagcaactccccgtgtctttgatgccttgacagagaaaatagctgacaagtcaacagaagacagctttcttcttaccactcacaatgcaaatattataccgcaacaagatgcaggtacaacaagatcatcttttgttcaccatctaaagttattagacgatgaagatagttggattctttttaaaacagagctgaaggtgcacagagatgtacaaatggaaccagagatgacagatcttgggaaaaaaattgtggccaaatgtgggggtctgccatcgcaaatattagacctgagcaaatttttttcagataaagatgtaacaaaagaggagtggttaagattgcaagagcagtggttaagagatcaaggtcaaggtcaaggtcaaaacccttggtctgaaacacttaacgcaatcgtcagtgacttcaacttaccttcatatgaatcacatctgaaatgcttatcttattttaagctatttcctgctaattttgggattcccgcaagaagattggttgctctgtgggttgcaggagatgtagtgcctcacagggaagaagagcaagagccacctgagcaagttgcagaaaggtatttagaagagttgatagatctgaacttggttcaaattgccaagagaaagcccaatggcaaggtgaaaacatgccgtctccctaatgctttgcgtgaactcttgttgagtgaagccccagaaaattccagaatacttcaggtggcagattgtcttgacgaaaatgatatatggtacaaccatattcacggtaatactgcaaccacaagtgattcggtttccctaagagaacactacaaggatgttctctcctttttgtcctttgatgctcgagaaggaagtagaccaggccaagaaatatgtaactttttgaacctgtgtattttgagcgattgtcttctacagctgcaggtgcttgatctagaaggcgttttcaagcccaagttgcctgaaaacattgcaagacttactggattgaggtatcttgggctacgatggacttatttagagtcacttccatcatctataagcaaattgctgaaactccagactcttgatctcaaacatacatacatacatactctaaccagctccatctggaagatggaactgagacacctgttcttgagtgagacttaccgtaccagatttccacccaaaccaatatgtgcaggtgattctctatctgatctccaaacattgtggggactttttgtagatgaagagactccagtgaagggtggtctggacaaattggtcaatatcagaaaattgggaataacatggcaatcaatgtcaccacagcaaaaggcaacgaaatcacaaaaacccaccggggtcgacttactggtaggggttctgggtagtttggacaggatcctaggttcaaaccttgttgatgtcattgcacaaaaaaggacaatggaatcacaagttgatgcagtagttgactggattgtgaaactaacaaaccttgaatcactaaggctaaaatcaagagatgaagaaggtcgaccttggaatttacccttgaagtctttgaaaaatcacaaaaaactcattgacatgcatttgctgggaatcttgagccattcatcaattctgtccgagtttcccacgagccttgttgaacttactctatcgcattcgaaactagaggacgaccccatgcaaattttgaaagatcttccagaacttcgctcattgtctttatgtgcagaatcctacgtgggagaaaaattagtttgcaattctcaaagctttcctcagctttatgtcctaaaagtttggaagctggagcaattaaaggaatggaagatagaacaaaaagcactcggctctctcagacaactggaaatccgatcatgtccctgcatgacaaagcttcctgatggactaaagcatgttaagactctccttgacttgaaattgacaaacatgtcaaaggaaatcaagactgaagaccatgacattcctccctattgtgaaatccttgtgcaaaattga

SEQ ID NO: 63062 - DNA, 762 bp, Glycine max
  Peptide Sequence Number=SeqID_179840
atgagttcatctaaccagttaaaccagagcagcaggttcctagcaaataaaccaaggaatgaggttaatgtgcagggatacaccttcagaattgatggaaacacaacatttgtgatgaactatggacgttggtcagaaaagcgtaagagacttatttctgagatacggagtgctttaaatgttcataatgatcaagttcttgatgacaaactactgtttctcatagacacagtcatgaagcactattttgaactcttcgagatgaaaacaagtgctgcaaatttagatgtcttcagtgttgtttctgctatttggtgcacaacagctgaacgcaatttgttgtggattggaggctttcgcccttctcaattgcttcaggatacaaacattattgtcacaattatgttccctaagtgtgtgctttgggtccaggctattctgcctcaagttcagcattcatgctcccagcaacaactttctgatatttttagttttgtacaatcctgtcaacaagcagaagatgctcttgcacaaggcatggaaaaactccagcaaaaccttgacaaagcaacagcagctggtgacaaagcattaaaactgacgtgtgtctcacaacaaatgtcatttttaaagcaggccaatcatgttcgccagcaattcttgtatcaattatctcgtctccttacaatttgtcagtatgctgaattcttacttgccttcggagaatgcctctataactcccagccttggagctcactttga

SEQ ID NO: 63063 - DNA, 246 bp, Glycine max
  Peptide Sequence Number=SeqID_179841
atgaaggaaccatggcacgcttctacttttgatttctcgggtttgaaacttaccaaggtgaaaggggagctacttctgaaaaaacatggagaagagggtggagatgatattgatcatgatcgtaggctgctgagctcttctgatgattacactagtggaaagcataatttatcaccagccatgtctagtaagggaaaactgacaggcaaaaccatgctagagaacaatctgatagacaacatataa

SEQ ID NO: 63064 - DNA, 474 bp, Glycine max
  Peptide Sequence Number=SeqID_179842
atgacctttaattttaaaaagtggctcaatcaggcccttgccaggctgaaaccctcaaactccatcatcaccaccaaacaaagtcccgtcctgcaattcctccaagtcactctcaggcactgcaatgccagcaaccagcgaatcctcttcaccatcaaatcggcaaaacccctccagccttggtcacatccctttgttacacatccctattacgtgtttaggggttttgatttgtgtttcaaaacacaacaccaccaccattgcactgtcggtcctcactgcaatgttgtgggcgccaatgaggtccaccatgtccaccttggcactggcaagattcagcaacgcacacaagggagagaaagggaggaaaacgacctctgttttggttctgaaaactggagtgtggttcttatcgttgtacatgatgggggtgaaggtgagaaaaaatacaagcggaagctttttaatttttaa

SEQ ID NO: 63065 - DNA, 2379 bp, Glycine max
  Peptide Sequence Number=SeqID_179843
atggaatatggtgggttggtgcagaatgcatatggttcatatgggagcttctcagatattcttggcccagaaacggatttcatcgatgagctgtttgtagaaggatgctggctggaaacaagggttggatcgtacctgaattgtggcacggaggctaattcttcaaagtcaaacacgatgaggagcatggagtcgacgcaaataatattccaacaagaagaatcattaccagacccggaaattagtttgatggtggggaagagatggtggattgggccaagggaaaatccgggtccatcttcctctgtgaaagagagattagtgattgctgttgggtacttgaaagaatacgccaagaattccaatttgccgattcaggtgtgggtgcccgaacgtagatctgcacgtgctcagcctcaggataatatttacccatacgccgccgcgcttcttaatggggatgcagcagcttttcagattcaagaggattgggttcatgttaatgatcagtactggactcccaacgtccgcttcttcagaagtcacgagtacccgcgccatctccgtactcctggatctctcgcacttcctgtctttgagagaggcactgctatgtgtctcggtgttgtcgagattctcatgcccaacaaccctcccgaccttcagtgtactgttgattttacgagcagtacttcttctcatcatcacaacttcattccaccagccgtgaccgtcaagggctttgacgagctgtaccaaagtgcattaaatgggatagtacaagttttgacgtgtgtatgcaaggcgcataacttgcctttagctctgacatgggctccctgcatccaacaagcaggaaagagtggatgtgggcattcaaacgatgagatgaattatgtgtcgactgtgtatgctgctagttttgtggcggatgtagagctaatgggtttcctggaagcctgctctgagtgccaccttttgggggggcaaggagtagttgggacagctttcacaaccaccaaaccttgttttgcaaatgacattacttccttcagcaaggcggagtatcctctggcacatcatgctaacatgtttggcttgcatgctgctctgggcattccactccggagtgcctccgctgattttgttttagaatttttcctgccaaaggattgccatgacacccaagaccagaagcagttgctcaactccttgtttatgctagtgcaacaagcttgccggagtttgcatcttgtcatggaggaggaggaggaactaatcgcgttgccgtccgtcgttggcaaagaaatggaatcatcatcctggattgcacatatgatggaggcccaacagaaggggaaaggtgtctcggtgtccttggaatacctccaagagccaaaacaagagttcaaagtgacaaccaactgcagcaatactaatgagcaggtcagtgttggtgttgagagtactgcagctttttgtggccgccgggttggccggaaatcagctggcgacaagagacgaaccaaggcagagaagactatcagcttgccagttcttcgacaatactttgcaggaagcctgaaagacgctgccaagagcattggcgtatgtcctaccactctaaaaaggatatgcagacaacatgggatcacaaggtggccttcaaggaaaattaagaaggtaggccactctttaagaaaacttcaacttgtgattgattccgtccagggtgccgaaggtgccattcaaattggctccttctataccagtttcccagagttgagctctgcagccaatggcgtttctgaatcatccaacatcaataataataataatgataattctaagtttttttctgaatataaccaaggtcaaggagctactacattcaaatccccaacaacttcgccttgcagtcagaccactattgtgatgtcagagagccaaccacttggacttggtgcatcagtccaggtggtccaagaggaagcaaaacatttcgcccaccaacatcttgagtctctacctcccttgccccaatctagtactagtgtctggaacatgggtacttttagagtcaaagctacttttggggatgaaaaaattcgcttcagcttgcaaccaaattggggattcagagatttgcagaaggagatttcaagacgtttcaatctaaacgagattagcaacattcagctcaagtatttggatgatgctcgagagtgggttcttttaacatgcgatgctgatcttgaggagtgtaaaggcataaatacatcatctcagtctcagagccgcacaattagactcttcctctttcatgcttcgcctctcaatcacgcaaatgcatttccaggcaccagccccagctcctag

SEQ ID NO: 63066 - DNA, 261 bp, Glycine max
  Peptide Sequence Number=SeqID_179844
atggagagttctgcgagggtttttggttctcaacgtaaggcttctaatgagaaagaagacctactccatcatagtactgaaaatgccaaagtgagagaggatgctggctctgatcatctgataaagatggaaggacgttctggtttacaaggaggttgcaacaaatacaatatgcttacatgtgttaacaagtatgagaatatcattgtgagggaccgaaagagcattttccaaagaataaattttgcaaagaaacggtga

SEQ ID NO: 63067 - DNA, 1002 bp, Glycine max
  Peptide Sequence Number=SeqID_179845
atggggaggcaatctgactttgatgcaaactatgcaggatcagtaactggtaggagatccacatcagggagtaagaagcaaaatgttgctcggtcaagtgctgaaggagagtttcgagctatggcccaaggaatgtgtgaagtattacagataaatattgttctagatgatttgaacataagtgatgattccaccctgcagaatggacttattcagcctttgccttccatggtgatgtgcgttgagccgttaacgtttgggtggggcgtccagatgtggtgcatgtcgggtttgggttcgcgatggcatttttgtggtgtggaggttgcaaagaggtccaatgacccaactaggtcatcttcctttcgacagttgcacccatcttccgccatagctgttctgaacaccataactgcaacacggatagcagctgccattgcgcgccatgaaaaatccacaaggccaccgattttgtatggcggctgggatattgatagggacttaggtaatatggggtgcctaagtctcacattgagtaaatatggaatgctcggtggagaccttaaggttcccacgggattggatgcttatcaattggtattagagccttccatcatgtctctcagatgtaaacaagcaatgcacggttctagtttgggacagttttttaagcaatttcttgagccaatcaagctgaatgatgtcaaggttgattggaaatcaatggatttgagctatttactggaggataaatattctatgcactttgcgaacgttgttaagaaagctacacctgtctatggagctgacatggttctaaaggcatataatatagatggcgatgtgcgtatcaaatatgaagatcagtcagactttgaaaacattgctcgccaatttggtatatttcaagagtggaaggctgtgagttctgcatcaatagtcaggcatgctatggtagttagttttcccaagttgatcaatcaaaggttaaagattccttag

SEQ ID NO: 63068 - DNA, 162 bp, Glycine max
  Peptide Sequence Number=SeqID_179846
atgaaggaggggatgaaagcgcttaaaagaaatggaacatgggagattgttgacaaaccatatgatcagagactagctaaagaaggctttatatgggttaaaatagtcaccacgagcttggtgcagaagattcacaaaagcaatgatgcccatgggttataa

SEQ ID NO: 63069 - DNA, 309 bp, Glycine max
  Peptide Sequence Number=SeqID_179847
atgggaaataacgaagaaaaaaagaagaaattagaaaaggcccagcccagcctctcgcttagcgcacagctcacgctagcgagacagacgacacacgcgctaagcgaggcgttaagcacgagagtcagaacttgcgctcaccgcgcagcacgcgctaagcgcgtgcgacagaaacagaacgcgctaagcgcacatcacgcgctaaacgctgttttggccatggtaggggccgtggcggttggggttctgttcactgacatgtgcacttcaagtttgggcacactgcttttgttacgtgctggaaactga

SEQ ID NO: 63070 - DNA, 363 bp, Glycine max
  Peptide Sequence Number=SeqID_179848
atgaaaccgaagactaagggttttataggaaagaaggaagtgctcgacaggctaccactatatttcccaaaaaaacagttatggatctctccgtttctttctccaaaacccgtcctcctccgttctctccctctttctgccgtccaatcactccgcaactgctgcgattctcccgaaactccggaacctttcgccgccgttgatttcccgccaaaacaagctcgcggtcacagccattcaggtttcggatctatccgagaattacgacgattctgtcctcgaagacgttccgcacctcaccgacttccttcccaatttgccggtaccactccgtttcttatcgttttcaatctgtttccatga

SEQ ID NO: 63071 - DNA, 153 bp, Glycine max
  Peptide Sequence Number=SeqID_179849
atggcacaaacacaattgtcagaaagtaagtttatgaagatagttggcaaagagacagggaacgatgtgtttgtagaggagattgggaacaaagcaagagaagaagtggaggttcaaagaaagggatcagagggagcaaagattgtggaatga

SEQ ID NO: 63072 - DNA, 603 bp, Glycine max
  Peptide Sequence Number=SeqID_179850
atggcttctcctcccatggctgcactcgaaggtctcatccatggagagaagatgcctagtgaagttgtgaacaattgtgagcttcatgtggtcatgttcccattccttgcatttggccacatcagcccatttgttcagctctccaataagttgttctctcatggagttcgtgtcactttcttgtcagctgcatccaacattcccaaaatcagatcaactcttaatctcaatccagccatcactgttatcccattacagttccctaatggcatagccaacactgctgaattgccacctcacttggctggaaatctcatacatgcccttgacctcactcaagatcaggtgaagtcccttcttttggaactcaaaccccattatgttttctttgactttgcacaaaactggatcccaaaattagcttctgaagttggcatcaaatctgttcacttctcagtctactctgccatttctgatgcttccattactgtgccttcaagatttgatgatgttgaaggaagaaacatcaactttgaggatcttaaaaagcctccacctggttatcctaaaaaacttcaatataatttccctcaaggcctttga

SEQ ID NO: 63073 - DNA, 1458 bp, Glycine max
  Peptide Sequence Number=SeqID_179851
atgtcttgtgaagttgtgaacaatgatgagcttcatgtggttatgttcccattccttgcatttggtcacattaacgcatttgttcaactctccaacaagttgttctctcatggagttcgtatcactttcttgtcagctgcatccaacattcccagaatcaaatcaactcttaatctcaatccagccatcaatgttatcccactatacttcccaaatggcataaccagcactgctgaattgccaccaaacttggctgcaaatctcatacatgcacttgaccttactcaacctcatgtaaagtcccttttgttggaactcaaaccccattatgttttctttgactttgcacaaaactggctcccaaaactagcttctgaacttggcatcaaatctgttcgctttgcgtccttctctgccatatctgattcttacattactgtgccttcaaggcttgctgatattgaaggaagaaacatcacttttgaggatcttaaaaagcctccaccagggtatcctcaaaactccaacatttccctcaaggcctttgaggccatggacttgatgttcctcttcaaaagatttggtgaaaaaaactttactggttatgagcgagttttgcaaggctttagtgactgctcattaatagtgtttagatcgtgcaaggaaatagaagaatcctacttagactacattgaaaagcaatttgggaaactggttttgttaactggtttccttgtcccagagccatcaatggatgtgctagaggaaaagtggtccaaatggttagacagtttccctgccaaatctgtcatactatgctcctttggcagtgagcaatttctgaatgatgatcaaatcaaagaagtggccagtggcttagaactcagtggcttacctttcattttggttctgaatttcccatccaatctctctgccaaagctgagttagagagagcattaccaaaagggtttttggaaagagtgaagaataggggagtggtgcacactggttggtttcagcagcagcttgtactgaaacactctagcgtgggatgccatttaggccatggtggcttcaattctgtgattgaagctctggccagtgattgtgaactggtgctgttgcctttcaaggctgaccagtttttcaatgctaagctcatagccaaggctttggaggcagggatagaggtgaataggagtgaagatggggactttaagaaagaggatatactgaaggcagtaaaaactatcatggtggaggatgataaagagccagggaagcaaataaaagaaaaccacatgaaatggaaggagtttttattgaataaaggaattcagaacaaattcatcactgatctggttgcccagttgaatgtggttgaatctgagaagatcagtactggttatgactggtggaatggaaactttcctgtgaattttacagttcttcactga

SEQ ID NO: 63074 - DNA, 200 bp, Glycine max
  Peptide Sequence Number=SeqID_179852
atggacgacgcggacgacatgatcatcttcaactccctctgcgacgccgttacacacggttggtctttgtccgattccaccacaacaaaaccagaaaacgacgccgcggatcagagaccagctcacgaaataagttactccgattgccagaacgacgattccaaagctgccgttttggcgcagaagatgaccatgggaac

SEQ ID NO: 63075 - DNA, 381 bp, Glycine max
  Peptide Sequence Number=SeqID_179853
atgcacactggttggtttcagcagaagcttgtgccgaaacactctagggtggggtgctatgtatgccatagtggctttagttcagtgatagaagcaatgttcaatgactgccaactggtgctgttgcctttcaagggtgaccagtttttcatggccaaggatttggaggcaggggtagaggtgaataggggtgatgaagatgggttctttcacaaagaggatatattggaggcattgaaaactatcattgtgaaggatagcaaagaaccagggaagcacacaagagaaaaccacatgaaatggtgcaagtttttgtcaaataaggaaattcagaacaaattcatcacaggtcttgctgcccagttgaagtccatggcttag

SEQ ID NO: 63076 - DNA, 813 bp, Glycine max
  Peptide Sequence Number=SeqID_179854
atgggagttgcaacttgcactcaaatcgccagtgacagttgcaactcccctttaggcctgcaccccctccaaaagcctgcaaaagcctgccctaactcgctagtcatggtggcaacttccacctgcaggcaactcgccactacgagtggcgtttttcatgccacgtggcttcgcacagcaaactcgccattgacaataacggtttgctatagaacccatgcaaaccttagtgagtgttcaaaacgtgatagtgagacatttctgaatgaggatcaaatcaaagaactagccactgggttagaactcattggcttacctttcattttggttttgaatttcccatccaatctctctgccaaagctgagttggaaagagcattaacaaaagggtttttggaaagagtgaagaataggggagtggtgcacactggttggtttcagcagcagcttgcactgaagcactcaagtttggggtgctatgtatgccatggtggctttagttctgtgatagaagctttgattaatgagtgtcaactggtgctgttgcctttcaagggtgaccagtttttcaattctaagctcatagccaatgatttaaaggcgggcgtagaggtgaataggggtgatgaaggtgggttctttcacaaagaggatataatagatgcaataaaaactatcatgatggaggataacaaagagcaagggaagcaaacaagagaaagccacatgcaatggagcatgtttttatcaaatcaggaaattcagaacaaattcatcacagatatggttgcccagttgaagtctatggcttag

SEQ ID NO: 63077 - DNA, 261 bp, Glycine max
  Peptide Sequence Number=SeqID_179855
atgcataggtctgcaagctggaacaggttctcggatgattacttcaagcatgccacgacgagttctccatcttcaggacatagatcatcttattctatgttcgatggcaacaatttgcctacatatgaccccattgcagagttggctaagagggagagggcacgtgtgaagttcgccgagaatgcagtgcatgttatccctttagtgctaattgtttgtgccatcatcctttggctcttttcaaatccagctcattattga

SEQ ID NO: 63078 - DNA, 639 bp, Glycine max
  Peptide Sequence Number=SeqID_179856
atgggttttgcatgcaagccttgcatgaaaagcttgccaacacgtgccaaaccacctcctcaggtgttgccacccaagcctccactcaccaatttctccatttataccctcattaccaccaccttaaaccctaccacattaattactcactcttcactcaaaactcttgtctttcattttgataattcccacactatggctgagcttcactaccaacaacaacaccaataccctcaccgataccctaatgatccatacgaacaacaaactagctactccactcaggtcgtcaaggcggccaccgccgtcaccgcgggcggctccctcttgatcctcgcctcgttgatccttgccggcaccatcatcgccctcaccatcgtcacaccaccgctcgtcatcttcagtccggttctcgtccccgcggtgatcaccgtcgcgctgctgagcctggggttccttgcctccggcgggttcggtgtggcggcgatcacggtgctggcgtggatctacaggtacgtcaccgggaagtacccacctggcgcggatcagttggacagcgcgcctcacaagatcatggacaaggcgcgtgagatcaaggactatggacagcagcaaatcagtggggtgcaggcttcttaa

SEQ ID NO: 63079 - DNA, 276 bp, Glycine max
  Peptide Sequence Number=SeqID_179857
atgggaacgtgctacagaggagtgaggcaaagaccatggggaaagttcacggccgagattcgcgacccggctcggaacggcgcgagggcgtggcttggcacttatcaaacggctgaggatgcggctttggcttatgatcgagccgcgttcaagctacgcggctcgaaggctttgctgaactttccgcaccgaataaacttcaacgagccgccgccggtgagagtcacggccaagaaacggaaagttccggcttcggtgaagctgagtcgaagttga

SEQ ID NO: 63080 - DNA, 336 bp, Glycine max
  Peptide Sequence Number=SeqID_179858
atggatccttatgattcgtattctaacagtgagctgaatttgaaatttatcgaatataaattgagtgtcattcataccaacataagtgtattaaaaaaatatgtgataaatgtgtggaaaaagaaggtagcaactgcaagcaacgtgctcgtaaaagaacttatataccaagaaatcgtgaagaagaatgatgcaattggaagaacgagtttttcaccgttgcagaaatgcaccgctgaaatttgcatgctggcttatggattaccaatagatagcatggatgagtatgtgcacattggtgaaatgcttacagaagtttatccaaggagtgaatga

SEQ ID NO: 63081 - DNA, 179 bp, Glycine max
  Peptide Sequence Number=SeqID_179859
atgtgggaatcataggagatccaatagaagcaagaatcgaaggattaagtcttgaaggagaaattgaaaatgatagcgacggtactcaaatgggtttcttacctattgtgacctcagaagaaatatcaacgacagaatttggtgctgaaaaagattcaataattccaaagaatctttag

SEQ ID NO: 63082 - DNA, 792 bp, Glycine max
  Peptide Sequence Number=SeqID_179860
atgggttatctggtgggatcttgggttttgaaagaaatagatgtgttagttagggcaagtaatatgagtagtgttgcaaattaccacgttggttcatttagaatattgatagatggaagcactatgtgtgtttctgcattctgtgtattaagctttggacaaaaccaagtccctggaagtggcaatggtggtgatgtttgtcggggagcaactacttcccaaaaactaactataattgatgccgtatcctatttaaaggaagtcaaagtggtgtttatggaccaagtggtgaagtatgacatgttttgtgaaatcttgatagatttcaaggctaaaagggttaacatttatgatgtcataaaaagggtgaaggagttattcaaagggcacaacaatttgattttgggatttcaaacttttctgccaaagggttataagataacatttgacaaggatgaggctccttcgaactttggacaaaaccaagtccctggaagtggcaatggtggtgatgtttgtgggggagcaactacttccaaagaagtgactgccgctgatgccttatcctatttgtgggaagtcaaagcagcatttcaggaccaaagggagaagtataacatgttcattgagatcatgaaagatttcgaggctcgaaggattcgcactaatgctgtcataacaagggtgaaggagttattcaaagggcacaacaatttgattttgggatttcaaacttttctaccagaaggttatgagataacaactgacaaggatgatgctccaccaaagtaa

SEQ ID NO: 63083 - DNA, 321 bp, Glycine max
  Peptide Sequence Number=SeqID_179861
atggaggcaaggcgaggagagagtgaacactggggaattaaggtttctgggaattactgtagggttggaattacgggttatggcagtgcattggcagggagatttgcgaagggtaaggaaagtgagagtgttgctaccatcatcggccttgatggtgatgatgttgtagtcgcagcggtagtgcttgaagtccttggatcaaaggaggaacgcaacaagggcgacatggctggagtccatggcttggagggagaacctggtggaggagcaatcaaagtttgcgttattataaaagatctaatgacatcagtttttaaatga

SEQ ID NO: 63084 - DNA, 1392 bp, Glycine max
  Peptide Sequence Number=SeqID_179862
atggaggtggagaatcagaagcaaagaagatatcaaaagctacgcaattggttcaatagcaagcaaaaggaagataggccatcttcattcagtttgaacgaaatacaagatggagcagaagatgagagtgatgactatgagggcaatctctccctgcggtcattggaattagatccatgcatttcaacaaataaactaagggtctttgttggtacttggaatgttgctggaagatctcctgtaggaagtttggctgttgacttggatgagtggttgaatctcaagaatgctgcagatgtatatgttctggggtttcaagagattgtacctttgaagaccttaactgtgataggagcagaggatccagctgtggcaacaagctggaaccagctaataggaaaaacactgaatgccaagtttggatgcccttggatgacaccaatgctaaattgttcatcatgtgatgatgatgacaataattaccagtatgtggagaatccaaacaccaaaggtggcaacaacagcaacaatgataagtacacactagtggccagcaagaagatggttggagtgttcataagtgtgtggatgagggaagaggtgctgaggaagcattgtgtctcaaatgtgagagtgtgctcagtggcatgtggggtgatggggtatttgggaaacaaaggatcagtggcagttagcatgtcaattgaaggaacaagtttttgttttgtagcagcacacctagcatctggggagaagaagggtgatgaagggagaaggaaccatcaggtagcagaaatttttaggagaacctctttttctaggaccacaaaagaccatcatcattttcctctaaccatcttaggccacgaccgtatattctggttcggggatctgaactataggctatacttggaggacaattttgcgaggcatttgataagaaaacaagattggaaggctttgcaagagtttgaccagctccagaaagaactagaagaaggtggagtgttcgagggttggaaagaaggtgacatagaattcgccccaacatataagtactcatcctccactaccaatagatactgtggtagcctccctagtagatccggggaaaaacaaagaactccagcatggtgtgatagaattctatggtatggtaaaggagtggagcaacttcactattttcggagtgaaagcaagttctctgatcatcgccccgtttcagcacttttctctacacagattgaaattaaatcatctaacagaggacttatggggttgcataatatccccccaacaatgttgaatcccaagaatgggatgaacaaaggagatgaagacggaaaatcttccttattatcgtcgttaaccaagaatgtacaaggctgctaa

SEQ ID NO: 63085 - DNA, 774 bp, Glycine max
  Peptide Sequence Number=SeqID_179863
atggaaggggaggaggtgccagagaagtggggtgctgaaaagttaaggggaggggggaggggtgctggaaagaaaagggaaggagaagggagaataagaaagggtccaaaagtcaatgcaaagttcgagctgaagccgccaccatatccactgccggtgatgagccagcagacacttgagtttcactgggggaagcaccacaagacttatgtggaaaatctgaaaaaacaagttgttgggacagagcttgatgggaagtcactagaagagattattgtcacatcatacaataagggtgacattcttccagctttcaacaatgcagcacaggcatgcatgcttgcaaccagaatctctaattcatgtggaggtggaaagccatccggggagcttctagaactgattgaaagagactttggttcatttgtaaaattccttgatgagttcaaggctgctgctgcaacacaatttggttcagggtgggcttggctagcatatagagcaagaaaatttgatggggaaaatgtagcaaatcctccttcacccgatgaggacaacaagctagtggtgctcaagagtcccaatgctgtgaacccccttgtttggggaggttactacccacttcttaccattgatgtttgggagcatgcttactaccttgattttcagaaccggcgtcctgattatatatcagtgttcatggataagcttgtttcctgggatgcagtgagctctagacttgaacaagctaaggctttaattaccagtgcatga

SEQ ID NO: 63086 - DNA, 1020 bp, Glycine max
  Peptide Sequence Number=SeqID_179864
atgaagagggcaagggatgatatctatggacaaaaccaagtccctggaagcggagggggaggaggaggtggcaatggaggtgttgttggcgggggagcaaatacttcccaaaagcttactaccaatgatgctttatcctatttgaaggaagttaaagacatgtttcaggaccaaagagagaagtacgacatgttccttgaggtcatgaaagatttcaaggcccaacggactgacactgccggtgtcataaaaagggtgaaggagttattcaaagggcacaacaatttgatttttggatttaatacattcctgccaaaaggttatgagataacgcttgatgaggatgaggctcctccaaagaaaactgttgaatttgaagaagcaatcagctttgtgaacaagataaagaaacgattccaaaatgatgagcttgtttacaaatcattcttggacattttaaatatgtaccgcaaagagcataaggacattggtgaggtttatagtgaggttgctaccctttttaaggaccatcgagatttgctcgaggagttcactagattcttaccagatacttctgctgcaccttccacacagcatgctccatatattcgaaattcattgcagcgctttaatgagcggggttctatggcccctatgatccgccaaatgccagcagacaaggcacaacgctatcgacgagacaggcttccttctcatgatcgtgatatgagtgctgaacgccctgagctggatgatgacaagacaatgatgaacatacacaaggagcagaggaagcgtgaaagtagggagaggagaatgcgtgatcaagatgagagagaacatgatcttgataacaacagggatttgaacttgcaacgctttcctgacaaaaaaaaatctgtcaagaaagctgaaggttttggaatggcttctgactttgcttcttatgaagacaaagataccttaaatagtaagccgtgctgttatgcttttggacaaatgcattgcttgaacacatga

SEQ ID NO: 63087 - DNA, 357 bp, Glycine max
  Peptide Sequence Number=SeqID_179865
atggcaacgtcgcctacgacaccatcgttaggcaaaacgagaacaggtgatgggtggtgtcggcaactccctctgctccgcaaagttgggaaagggtgggtcgatgatgagtggcagtgcggtgcggatgatgggtttggaggttggtcagaaagagctgttggtcagaaagagctgcagtggaattcttatgaaacattggatgaacagctgaagcaggactggttgatgagtgtagaaccaaggaaacaaatcgcaaggacaccatgtagcaaaagagcatccaagtaccataaacaaagaaggaaaagagcacccaaatacattgatttatggttttcctgccatggacactaa

SEQ ID NO: 63088 - DNA, 398 bp, Glycine max
  Peptide Sequence Number=SeqID_179866
ttttccaatattcatcaagccaaagtgtggaagaggttacaaaagaaaactttgacacatgcaacaccaccaatgttttagcaacttatgggagtgggaacacaacagtgccattgacaagagctgggggcaggtattatgtatctggaaacaaattgtattgccttggagggatgaagcttcatgttcacgtagaaggcgatgacaaatcactagcaccaactatagcacctaaggctgtggctggaacagatcaaaacacttccacacttccgcagtctccttcttcaaagaaaaacacacacttttcggcaggagctgcgaattgtgcaagggatgcaattcagttagtttatattgctctcgtggctgccgtatatgggatgatgaagatttga

SEQ ID NO: 63089 - DNA, 225 bp, Glycine max
  Peptide Sequence Number=SeqID_179867
atggcttcaatcaggtctagtattaaacaaatccttaaagagcgtgagcacagcaaagtatgtactttatgtattttcttttcagcccgcagtacagtgtcttttgagaatggcttaaagacactgaaagcggtttatatggaagatgcaaaaatgaaagtgccccagaagctaatggcagtatccacctccatatttgaggccacaatgattagaactgcataa

SEQ ID NO: 63090 - DNA, 2517 bp, Glycine max
  Peptide Sequence Number=SeqID_179868
atgttattagagtctgtgagttcagctgctaaaaaagcagaggaattgtataataacatcaatgaaaataaaattggcatggagactctgaaccgtattgaagatcactttactgttctgaatttaaggtgcattgaacgtttatacggtgatcatggtctggatgttatagacatattgcgtaaaaacccaacccatgccctgcctgtaatattgactcgactgaagcagaagcaagaggagtggagtaagtgtcgttcagatttcaataaagtatgggctgaaatttatgctaaaaatcactacaaatcacttgatcatcgtagcttctacttcaaacagcaagattcaaagaacttgagcaccaaatctttggttactgagattaaagaaattaaagaaaagcagcagaaagaggatgatattattcagtctattgcagctggaaataaacagcctctaattccacatctggaatttgaatattctgatgttgggattcatgaagacctgtataaacttgtttgttattcatgtgaggagttattctcaagtaaggagttgttaaataaaattatgaggctctggagtaccttcttggagccaatgcttggtgttccttcccaatctcatggaacagaaagggccgaggacagaaaaactgggcataatgttcgcaattttggtgcaccaaatatcgggggtgatggaagtccccgtggagactctcttttaatgaattcaagggtaccaaaatctgataagaatgaagctgatggtagagtaactgaagtgaagaatgttcaccggactactgtggcatccaatgataaagaaaatggatctgttggtggcgaacttgttagtagagatgatcctttaatggataaaggacagaaaaatgtagaatacaatgataaagcttctggatttagcaaacaatttacctctgatgagcaaggagctaaaaacaatgtatcaattgcaattagaggagaaaacagcctgaacagaactaacttagatgtgtctccaggccgtgcccttactccatcgcgacctactgatgttgatgactctgtatccaagtctcagggtgttaatgcaccatcggtggagggatgtgacatggcaactccagtaccagtggccaatggtgttctaagtgagagcagtaaagttaaaactcacgatgaatcagttgggccttgcaaaattgaaaaggaagagggtgaattgtcaccaaatggtgactctgaggaggataacattgttgcttatggagattcaaatgtgcaatcaatggccaagtcaaagcacaacattgaaagaaggaaatatcagtctagaaatggagaggatgaatcttgtcctgaggctggaggtgacaatgatgcagatgcagatgatgaggacagtgaaaatgtttctgaagctggtgaagatgtctcaggcagtgaatctgctggtgatgaatgcttccgtgaagatcatgaagaggaggaggatatagaacatgatgatgttgatggtaaggctgagagtgaaggtgaagctgaggggatatgtgatgcacaagcaggaggagatggcacatctttgccattgtcagagaggttcctttcatctgtgaaacctctcacaaagcatgtatcagcagtttcatttgtcgaagaaatgaaggactcaagggtgttctatggaaatgatgacttctatgtgttttttagacttcatcaagctctttatgagaggctcttatcagcaaaaacacattcaatgagcgcagaaatgaaatggaaagcaaaagatgctagttcaccagatccttattcaagatttatcaatgcattgtacaacttgcttgatggatctgccgaaaatgcaaagtttgaagatgaatgccgggcaattattgggaaccagtcatatgtgttattcacattggacaagttaatatacaaattggtcagacagcttcaaactgtcgcaaccgatgaggtagacaataagcttctccaattatatgaatatgaaaagtctcgcaagcctgggaagttaaatgattctgtatatcatgcaaatgctcattcctctaccccctcacgactatccatccagctcatggacaatatgaatgaaaagcctgagttgtttgccgtttccattgatccaaatttctctttttatctgcacaatgattttctgtctgtctttcccaacaaaaaggagccccatggcatcatactgcatagaaacaaacgccaatatggaaaattagatgagctttctgcaatatgctctgccatggaaggtgttaaagtaattaatggattggaatgtaagatagcttgcagctcatctaagtgtggtgctgcaattatttcttatgttcttgacacacaagattttttcttccgaccaagaaagaaaagacgaacgccttcagggaccacaacctcccggttccgcagggacagagaggaaagattccgcaaattgttggcatgctcgtaa

SEQ ID NO: 63091 - DNA, 189 bp, Glycine max
  Peptide Sequence Number=SeqID_179869
atgacggaaaatgccagcaaacacaccaacggagctccaaaaatgcacgaaaatggcaacaggaagaagagtaggtgcggaggaagtgagaaatccattgagatcttgttgcacttccattccaagaaaaaagaaagtgtcaccaatcaagatctgttatctcaaaggctaggagcatttcagctatga

SEQ ID NO: 63092 - DNA, 225 bp, Glycine max
  Peptide Sequence Number=SeqID_179870
atgcattgtgaccactttggtcaaggcaataatgttaaggaggtacgttggcaagtgatgattatgacggtggttggtgtgattgttaccggaggatgtaccatcgatgaactgaaggatttgataaagcaagttgcacctcaagggattctccctcatggaattcatgcatcacaaacggttatggaaatggaagacgacatggctacatcgctacaggattga

SEQ ID NO: 63093 - DNA, 2451 bp, Glycine max
  Peptide Sequence Number=SeqID_179871
ggaggtgatgaaaaatggttgaggcttgacaagcctgctacttttgaccatgttatccacataacgaaatgtgcaatagaaaagctgtctcagattggtgtccttgctgcaaatgatggtggcaactctgtcaatattcttaatgtctcctggaaaggtgttgtttctttgcttcaaggtggtggtggacattttacagaagttaacatagcaaatatagtgttaactttgcttgcattgataacggagcctctgaaatgtgctgcccaggcttggtcttcctcactgaatgaagccatttctgtgactgaagctaaaaggatctttgtgccagtgaaattttacctaattaatgctgtaaaaatatgctcactgtatcctcatcaggcctatacagtgtacaaggaaattacgctgtgtgttctcaagatcaaatgtttttggatttttgtaagtaacgaaaaccttctgaaatgtgcatctgtgataattactgaattactggaggaaacaacattgaatttgctattgtctttgctaaattctcataaactgaaactggaacagaggcttcaggtgctagaatggttgttcattaataaaggggattgtcattctggccttgattgtccaaccttaagtgattgtaaccttgcatgggttaatgaaatcttttgcaatagttatgaaagtatgagcagatcaaaaatactaatacttggtcgagttgtattgtttattaacttcctcagacattcgcttgagcttgatggagatgtgagaatagcaataactcagaagctttattggtttttggatgttttagttgaggaagatgtctattctcatatacttgttttgcaatttcctttattgtatggctctggaaaaacagtggaactcttgtggcagcctatgtttactttcctcttgcaagcattcaaaaccttcatgatcgtgatctcttcaagtacagcttgggaggagttggagtctttcttattagagaatttctttcatcctcactttttatgctgggagattgtgatggaatgctggtgctttatgctgcgatatgctgaaacacaaatggcaaacagcattcttggaaaactatgttcattacttaagctgtcggcatcctcatactcagttttcctgccttattcttccttcagaaagttggcaagatcaatatgcatgcttttaaccgatggtgcacaatcaatggttaacgtggtgtacatgtctcttgttggtgatgggaaatcccatttgtcatcagttttttgtttggctttgttcatggaaggttttccttttgatttactgacagatgaattgagaaagacttctattcaaagaattatatctgactattttgacttcatagacaactttgatgaagcaccattgatggcatgctcctctggtttgtttggtgttccagatggactatctgatattgatgaaagggccttgaagtttttggttgcaatttcttctaattacaaaagtactgtagacaaagtaatcaaggaccgttttcttcagcttttcagtgaaactctagggatcatctcctatttgaaaaaactgtatacctcaaatgctattgaacaagtcatcatggagattcaaaatatctttttgtctgagcctccagcccttttggacaaatgcaaaccacatttggcccaattccttgcaggacttgttcacatggaaatttccgaaagtgatgatgatgctaagagctgtgctgtgtgggaattatatcacttgctcttgaaagagcggcactgggcactcagtcacttggcaataactgcatttggatattttgcttctcatactaggtgcaataagctatggagatttgttccagaagatgcagcactttcatatgatacagtttcaggagtggagtcagatcagcaaagatttatggttgagtttggaaaatttcttaaaaaggaaatagctcttcttacacttgaaccaagccctgaacagcttgatcttctagggagagaaggttttgtgttgaaacagatggtccaaaagatttcagccactgctgaagagagagagaaatgtgagatcatggatgttgatcacaagaaccaatcaaataaaaagaggaaacttcctgatggaattagcagaggagtggaattgctgaaaaatggtttaaaaattattggtgacggtttttcccagtggcagcttaatgattttgataccactgaactgcatgtaaaatatttgactcagttttctcaacttgaagacgtaattactaactttgaggaattgaccggcagcggtgagcattcgagtacgaaatctgtctacgtcaagacaaagttgcttatgtaccgcagcaatgtcttcactttaaatgaggaggtgagaagtgagataagaagaaaggaagatagaaagtga

SEQ ID NO: 63094 - DNA, 3487 bp, Glycine max
  Peptide Sequence Number=SeqID_179872
atgcccttctcctcctctcgccgtggaacatcctgggcctcctcgatcctcccctcttcgaacccacccaaatcaaaggcacccagaaagggtagaaaacgcgcgttggtgaaagacttcatcttttccaacttcttcgccattggcctcgtcctctccctttccctcttcctcctcatcctcctccgattcggggtccccaagcccctctccacgcacttccgcaccaccacgcgctcctcacgcgcccgccacacccgaaagcccctccctgccggtaccaaccgcagcacactcgccggcgccgccgtggacgtcaccaccaaggcgctgtatgacaagattgagtttttggacgtggacggcggagcgtggaagcaggggtggagcgtgacctacaggggcaacgagtgggactcggagaagctgaaggtgttcgtggtgccacactcgcataacgatcctgggtggaagctcactgtggatgagtactatgatagacaatcgaggcatatacttgataccattgtgcaaacactaaccaaggattttcgccggaagttcatatgggaggagatgtcatacttagaaagatggtggagggatgcatcagatgagatgaaggaatccttcatcaatttggtaaaaaatggacagctagaaattgttggaggtggctgggtgatgaatgatgagatagcagaaggaaacatgtggttgaatgacaccattgggtttgttccaaaaaattcttgggcaatagatccatttggatactcatctaccatggcatatcttctgcgtcgcatgggttttgacaacatgcttatccagaggacccattatgagctgaagaaggagcttgcatggcataaaaatttagaatacatatggcgtcaaagctgggatgcagaggaaaccactgatatatttgtccatatgatgcccttctattcgtatgatatacctcatacatgtggcccagagcctgctatttgctgtcagtttgactttgcacgcatgtcgggttttgcttatgaacaatgcccatgggggcagtatcctgtggagaccactcaggaaaatgttcaggaaagagctcttaaattactggatcaatacaagaaaaagtcaactttgtaccgaaccaatactcttcttgttcctcttggagatgattttcggtatattaatgttgaagaagcagaagcccaattccgaaattaccaaatgttgtttgattatatcaattcaaaccccagtttgaatgcagaggccaagtttggtactttggaagactactttgtaaccctgcgtgaggaagcagagagaataaattactcgtctcctggtgaaataggatctggtctagttgaaggttttccttctctatctggtgacttttttacttatgctgatcggcaacaagactactggagtggttattatgtttcacgacccttcttcaaggctgttgatagggtactagaacagacacttcgtgccactgaaatgatggtagctctaatacttggcacctgttggagatcacattgtgaaaagtttgcaatggggttttcttataagttgacagctgctagaaggaacttagctctttttcagcatcatgatggggtgactggtactgcaaaagatcatgtggttatggactatggaatgcgcatgcatacttcattactggacttgcaaattttcatgtccaaggcagctgaggcacttcttggaatccgctttgataaattagaccacagtcctgctcagtttgagccagcaatagtgagatctaaatatgatgctcaaccattgcataaagtgattagtgttcatgagggttcttatgaatcagtggtcttttttaatcctttggagcaaaccagagaagaagttgtgatggttgttgttgacagtcctgatgttacagttgttgattctagctggacttgtgttcagagccagattttgcccgagttgcagtatcatagtagcaagatctttactgggaagcatcgactttactggaaagtttctgttcctgcaatggggttggaaacttattatatttccaatagttttgctcagtgtgaaaaggccaggcctgcaaagttgaaaattttctctaaatctagctcggttgcctgtcctacaccctattcttgtgtgaaaatagaggctgatgtggctgaaattgagaatgagcatcaaaaactaatttttgatgtgaagtacggcttgttgcagaagataatctcagaaaatagttccccaaatactgtaaatgaggaaattggtatgtattctagttctggtggggcatacttgttcaagccccatggcgatgcccagtccattattgaagaaggtggccagttgttggtgtcagagggtcctttgatgcaggaagtatactcttatccaaggacagcttgggagaaatcccccatttctcatagcacccgaatatatagtggagagagtacagtccaagggtttgccattgaaaaggaatatcatgttgagcttcttggccatgatttcaatgatagggaattgatagttagatataaaacagatattgataacaagaagattttttactcagatttaaatggatttcagatgagtcgaagagaaacttacgataagattcctctgcaaggtaattactatcccatgccctatctagcattcatacaaggatcaaatggtcggcggttttctgtccattcccggcaatcattaggtgtgactagccttaaaaatggatggctagaaataatggttgaccgccggttggtaagagatgacggtcgtggtttgggacaaggagtgatggataatcgtgtgatgaacgttgtcttccacctaaccgtggaagccaatgtttctgccacatcaaatctggttcccaccccttttccttacagcccttctcttttgtctcaccgagttggttctcacttgaactatccaatacatgcatttgtttctaagaaaccgcaggatatgtctatgaagccaccgcctagatccttttctcctcttgcagcccccttgccgtgtgatttgcacatagtgaacttcaaggttcccaaacccttaaaatttttgcagcaaccacctgaaggtcctagatttgggctaattttgcacaggcgacattgggattcttcgtactgccagaagggaagatcgcaatgcactaatctggccaatggcaccatgaatctgttcagcatgttcaagaatcttacagtctcgaaggccaaagcaacttccctgaatctcttgcatgaagaccctgaagtaatgggattctcagagcagtttggagatcttgcacaagaggggcatctgaaccacacgggattcttggaccgattcaaagacgaattgttagcaaatttttttgactgctccattgatggtagggatgagttattcttggactgcttgctcggtggagcag

SEQ ID NO: 63095 - DNA, 198 bp, Glycine max
  Peptide Sequence Number=SeqID_179873
atgttgttgggagcggagaattccactaaagagaagtttactgactttgcagaagcacttgaagcagaagaaattttacagacaagtttactgttttctccggaagcacttgaaagggaagatattaagaaggtacactctatggaatgcggagtacaggatgtctctggcgaggaatctggatatgtcgggttctag

SEQ ID NO: 63096 - DNA, 498 bp, Glycine max
  Peptide Sequence Number=SeqID_179874
atggcagaggtgaagcttcatggattttggtataatctctttactttgagggtggtatggaccttaaagttaaagggtataccatatctaaacatagagaaagaccgctacaataagagtcttcaacttcttgaatacaacccagtatacaggaaaactccagtgcttgtccataatggaaaacccctatgtgagtccatgcttattgttgaatacattgatgagatttggccacataattcattgcttcctgctgatacctatgagagagctctggcacggttttggattaaatatgccgatgaaatttttcctgcagtttctgcattcttcagtagcaataatgatgaagaacgagaaaagagtatagagaagatatgggagcatctaagggttgttgagaatcagtgttttgttattaaagaaaacctcccagaccatgagaaaatggtggcttttattaagtttattagagaaaaacgtttggcatcttcctaa

SEQ ID NO: 63097 - DNA, 2466 bp, Glycine max
  Peptide Sequence Number=SeqID_179875
atgttcgtgaagctgcaactcttgtacacccacgcacccctcctcgcaaacgcaaacgcgtttcttctgccagagaaaaccgaacaagttacccccaatggcagaaagcaaagagtccctcttcataacggcgccgttaaacaagagacccattcgaagaaacgccgtccggagaagaatcccgaagagtgtgttcctagaaagaccaaaccggagaagtcgcacaccaagtgttcgatgaaacgcgtctcttatggtggatgcattaccgccattctagaagcattggatgtagttctcgacgtggatgaggctcttgggccgtgggaggacaggcttagcaacaaggagaggagcatcattttgaaggagcagctgaggtgggacagagctttggagattttcgagtggttcaacaaaaagggtcatgaattgaatgtgattcattacaacatcatgctgaggagcctcggcagagcacgccagtggagacgcgtggagagcttgtggaatgagatgaatgccagaggcattgctgccacctgttccacttatggaactttgattgatgtttatagcaaaggagggcgcagagacgatgctctttcttggcttaacatgatgttgggacaaggggtgcagcctgatgaggtcactatggtgattgtggttcagttgtacaagaaagcaggagagtttcagaaaggtgaggagtttttcagaaagtggtcatctggtaaacctttgaggagcaaaagcaaacctttgaggagcaatgataatgtggtggcttctccagaattggatgagagggtggcatgcgctaatgcttcttttggctcgcatacttataacaccttgatcgatacatatggaaaggctggtcaacttaaagaggcatctcagacttttgtggagatgcttaaacaaggcgtggcgccgaccacagtgacgtttaatacgatgattaacatttgtggaaaccatggacgattagaggaagtgagtttgcttgtccggaaaatggaagaacttcgatgctcgccgaacacaaggacatataatattctaatctctcttcatgctaagcatgatgatataggtatggcaacaaagtattttgaaacaatgaaggaggcctgcctcgagcctgatcttgtaagttaccgtactcttttgtatgcatactcgataaggaaaatgattcgtgaagcagaagagcttgtaaaggagatggataagaggagacttgaaattgatcaatatacccagtctgctttgactaggatgtacatagaagcaggaatgcttgatcggtccttgttatggtttctgaggtttcatgtagctggcaatatgacatccgagtgctatgctgccaatattgatgcatatggggagcacgggcatacattggaagctgagaaagtcttcatttggtgccaaaaacagaagaatctcagcgtccttgagttcaatgtgatgattaaagcatatggcatagggaaatgctatgagaaggcatgtcaattgtttgatagtatggagaaacatggcgtagttgcagacagatgcagctatacttctctcatacacattttggccagtgctgaccagccacatattgccaaaccttatctgaaaaaaatgcaggaggcaggattagtaagtgattgcatcccatactgtgctgtgatttccagctttgcaaaattaggccaattggaaatgactgaagatatatacagggaaatgattaggcatggtgtgcagcctgatgttatagttcacggcatattgatcaatgttttctctgatgctggaagagttaaagaagccatcggttatgttgatgaaatgaagaaagctggcttgccagggaatacagttatatataattcattgatcaagttgtatgcaaaaattgacaacctggaaaaagcaaaagaagcatacaagttgcttcaattgtcagatgaaggtcctggtgtatactcttcaaattgtatgattgatctttatgttaagaggtccatggttgatcaagcaaaagagatatttgagaccttaaagaaaaatggagctgcaaatgaatttacatttgcaatgatgctatgcttgtataagaaaattgagaggtttgatgaagccattcaaattgcaaagcagataagaaaattgggacccttgacagatttaagttataacaatgtgcttgacctgtatgctattgctgggagacccaaggaagcaatagagacttttaaggaaatggtaagagcttccattcaagttaatgattgtagtcttagatcacttggaaatcttttgttgagatatggagtatcaaggctggctgttcacaaattagaagcattagtgaaaaaggatgcttccaatggtttgcaggcatggatgtcagcactcgcaagtgtgcttgaagtagatgattatgatcatgactag

SEQ ID NO: 63098 - DNA, 1302 bp, Glycine max
  Peptide Sequence Number=SeqID_179876
atggggaatctggctggcgccacctttagtggaattctccgctcccaacaacattttacaaggctcgaaccgagcctttgcttagagggaccgagagtgttgattgtaccctgtgacgatggaggagaagaggaggcggtggagggggtgtttggagacggtgacggtgacagcgaagtggtcggaggggagcaatccgagcatggtggaaatggtctgcttcatggagtctcgggcggcgggggacacgcctttcgagatggcggagttgtcgaggggctcgatgcggcggagcatggcggcgatcacggtgaagccacggtcgaagttgcgcgtggagacggcgtcgtcggagaggcaggaggagatgaagccgccgcggcggcgcgtgagggggaggaggacggagggagagtgccatggagtggtggtggtgctggtgagggtgaacggtcgttgtatggattgaagcagtctccaaagcaatggtacaaactatttgattcctacatgtttcaaattggttacagacgattaaccattttgtgtgatgtgaatgagttaaaatcactattaagcaaggagtttgacatgaaggacttgggtcctgttaagaagattttcgggatggagattcacaggaacaagaaatccaaacgattatggctctcacaacagggttatgttgaaaaggtgctagacaagttcaacatgagcaatgcaaagcctgtgagtacttcattgccaaaacactttaagctttatgtagatcaatgtctgaagatagatgttgaggtggagtacatgtcgatggttacctatgcaaatgtagttggttgtttgatgtatgctatggtgtgcactagaccgaatttggcacatattgttagccaagtctgcaagtttatgtctaactcagttaagcgacattgtgaagtaatgaagtggatcttgaggtacctaaagggtacaataggtcatgatattatgtttgatagtcaacaaggtgatctttcaattgcaggatatgtggattgtgattattccattattcaatcacttgtggcaatgtcaacaactgaagtagagtatatggcagtaacaaaggctagcaatggagttgtgtggttagcaggactagtgaaagagttgggcattgagcaaggtgaaatcaaggagttgatggcatctggtcagattttgttcaggaaggttcacaatgtagctgatatgttaaccaagatggtcacaactaacaagttcaagcatttattggacttgttaaatgttgttaagtgctag

SEQ ID NO: 63099 - DNA, 3444 bp, Glycine max
  Peptide Sequence Number=SeqID_179877
atgagcaatgaggatcacggtgtttcaggcaagcaatatatagatgcggtgagtgttggtttaagtgacagaatcccttctgatgatgatgcagactatatatgtctacagacgggtgaagaattttctgccgagttcttacgtgatcgggttgcctcaaggaaatttcctgtcattactgatgcagaccagcatctgccaaacaggttggatgctaatattagagaaaatagtcctcaactggtttatgaggatctaaagcatgttcttgggctaaggagaacagaatctgatagtaactcagatttgttggagattgcttcagtcagaggatatgttgatgaagttgacagcagggcttatcctaataatttgaacagataccagtgtgaacacagcggtttcagacaagcatcaggacccaatgctccatctgtttacgtcgttgagtctcctcattcatgccatccttatggatcagtattctcagaaggttctttctataagaagataaagtttctgtgtagctttggaggtagaatactaccaagaccaaatgacgggaagctcaggtatgtgggtggagagacacggataatatcaatcaggaagaacataaaatgggaggaacttatgaggaagacttctgctatttgcagtcaaactcacattatcaagtaccagcttcctggagaagatcttgatgctcttatatctgtttgttccaatgaggatcttcatcatatgatcgaggaatatgaagagcttgaaagagctggaggctctcaatggctgaggatttttctcataccttcaaatgaatgtgagagtccaagttcaaatgaagcaagagtcaatcagccaagtgatgcagattatcattatgttgttgctgttaatggtatgctgaatccaagtccacaaaagaattccaatgggctgagtttggcaaaccatactagtcagtttggaaataccactgattacaacagtccacatttctatagagactcatccacatctgcatttgcttcagagatgaaggattgcaccccaacttctccaaatttggtaggcatactctcaaaacctggttctcaatattttacagccttagcaggcaagtcagtcaatcaaatgtctcctttatctcccgcttgtgtacagcctacagatcccaaaatttctaatgtacagatatttaaggataaaccatataatgctatcaatgaaagcatcactccctttgttacggaaaaagttccatgcaacaattctttgtatgtagacaataccaattatattgatccagttgcataccataataaccaatatatagtgaaatctgacctgatcaggaaacctggcaagaatcttcatcttcacagacggaacaacagcagtaatgagtttgtctcttctacggcatgtagtctaactgacttgattttcgagagacctttagtcaccaatgaaggttcatatcattttaacaaggttgtctctcgtcctcatgagtcgtcgagtttattctcagagtctgatgttagagaggggtctcggtacagaatgttgcatgcacattctgactcaacacttaaggagaatgatgagaactataaagttcacttgcaatttccccttagcgtagagagagacaattttccatcattgaaaaattcatgttctttagaagaatgttcaatacagcctggaaagacaattgataggaaagaacactcagcaaagtatcaaaatttgcccatttttggaatgacggatagttttaatgtgtcagaaaagggtaaagagatcttgcaacatgcagataacagcaatgatttctttaatgaaaatgttggagctatgtcacaagacaattccatagatttaaaacatttacagtacatttacaccccacatggtgtttgctcttcttcaccagatttccaaagcagtgaatgcaatttatctactgcatcatctatctctttggaatccacaagaaacctgagggggcaaccacatggtctatcattagacagaactgcttctgagttttccacgaggagccaaaattcatcaatgcatcaccaatatgctatgccggagacaaaagacggtcaaccactttttcctggctcttttgagtcccaaactgagagagggtctatactacctatctcatatatggacatgggttcttccctaagagaggttgttatccctgttgaagatcctgcatacaacctgcaccaaaaggaacaaaacacagtcattaagaatcagtgttctgaatatatcaatgaattctgtgtcaacaagcctgtgccagaatcagtggctgttgtcaagggagcaatggattatatttcttcaggtatccagtcatgcctaaaagatgtctcaaatgtagatgaagaggctgaagttgaacctacatctcctgaaaaggaagggatagaatgtgataatccagaatctgaaagtaagcatgcagaatctgatagtggaaacgtcaacaaacctatgggtgatagagcaactgctgaaacagaggctgaagtttatggtttacagaatattgagaatgctgatcttgaagaattgcaagagttaggatctggaacatttggaactgtttatcatggaaagtggaggggaacagatgttgcaattaagagaataaaaagtagttgtttctctggtagattgtcagagcaagagcggttgactaaagatttttggagagaggcacagattctgtcaactcttcaccatccaaatgtggtagcattttatggggtagttccagatggcccaggtggaacattggcaacagtaaccgaatacatggtgcatggatcactgaggaatgttctcacgaagaaggatagagtgcttgaccgtcgtaaaaggctcctgattgcaatggatgcagcctttgggatggaatatttgcatttgaaaaatattgttcattttgatttgaagtgtgataatttacttgtcaatctgggcgatcttgaacgacctgtatgtaaggttggagattttggcctatcccgaattaaacgcaacacacttgtttccggtggtgttagaggaacccttccatggatggcacctgagttactggatggtaacagttgtagggtatctgagaaggttgatattttctcatttggcattgcaatgtgggaaatcttgaccggggaagaaccatattctaacatgcactgtggcgctatcataggtggtattgtcaataatacgctcaggcctccgattccaaaacgatgcgattccgagtggaaaaagctgatggaagaatgctggagtcccgatcctgcagccaggccaaccttcacagaaattacaaacaggcttcgcagcatgtcagattcactgcccaaaaagagacataacattgtaaaacgatga

SEQ ID NO: 63100 - DNA, 1725 bp, Glycine max
  Peptide Sequence Number=SeqID_179878
atggatctccttcaccaatactcagacggcgacgatcccgactccccctctgaaaaccctagctcccctccgcgcctcctcccgggacgctccgccgcgcccaacgtcgacgacaccatgctggccctcaccgtcgcctcctcctcctcggccctctcgcggcccatcgaccctacccagcacctggtgggcttcaacccctcctacgaccagctctgggcccccatccagggcccggcccaccccttcgccaaggacggcatcgcccagggcatgcgcaaccacaagctcggcttcgtcgaggacgcctccatcgaacccttcctcttcgacgagcagtacaacaccttccacaagttcggctacgccgccgaccccgccgccaacaacttcgtcggcgacctcgacgcgctacgcgacaacaacgccgtctccgtctacaacatcccccgccacgagcataagaaacgccgcattgaggccaagcagaagaagaaatcagaggaagacgacgacggcgacgtcaacgaggagatcgaaaacccggcctcggaggcgtggataatgaagaacaagaagagcccttgggcagggaagaaggaagggttgcaaggagaattgactgaagaacagcagaagtatgcggaggagtatgcgaagaagaaaggggaagagaagagtggtttgggaggggagaaagttgaggttgttaaagataagagcacctttcatgggaaagaggagagggattaccaaggtaggtcttggattgcgcctcccaaggatgcaaaggcgaatagtgatcgttgttatattcctaagagattgattcatacttggagtggacacaccaaaggggtttctgctattaggtttttccccaagtatggccacttgattctctctgccggcatggataccaaggttaagatttgggatgttttcaactctggcaagtgtatgaggacctacatgggacactcgaaagccgttagggatatttgtttcagcaatgatgggaccaagtttttgagtgctgggtatgacaagaatattaagtattgggataccgagacggggcaggtgatatcgacatttgccaccggcaaaattccttacgttgtgaagcttaatccggatgaggataagcagaatgttttgttggctggaatgagtgataagaagattgttcagtgggatatgaataccggccagataactcaggagtatgatcagcatttgggggctgtgaataccatcacctttgttgataacaacaggaggtttgttacttccagtgatgataagtcactcagggtatgggaattcggtattcctgtggttataaagtatattagtgaaccccacatgcactccatgccttccatttcgcttcaccccaatgccaattggcttgctgcgcagagcttggataaccagatacttatttatagcactagggagaagtttcaacttaacaagaggaagagatttggtggacatattgtggctggatatgcatgtcaggtcaatttttctccggatggacaatatgtcatgtcgggggatggtgaggggaagtgttggttctgggactggaagacttgcaaggtctacagaactctcaagtgtcacgaaggtgtttgcattggttgcgagtggcatcccttggaacagagcaaggtagcgacatgtggctgggatgggatgattaagtactggtaa

SEQ ID NO: 63101 - DNA, 501 bp, Glycine max
  Peptide Sequence Number=SeqID_179879
atgaactcaaaaaaccaaacgccgattagggttttcgggcagcgaaccattgcttcaacgttccgcaatctctcaccacgctatcctccttctgaaagaaacgagagaaatcaagctttacgcaagagcgaaaccgcgcatccctcgctttcacacttcctcaacctcaagctgcaaaaatctcctcaaacggttccggggaaatcgacgcctttcctgtcaccgctgggtttaagaagaggtgaggagggtgaagctgtgaaggaagttgaaaaagagaaaaatggtggcagtgatgataaggtgatatttgaaagcttcaagcacactgaagaggacaaaggagactttattgatcaaattgatgttggtgaattagaaaagtcagttgcggatgatatcaagagtcaaagaaaaggaaaattccgtttgaagctgtttgggctatttagaggagggtaccgcattgtgtcaggacatgaaaaagagttatccgaatag

SEQ ID NO: 63102 - DNA, 307 bp, Glycine max
  Peptide Sequence Number=SeqID_179880
atgtcgatgaggccaaccctttccttagcatcatcaagggttgtggtaggtgcctgttgcaagaaaaaatggtcatggatgtctcacgtttgtaagaagttcatcttcattgttgacgagttcaagctcgtcaactatttggggggtagcaggttggccatgcccgttgaggtcattcaattttgttggaggttcactgtggtgaggttacacaagctttttgaggaggctgggtgcgttgcaaaacttaggacttttaggaagaaagagaagccttatgtcacgaacaatggaaactttattgtgg

SEQ ID NO: 63103 - DNA, 1125 bp, Glycine max
  Peptide Sequence Number=SeqID_179881
atgtcgtcaactcttctcccagtgacagcaactcccattttcactctcaccaaaaccctccctctccccaaaccctacctactctcctataaattcaaattcaacaccctcgtccgccgctgctccctctccgaccacgaggagcagcgctggctccgcgaagagcagcgctggctccgcgacgaacaccgctggctccgtgaggagcagcgctgggctcgcgagcgcgaccaactcctccgcgagatcgccgacctcaagctccaaatccaggcgctggagcgtcgcctcttgacgcgcgatttgtcctctccggcttccatctccgacgccgtcgccaatgtcacgttgctcttgcaggtgctcaaggacaagaatctggttctcgagagcggttcgagcctgcggaacacggaggaggtgaagcaattggaagaggtcgtcgaacatgtgaaggaggttgtggtggttgaggaatctgctagggttgaaaagaggatctcgttgcggataggttccgaaggtgaagaggttcgacagatgcaggaagcattgttgaaattggggttttactctggcgaggaagacatggagtattccagcttctcaagtggaaccgagcgtgctgtgaagacttggcaagctgcattaggtgctcctgaggatggtatcatgacagctgaacttcttgaaaggttgtatttggagataaggaataaggacaccggcagtgcgactcaagacaaacaatctactactgttttgccaaaggaagttgaaaatggagctgcagttgcttcagtggcagaaaattcagagggtcagcaaaaagatgtgaaaagtgataagggaacagaagtctcccaccggggagtttttctccttggagagaatcggtgggaagaaccatcaagacttttcacaaggaatggagttgataggagcaagaacaaggatgtaacgacaaaatgccttcaatgtcgtggggaaggtcgcttgctgtgtacagaatgtgatggatctggcgagccaaatattgaacctcaagctattgaacttatcaatgaattctttaatgcagtttttggaatgggtggacgagggtacaaaatgcccatattgtga

SEQ ID NO: 63104 - DNA, 960 bp, Glycine max
  Peptide Sequence Number=SeqID_179882
atggttagcggcaacatttttcattgtagaaaaaattcgtggcctcctcaggagtatatcagtaaatccactttgcagctgttgttcttcgtttttggtgaactggcgtcctggtcttgtgatgttgccgcgccttttgtgatatctgaaaatcatacatttgcgccttttgtgtttgattatgatagttctgctcctcctgaacaagcttggagaagaagattgaacagccatgccaatcttcttaaagaatttagagttcgattaggtatacgcatttggtcatatgttagggaagaggcttctcatggaaggaaagcacctattgatcctttcactcgagaaagttgcaagccatctgcatctcaaggagtcccactcggagggatggggagtggcagcatatcaagaggatttagaggtgagttccgacaatggcaaattattcctagcttatgtgaagcgtcaccagtcatggccaatcagttctctatttttataagtagagagggaggaaacaaaaattttgcatcagttttggctcctggccagcatgaaggtttaggatctagcaggaaacctgatgatcagggcatatcatcatggggttggaatctaagtggccagcactcaacctaccacgctttgtttccaagagcttggacagtttatgatggtgagccagacccagaactaaaaatatcgtgtcggcagatatcaccattcgtaccacataattatagagaaagcagtctaccagctgctgtttttgtttatacgttggtgaacactggtaaggaaagagctaaagtcagccttttgtttacttgggcgaattccattggtggaagctcacacttgtcaggagatcatgtgaatgaaccattcaaagctgaagatggagtctccggtgtacttctatatcacaagcaagttatcaaaccttatagctatatatga

SEQ ID NO: 63105 - DNA, 393 bp, Glycine max
  Peptide Sequence Number=SeqID_179883
atggcagaatcgcgcccccctaagcgccccaaaatctctaggggggatgatgattatatgccgggaaatattcttgagattgagctttgtaatttcatgacatttgattacttaaaatgcaaacctgggcctcggttgaatcttgtaattgggcccaatggttctggtaaaagttcgcttgtatgtgctattgctcttggcctctgtggagagccccagttgcttgggcgtgctacgagtattggggcatatgtgaagcggggagaagaatctggctacattaagatcaccttgagaggggaccataaagtggaacacattaccattatgcgtaaaattaatactaataacaagtctgaatggttgctcaatggtggggttttaatactctag

SEQ ID NO: 63106 - DNA, 480 bp, Glycine max
  Peptide Sequence Number=SeqID_179884
atgtttttaccgcaagacagggtctgtgagtttgcaaagttaactcctgttcaacttctggaagagaccgaaaaggctgttggtgatccacagcttccagagcaacatcgagcattagttgataaaagtcgtgcattgaagcatattgagttgtctctggagaaaaatgaaggaactttaaaacagttgaaggaacggaatgctgaattagagacggatgttgaacgtgttcgtcaaagagacgaacttcttgccaaggctgaagcaatgaaaaagaaattgccatggctgaggtatgatatgaagcaggcagaataccgggaagctaaggagcgtgagaatgatgccgcaaaggcattggaggaagctgcagagttattaaatgatcttaaagaacccattatgtatggtggcctttcttacttctatacgtattctcaactgcttaaatttctgatcttcttattcttagtattttga

SEQ ID NO: 63107 - DNA, 690 bp, Glycine max
  Peptide Sequence Number=SeqID_179885
atggccttatgcgagagtgtcaacacatattgctctgggaagccagagcaaatgcatcacctatgggacagagtcataaaggatgtgccatggttcttgagttccttcttagccttggtggcgatagaggcagcatggggtagaagctcattgaaatcatggagagagctgcatgaacttgcccaaggtaggcagtcatgggcatgccaaattgctaaggagctaggagggtcatcaagtctctacgcacaccgtataaccgttgagcatcaattgtgtagagagcacgtgcctcactccaaacagattcatagtagtgaaatgagatttatggccaagcccactaaaccacaaagtgatgtcagatgcctgagcggagtagttcgaaccatccaacttctccataaagagtgggaggttcgaaaacattggagtgtttgccttagttggggtggggtaccatcagaagccatgggaggcgagatcacagttggaagcgcggccggaaagggagcaatgcctaagaactccgatggagacgtgagtggtagatctgagaagatcgatgaaagactagtcaaacgcagggatcaccgggcgcttaaggaggtcgaattggatgcaagtggttcactagaagaagaaaattatcatagggacagggggtccactggacaacacggttattga

SEQ ID NO: 63108 - DNA, 699 bp, Glycine max
  Peptide Sequence Number=SeqID_179886
atgccgagctccgattccgggaaaccatccgacgtccctgtaccttttgcttcaaccattgggtccaaaccagtgggtaataacccacgtgcgacgaccagtggcacggttaaccaagcaactatgccattaatgaaagccccaaatgggaatgtagttgacacactttcattgtgtagggcagaaataacttgcatgaatgaggaaagttctatagtgaagaaagggtatagcgcagaaggtagggagaagcatgtggtgttaggagatgatttccagatggctaaggataatcttcagcaaattcaacaacccaatatgaccattggagatgatggaacatggtgcaaaaagaaaaaaggcttgtccaacacatgcgcgaatctaatggaggcaggtacggaggcttggatccagcagcaacgtgaaataactcctgtgataaacctcagacccaccactggtcatgaagcacctcattccgacacacatacagactatgaagtgaaccagcaagcagagaacaaggaagacattacagagcactttcagcaagctaaacagcaatgggaaatggctcaggagctgggggtgtcaactaatataggacatgacagtattattgcaagaatctgtgacatggaaagcagagatagcaaggaagccgagaagctgggcaataggagtgttacctcatga

SEQ ID NO: 63109 - DNA, 219 bp, Glycine max
  Peptide Sequence Number=SeqID_179887
atgcctccaccaacatcttctgcacttgagcttcctatttccttatgcaaaggtgaagccatgactgatcctcgttggcaactagcgatgttggatgaaatggctgctttacatgctagtggaacatgggagctagttcccttgcctcccgagaagactaccattggttgtcgttgggtttatatggtgaagcttggaccgaatgggaatattgattga

SEQ ID NO: 63110 - DNA, 321 bp, Glycine max
  Peptide Sequence Number=SeqID_179888
atgtctctgatctgcagcaagtttgaacctctatacattgatgaggttgaaactttgctacaagcacatgaagctcgtcttgataagttccacaagaacaaatccttagtttctgtcaatctgactgaaggtgccttgacatctaattccactattgtccaaacagttgaaatccctaattttgttctcaatgtgcctaattcgttgaatggcaatttgaacaatcaatcatttgatgcacaggtgcatcttaccatgcaagaagacatttttgatatccaactggtgaagcggccaatggtaatgatagccatagcatga

SEQ ID NO: 63111 - DNA, 1212 bp, Glycine max
  Peptide Sequence Number=SeqID_179889
atgtcttcatttctaataaattttccccaccagcaaagactaacggccaaaattgcggaattggattattctgctaagcaaatgaggcagaagaagtcacaagcagaaaatgaaataaaccataagaagtcatccatgaatcggattaaagaaaggttgattgaaatgaataataaaagtacaaagtgtttgcatgcattgcaaagatcaggggctgaaaaaatttttgaagcttataaatgggtccaagatcatcggcatgaattcaataaggaggtttacggcccagttttattagaggtgaatgtctcaaataaggatcatgctgcatatctagagggtcaagtggctcattacacttggaagtccttcataacacaagattctggtgatcgagatcttttggcgaaacacctacggttctttgatgtaaatgttctaaattatactggcggtgatggtccccaaagagagccttttgaaatttctgaagataagcgtgctcttggcatctactcccggctggatcaaatttttgatgctcctattgctgtgaaggaggttttgattagccagtttaatctagattattcatatattggatccgaaaaatctgatcagaatgctggtgaggtccggaaattgggaatcctagatttttggacacctgagaatcactaccattggtccaagtctagatatgcaaattatgaatctgcagtcgttaatcaagtgcaacgcccacaacttttattgaataatttgaatgttggtgaaattgagaagctgagttccgagcaaagggagcttgaagaaattgttgctaatttggaggaaagtgttaaaaggtttcacgacgaagaaagaagcttactgaatcaatctgctaatcttcgtaaacagtgggaggacattagtattacagtacagaatgagcaaaagaaacgtcaagcaatcattagccgtattgatcaaaagaaaaagttcttgaaactgatggaggaacgggatgatctagatactgagatagcaaagcttgttgatcaggctacaaaatataacattcggcgtttccataatgcaatggaaattaaggatcttcttgttgaagctgtgagttacagacggatttttattgaacaacgtatggctttcattgaatttgatgcaaagtcattgctaggagatgatgaagtcaggaactgcaagtaa

SEQ ID NO: 63112 - DNA, 408 bp, Glycine max
  Peptide Sequence Number=SeqID_179890
atggtggaagaaactcacagcgcagaaggaaggcgagcccgacaccggcggagcttctccgggtcatcggaagaaattacgtccgacgttagcgacttcgacacaccattgactgggtacagtggtccttcgccgaggtttctcgccaccaaagccatggatggaagcaacgtccattgggttgagaaaataccaagcagtctcccagggaatgaatacccaacgggtattgaaggaagtagcaaggcacacggctctatacctgaccagtgcgtgacaaaaagtgacaaggggaaaaccatcgcgctcgaagctggcccaatgtcggaagaaattgccattagcggtgaaggtgcaggtgggaacgcgaatagcactgccaactcaaggggaaaaaaaggaaagtga

SEQ ID NO: 63113 - DNA, 1849 bp, Glycine max
  Peptide Sequence Number=SeqID_179891
atgtcggtggctcgtttcagggaggaggaaataaaggcagccgtgtgggattgcggtagcgagaaaagcccaggacctgacggtttcaatttcaagttcataaagcagttttgggagacacttaaacctgatttcattaggttccttgatgaatttcatgtcaacggtatcttcccaaagggttgcaacgcctcttttattgctctaatacccaaagtgaaagacccacaatctcttaatgaatacagacctatttcattaatagggtgtgtttataagactgtggccaagatcttagcaaatagattgaaagaggtgctgccgaacatcatagatgagagacagacagctttcattagggaaaggcatttgcttcatggtgtagtgatagctaacgaagtggtagaggaggcaaaaagggagaaaaaaaccttgtctgtttctaacaaacatgatgaggagattgggtttttgcaacaaatggatacattggatcaggggttgcctccattcagcatcggtgtctattttgaaggtctaaccgggttgatgagggaggctgtggataaagagagattcagcagttttttagtagggaaaaacaaagaaccagtcagtattctgcaatacgctgacgatatcattttctttggggaggccacaatggaaaacgtgaaggttataaaaatgatcctcagatgttttgaattagcatcaggcctcaagataaattttgcaaagagtcgattcggggcaattgggaaacctgagcaatgggggaaggaggctgctgagtttttaaactgcagtttgttgtccacgcctttttcttatcttggaatcccaattggggcaaatccaagccatagcgagttgtgggatcatatcattagtaaggttccaaacaaaataatagagaagttggtcaacattcaacgccgattcctgtggggtggaggaatggagcaaacgaaaattgcgtgggtcaattgggaaacaatttgtctcccaaaagcgaaaggaggattaggcataaaagatctccgagcgttcaacacagctttgcttggcaagtggagatgggaaatgtttcagcacaaaggagaaatgtggaccagaattctgatttcaaagtatggaggatggagatctctagatgatgaaagaaacagcacctatcactctcactggtggaaagatctgaagaagattaatcagcagcaggagacatctgttctaaagaaacagataaaatggagggtgggaagcggagataagatcagattttgggaggacacatgggcagccgaggatagaccactgatggaaaaataccatagcatgaatcagatatcaaaccaacagcaacaaattatcagccgcatagggagtcataccgaagtagggtgggaatggaagttcagctggaggagaaccttatttgataatgaagttttcatggctgcagattttctggaggaatcaacacggctaacaatacaacagaatggagaagattcatggatatggaaggctgattcaagtgggaagtattcaacaacaacggcatacgagctactgctggaagcagcaaggggggaaactaaggatgagacttttgtggaattgtggaaactcaagattcctctcaaagcagcagtgtttgcatggaggctctttagagacagactagcaacgaaagtgaatttgagaaggagacaggtggagcttaatgacacactttgcccactatgcaacactaaggaggaagacacagctcatttattcttcaactgcagccacaccctccccttatggtgggaatcacggacatgggtgaatactgtgg

SEQ ID NO: 63114 - DNA, 5547 bp, Glycine max
  Peptide Sequence Number=SeqID_179892
atggcgagatgcagtccatggggatgtgcacccctgtcgggagccatcgacccttacccgaaagcggatgataagtttgggccaacttctgctacttacacccccaccactctaccaacccaacaccccgagagcctagtgaaggaacaaatggacccaaatgtttcaagcacatttcaccctcgaaatcagatcccgctaagaggtcaactgagcccacataagtcattcagcttttattcgcggaaaacttggcaaaagaagaaagctcccgagaccactatatcagcaacagcaccagaggaagaaattctagctcataatccgactaaagaggcagagcatatttggaacatggcaatggatttaggagcaactactgggtccatgcaaaaggaatatgaggacaaccccatgaatatcatcacctacaatgaaacaaaggagacaattgacagatctatttgtcaagctttatggggggataatgaaatcaattgggaagctcaacctgcatcgaatgcagcaggtggcatcctatgtatttggagtgagaaatcttttgtgctagagaggaaggtcattgggaatggatttatcatgctgataggaacgtggcttcaagaggctgaacgagttcacattgtcaacatttactcgccctgcgatattcagaacaaaagactgttgtgggacagtattaagcaactgaaaactcccacatctgggggtctatggtgcatagtagctgtggaagatggcagctctagggagtttaatgattggattgcggagttggaggtggaggaagcaccgtgggttggcagaaaattcacatggttcagaccaaatggttcggctaaaagcaagcttaatagattcttgttatcccccgaatggttctctaaatggccagggactgcacaatacacactggacagcaatttttctgatcattgtcctcttttacttagatctaaatgcgttgattgggtacctaaaccttttaggatccttgattgctggctcacagactcatccttcagggagaccgttcatcaaagctggtcttccaatcagcaaagtggttggggaggattcgtactaaaggagaaaatcaaaagactcaaagccgatatcaagaactggaacagggaccaattcggtaacacactcaagaagtataagaagatagaggaagacttaaacaaattggaagaggacaccattgacagaattctagagcctcaagaagtagcgcttagaaagaagcttcaggaagagttatggatggcagctcaatcacatcagtccttactgagacagaaagcgagatctaggtggatcagtgaaggcgattgtaattcccgatatttccacctgctgattaattcaagccgcagaaataattgtctaaagggagtgatgattgatgggtcgtggactgaagagccgacaagagttaaagaggcagttagattgttcttcttgaagcgcttccaagagcctaattttgccaaacctagattggatgggattactttcaagactattaatagtcaccaaaatgatatgctagtggctcgatttcaggaagatgaggtgaaaagggcaatttggagttgcgggagtgagaagagcccagacccagatggactgaatttcaaattcattaagcaattttggcacgtctttcaacctgatttcctccgatttcttgatgaatttttcgtcaacggaatcttcccaaaaggatccaatgcattcttccttgctctcatccccaaagtggcagacccactcctgttgaatgattatagacccatctcgctaattggatgcatgtataaggtagtggctaagattctggccaacaaactaaaaaaggttatgcacaccctcatagatgaaagccaatcagcattcatagaaggaagacacatgttgcacagcgtggtaatagcaaatgaggtggttgatgaagctaaaaggagcaacaagccatgcatcgtgttcaaggttgattacgagaaggcgtatgactcagtgtcttgggatttcttgctgtatatgctaaggcgtatgggtttctactccagatggattcattggattgaggggtgtctaaaatccacatctgtctcgatccttataaatggtagtccatcccaggagtttctccctcaaagaggacttaggcaaggggatcccctagcaccactcctctttaacatcattgctgaagccctaagtggcctaatgtcacaagctattcgaaaaggtctttataggggtttctcagttggtgtgaatcaggtggaaaacgtcaaagcaatcaaggcaattttgaggactttcaaacttgtatctggcctcaaaattaactttgctaaaagtagttttgggacttttggtgtaccggatcaatggaagtctgaggcagctagttacctcaactgtagcttgatgtcctttcctttcacctacctaggtgttcctattggagcgaatccaagattactgacacttatacgggtacctaaaaaggtggaggacaagatggttagcatacaaaggagatttctttggggaggtacacatgatcaaaacaagatagcttggattaagtgggagtcagtgtaccttccaaaagaacatggaggcttgggaattaaagacatcaacacatttaatctagcattgttgggcaagtggaaatggaaaatgtttcagcaccagagggaattgtgggtaagggtccttgagtctaaatatggtggctggagaaatctgagcgaactaccccgaattagtagcgaatccatatggtggcgggacttaaaattattggatcaacatccacttcatggtctcacaatccaatcagcaatctcatggcaggtgggatgtggtgatcagtttagattttgggaggataattggagaggaggtgagggaacattgttaagtaagtatcctagattgtatgctatatcttgccagcaaaaccaaaccatacagcagatgggaaatttcaggcaaacaaggtgggaatgggactttaaatggaggagatcattgtttgacaacgagatagacatggctgtttcatttttaggagatattgatcagtgcagaattcaggctcagtctagagatcagtgggtgtggctactagagccaagcggtcattactcagttaacggtgcatatagggtgttgaagggggagataacagaggagattcaggacagagtatttgaagacttgtggaaactcaaggtcccaaataaaattctggtcttcgcgtggagattactcaaagataggctgccgacaagagctaatttgagaaggcgacaaattgaagtagttgacaacacttgccctttctgcagaagcgtggaggagaatgccagtcatctgttttttcgctgcagcaaagtcattcctgtgtggtgggaatctttgtcttgggtgcgccttgtgggacctctccccaatgacccaaaacaacatttccttcaacatgtagctgcagcaacagagggtattggggccactagaaaattcacttggtttagaccaaatggttcagctaaaagcaagttggacagatttttgatatctcatgaatggattgcaaaatggcctgataccactcaattcaccttagagagaaacttttctgatcattgtcctatcttgcttaggtcaaagatcatttactggggacccaaaccttttaaggttctggattgctggatgaaggatagctctttcaagagaacagtccatgaatgctggacatcttctctgctaggaggatggggtggttttgtgcttaaagaaaaattaaaacgcctcaaaagaagactgaagatttggaacaaggagcagttcggggacactttcaagaagtacaagcagattcaggaggagctaaataggctggaagagcagacaattgacaaatttttatccccccaggaggccaatgttacaaagcagctgcagcaagatttgtgggcagctgcccattctcaagagtcgctactgagacaaaaatctaggtccaggtggattaaagaaggagattataactcaagatactttcacttattgatgaatgcaaatcgaagaaataacttaatgaaagggatcctgattgatgggtcatgggttgaagaaccccaaaaggtgaaggaggaagtcagattgttcttcttaaagagatttcaggaatctgactttcacagaccaacattagatggaatcccatttcaggcagttagccaacagcagaaagatatgctgattgagaggtttcgggaggaggaagtaaaggaggccgtatggggttgtgggagcgagaaaagcccaggccctgatggttttaatttcaagttcattaagaaattttggcccaccatcaagcctgatatcctgcgcttcctggacgaattttatgttaacggatgtttcccaaaaggaagcaatgtctcttttatagcattgattcctaaggtggctgatccgcaatccctgcatgattacagacatatttccctaataggttgcgtttacaagatagtgagcaagctattggccaacagattgaagaaagtgatgccatccattagagatgaacgaagtaaaaagccatgtcttgtgttcaaagttgactatgagaaggcttatgactcggtatcatgggaatttctgaaatacatgatgagaaggatggatttctgccccaaatggatacaatggattgtggggtgtttgtcttctgcatctgtttcgatcttggtgaatgggagtccctcgactgaattcacacctcaaagaggccttagacaaggcgatccactagcgccacttctttttaatatagttgctgagggtctaaaagaattgatgagacaagctgtggagaaaaatatattcagaggctttggagcaattggtatgccggagatgtggaagcaaaatgcagctgatttcctgaactgcagtctgctgtccatcccttttgtttacttgggaatcccattggggataacccgagaaggtgtcagttgtgggatcctattctcagaaaatggctcctacaagggtgatagaaagattggagggcatttagagaagattcctttggggatattaacagcttcaaccttgcattgttgggcaaatggaaatggagtttatttcaaaatcacaaagagctatgggctagagtgttggaatcaaaatatggaggatggaggagtttggatgaagcatctcgagattctaatgattcattttgcactggcagccaaatatccaaggctatatcttattacttgccaacagaatcaccttattcagcaaatgggagatcacaaaggcacaggatgggaatgggacttcaaatggaggcgacacttgttcgatagtgaggtatctatggctgacagtttcataaatgaggtggcagacccatctggcaaatactcagcaaaaactgattatgatatgttgaggggggatgcagtgtag

SEQ ID NO: 63115 - DNA, 189 bp, Glycine max
  Peptide Sequence Number=SeqID_179893
atgtcgattattaatttaagtaattatgctaagcaatactactcaataagaaaggtaaagggaggaggactgcagacagttccttcagcatctgctgttaatccagcaaaaccaacaattgatgagacttgtctcccaactttgcaaggctgtccgcacacgcattcccttctcggtaagtttgcttga

SEQ ID NO: 63116 - DNA, 2682 bp, Glycine max
  Peptide Sequence Number=SeqID_179894
atggatggtgaaagagaaaccctagaggagcctatagaaaaggagggatctttggttggggatgggaaggacctaaaggtgggggttttgggttctgatttgtgcatagaaggtgttgtttgcactcgtgagcgtgatgctgagctgaatggtgatgtgggttttgatggatcaaaagaggagggtaaaggtgtggatccttcaggtggagaagctgctgaggctcttggtgaggattctcaagttttgagatccttagaaagtaagagcgtgaatgagattgctgagttagatggaaatgaagctaccttgaaaacattggatgagcagaagaacattgatgacaaggaggtcaataagttagtggagaaagaagcaattagtgatgttattcaggctgagccagatgttacgcaaagcattaaagaacatgctggggatcttggtgaaggttctcaagttgtgaggtccttagaaggtaagagtgagaatgagactgctgagttggatggaaatgatgtcaccttgaaaacattggatgagcagaagaacattgatattcaggttgagtcggatattagtcaaagcattgaagggcaagctggcattgctgagcaggttggttcacaaggagagcaggaaattgaaggtgaaaaacttgatgatgctaaacagcgaaaaccaacacatggaagagttgcaaagcatgtgtcaaataaaagttcaggaaacattcttcaagcaagttatcagctgccaaaggaaaaatctgagttttctgtgtatgatatggtttggggtaaggtgaaaagccatccgtggtggccagggcagatatttgatccctcggattcgtctgtggaggcaaagaagcatttaaaaaaggaccgccatttggttgcgtattttggggatagaacatttgcttggaatgagtcatctcagctaaagctctttaggactcatttctctaatgttgtaaagcagagcaattcagatgcatttcagaatgcagtagattgtgctttggatgaagtcgggagatgtgcagaatttgggttagcatgttcctgcatacctaaagatacttatgacgagattaagctccaaactgttcaaaacactgggattcgagaagaactaagtttcacacgcagagtggatgaatctttaaatgctagttccttttcacctgagaacattttggaatacttgaaaactctatccgagtttccaactggtggctttgatcgattggagcttttaattgctaaggctcagttgcttgctttctatcgtttgaagggttactcttgcttgcctgagttgcaatattgtggagttgtggataatgacactgatgccttcttaattaaggacttaattaagggctctgataaaagtttgagtgaagttaataagcatgcaactcatgcgagtaaaaaaggtcaaactggtgctggaaatttgaagacagcaaatggctcctgtctcaaacgcaaacataatttgaaagatgatttatatccagaaaagaagaaaataattttgtcagaagcagcaggtgggactccagattcttcacttggtaattatcagccaggtgatgccactgataatctgatttctcctgcctcttccaagaaaaggaagactattgatcactgtgctggtgtttcagggatgaaagataggagaaaaacaatttcccttgccaaagtttcaaataccataaatcaatcatttaagattggtgaacgtattctaagggttgctaatcaacttactggaccaccctcctctatgttgaagtgttctggagacaggactcaaatggaagatggaagtgctgatggttttccagggaatggatctgatgtcttctcccctaatcctgagaagactcagaagtcaagcttcactgttccaacggaatattcatctctagatgatttgctacatttacttcagtgggtagcacatgaacccctgggagattatagttccctgaatgttatagtgagcttcttctctgatttcaggaattcaataatcgtggccaatgattctggaaaagaaaattttcctacaaagaaagttggtgctaaaaggaataaacgacctgtgggtggatcacctgaaacatttgaatttgatgatctgagtcatacacattggactgacatgggcatccagagtggttctgaaaaacagcagtcacagagaagcagcagaagagactatcaacatgcccctgctgagccagaaaaaccttttatagtttatactcgtaggtcctattccaggaaacaatgttctgacagcaatcatgttgcagttcctgaaaagcattctggttgtgcagatgagaattccccagttgagcttgttttaaactttgctgagctggattctgttccctcagaaatgcgcctaaataagatttttaggcgatttggacctctaaatgaatctgaaacagaagttgatagagggagcagccgggctagagtggtttttaagaagtgtgttgatgcagaggttgctttcagtagtgctaaaaagttcaacatatttggatcagttcttgtaaattacaagcttaaccatactccaagtacattatccaaagcttcatctcttgccacaactcaagaccaggagaacggaaatgcatcttga

SEQ ID NO: 63117 - DNA, 300 bp, Glycine max
  Peptide Sequence Number=SeqID_179895
atggagaatggggtctcgcttaaggagaagtatccaagactataccagatttctcaacagcaacatcaacacatccagcaaatggggacaatagcaaatataggttgggaatggaagcttcagtggaggaggttcctcttggaggctgaaatagacactgttgcaaaatttatggaagacttacagcgtctgacgtgggtgctttctcggaaaatccaaaacaacacttccttcaacattcctactacaatctcagcggacttaggcttcagtggtggcagacctggtggattgctttga

SEQ ID NO: 63118 - DNA, 207 bp, Glycine max
  Peptide Sequence Number=SeqID_179896
atggtggcggaacttgtttcaccatcaagggagctgtgggctagagtgttggactctaagtatggaggatggaagaacctagatgagaatagaaggaacttggcagaatctgtatggtggcaagatcttaggtccgcttgtcagtcaatgggggagggaaactggttcaaaaggggaataagattgagtgtggggtgtgggtcaaag

SEQ ID NO: 63119 - DNA, 1488 bp, Glycine max
  Peptide Sequence Number=SeqID_179897
atgtgcgggaaatcttcatacccaacagaaggaataataacggaaggagatatggatgtcagattcaaaggggtcagagacacccataacctggcaaaacaactcgacaatatcatcattagggggttgaagctatatgtcaacatacctaggtacaacagggagagactgggacagaggactccaggaaacaagtcacaggacaaagacgacaacacccaacacgaagttgattgttgcaagaaaaagaaatacacaaaccagggatcatatgctgaggtactgagaagaaacattggccccaaggggtcacggcagccttaccatagtcacccccaagcacaccacactaccacatcttccattcatcttaacatagaacctgaagataccaattggttgaaggacgcgtgggtaaggagactatcaaaccccgcaatgtttgacagagtggaggaagagctgctatgggaaactgggctggacatatcacccaagtatattggtgatgatctaatcttattgctcggactcacggacaatggagctaaacacctcatgaatggggggcaacatggagggacatcaatgttctattcgatggagaaatggaacccaggtattcgcacaggttttaggttgacatgggtccaagtttggggcatcccgctgcaggcttgggacacgaagtactttaggcacatactggcagcaatgggggatttggtggaaatagatgacgacacaaaggagaagaggaggcttgatagggctagggtgctcctaaaaacaccatggagaccaacaatcaaccacatggttgaagtccacataagcgatgaatgtttcaaggtgtttgtcgttgaggaaaccagaggaggcagctttcattaccaacggcgacgcagttcgatgggagggtcgtcggacgatatctcctctaaagacatctccctcgggagccttacactgagaaccaccagcccccgcggccttgaagacgtcacgcgactctcaccggcgcaggtaggcggtgacgctgactctgacgggggtggcatagcggaagtcgaggaagcccatcgggaaccccttttacccagtgggtctcacgacggaagttacccactaggtaatgcctctaccccgcgtgcgacagatcaggtcacatcacaaagtgcgacccgagccttaacggctagttctgctcacgacacgcctcccaatcatggcttggcacagtgtaccgagggggtgggtgttgcaggaagcggtgtgaagttgcataagaaaggaaagagtgatgagggagactctacaggggcagtagatgcattgaagaaaaaaccaaaagcaagtgctgacatggcagcaacaagcaacgtggcagatgaaacagaacttgggtcaacaaatttaaaagttgagacggcacaagtgcagcaagtgcaaaacctgtgcctgtggatttcgacacccctaatgtaa

SEQ ID NO: 63120 - DNA, 237 bp, Glycine max
  Peptide Sequence Number=SeqID_179898
atggcaacaacaacctcaacgtttcaaccgcagacccatcacccaaccctcctccttccaatcaatttcctcaccataacaatcaacctcaccagcacaatgttgcgaagatggagacgaagcaaacctcaaattcgtagggaagatcatgttggcgatggtgacgacgaaggaacaagagactctgatgatggctgttcgggaagcgcaagggaggaacaaaaaacgatttgttga

SEQ ID NO: 63121 - DNA, 510 bp, Glycine max
  Peptide Sequence Number=SeqID_179899
atggcatggcatttagcttcgatgctgggtctagcaactatattttgcttcttacttctgcatgagaacaaatttccttccaagagtcagagtctacaacctggtgcatacttgatatatctaaggattgatatatctaaggatgcgcatgacagcatcccaatggctatcacaaggggcattgaggaattgacttaccacacttactgcaaagaggcaccagaatcaagtattcaaggtccaagagaagagaactgggagaaaaaggctacaggattaccagacttcacaacaataacaggcaaggcaggttgcttggctgctcaaaactggaggaaatcaatatactcactagcaaagatagtcacactcctatgtggggcagggaggagtgttgccaatgagtgggtgtggccaaaaagtagttcacgtgccaagaaagggtcgtgcgtggaggcgtgtgtagaagcatctattgacacaacttccaatgccgaggtcgttggatag

SEQ ID NO: 63122 - DNA, 192 bp, Glycine max
  Peptide Sequence Number=SeqID_179900
atggtgtccttaccctctgatttaggaagaccttcaaaaaaatcttatgaaatgtcactccaaacttgtgagggtatcagtaatggctgcaataaacctgcgggggtatcacaggtggccacaaaaaacactggatatccttcttcatcccctctcattataccaacccagctagtctttgataagttctaa

SEQ ID NO: 63123 - DNA, 1401 bp, Glycine max
  Peptide Sequence Number=SeqID_179901
atgatacccgagaaataccttcttgagcaacgagcagtcgttgatgttgatggagggacattgctgaatgaagactatgacatcagatctgttcttcaatacctgttagatgacgtctctgagtttctatccactaaattagttgaagtaaaagaggaaagggaaatatctgaagataagggctgcatttttgttctaaaagcattcattgattatttacttgagcgtgagaaagaaaattttggtgctcggaggaaggacaatgaaaactctgtgacgttgactaccattcatcaggcaaaaggtttagagtgggatgttgtcttcatagttaaggcaaatgactctgagatccctctattacatgatttcaagggcaccgtaaaggacactgcagccttacttgaggaagaaagacgattattatatgttgcaatgactcgtgctcgggagaagctttttattcttcatgttatgatggactcaaactggcagatgcttcaaccttcaagatttttgaaagaaatccctcgtcatcttacagaagttcagctgcattatactaatgtcgaaccacaatactggccaccactcgaaacagaggggcctaccaaaaacctctggagcagtgctagggacctgatggacaggagtgggcagagactgcttgaacaagcagctggaaaagattcactacaaaaaactacacccagggcagtgcatgaacatcttgcactgagaagaatggattattactggtgcataactggtgaaataagttttcaagaactactgataaagcaagaagctcttcaaaaggaaactgcccattgtaccactgacttgttgataaaagagaaacaatctgaagcagatgtgatccctatgcctcatgaaatacttgataatcattctagtgagacttccaatgagcttgcacaatttgcagaggcaaacaatagaaatgatttcttaagaagatttagtgttgagaacaggtctattgtttcccatttattccatcagtgggccaaaaagaaagcatttcaagatccaaagagattgcttgacaaggttagttttgtaattgatgaacgcctcagacagaagagaaacaaaaacaaggatttgttgaatacattaaaatcttgtttaagctgtgatgaagcatttcagtatgctcaatatgttttgagatgggagcagattcctgctgataaacgtgctcatcttatgagagaaaaacaggaacatttcctgaaattaaagattgagaatgcaatgggttcggcaacaccaactgacaagcagatttcatatttgaaaaaactgggttgcaccgcaatccctacctcccgcctccatgcatctcatcttattgagcaattcaaatcattgtaa

SEQ ID NO: 63124 - DNA, 960 bp, Glycine max
  Peptide Sequence Number=SeqID_179902
atggggcttatccgctttctcaggcttcctgtgtatttacacgaaaatacaatgggtgttatgtatgcctttgtaatgcgtcctgagagcttgccaaaatcctatcaagacttcattcaaaagaccgggccagttgcagagcctgtatacaaggctgtaagggatagctgtagaggtcatccagttgatgttgcgtcactgcatgcttatttatctcgtgtaggaagatctgactatgtaaagttggaagaatttccctccattattccatgttccattattcatccagcaacaaattcatgcttagctcatcaaggaaatgcaacatcattaacgtttaagaaaacatttccgctttacttctctttgacctttgtgccttttgttgttctgcacctacagaagttcactgatgctcctttccgcactttctggcttgccattaaaggtgctgttcgctcgacaacctttttatccgcttttgttggaatctttcagggagtcatatgttcacatagaaaagttttttcaagagatcacaagcttgtatattggatagcaggtggaatagctgccctatctgtgctattggagaaaaaagctaggcgtggtgagctagctttatatgttcttcccagagcagtagattcattgtggtatatcttggtgaacaggcaccttcttccaaatatcaggaatgctgaggttttcttgttttctctgtgtatggggggaatcatgtattacctggaacacgaaccagaaaccatggccccatttcttcgaggcttgatccgtcgcttccttgccagcagaatcagcaatccaagcccacctaatcggactgcttcctacacatacctgcaagctcttgatggcataacgaaaccaacattacaggagaagagggatactgaatcttccgaaaagtacaaccttgaatctattcctgggctttaa

SEQ ID NO: 63125 - DNA, 243 bp, Glycine max
  Peptide Sequence Number=SeqID_179903
atggcttcagaaaccattgaaaatgtgtgtgcctggaacatctttggtgcagaaaacacaacagggtcaagcagtaacatcatggagggcgcaaggctaagtttaggaaatctaaaatccttgttacaatttatcacctccaggacactggcaatatcaccttggttgaaatggcacacaaaaagtttttcaatggtggaagacactgaatcaaccttcataagatatcttctcaaagattga

SEQ ID NO: 63126 - DNA, 180 bp, Glycine max
  Peptide Sequence Number=SeqID_179904
atggcactgatgtgtctatttgtttttgaagagggagatttagttgctttggggtcattgaggggtctgtcattgcaaccttgctcgtctgaaattccatctgataagagtggaaaggggtctagagataagcgacctgtccataaagttgccgcagagtttcgtaggcatgtaatttaa

SEQ ID NO: 63127 - DNA, 447 bp, Glycine max
  Peptide Sequence Number=SeqID_179905
atggcggtgatggtggagttttcggcgacattatcgaagaaaccgtcggacataatggcgtcgacgtgggagaagtcaaggaggtcgtcaatggcaaaaggctcgccgatccaaaaccaagctaaatgcaattatcatctattttatttatggatcatagcattactctttcaaaaaggaagctttcacattctttgtattgatgcagcaaccgagacaagatacttgaatgctagcaatagagaactatgccctccaaatgaagctcgattatcttctgataatcctgattccccatctaaggagaataaggttccttgccagctccttcaatttacatttcaagaactaaaggctgcaactgggaatttcagacccgatagcattcctagggagggtcgctttggttacatacatcacttacatgtactaagacttctcacataa

SEQ ID NO: 63128 - DNA, 138 bp, Glycine max
  Peptide Sequence Number=SeqID_179906
atggaaatcaccatggcgatagagggtgtgatttgtagcactggcgggaaggttatggatgttgctactgacaataaagctagtggtgaaaggatagtgcagagggtagaagtcactactcctgattccatggtatag

SEQ ID NO: 63129 - DNA, 402 bp, Glycine max
  Peptide Sequence Number=SeqID_179907
atggagcaggaagagcacgaggtgtacggtgcagacattcccgacgaggagattgacatggacgcagacgccgaacagcaagacgagcaacttgcccccaatcacacaaacaaggaactggaggacatgaagaagaggctgaaggagatcgaggaggaagctagcgccctacgcgaaatgcaggcaaaggttgagaaagagatgggcgctgttcaagattcgtctggcacttctgcgactcaagttgaaaaggaggaagtggatgctcgatcaatctatgttggtaatggggtagttttaacctatgtcagaagtcacaggagacatatccatatgactggatattatgtgaattttatcccccatagttttaaaagaattggcaaggatctcggcccttag

SEQ ID NO: 63130 - DNA, 237 bp, Glycine max
  Peptide Sequence Number=SeqID_179908
atgatcgaaagtgacattgaagccctgagtcattatggattgactatgatcctcttggttgatcacaaccctcatgaattgatcaggaccttggtgagtttaccacgatcgtcatcagatcctttacgtggttatgggaaggcttgtattgttcccaacaattcctctatgaagaagcactttgacatgtccatcagcgtacttaatgggcctaacaacaaggacccaattaggtaa

SEQ ID NO: 63131 - DNA, 972 bp, Glycine max
  Peptide Sequence Number=SeqID_179909
atgcctcggaggaatgtgggttcatttaatgtagtaatttctggatgtgctgcattggaaaattctaattctacttcccatgatgatttatggaatttttttgtgagaatgcattgtgaagggtttaaggctgatgctttcaaggttgcgagtttgctgcctgtgtattgtagcgatactgggaaatgggattatgggagggagcttcactgttatgttgtgaagaatggattggatttgaagatgggttcagatgttcatctgggatcttctttgattgatatgagagtgtttgaccaaatgaaaaacatgaatgtgtatgtttggacggcaatgatcgatggttatgtgcagaatggagtacctgaggatgcactggttcttccccgtgagatgcaaatgaaggatgggatacgacccaataaatttggattatgcaagatgagccttcgaaactggttcttacttcaaagatgctgtcacttggagttcaatgatctctgcatatggattacatggaagaggagaagaggctattattacgtattacaaaatgcttcagcaagggccagcttgatcaagcctcggaattcatcaaagatatgccttagtccaagtgtttggggatctattttaactgcctcggtaatgcatgggaattcaaggacaagagacctggcttattggcatctcttagaactggaacctgaaaacccttcaaattatatctcactttcaaatacatatgcttctgatagaaaatgggatgtggtaactgaggtgagaacgattatgaaacaaagaggcttgaaaaaggttccaggttgcagttggataactattagtgggaagactcattctttttctgttgctgacaaagcgcatccttcgtctagtttaatctatgaaatgcatgatgaccttgtatcaataatgatggatggttgtgctgatattgatatcctgacttaa

SEQ ID NO: 63132 - DNA, 1590 bp, Glycine max
  Peptide Sequence Number=SeqID_179910
atgggtggtggattacaacttcggcaaggaagaaacgaagaaaaaataaagactgcaatgtcaatcatgatgaatatgcgatgtcaaggggtgtcacagtggaagtgtttttcgttaagggtaatagaatctcggtttccattggcacatagaaggaagaaaggtcttggttctagaaatagggattctgggaaagaattttcaattggggtggtgccacgaataagcagcatctgttatcctcagtgtggctattttccatcaagtgggggtttcactgccaaaaggaggaaatgtaatagtctcctaagactgaaggattgttcagaaaacataagacaacatgcttctattttgtttgtgcggctggttactggagtgatgttggtcatggctgtttctttggcttctagtgagccatcctgggccctgtctgaagagaatctcctctttctggaggcatggagaacaattgaccgagcgtacattgataaaagttttaatggacagagttggtttaggtatagagaagatgcactacgcaatgaaccaatgaacaatcgagatgagacatatacagcaataagaaagatgcttgccacattggatgatccattcactagatttttggagcctgaaaagcagtctggaactaaaggcgctctaactggagtggggttatcaataggctaccctaccaaagctgacatgcaacctggtggacttgttgtcatttcagcttctccaggaggtcctgcatatagagctggtgtttcgtctggagatgttatcctggctattgatgatacaaacacagaaaacatgggactatatgatgcagctgaacgtctacagggaccggaaggaagctctatagctttgaccattcgtagtggttcggacataaaacacctggatttgacgcgagagaaagtttcattgaatccagtgaagtcaagattgtgcaagctacctgcttcaggaaatgattccccgacaattggttatatcaaactaacatctttcaaccaaaaggcatctagtgctatcaaagaagcaatcaatacattaaggagtgataatgttaatgcatttgttttggatcttagagataatagtggtggtcttttcccagaaggaattgagattgccaaaatttggttggacaaaggggtgattgtgtatatttgtgatagtcgtggtgttcgagatatacttgatacagatggaagtagtgcactagcaacttcagaacccctggttgtactggtaaacaagggaactgcaagtgcaagcgaaatattagctggtgcattgaaagataataaacgagccgtattgtttggagagccaacatttggaaaagggaagatccaatcagtttttgagctctctgatggctctggattggttgttactgttgctcgctacgagacacctgcacatacagatattgacaaggttggtgtcattcctgaccatcctttaccaatatcatttcccaaggatgaggatgcattttgcaattgcctccaggatcctgcgtcttcttgctacgtcaataggatccagcttttttcaaaatcatga

SEQ ID NO: 63133 - DNA, 123 bp, Glycine max
  Peptide Sequence Number=SeqID_179911
atgaaggttttcaacaacaacatgggcaatgctcccaacctcatggaagatgctgccactgctgagatcagcagggtgcagaattggcagtggcttaagtatggagatggacttggcgtgaag

SEQ ID NO: 63134 - DNA, 360 bp, Glycine max
  Peptide Sequence Number=SeqID_179912
atgttttcttctgttttcaagccagcaaaagcaagtgattgtgtagcagattggagctcggagagtgggaggaagaagcaagtgttgtgcaaatatttgaaatttgaggtgggggaggaagtttggcttcttgtgataactgtaataaatacttctagcgtgactagcaacttgaagaggaacacatggcagtggatcaagtgcaccaagagggaaggaaaccgagtagcagacgatttagctaagttagctttctctacttatgagatgtattggatggaagaatgtccatctcaacttttgctgtattttaatgatattggtaacacaactacaaaaagcagattctacatcggttaa

SEQ ID NO: 63135 - DNA, 555 bp, Glycine max
  Peptide Sequence Number=SeqID_179913
atggcgaataatattggtgtgttgatgatggtcttcttattatgcctattgaatgtaataacccatcttccaaatctcacaaacgcatcatcatcgtgcaaatccaaagggcttcattcccccccatataatccctctggaacgcatgccattctcactctcaacaacttcgctcgcggcggggatggaggcggccccgccgagtgcgacggtaagttccatccgctgccacaaagagtggtggcactctccaccggatggtacaacaaaggcgcacgatgcgggaaaatgataagaatcaaagctagaaatggaagaagcacgttggctaaggtggtggacgagtgtgactctgtgcatggctgtgcatgcaagaccaacgttgttgatgcgtccaaaaccgtgtggaaggatttgggactcaacacaaatgatggtgaagtaccagtgacttggaccatgttcaattatctttcttcatcttcgcttgcaactagttttctggtttcattcaacacaatctttcccgtctcttcatttaatcacaggaagtaa

SEQ ID NO: 63136 - DNA, 168 bp, Glycine max
  Peptide Sequence Number=SeqID_179914
atgattttggcatggacttccaaagacaagcatgagatggtggatgacggtgaagatgatggctataaaagtgctccggaaaaaggatgtgggtcaaagtacccagagagtatttttcttaattgtttcacatgcaaattccaaatcaatcccgatttaatcgaataa

SEQ ID NO: 63137 - DNA, 270 bp, Glycine max
  Peptide Sequence Number=SeqID_179915
atgacggtggtggaagaaagagaggcagtgttggcatgtagtgacaagaacatgaagataggggcgacgatgtgggacttggaaacaggagaaaaattgtttcacataccaacatgtgcctcgccaccttttggcttcttgtgcttgagaaaccgtttccttgtggcgtctcaatcaaacaaactcgggtctgttggcgacggagccattgcaatttggtctttcaacaaggaggaaaacatttaccatgtgtacactcatagtctttga

SEQ ID NO: 63138 - DNA, 507 bp, Glycine max
  Peptide Sequence Number=SeqID_179916
atggagtatgaaatcctcatgaaggataaatctaatatgtccgaacaacaacgccaagaccacgaaaattaccatgtaatggatccaaatatcaatttagatgaagctttggaccaaatggtagatgaagaattggaagacaaaatcgaagaagaaattattaggttgatactaaagagccaacatcaactagatggcaacaccactaagcggaggcaaagtagaagaatggtacatcagaatcataaggaaggtcatgatcgattgtttaatgactatttctcagcaaatcttgtgtacacagagactcggtttcgaagaaagttttgtatgcaaaggcatgtatttcttcgaattatagacgcacttaacaatcatgatgaatactttcaaatgaggatcgatgcactaagtcaaaaagacctatctccattgcaaaagtgcacaactgctcttcgtatattggcttatggctcatctattaacaatgtggatgaatatgtttga

SEQ ID NO: 63139 - DNA, 408 bp, Glycine max
  Peptide Sequence Number=SeqID_179917
atggcaacttcttgccaatccaatggtgctcactcacccgcattcaatccatcgggaacgccggccattctcactgtcaacgacttcggccccggcggtgacggaggaggcccctccgaatgcgacgggacctaccacccgctgccgcaaagagtggtggcgctgtccacgggatggtacaatggcggttcccggtgcggaaaaatggtaagaatcacggcgagaaacggtaggactgcggtggccaaggtggtggacgagtgtgactccacacaaggctgtgaccaggaacacgcaaatcaatcaccatgcaagacaaacattgttgatgcatctgaaaatgtgtggcatgacttaggccttaatactgatgatggtgaagtaccagtcacttggaccatggtctaa

SEQ ID NO: 63140 - DNA, 327 bp, Glycine max
  Peptide Sequence Number=SeqID_179918
atggagtttgttaatcgaatagtggacatagctaccagagctgtaaacagcaacgcagtgatcaatgtttgtctgcttgcgtcgtttgcaacactcggcgtaagatctatgaatcagcaaaagaccattgaagctctacaggatgagaaggagtctcttaccaaatccaacaagtccattagaaagacattgtgggactggaaacagcagctttatgctgaagcctccgctgattctgcagtggttcctctggctaggctcaaagcaatctatggcgaagccccgcctcctccacgtgccacgctcgaaaatggttttgtggattga

SEQ ID NO: 63141 - DNA, 330 bp, Glycine max
  Peptide Sequence Number=SeqID_179919
atggataagcgacatggaaattacatacaatgtagcaccatcggtcaaggagaattcaaccgaatagcattcccgaatcccgacactttcttacaaaataaataccacggagaaattgattatgagcgtgctttacatgctgaagcggctgttcgtggaaaagctattagtaagcgtttccatgttatctgctttgaagatataaggccttacactgggtggttgcataggaatgattctaaggcaagcattgcaaacggggtaactccagaaggttttatagattatgacagcctcaggttttggataacgggaaacagtgttatttaa

SEQ ID NO: 63142 - DNA, 267 bp, Glycine max
  Peptide Sequence Number=SeqID_179920
atggtgggaaaggagaaaactagttttagagagtatttgattaaagtggtcggcaaagaggagtctgtcatggaggtgttcatggaaggcagagaggccaaagtcgaagaccttcaggtcatcggcaccatccaggaggaggttttgtggcttgaggttgcaatgggcgacgtcgtggcaatggcagaagcagagcatggagacgagttgtgcgaagtagcagtggacgaggggcttcgggaggcatttgtggctagagaaccttaa

SEQ ID NO: 63143 - DNA, 1356 bp, Glycine max
  Peptide Sequence Number=SeqID_179921
atggctcagttgaaagcttcccctgcgtgttcaacccgtgccactgctccctcatttcatacaacagggcacctgtatcatcatttctggaaggcaaaaccttcgtcattcaaagagttggggctaagaacaagcgttggtgccaataaacttcaagttattaaagcagctgcacgcagtgatacagaggtagtttctgaaaccacaaaggctggtggcctacgtggaaaattgaataaggtggtgttggcttacagtggtggcttagacacatcagtcattgttccatggctgagagagaattatggttgtgaagttgtttgcttcactgctgatgttggccaaggtataaaggaattggaaggtttagaacagaaagccaaagccagtggagcctgtcaattagtggtaaaagatttgaaggaggaatttgtcaaagattatatatttccttgcctgcgtgctggtgcagtttatgagaggaagtatttgcttgggacctcaatggctcgccctgtaattgcgaaggttcgatttgagctcactttctttgctctaaaccccaagctcaatgttgtggctccatggagggagtgggatattacaggtagagaagatgctattgagtatgctaaaaagcatagtatacctgttcctgtgacaaagaaatccatatatagcagggataggaatctttggcaccttagccatgagggagatattttggaagacccgagtaatgaacctaaaaaggacatgtacatgatgtctgtagacccagaggatgctcctgatcaagcagaatatgtggaaattgggttagagtcagggcttcctgtttcagtcaatggtaagagtctttcaccagcgtctttacttgctgagctcaatgagattggtggaaggcatggaattggccggatcgacatggttgagaatcggcttgtaggtatgaaaagccgtggagtttatgaaactcctgggggaacaatcctgtttgctgcagcacgtgagttggagtcattgacacttgatcgtgaaacaatacaagtcaaagattcattagcccttaaatatgcagagttagtgtatgctggcagatggtttgatccgcttcgggagtccatggatgcctttatgcagaagatcacagagaccacaacaggttctgtgactttgaaattgtacaaaggttctgttactgtaaccagtcgtacgagtccctttagcttgtatagggaagacatttcttcatttgaaagtgggcagatatatgatcaagctgatgctgctgggttcattcggctttatggtcttccagtgagggttcgagcaatgcttgagcagggcatctaa

SEQ ID NO: 63144 - DNA, 177 bp, Glycine max
  Peptide Sequence Number=SeqID_179922
atggcagcaaggggttgtcgacattttgggaggagatggtggcgcaacgggttgatggtggtggtgtttgacttggttgcgtggggtcaatcaaagattgtggtggttgtgggtaatagtggtgcgcgtgagttgggtgacaaaggtgaggttggcagtgttgggaattttcaataa

SEQ ID NO: 63145 - DNA, 1188 bp, Glycine max
  Peptide Sequence Number=SeqID_179923
atggatagttcttccaattcagtgatggaggatgaagttgagtcaacaaccttacattctgccccatcatttgcaatatacaacaatcttcatggagatgatgacatcacccctgaagaagttttgaagagaactgttttggttggacagagtttggaagctacaggcagtggtgacttcagctttgggagtaacaagatggatttgattgaggaaggagagaatgagaatgagaataatgattggtcaactgggattcggaatttgagtattgaggaggaagatgttcagccagctagtccccccatgtatctggcagcagggcttggggttgatgctgatgtaggatttgataaatttatcagcgatgatgtatttaatcccagtttggaagaaagtgaggatcttgaagggtattacaagcggatggttgatgagtacccctgccaccctttggttctcaaaaagtatgctcagcttttacaatctaatggagaccttcaaggagctcaggagtactttcttcaggctaccgtggcagatcctaatgatggtgaaatcttgatgcagtatgcgaagctggtgtgggagaaccatcatgacaaggatagagcaatggtctattttgaacgtgcagttcaagcagcaccacaagacagcaatgttcttgcagcatatactagttttctctggaatattgaagatgatgagaatgaagatagaaaacatgaaattcagagtgacatggaaatacaaaagactgaacctgtaaagccctccaaagaagaaagtggacaagtgattgatgcagcaaatgttacaacagctaattttggtgaagaaagcaatgttgaagattatttgaagaagatggttgatgaaaatccaagcaatcctctgtttctgaaaaagtatgctcagtttctgttacagtccaagcgagatcttcaagcagcagaggattactactcacgtgcggtagtagctgatcccagtgatggtgaaatgatatcagaatatgctaatctggtgtgggaacttcatcatgatcaggaaaaagcttcttttttgtttgagcaagcagttcaggctacccctggggataggagagaaaaatccatagcaatgttctggcagcatatacctgttttctctgggaaacagatgacgcagaaagctgaaatttaa

SEQ ID NO: 63146 - DNA, 1356 bp, Glycine max
  Peptide Sequence Number=SeqID_179924
aaagacttgggtttctttgcttttccttcaccatcctccataattgggaagagacagaaatgcaagaaaacatcatcaaataagattgtttctgttgtgtcatcccccaagaacaaacgcagcccttctgcaactggctcagttgtgttcactttcttccctaccaaaattccgatgactgcgacagagaagattctggcaagagctgccgagaaatgtgaggtgaggccaggggagaacgcttgggcaaatgttgatgttttgatgatcaatgatatcacttgtccaggtatttctggaatcttcaagaaagagtttggcaacactgcaaaggtttgggaccgtgaaaagattgtggttatccctgatcattacatattcacaaatgatgaacgcgcacaccgcaatgtggatattgctagagatttttgtgttgagcaagatatcaagtacttttatgatattcaagatcgcagtaacttcagggctaatccagattataaaggtgtttgtcacgttgctctagcacaggaaggtcattgcagacctggagaggtcttgtttggtactgattctcacaccacatcagctggagcatttggccagtttgccacaggagttggtaacactgatgcagcttttgtattagggacagggaagatcttactcaaggcaaaaaggatgacactgtgcaacatggttatagaagctggagggaaaaacggtattgttgctgctgatagaaccacatacaaataccttgaggataagacgtctgcaccatatgagccagtttctagtgatgagaatgcaaggcaagttctgtttctagcccaatatagatttgatgtatcaaatatggaaccattggttgcaaagccacattcccccgataatcgtgctttggcaagagaatgcaacaatgtgaaaattgacagagtatacattggatcctgcactggtgggaagactgaagattttatggctgcagcaaaagttttcttagcggggggaaaaaccgtcaaagttcctacttttcttgtgcctgctacacaaaaggtttggatggacttatacacacttgaggtacctgactcaggtggcaagacttgttcgatgatttttgaagaagctggctgtgatcctcctgctagtcctagttgtgctgcatgtatgggtggtccaagagacacatatggacgtttaaatgaaccccaggtctgtgtctcaacaacaaatcgaaatttccctggtcggatggggcacatggaaggccagatatatcttgcttccccctatactgctgcagcatctgcactaactggtttcgtaactgatcccagggagttcttgtag

SEQ ID NO: 63147 - DNA, 1026 bp, Glycine max
  Peptide Sequence Number=SeqID_179925
atgggtattacagtgtccaaccacctgttaggtggagatatacatgcaagggactttgttgctacgaatgaggtcaaagaaaatggcgcagtcaacaattatggattttcacatcaacaaatgctacgagtccatgattctgaacatattcaggaggatgttgttgctgaagaatcacatggttcatttcaacctactgtggatgctgtgcaagaacatgtaccttctgctgaagaatctcctgaggagccccaaaaacatacttatgcttccatattacgggttgctaaaggacaagctacaccatctgtagcttctcagccatctcagaagaatttgacttctttagactgggatcatgctccactgactaatagtcagcagactacgtcatttgaaaggtctgaaactgttgtagtggaggaggctcccacaacagaagatgaagatgaaatcaaatctgtttatgtgagaaacttgtctcctactgtgtctgcttctgaaattgaagaggaattcaagaattttggcaggattcagcctgatggtgtagtcataagaagtcgcaagtggtatcacactgtggctccctgctgctgctgcgtggcctgttgtggagcagtttcatttagcagtgtgaattgtggccgctttcatgatgtcggagtttgttatgcatttgttgaatttgaagatatgatgggggttcataatgcagtcaaggcaggatctgttgaggtagcaggaagacacgtatacattgaagagcggagaccaaacagtaacatcccttcacgaggaggaaggaggggtagaggtaggagtagctatcaattatcagaggcacaaagaggacgttttggtccaaggagcttttgcaggggaagtggccaagatggaggtgaatgggagtataacaaacccaaaggaaacggtttctatagacaaagtacccgtcaagagaggggatattcttcagggtatcaagggccaagaaatggtcagaaccctgccgaatcagcataa

SEQ ID NO: 63148 - DNA, 183 bp, Glycine max
  Peptide Sequence Number=SeqID_179926
atgaatcaggcaatgaaattgtttgtaggagaggacgtattttttgtagagtttgtcggcggttttggagcgtttgaggggtcggacccaggagaagacggaggagatgcggctgcgagtgcgagtgcgaggaggggtggcactcgcagtggtggtggtggtggtggaggagggagggcgtga

SEQ ID NO: 63149 - DNA, 1929 bp, Glycine max
  Peptide Sequence Number=SeqID_179927
atgtctcaaatcttggcaccgttccagttactggaactgaacgtgatttccgcccaggacctggctcctctgggtcgcaacatgcgtacctacgctgtctcctgggttcacccggaccggaagctctccacacgcgtcgactctgagggccacaccaacccaacttggaatgacaagttcgtcttccgcgtcgacgaagagtttctctactccgacacctccgccatcatgatcgagatctacgcgcttcattggttcaaggacatccacgtcggcaccgtccgcgtcctcgtcggaaacctcgcccctcctccctccaaacccttccacaacaaccgcactccgctcggcatgcgcttcatcgccctccaggttcgccgcccctccggcaggccacaggggattctaaacattggcttcaccgtcctcgacagctccatgcgcagcatgccgctctacactcacaacgcctcggccgtcggctaccgccacctcatgggtgagaaggacgcttacgacagccacaaccacctcagcccccgcatccgccccactgccgtcgcaactcccatgcctgagcttcgccggaccaagagcgacaccagctccatgctcggcgccgctgaagccgtggcgcgccaccaccgagccatggctgtacgagccgactccaccatttcgggatccgaggttagcgttaaaaagaagaaggggaagaagaagaaaacgaaagccaagaagagtagctcggttgtgagtagcgtcaacgaaacgaactcggtcctcagcgacaccgttttgccgtggaaggttaaaagcggaaaggcaagtcccgatgatattgtccacgtccacaacaacgtcgttgaggaggttcataatgataatgacgatgataacgagaacgcacattcaaccgttaactccgtttctgaaattgccaccagcgaaaccgacgctgatgaaggacaacaacatgttcatgttaatcacgttcaatacgaagttcgagcctcccccaaaccgcagtttcgaaactctccggcaccacaatttaagaactctccggcaccacaatttaagaactctccggcaccgcaatttaaaaattctccggcaccgcactttaagaattctccggcaccacaatataagaattctcctgcaccacggtatatgaactctccgaagccgcagtttaagaattctccggcgccgcaatttaagaattcgcctgcaccgcagtttaagaactctcctacgccacagtacaagagttctccggtgctgcagtatatgaactcgccgaagccgcagtttaagaattctccgatgccgcagtatatgccaactccaaagccgcagtttcggaactcgccggcagtgtcgaagttcaacccggcggtggggttcaacgggtcgcagagggggacgccaatgcatccattcgggaaagtgaacggtgcagggtttgagtacatgacaccgcggaggtcaaacttggccaacatggggcatgtggtgataacggagtcggagctggggccgtcgccatcggaggtggcggcggcgatcgcgaggaagccggtgatcgacgagggggagaattcaacggtgggaggatggagcttggacgcggagagcgtggaggggctgcagtcgaagctggagaggtggcggacggacttgccgccggtggtcgatcgcggcgaggtctcgagctacccaacgacgagcaccaccaagacgagccggcactcgcggaggcacaccgacggcgggagtactgggagtggcttgttctcatgctttagtaacatatgtggtgttgagtgctacgttggttgcggcggtgaccctaaaggaaagaagaaccgcatccgcagtcgccgcactccctcagcggatgacagttccagtcttctctaa

SEQ ID NO: 63150 - DNA, 579 bp, Glycine max
  Peptide Sequence Number=SeqID_179928
atggaccagaaagttgtctctacggcatccattgtcaaagcaccaaagtgttatgtgcctgtaactattccaagagtacttgtaactgaagaagattctggagacttcagttcggtatctgattcctcaggagctacaggatccgagaaggatgatagtaccgatgaaaataaagtaaatattagagccagttcgatcccacgccctcgtgctgtcatttctagtcctgaaaatgacatgatgatcgggaatagaaacaagaatggagatggaagactttctgcttcaaagaatggcggtgtgttagaaaatagacatgcacactgtaaagttaaatcacatgacgttactgatattcctccagacacaagaaagcagagggagccagggtctaaggataaagctgatcctgtaggaaagaaaaagattaaaggactgcttaagttgttccagattttcatgctagctgctcactttggctatggctttattatcggtattatttccttgtacagtgctccagagttggtaaagggtcgctcattgcagccgttagttggcaatccaacagtaatctga

SEQ ID NO: 63151 - DNA, 837 bp, Glycine max
  Peptide Sequence Number=SeqID_179929
atgggcaatcgtaacttggcccaactcacccacacctccctcacacgtgccgtccacgctcacatcctcacctccggcttcaagccattccctctcatcatcaaccgcctcatcaatcattactgcaaattctccaacatctcctacgcccgccacctgttcgacaaaattcccaaaccagacatcgtcgccacaaccaccatgctttctgcctactctgccgcgggcaacgtcaaacttgcccacctactcttcaacgccacaccactgtccattcgcgacaccgtcagttacaacgccatgataacagccttttcccacagtcatgatggtcatgctgctcttcatctcttcatacacatgaaaagccttggttttgtccccgacccatttaccttctcgagcgttcttggtgccctgtcgttgatagctgatgaagagaggcattgtcagcaattgcactgtgaggttctcaagtggggtgcactctctgtgccttctgttttgaatgctttgatgagttgttatgtttgttgtgcctcttcgtggttggtggactcttgtgtgttgatggctgctgctaggaagctatttgatgaggtgcctcctggtcggagggatgaacctgcttggactaccatcattgctggctatgtcaggaatgatgaccttgttgcagcgcgtgagcttcttgaaggaatgactgatcacattgctgttgcatggaatgccatgatttctggctatgtgcaccgtggtttttatgaggaggcgtttgacttgttgaggagaatgcattcattgggaattcagctggatgagtacacaccagtgtaa

SEQ ID NO: 63152 - DNA, 498 bp, Glycine max
  Peptide Sequence Number=SeqID_179930
atgccttttgagcccagtgcaccaatttgggaggctcttcttgctggttgttggatccatgggaacatggaattaggtattcaagctactgaacgactcttagagcttatgccacagcaagatggaacctacataagcctttccaatatgtatgccgctttaggtcagtgggatgaagttgccaggatatctggagcaatggtacatgaaatgaggaaattgggttatgttcctgatccaaagtttgtattacatgatatggaatctgaacaaaaggaatatgctttgtctactcatagcgaaaaacttgctgttgtttatggaattatgaaactgtctttaggagctacaatttgggttttaaaaaatttgaggatatgcagggactgccataatgcattcaacctaaaggatggaaatttgccttctgctaatccactactcttgcacatggacgatagagttgattattgctatatcaagtcattaaccatgtga

SEQ ID NO: 63153 - DNA, 228 bp, Glycine max
  Peptide Sequence Number=SeqID_179931
atggagaactatttataccaatgcagtattgttgaagccttggaggctcgtgaatcaaaaacggctgtgaaccttaacaaccgagaatcatactggctgtactgtacaaccgagttttttttaagggtgccagggatggaaatggcatggaccagggttttatacggactgggtcattggcctctaatgaacgacctgacttacttcttccaccatcaatggctttga

SEQ ID NO: 63154 - DNA, 207 bp, Glycine max
  Peptide Sequence Number=SeqID_179932
atggacgaggtcgaagcggccatcatagcaccagatctagcatgtgaagaccaagagcacagtaaagaggaggaagaagagtttgcctttggatctcgatggtgggtttcatggaagagttggtcggatgagaagaatttgcaggcagcgggaggtggtggaagggagagcaatgagagagaagggagcgttgggacaaatctgtaa

SEQ ID NO: 63155 - DNA, 147 bp, Glycine max
  Peptide Sequence Number=SeqID_179933
atggagttgcattccttgctgaaagggtctgaaaatggtctgccaagtgtcaaaggtgaatggattgaactaatgagctactttggcatatggaaattcaagatgtatattgaccagcagcttactttagggaagttaagattgtaa

SEQ ID NO: 63156 - DNA, 1036 bp, Glycine max
  Peptide Sequence Number=SeqID_179934
tgttattgttggcttcactaccaaggtcctacaaacctttggtttagacactgcttgtaaggaggacaacgttgaaggaggaatcattcatggagacaacaagatgggcaaagaggaatatcaaagtcacaatgatgtccaaaacgagataggaacaaatgatgacaagtctgaggcaaatgtggtccaaaactttgaagatgaagacttgtatttggcaactactaatgaggttgctaaatcaaaatggataatggattcccctgcttcgaagcacatttgtagagatcgagcgatgttcgatactttgaaaactaatggggagtttggtcatttcaacttaggaaatggtgagaaaatgaaggttgaagtcattgagactgtgagaatgaaactccacaacaacatcattcaaacttttcaaaatgtcagatttgtaccttctgctactactaatgtcatttcattgggagagatgacatcacctgggtataggtatgttggtttaaattggggatgcaaggatagtccatattctcaagaggataaacctttgtcttcatatttatcttacattatcccttcagtcagctttgatggatcgaagacaaacaagaatcaacatgaacttaaaccaattcaatcaacttctgctggatataattatgagaattttgagtatcaggatgttccatcggataattatgttgactgtactaacatggatttgttgaaagatgataatgataatattaatgaagatcctatctctagaaggaccagtagcagtagcagttctgaggtttttgaagaagcaaatgaacagcaaactccaaatacttcaaagaagtctcgactcaatcttactgatgactctacgtttatatctcctgaattgtatgaatttttggaaatatgcctccctaatatagtgaaaggacgccaatgggtcttactttatagtacgttaaaacatggagtatcacttcgtacacttattcgcaagagtgctgagctttcttgtcctggtttgctg

SEQ ID NO: 63157 - DNA, 420 bp, Glycine max
  Peptide Sequence Number=SeqID_179935
atgactgactggccatatcacctctgcatgtcctcttctagtataagtagtgtagaagtcagagaaaactcaagaaataagaaaaaggaaaagagattttttctggccaacttttctgtagaaaaaaggcattttcccatgagcatgtcaatttgttttaatccttttgaccttatagggattgacagtttacacatagtgggagaaggtgtcaaccgatactactacatgtgtttgaatggcctacttgcacttggtggtgggggtaattatgctttatgcttagaagaagatttgttaactggaactagtggaccttctgacacatttggaaacaaatgtctagctcacagtccagagtttgagttgaagaatgttgagttgtggggttttgcacatccttccccttttcaaggctaa

SEQ ID NO: 63158 - DNA, 256 bp, Glycine max
  Peptide Sequence Number=SeqID_179936
atgaatggaattgttaacgcgatcgaaaagggggaaattgaacgtactactcgggattcatatcgaggaagcggtgaattcgccggaaaagggagagttatcgccggagaaatgagaggatccggtgctgcacgaatggcaccaacggaagggaaaaggaaaaggcaatacggtgacgtattaaagtggcttctgattttgttgcgcttctccattcacacatggcaacctttgacgctgcctgctatgtgtgtgg

SEQ ID NO: 63159 - DNA, 612 bp, Glycine max
  Peptide Sequence Number=SeqID_179937
atgtcccttaagcatgtgatcagagatacgatcttcatatccaagtgcatagaagatcatcatctgttgggaaagggagctagtggcaaatcatgtgactatctgttcaagctccttctgattggagactctggtgttggtaaatcatgccttcttctaagatttgctgatgattcatacattgagagctacataagcaccatcggagttgattttaaaattcgcactgttgagcaggatgggaagacaattaaactacagatttgggatactgctggacaagaacgatttaggacaataactagtagctactatcgtggagcacatggaatcattattgtttatgacgtgacagatgaagatagcttcaataatgtgaagcaatggctcagtgaaattgaccgctatgccagtgataatgttaacaaacttttggttggaaacaagagtgatctgacagcaaatagagttgtctcatatgacacagctaaggaattcgcagatcaaattggcatacctttcatggaaacaagtgcaaaagatgctacaaatgtggaagatgctttcatggccatgtctgctgccatcaagaatagagaattggcgttttaa

SEQ ID NO: 63160 - DNA, 141 bp, Glycine max
  Peptide Sequence Number=SeqID_179938
atggcataccacagccccctcaacctctccccctacatggctatttatagaaaaagccattttgtacaggggaagctcactcaggcgagtagcttgcttaaggctgaagctttttcgtggcccaggcgagctagatgctag

SEQ ID NO: 63161 - DNA, 177 bp, Glycine max
  Peptide Sequence Number=SeqID_179939
atgggatcatctaggccaattcccaaaccacaggttggattacgtgacactggtccactatttagtgaaatagcatatgccccttacatgcaaaaggtaagtgtagaccaagcagcaccacctggttgccctctgatctgcactgttggaggccttgcattgtttgctgaaggctga

SEQ ID NO: 63162 - DNA, 351 bp, Glycine max
  Peptide Sequence Number=SeqID_179940
atgaagaaaagaaatgaaagaaacttcagcaagaaaattaaggtattccttgcttataaacaaccacttgttattgcatactttcaagttcaactaatgatgcaaccaaatatgcagtatgcctgccgcaaaactctggcagatagccgacctcgagttagaggaaggtttgcaaagaatgatgactttggagaaaccaatagaactactagtagcaatcatgaagaagatgatgaagaagaagtagttatgaaagatgaagatgatatggttgattcctcagatatctttgctcatatcagtgggctgaactccttcaaatgcaactattccatccagtcctggatttga

SEQ ID NO: 63163 - DNA, 660 bp, Glycine max
  Peptide Sequence Number=SeqID_179941
atggagatcaacatgaaagatctatcattggttgaaaaagaagaggatggtttagcttatgatgtagagaaggaccctgatgtttcttccaatgtggaactttgtcttatgggtcattttcttgctgataaggtgataagggtgggccccatgaaggaaagaataataaatatatggtggccagggaagggagctttaattagagagatcccaagggtttatttgtgttccagttctatgacaaaggttctcaatagtagcctgtggagttttgataatcatcttcttataccaaaaagcataaaaccaggcaatgtcattgaccaaattccattattttatgtgaatttcatggtgcgagtccacagtcttctagtggatcaattctttgtaaagctgtttgatctggaaaacaatgttggacataaagaatggggccttgatttcagggtgaaggttaagaagggtgaaggaggttcacaatggctctgggaggagggtaaagattggaattcaattgaaatcaatcataccagattctcaagaacaatgaacatagttactaaagatcttaattcagaaagatttctagtcgtggttcctaggcctgccaggagtaatgagtatcatcaattggaaattggaatggtcaaggcctag

SEQ ID NO: 63164 - DNA, 540 bp, Glycine max
  Peptide Sequence Number=SeqID_179942
atggctttgaagctagatatttgcaaggcctatcatcgtatagaccaggggaaaattttagggcttacctttgatgattgggtggagcagaaaggcaacattcaagtttgttacagagaaaatctggaagaaaaatcattccatgagtggggtgttaaaggaaaaggaattaaatggatgaaatgggagaaacttattagtaaaggaggggaggcatggacttttgaaatctacatggcttcaatctggccatgcttgggaaacaaggagttatatttcgcaaagcatttggagaactcgggtgttgatcaaggagggagtacaagaccctttcctattgaatgctttgtgttcacaagaaatggttacgaatgtaattcaaactcctctactggaggaagtcatggaggacgagtttggaaattcgattttaaaggtttgtacactgttaaatttgcctacaatctttatatggagcactttgtgaataacgagcagttcactatacaaggaaacttggaatcaatatggagtctaaag

SEQ ID NO: 63165 - DNA, 1032 bp, Glycine max
  Peptide Sequence Number=SeqID_179943
atggaaaatacaggcctatggattcagaaagagggccatggaagaaaagattcattgcgtggcttattgaatgatagggaaatatcagaggaagaagactcttcaaaatcacagttaaagaagttgatcaaaagatcaaactctcatcgggcaatagttgtaaatgctatccaatcacaaatcagcaaagttttcttaaaggatttattcgttcaacgtgtccatggactagacaataggattccgaagcatgtggtgagtgtggacgagaaatacatccaccgctgccttgaattcatacataacactgcattaaaagcagctcaattcaacatacctgagagcttaagagccactaacatggagactttatcagaaagcttgaatacagctaaattttttggtggaaatgcatgtggttcgggacattttgtctttgaatgtcctgtggtcaccgagactgggagagtagttataagtgctaatgcaggggaccagtggactttaggtacaataatggggagcaagagtatgataaatatattgaatagtactcttcttcagcagtttggtgcttcacatagaactgacaatttgaataggatgaacttttctgatcctgaaggattggtatgctatgattttatggactctcctagtgatttatgtatctcttcttcatataaactagaaaaggaaaaacagttagtgcgaagtcataagtatggccccatttctgttcacaaaaggcttgtttcaacttctagcaccacctctacttgttctgattggttgtcttcaacatcttctaatctatctcagggaatgatccaatgtacatggaagcaagggattcctcattttgttttttccgcagatgatcagaaggaggtctatgtcacaaaattgaggaaggtagactcaacagataataaggctttggactatgtgtatgagtttcacttgaacaagggtggccaaaagggtcgtgaaattcctgatggtgatttgccatttgttgggaagatgcat

SEQ ID NO: 63166 - DNA, 309 bp, Glycine max
  Peptide Sequence Number=SeqID_179944
atggtggttgcaaagtctcagcaaggtacaaaagataaagatactcaggcaggcaattttagcttggagcagatcagagatgctactaatgacttctcttctgctaataagattggggaaggcggtgttggtcccgtatacaagggccaattgctagatggtacttttataacagtcaagcaactgtcatcaaaatcaaggcagggaaatcgtgaatttataaatgaaataggcttgatatcttgtgtgcaacaccctaaccttgtaaagcttcatggatactgtgctgaaggggaacaactcttgctg

SEQ ID NO: 63167 - DNA, 279 bp, Glycine max
  Peptide Sequence Number=SeqID_179945
atggctgtgactgtgactctgacagtggcttctttagagggcagaaaggttgaagatcatagcaatagagaagatgagagtgattccaattctttgttgccagtgcgaaaaggaggaattgcacggaaatcagataagacttataggaaaaggaaagtgcagtggaacgataggataggaaacaagcttgttgaggttttggaatacgagccaagtgatgttagtgactcagaggatgaggatgacggcggcgatccttgtatctgttcaattatgtag

SEQ ID NO: 63168 - DNA, 860 bp, Glycine max
  Peptide Sequence Number=SeqID_179946
cagcattttccctccctactcacaaccaggcattgaacaaacaactcattgttgatttctcaactcacgaggggaacatccctcatatcatcacattcacagcaatccgacccattaaaaaagcttctcaatttccaaagctcccggtcgagaatatcgtccacgaagggccttatcagaatcgcgttctcgggttggttcgcgaacgaattcgggttatcgtcgacgataacgacccgtttgaggtcgcgacccgtttcgttaaggtccttcacgagcttcccgtcaatgtttcggcacgagtcgcggtagagccggtgcgagatgaaccggttccggtcgagccggtccaggaccatggaggcgtactccttaagcgccgcggtgaaaacgacaacctcgtacttggcggcgagggactcgaggaactcgtcgacgccggggcgcttcaggacgtagaaatccatgggctcgccgtcgatgaccggccggacgacgaagtcgaagcgctccggcggcggcgaggggtgcgagtggacgagcgtttcgtcgaggtcgaggaacaccgtttttcggacggagaacaacggagggaggagcggggtggtggtggtggcggtggtgtcgtcgaacacgagggttcggcgaatgttgtcgagttctccgtcggttgttgtagtctttttgaggattttgtaggaggttgcttttttcttgtgggcgctggtgctgaggcgcgcgatcttcgagaagagtttcgtgatacggcggcggatggtggccagcgcggcggaggaagccgccaccacattttttatgggggttttccgtcgccagcgacggttgttgttgttgcggag

SEQ ID NO: 63169 - DNA, 234 bp, Glycine max
  Peptide Sequence Number=SeqID_179947
atggctgtagaaatggagagggagtccttgataactgaagctcctaatgcaccggttactgcacagagaagggtcagaagtgacttggaaaattctctaccaaaaccatatcacaatggaatcatttacccttgggaaacttacatggggctgcgtgctattggatttaatgtcgttgcatctgttattttagctgttgttatcaatgctggattgagttatcccactcagcct

SEQ ID NO: 63170 - DNA, 424 bp, Glycine max
  Peptide Sequence Number=SeqID_179948
ttcatgatgtttgggatgttgaattgcttggatgttgtggaagcttggagagattgctggggacccggtgttgagaggaacgaggataagggctacgtgggagtacgtgagctcagtgaaggtgggcaactggggatggtgggtgtatgtgtgatctgtggatgtggagagttgacttccaccatcgcccgaccgccacctagtaccacattggtacctggagatatgtcgcgggggtcaggagaccttggggatgtcaggcgagctcctggcagtcaaccgataaaagaacaaagaccacaaagcaaggagacttgtgtggtggctggccagctgcttagaaatgggactggaatgttaaaggggcctctggtaatcgattaccagtgctgtgtaattgattacacagaggaacaggccactg

SEQ ID NO: 63171 - DNA, 399 bp, Glycine max
  Peptide Sequence Number=SeqID_179949
atggttattgtggaggggatatacaacatggaaggagagctttgtaaacgtctagaggtcatagctgttgctattgtgacagtggcatttcctgcaaccccactgctactggctagagcacgtatatgcatatttgcagctcattcaagggaggaccttatcaaagccttgcagattttgcccagagaagcagatccttataattgttctcagattcaagtgaacgtctcttggagggaagtctattcttattttgccccgtcattagataatatatatttaataaaagttcaagtgtatgatggaaccggtaaagcttgctttaaactggttgatgctaatgttgaagagttgttgcaaataccatgccatgaccttatattgcttattaagagataa

SEQ ID NO: 63172 - DNA, 315 bp, Glycine max
  Peptide Sequence Number=SeqID_179950
atgttaagacataataaagggatttttaatttagggttctgctccgctttaatgattagcacagggtgctgcatcttaagtgcacttgtacaatgcattgctggacaaaaagaagttctgaatactccagaagttgtgcatgtatatattagtgtaaagagaggtggtccaaatgtaacatccaattcagttttggctgttgtacttgggaaagccaaggagcttgatgtctctaaagatattgttgaccgcaatatcaagagagctaatgagaaaggacaagaggcttatatcgagaaagcctacgaggtatag

SEQ ID NO: 63173 - DNA, 456 bp, Glycine max
  Peptide Sequence Number=SeqID_179951
atgtttcttgttttcaacgacatttaccggtcacgtcaaaggaaaaaacgacatttaccgggggaagagctttaccaacttcaaaacttggagcttattcatttcatccatggcgttctgtctcttcatccccaaccaacccttcactctggtgccaacccttcttctccttgttctcctccacgcctctctctgcgaacccctctcacgggttctcctgatatggcgctagaatttccaaggatggttcaactcggcacctatttgagtcgaggaacactaagcaccaccccaacaactgtggagagttggtggcgcagtctcagtgctcacagaactcaaagtgcagctggtgcaccagtgaggaccttgatgacatgtgtttcagctttgccacaacaggtgcaccagctgaggcgtggaggttgccacaacaggtttactcttgcagcttga

SEQ ID NO: 63174 - DNA, 1464 bp, Glycine max
  Peptide Sequence Number=SeqID_179952
atggattcggatcaaggcaagcttttcatcggtgggatttcatgggatacgacggaggacaagctcaaggagcatttcggtaactacggcgacgttttgagcacttccgtcatgcgggagaagaacactgggaagccaaggggctttggtttcgtcgtttttgcggatcctaacattctagatagggttttggaagacaaacatgtcatagacggcagaacgggtcttaactgttctcgcggtttgttcatggaggttgatgccaaaaaggccttctcaagagaggatcaacaaatttctgtcacttccagaggtggaaattccaattctggcatgaattctgaaaatggaggaaacatcaggactaaaaagatatttgttggagggttgcctcccaccctgactgaagaaaaatttcgtctgtactttgagtcttatggacatgtaactgatgtagtagtcatgtatgaccagaatactgggcgtccacggggatttgggtttatttcatttgatactgaggaggcagttgatagggttttgcacaaatcatttcatgatttaaatggtaaacaagttgaggtaaagcgtgcacttcccaaggatgccaatcctggtgcaagtggccgtatgatgggtggtgctggaggtggtggtgctggaattggtgggtatcaaggttatggggcatctggtggcagccaaaatgcatatgatggtcgtatggattctagtaggtatatgcagcctcaaagcgctgcaggtggattccctccttacggttcttctgcctatagtgctcctgggtatggttatggtccggctaataatggcattggttatggtgcatatggaagttatggtagtgccactgctgggtatggtggacctgctggtgcaacatatgggaatcctaatgtccctaatgctgcttatgctggtggtccacctggtggcccaagaagttcatggcctgctcaggctccttctggttatggatctatgggttatgggaacactgctgcttggggtgctcctagtggtggtgctggatctggtggtggcggtcctggttcagcaactgcaggtcagtcccctggtggagctgctggatatgggaatcaaggttatggatatggtgggtatgctggatatggtggaagtgatagttcttatgggaattcaagtgcatatggtactgttggtggacgtactgggagtggtccaaacagtaatgctagtgctcctggtgggactgaactaacaagtagtggtggcagtggcaactatatgggtggtggctatggggatgcaaatggaaattcaggttatggaaatgcagcttggagatctgaacaaactcatgcatctggaaattatgggactcctcagggaaatggtgggcaagttggttatggtggtggctatggtggtgctcagtctcgacaagcccaacagcagtaa

SEQ ID NO: 63175 - DNA, 2450 bp, Glycine max
  Peptide Sequence Number=SeqID_179953
caaggatgagagttgcagtggttggtagtgggattagtgggttggcttcagcttatcttttggccaaagggggagtgaatgtggtgctctatgagaaggaggattcgttgggaggacatgccaagactgtgaatgttgatggggttgatgttgaccttggcttcatggtcttcaatcgggtcacctatcctaacatgttggatttttttgagaatcttggagttgacatggaatcatcagacatgtctttttctgttagtttagacaaaggtcgtggatgcgaatggggaagcagaaatggtttgtcaagcttgtttgcacagaagaagaatgtactgaatccttacttctggcaaatgataagggaaattgtcaagttcaaagatgatgttattaggcaaatcagctttaatttctctggcctgaatattgaatttgaactcaacagcaaaaagttcaaagttgtgatgaacactaattacaactatcttgatatgcttgagaataacccagatattgaccgcaacgagcctctaggggaattcatcaagtcaaggggagttatgagtttctctgctttctcagttctttcattctgtcgcaaccaccatctacttcagctctttggcagaccacagtggctaactgtaagatggcgctcacaaacttatgttaataaggtcaaacaagagcttgagagggaaggtagtcaaataataactaatcgtgaggttcacttggtttcgacgacatctgaaaaaggatgtgttgtgtactgcaatgatggttctcaagaaatgtatgatggatgcataatggcagtgcatgcacctgatgccttgcgattattaggagatgaagcaacatatgatgagcgaagaatactcggagcttttcaatatgcttacagtgatatttttcttcatcgtgacaaaaatttaatgccccaaaacccagcagcatggagtgcatggaattttcttggtagtaacaacaacaaagtttgtctaacatactggatcaatattcttcagaatattaaagagacaagtcaaccctttcttgtaactctcaatccagaccatataccagaaaataccttgctaaagtggtcaactggccatccagtcccatcagttgctgcattcaaagcttcattagagcttgaccatattcaagggaaaagaaaaatctggttttcaggagcataccaaggttatggatttcatgaagatggatttaaggctggcatgatcgcagctcatggcattctaggaagctgctgtgcccttcagaccaacccaaaacacatgggaggaacaatgttcacctttgagggaactgggaaaaactgtggtctgaagagtgttttgagggtccacgatccacaattttattggaaggtgatgacacaggcagatttaggccttgcagatgcatatatcaatggggacttttcatttgttgataaagatgaaggtctcttgaatcttattttgattctcatagccaacagagattcaaatgcatccaactcaaaactgaagaagaataggggttggtggacacccgttttctttacgtctgctttgacatctgcaaagttcttcatggatcatgtttcaaggcgaaatactctcacgcaggctcgcaggaacatctctaggcattatgatctgaataaagatgaagacttgaaagatgcacaaaagagaaaaatctctctcctgattgaaaaagctagaatagataagacacatgaaattcttgagattggatgtggatggggaagtttagccattgaagttgtcaaacaaaccggctgcaaatacactggtatcactttgtctgaggagcaactgaaacttgcagaacaaagagttaaagatgctgggcttcaggaccgcatcaattttgttctatgcgactatcgccaattgcccaagacatataaatacgataggattatatcttgtgaaatgatagaagctgttggtcatgaatacatggaagagttctttggctgttgtgaatcagtattggcggataatggacttcttgttctccagttcatatcaatcccggatgagcgttatgatgaatataggcgcagttctgattttataaaggaatatatatttccaggaggttgcctaccctctctaagtaggataacatctgccatggcagccacatccagactatgcgtggagcacgttgaaaacataggtattcattactaccaaacactcagatgctggagaaaaaacttcttgaaaaggcagaatgaaattttggctctcggattcaatgaaaaatttatcaggacatgggaatactattttgattactgtggtgcaggttttaagtcactcacactagggaattatcaggtggttttctcacgccctggtaacgttcctgcattaggcgatccatacaaaagctag

SEQ ID NO: 63176 - DNA, 213 bp, Glycine max
  Peptide Sequence Number=SeqID_179954
atggctggaaatggaggagaccacaaggcagaatttgtgtctagaactaaagaggctggtgaagattcatacaatagtcaaaataaaaacaaaccagctatgaccacaacaaacaatgccaagaacaacctggaaatgtcaaaccaaatggagagagagaaagagaacatgtcagatttgagcattatacatcacaaaacacattccaactga

SEQ ID NO: 63177 - DNA, 945 bp, Glycine max
  Peptide Sequence Number=SeqID_179955
atggctgcttgcaatggaattacagagattgttgaagttataattcatttccatcctcattcgattgagcatgttagtgacgacgagcagaacatattatacatggctgtcaaacaccgccagaagaaaatttaccaaatcttaaagaaattgaaaatggtaagaagtcttgctggaaaaattgacaaggaaagtaacactgtccttcactacactgcagaatttcaagggggttcccaaccgggttttgctctgcaactgcaagaggagttgcattggttcgatcggatagaaaagagactcccttatcattacaccattcacaagaaccaatacaacaaaacagcaaagcaactttttgtggaaaagcatgaagcactgctcaacgatgctcgtgaatggataaaagaaactgctcaatcatgctctgcagtagctgttcttgttgccactgttgtctttgccgcggcatacactgtccctggaggcacagatgacaatggattccctagatttcttcatgaaactatattcatggtgttcacaattatggatattgtggctcttgtaagttcactcggttcggtgattatgttcctttcaatcctcacatcaccttgtgagatgtgggattttcggaagtctctcccgaggaaactgaacacaggttttgccttgctgttcttctccatggccacaacaatgctatcattcagtgcaacaattctgatcaacatcaagttagagaagaacaaatggacttcaagtttgacatatgctgcagcattctttcctgtctgtatatttgcattggtgcagttccctctatatgttgccatgaaaggatgtgtgcggagcatgcttaggaaccttaagaagatcattcctcgtttcctcctcaacttgctcaaaaagagcaggagaaagaaattgtgggacatttga

SEQ ID NO: 63178 - DNA, 171 bp, Glycine max
  Peptide Sequence Number=SeqID_179956
atgctggatggtgtcgcgatacatgacatgatcatggggatgctgctgacatgcacagtgtgtttcgccactatcaaggcgaaacctcacatggcacgtgaatgctttttctgcatgaacaatgttgttgcaatgtggggttacactgatgggaatggcgatatcacgtga

SEQ ID NO: 63179 - DNA, 1761 bp, Glycine max
  Peptide Sequence Number=SeqID_179957
atggggatgatttttgccaatactgttggcggaacctatgctggatggtgcggggatacatggcatggccatggggatgctgctgatatgcacagtgtgtttcgccactatcattggcgaaacccacatggtgtgccaatggagggcaaaatcttggattctcggaatcaggcgcaagttgtggaaaatttatctgcaagggtttctagttgctcccttggcgacaagatatcctattccgattctcctctggatgatgaggtggttggtatgaggaagaattctgttactaaagagtattgtgattctttttccactgatagcactgaagggcattgtataaattcttctagattatatcctgaattacctgaaaaacaaatggaaaagaataacgaggacatggagtcttcagctaatcttcagaagcggggaaggtacttctattatgatactccactgcatgaagatactggagtttggataccagtttcagttccacctatgttggaagatgatcacaaagagtggaccaagggttttcactcgaatggtggctattttcctgatgatgatatgggatggaatcaatatgttggagatgaaagggaattgactatgtgggatgtgctagcagaaatgttacttgtggctcgaggaaaagtgacttctttggcattaggagatattcatacatgtaatttttcatggatatccagccatgtgcttgaacaagcttggagagaaatggcacaaactcttacagaggccaactttggtaatgtaaaggaactactggaagcagagcctccaaaatggttagcagatagtgctgctgcttcttgtatgctttgtggtgtgagatttcatcccatcatgtgctcccggcatcactgccgattttgtggaggaatattttgtggtgagtgttccaaggggcggagcttgttgccatcaaaattccaagtttctgacccccaaagagtatgcgatgtatgctgtgtccgacttgattcagtacagccttatttgatggatcatgtaagcaatgctgctcagttgccaacccatgacctgacagatctgagcactttgcgatcgtggattaattttccttgggggcagtccatggaatatgaaatttacaaggcaactaacactatcaaggcttataatcagataggttttctaaagctcgagaagtcaattccagatgccattctaagacaagcaaaaggccttgcaattatcactgtggtcaaagtaggagtgggggttacttacaatattggaacaggacttgtggttgcccgtagggaagacggttcatggtctcctccatctgctgtttccacctttggtgtagggtggggggctcaggctggaggcgagttgacagacttcatcattgttttgagaacaaatgatgctgtcaagacatttggtggcaatatgcatctttcacttggagcaggtttgagtgctgcagtaggctttgttggtaggtcagttaaagctgatgttcgagctggtgatggtggctatgctgcttgttatacctacaactgcagtaaaggtgcatttgttggatgttcacttgaaggaagtatggtgactactcgcacgcaagaaaattcccgtttctatggcagccagtctataactgcaacagatatactttttggctcgttgcctaggccacctgccgctgccattctctatcgtgcacttgctgatttgtattcgaagtttgatgattaa

SEQ ID NO: 63180 - DNA, 723 bp, Glycine max
  Peptide Sequence Number=SeqID_179958
atgatgtttttgtctttgcactcaaacctccattcccttactttgctacaacaagcgccggaaaatcacacaccaaaactccttaactctcactccttggacttcccataccgaacaccgcttatactcttccaacctcctccacgcgctccgccgcaacaacaatcctacctccgccctccaagtccgcgccaccgcagaccgcgtcctcgccgccactaccaaaggccgaactcgctggagccgcgccattcttgcaaattcattcggtcggtggaggaagcagaagcagaggcaccacaagaaggtcaagaactactccgccaacaaatgtatgaagaagaccacaccggagattcggagaaggttaccggcggtgcagaagaaagcgcacctcttgtttcccaagtggctcaactcagaaaagagaaccaacaaatactcacaagcatcaacatcaccatgcaacagtacctgagtgttgaggttgagaactcggtgcttagggctcaggtgggtgagcttagtcacaggttagagtctctgaatgagatcgttgacgtgttgaatgccactattgtggcgggttttggagcagcaacaacatcgagcaccttcgttgagccaattaataataataataataatagcttcttcaacccgttgaatatggggtatctgaaccaccctattatgacttctgcggatatattgcagtactga

SEQ ID NO: 63181 - DNA, 585 bp, Glycine max
  Peptide Sequence Number=SeqID_179959
atgaacgcccccatagaacaagatgcaggcaatcctacatataccccattgcttatggttgcttgcaatgcaattacagagattgttgaatcaataactagttttcatcctcattcaattgagcatgttagtgaagacgaacagaacatattgaacttggctgtcaaacatcgccagaaagaaaaggaatatagagaacagtctcccttgaacaatagacagggaagcaacaaaaccgcaaagcagctttttatggaaaagcatgaacctctgttcaaggatgctcgtcaatggataaaagagacttctcagtcatgctctgctgtagctgttcttgttgccactgttgtctttgccgcagcatacactatccctggaggcgcaaatgacaatggcttccctatatttcttgataaccctatattcatagtgttcacagtcatgtatgttgtggctctttgcaacattcttgctgtctgcatatttgcattggtggagttccctctatatgttgccgtcaaaggatgtgtgcggaccatccttaagacacttaagaagatcattcctcgtttcctcctcaactag

SEQ ID NO: 63182 - DNA, 1017 bp, Glycine max
  Peptide Sequence Number=SeqID_179960
atgagagagctgcagatagggagaaagaaattagagatgacaaggcactccgtagccttaattgagaaaatgaaaaagccatatatactggccaagagatacgaatgggaagaattcggcagatttttcaacaaacacaaggatctattggacaagcaaattgacttgcaccacagcactcctcttcactacgcagctcactgtgggaacccaacaatgtacagggaaatgatcgagtgggtgggagagggagacatcaagcgtgtgctgaggttgcaggacgacatggggaacactccgcttcacgaggtggcattcactggagaagtggaaatgaccaagagcattctggagcacgaggaggaagaaggcccaaatcagcagtatgagccattgctgcgaatgagaaacaaattgggagaaaccgccgtctatagagctgctgcacttggaaaaactgacttgctcagcttcttccttcaagacttgggagcagatgctcatcgtgatatacattttcaccgaaagggggataagatgtccattctgcacactgctgtcattgatcaattctttggcacagctttatggatattggaaagatatgaacacctcgcttatgaaaaggaagacaatgaactcacaactctgcaattgctagccaaaatgccctctacgtttaaaagtcaaacccaaatggggcctttgaaaaatttcatatacctcttgcttcctaactttcaagattacaaatactacaatcaaaataaggaatacacaaccaaaaaggaagatttggagagtggcagggaggacaaaaatgagccatctccaactcaaatgaagctcgaggataatacgagagaagggcaaattttgaaaagtggcgggaaggcaaggagaaatgaaccacctacaactcaaaggaaactatcagatgcggggaataggaaagttttaaatgcaaggaggaaatgggtgatttcaatggatgagagacctataagaaaaaattaa

SEQ ID NO: 63183 - DNA, 357 bp, Glycine max
  Peptide Sequence Number=SeqID_179961
atggcattgatgtgcactacttggcaggcttggtttagagaactaccaactggagtattggaccctctttcgtcagaagaagaatgtgctcagcttgtgaggcttcttcctccaacagaagctgctttgctagattgggcaataaacttaatggcagatgttgctcaaatggaaaacttgaacaacatgaatgcacgtaatattgcaatggtttttgcaccaaacatgactcaattgaaactggttgacgatgattcaacatatatggttatttgtggtaaacttgtttattgtactgttccatctaaaatttggcacaacattcaaagacggttaataacaattaacagtctttga

SEQ ID NO: 63184 - DNA, 183 bp, Glycine max
  Peptide Sequence Number=SeqID_179962
atggaggagactctttctctcagtctcatccatgccaacaagtctttggtctcagacccatctttcttcatttttctgcttatccctctatcagctctcaccaagcacttagtcgaagtcctctcaactggaggaacattcaaaaaatggataattgagcaaaggatatgcatgatcacatga

SEQ ID NO: 63185 - DNA, 316 bp, Glycine max
  Peptide Sequence Number=SeqID_179963
atggagcacgcgacacgtggcacagcgcggcgcacgaggcagcagcagggtagtgcctctaacgaaggcgcgtctggtagcgccctgccgctgggcgcgactggcgcctgggtcgtgcccgcgtcaggggcactacaagtcgcgtccgcgttaggggcactaccagtcgcgcccagcggcagggcgctaccagacgtgcccgcgtcaggggcgctaccctgctgctgcctcgtgcgccgcgctgtgccacgtgtcgcatgctccatggaagcgccttcctggggggcgctttgtaataaaaaaatagaccccccag

SEQ ID NO: 63186 - DNA, 2997 bp, Glycine max
  Peptide Sequence Number=SeqID_179964
atgggtcaccacacccgccgcgagtcctacccctccgccacctcctcccggttggactacaacctccacagccagcgccccctcgactacgccgctggctctcgtggcccttcgggaagctcaacggcctcgacgccgaccatgtcctcgcccggctttgggggccaccacgccctcacgttttattccaatcacgagaatggtggcgagggggggaagcagaaccaggtggtgacgaagccgacgagcagggtgaagaagatgttgggcttgaagatgttgaagaggagtccttccaggagattggccaccagtgccggctcatccaccccctcctctcctgtcggtgcacccggcagccctctgtcgcgcactgtgccgccgtttaggccgcggcggcccatgaccgccgcggagatcatgaggcagcagatgagggtgacggagcacgatgataataggttgaggaaaaccctcttgaggacccatgttggccaaatgggaaggcgagcagaaactattatcctccccttggaactgatacgccacctaaagccctcagaattcagtgattcccatgagtatcatatgtggcaaaagcggcaactcaaagtccttgaagcagggctcctcctctacccatcaatccctctagaacagactaacacatttgccatgcgcctcagggacatcgtaaatagtggtgagtccaaacctattgacaccggcaaaaacgcagacataatgaggaccctttgcaattctgtggtttccttgtcatggagaagccacaatggcattcccactgatgtttgccactgggctgatggattccctttcaacattcacctctacacctctcttcttcaatccatttttgatgtcagggatgaaacactagtgctagatgaggttgatgagctacttgagctgataaagaaaacatggtctacactgggaatcaccttgccaattcacaatgtgtgcttcacctgggtgctgtttaagcagtacgtgagcactggccagatagaacctgaccttctttgtgcctcacatgccatgttgaatgaggtggcaatcgatgctatgagagaaaaggaatctttgtattttaagatgctgtcgtcagtgctgaactcaatacagggttgggcagagaagagattgcttaattaccatgactatttccaaagagggaatgctggtcaaatcgaaaaccttcttcctgtggtgttgacagcctcaaagattttaggtgaagatctgacactcacaggtggagaaaggggagagaaaggaggcataaccgtagtggattcatcaagtgaccgaattgatagttatattcgttcttccatgaaaaatgcatttgataaggtattggaggcagcgaatgccaagtctgctgaatttgaaagaaagaaagaattgagtgaagttcttctccaactggctcaggagactgaagccttggtgatgaaggaaagacatcattttagtccaattctaaagaaatggcattcaatagcaggtgcagttgcagcaatggtgctgcatacatgctttggtaaaatgctgaagcagtacgtaagggaattgacttcactgacaaccgaatcagttcaggtgttgcagaaggctggaaagctagaaaaagtaattgtccaaatgatggttgaagactctagtgagtgtgaggatggtggcaaaacattaatcagagagatggttccctatgatgttgattcagtcatattgagtcttctgggaaaatggatagatgaatcattgcacaaaggcaaagagtgtttgcagagggcaaaagaaactgaaacatggaatccaaagtccaaatcagaattacatgcacaatcagctgcggagctaatgaaattggccgcgacaactgtggaagaattcttccaagttccaatagccattacagaagatttagttcaagatctggctgatggattggaaaacctcttccaggactacatgaagtttgttgcttcatgtggttcaaaacaaagttacattcccatgcttcccccacttaccagatgcaacagtgattcaagattcacgaagctgtggaagagagctgctccatgcaatgctggttttgatgctcatatacaacatattaatggaagacacgaaggtcataatcctcggccatcaactagccgtggaactcaacgcctctatgttcgtctcaacaccttgcactatcttgttactcaaattcattctcttgagaaaacactctctatgaactccggagttgttccttcaaaccgccttcggtttgcaagcaaccgcaagagttgttgttcatactttgaaacagtgaacttgtccattcttggagcctgccaacatgtctcagaagttgctgcataccgtcttacatttcacgactcaagctctgtgttgtatgacagcctctatgttggtggtgtgggtagaggtgagataagagctgcattgagaatcctcaagcagaatctcacactaatgactacaattctcacagatagagctcaaccattggcaatgaaggaagtgatgaaggcctcatacgatgcattccttatggttttgcttgctggtggaagctcgcgggtgtttcaccggtatgaccacgagatcatccgagaggacttcgagaatttgaagatagttttcagcaacagtgtggaagggttgatagcagagaatgtggtgaatggagaggctgcagtggtggagggagtgattgcattgatgggtcaaagtagtgaacaattgatggaagatttcagcattatgagctgtgagtcaagtgggataggtttgatgagtaatggatacaagctgccaatgcctcctactacaggaaagtggaacagatcagaccccaacacaatattgagggtgttgtgctatagaaaagaccgcgcagcaaatctgttcttgaagagaacattccagttagcaaagaggagataa

SEQ ID NO: 63187 - DNA, 1140 bp, Glycine max
  Peptide Sequence Number=SeqID_179965
atgcagttgtggaagctcttcatcactgcattaatgcccgtacttaagttgctcctgcttactgctgttggcgcatttcttgctctgcaccgctttaatatactgaggaagagtgctaggaagcacttgaatgtaatagtctactttgtcttcactccggctcttgctttcagcattctgactaagactataacatttaggagcctgattatggtgtggttcatgccattgaatgttcttctcacatatatcattggcgcggcactaggatggttgtttctgaaaataactaaagaaccttctgatatgcaaggtcttgtgttggggtgttgtgctgcagatttgatgcaaacaggaaatcagtctgtaaggaaagcgggtagtccttttggagctgtggatgtttgtaataaaaaagggatggcatatgcttctttgtccttggcaataggaaacatctacctttggacttttgcatacaacattatccgcatttattcaggcaagattttcaacgtgaacaaagttgatgattccacagtaggtccagtgtcagcaatagaaacagatctcgaaagccattcaactgtaccagtggttactgcagaggatatctcagaaaacaatgatcgcacgactcattttggaagtgaatttacattgcctggggaaaaagctagggcatcgttaagaacattagtagataaactcaatctgaaggtcatattatcacctgcaactattggatcgattcttggtctaatagttggtgtagttcctccattccaaaagatgtttgttggcgataatgctcctttaagcgtggttgaagactcagcatccatgctgggggactcatccattccagcaatgactttgttacttggagcaaatcttctgaatgggttaaaacggtcaggaatgaagttttcacttcttgtggggatcattgtgattagatacattgccttaccaattttaggcgtggtcattgtaaaaggtgcaatccattttggcattatccaccacgatccgttataccagtttgttttaatgcttcaatacgcccttccacctgcaacaagcataagatgtcttactgttaaagaacagcatgttatgggttacagattattctag

SEQ ID NO: 63188 - DNA, 498 bp, Glycine max
  Peptide Sequence Number=SeqID_179966
atgaaggttctaaactttattttggcattgaatcttcttcttgcagtggttcatgttcagccaaaccaagctggtagggttttgagcatgaaggaacaactgagccttatgtctctagatgataaaggtccggtgactccctcaggaccttctacatgcacatatatccccggaaccggtggcacaaactgcccccctgtgaaggaaatgaatatggcaggaaacgctcagcaccatagtcatgaaacttatcctcgtcttccaaacctagctggtagggttttgaacatgaaggaacaactgaaccttatgtctctagacaagggtcctgtgactccctcggggccttctacctgcacttatataccccgaaccggtggcagaaactgcccccctgtggaagaaatgaataatgtcgcaggaaacgctcagcaccacggtggtgaaacttatcctcgtcttgttgttccatttggtgttgcaaccaatcaacattga

SEQ ID NO: 63189 - DNA, 177 bp, Glycine max
  Peptide Sequence Number=SeqID_179967
atgacgacaaccaccacgacgcgagtagctcaacgagagtcattttggggggttagtagcttgaacaagactcgcgagtctacccaaactcgttcaagtctacgcaaaatcggacgagtctactccggttttgattctacttccgatttaactcgtcaaccctcagtagaatcgtaa

SEQ ID NO: 63190 - DNA, 219 bp, Glycine max
  Peptide Sequence Number=SeqID_179968
atggacgagtttcttacttcactctgtttcctattcctttgcatttttcttttcccttctttctcttcttccgccatactgtttcaggggttcaactgggcatcaagtgaaaaagcaggagaatggtacaactttatgaagaccttggtccctgacatagctgattctggagttgactatgtttggctccctcctccctctaactctcacgatcgatga

SEQ ID NO: 63191 - DNA, 477 bp, Glycine max
  Peptide Sequence Number=SeqID_179969
atggctgattcttcttcgaacttgaaatccgacgcgataatggagcagatgaagcagcacctcgccaccgactcaggcaaacaagtcaccaaaaaaattggactcgtttatcagattcaaattgctcctaagaaacttggaatcgacgaggtcgtctacaccgttgatctcaggaaaggagaggtcactaaagggccatatgaaggaggaaagcctgatgcatctttttcatttaaggacgaggactttgttaaggttgccttggggaagatgaatccacagattgctttcatgaggtttgacctttcaatggactttttccttcctaaattttttcttcttctttgtttatgcattcgtgtgcttgtatctgatgtagtggttaatggatgtagaggtgcgatgaagattaagggaagcttgagtgctgctcagaaatttactccagatatcttcccaaagccttccaagctgtga

SEQ ID NO: 63192 - DNA, 1563 bp, Glycine max
  Peptide Sequence Number=SeqID_179970
atggatggaattttcgcttacatcattctcattttggttaccatattttcatttatgttcttaccaaaaccaaacagaagaagacctcagaaccagacacttgcaaagctccctccaggctcaatggggtggccgtacataggagaaacccttcaactctactcccaagacccaaatgcctacttttccaccaaacacaaaaggttgtttaatgtttactatgctacttccactccactcatgtatggtgaaattttcaagaccaacatcttgggttgtccctgtgtgatgctgaccagccctgaggctgcacgcttcgtgctagtgactcaagctcacttgttcagaccaacatacccgaaaagcaaagagcgtttgattggtccctttgctctgtttttccaccaaggtgaataccacacacgtttgaggaaacttgttcagaggtcactgtctttagaagcacttcgcaacttggtgcctcatattgaaaccttagccttatctgccatgaactcttggggtggtgatggccaagtcattaacacatttaaggaaatgaaaaggtgtgatagtgatagcaattcagcaacagaacaccacacaggccacattgcagaagctactaacaggccaagaagattttcttttgaagttggaatcctcacagtttttggccatctagagccgcgtttgagggaggagctaaagaagaattaccggattgtggacaatggttacaattcctttccaacgtgcatcccaggaacacaataccaaaaggcactgttggctagaaggagacttggcaagattatatgtgacataatttgtgagaggaaggagaagaagttgcttgaaagggatctcttgagctgcttattgaattggaaaggtgaagggggagaagtgttatctgatgaccaaattgcagataacattattggggtgctttttgctgctcaggacaccacagctagtgccatgacatgggttgtaaagtacctgcatgatgaaccgaaacttctggagtctgtaaaggctgagcagaaggcaattcacaagtctaatgaaggtaacctaccactgagttgggatcagactagaaacatgcgaattactcacaaggttgtgttagagagtttgagaatggcaagcattatatcattccctttcagagaagcaatagctgatgtggaatacaagggattcctaataccaaaagggtggaaagcgatgcctctgtttagaaatattcaccacaatccagaattttttccagagcctcagaaattcaaccctttaaggtttgaggtcgcaccaaagcccaatactttcatgccatttggtagtggagtgcatgcctgccccggcaatgagcttgctaagctggagacactgattatgatccatcatttggtcaccaagtttaggtgggaagtggtaggatccaagtgtggaattcagtatggcccattccctttgccactgaatggactcccagctagatgttggagagaatcctaccagctagaaaaggcagcacgggaagaaaacgcatga

SEQ ID NO: 63193 - DNA, 150 bp, Glycine max
  Peptide Sequence Number=SeqID_179971
atgaggtgcagacgaacctggaatcaaagagcagaggtttgtcaaaaagggcacaatctgagtcctgagattttagagagagaaagaccaagtgagagaaacaaagaaaaggttgagcagcaacagggagcaaaggtcgtttcctgctga

SEQ ID NO: 63194 - DNA, 231 bp, Glycine max
  Peptide Sequence Number=SeqID_179972
atgctgctgctgcgggcgttcctggatgcgggcgtgccgtccggcgcgatcagcctgctgtatggccagccggcgcagatttccgagcgcctgatcgcctcgccgatcatccgcaaggtctccttcacgggctcggtgccggtgggtgcggctgctggccatgctggccgcgcgccatctcaagccgtgcacgatggtactgggcggccatgcgccggtgctcgtctgtga

SEQ ID NO: 63195 - DNA, 996 bp, Glycine max
  Peptide Sequence Number=SeqID_179973
atgccacccgtgataacagcagcggatgccatgctcggcgatgatgccgaattccagcgaggcgccacggtgcgcgcactggcggtgcatgacgccaacgtcgccgctcttgtcgcgaaacgccaccaggtcctcgcccatgatgcggatggccttgggcacgtccgtcagttcctgcgacaggcacaccggctgccaatggcggcgcatgtattcgcccatcggcgtgccgggattgctgctggtcagttccaggtccgggccgggccggttgcgttgctggtagccggagaaccgcaacggatgctcgttgcgggtcgggggcacggaactcgtggcttgtgtcatgtcttgtctcctgatgatgggaatggatcaaacacgcagattcgattggctgacgaagcggatctgctggtatgcgtccaggccttccggcccgccttcgtagcccagtccgctgtccttgacgccgccgaccggcgcgtccgccagcgagggcgtgaagttgttgatgccgatccaggcggcatcgatgccctcggcaaaggtggcggcgcgctgcaggtcgttggtgaacgcataggccgccaggccatactcgacggcattggcccgggcgatggcgtcgtcgagggtgccgaacggcaggatcggcgccaccgggcagaacggttcgtcgtgcaggatgcgggccgtggccggtacgtcggtcaacacggtcggcgggaagaagtagccctcgcccgccaggcgggtcccgcccagcctgacgttggcgccacgccgcagcgcgtcctcgaccaggccgaccgcggcggccaggcgccgcgcgttgttcagcggccccatccgcacgccggcggccaatccgtcgcccacgtcgagctggccggcgtagtccacgaagtgcgcgacgaaagcctcgtagagacggtcctgcacgaagaagcggatgggcagacaggcacaccgggccgctgttccggaacttga

SEQ ID NO: 63196 - DNA, 663 bp, Glycine max
  Peptide Sequence Number=SeqID_179974
atgactaaagcaccattttttgatataaagaaccctattattaatttaaccgaaaaggcaaacaattatatgatgtcgattggctttcgctttatgccaggacaaggggaattcttaataaaagatctccgagctcctgataccttagtgggtttaagaaagttaaaagatagcctaggcttatcgttaacaaaaggtagtcttaacagcaatccattacttaagttaaagggtatttctgactctgtttctaatagtatggagtcgctggcatctcgtgtcttggttgaagtaattacatttaatgaggggtattatggtcgattcttaatcctggtccaaatgggtattggttgtactgtatggtatggcttcgtacctggcgatggtatcaatatgccaattgaaggattaaataccctatttagtcctattgagaattatgatactatctttactaatcctgatgctcatgttataccgggctttaataaaatgactttaattgagggcgtaaataatccagcagcaccgctgtcacaggcatttgctcaagataggcccttcatggatatggatattgaaataccggattctaataaatctattattatcggtgttagcttaggactagcagtgccatcttatttacatttggattaa

SEQ ID NO: 63197 - DNA, 126 bp, Glycine max
  Peptide Sequence Number=SeqID_179975
atgttggtggcgacggtttacaggaggctaagtcttgaagtgcataaaggagcagtcgcgctcagcgaaccatttgggctcagcgtgcatccgacgctaagcgcaacttcagcgcgcttagcgtga

SEQ ID NO: 63198 - DNA, 539 bp, Glycine max
  Peptide Sequence Number=SeqID_179976
agactaacgtcgtcttctgcaccctttgtcaatcacggtctgagcccgttgacacgcagagactaacatcgtcttctacaccctttgtcaatcgtgacccagagcatgatagcatgcagagactaacttcgtcttctgcaccctttgtcaatcacggcggaaatacccgagtggttatccgtataaacattattttgctatccatcagaccagagcacgataccatgcagagactaacgtcgtcttctgcaccctttgtcaatcgcggcggaaatacccaagtggttattcgtataaacattcttttgctatccatcagacccagagcacgacagcatgcaaagactaacgtcgtcttctgcaccctttgtcaattacggtccgagcccgttgacacgaggagatttacatcatcttccgtgctttctatcacactgaccctgaagttaggaggcaagcggaaatacccgagtggttatccgtataaacattcttttgctatccatcagacccagagcacgatagcatgcagagactaa

SEQ ID NO: 63199 - DNA, 366 bp, Glycine max
  Peptide Sequence Number=SeqID_179977
aattgttcttccggacttattccggaagaacacttcttccggaaacttcttccggaaatcccaaacgttttccgaaagaacccttcttccggaaagtttccggaagaagggttcttccggaaaacgtttggtttcttccggaagaacacttcttccggaaagtttccggaacaggttcttccggaagccttgccgtcagccctcttcccaattttttccggcacctcctgctctcgtcttctaccctatggttccgctaacctaagtaatggcgtccaagcgaaagaagcagtagctgggctcgcggtggaagagaaggctcgtggaagaggaaagaaaagaaagaaaagcagaagcaagaagtga

SEQ ID NO: 63200 - DNA, 135 bp, Glycine max
  Peptide Sequence Number=SeqID_179978
atgtctcgtgtgtatgttggtaacttggattcaggagtcaccgagagagatgtcaaagacgaattccgtgttttcggagttattcggagatactatgtgcctggatcattagtgaaagtgcaaattcatttttag

SEQ ID NO: 63201 - DNA, 812 bp, Glycine max
  Peptide Sequence Number=SeqID_179979
ccggaaccaagcgcgacctggtgctcctcctagacagctccatctccgtcgcgaagcgccgcgccctcgaactctccggatggaagatccgactcatcacccggatccgaaacccgcgcgccgagaacggcacttacaacgaatataactacagcaagtttcggttatggcagctaacggattatgagagagtgatctttatcgatgccgacatcatcgtcctccgcaaccttgatattctcttccacttcccgcagatgtccgctacggggaatgaccagtccatcttcaactccggcatcatggtcctcgaaccctccaactgcaccttcgagattctcatgtcgcgtcgccacgacgtcgtctcctataacggtggcgatcaggggttcctgaacgagatcttcgtgtggtggcacaggcttccacggcgggtgaactacttaaagaacttctgggccaacacgacgatagaggcgggtaggaagaacgcaatgtttgcggcggagccgccgaagctctacgcgattcactacctagggctgaagccatggcattgttacaaggactacgactgcaactgggacgtgcaggatcagagggtgtacgcgagcgacgtcgcgcatcgacggtggtggaaggtgcacgatgccatggacgagaacttgcagaagctgtgtaggttgacgaggcaacgaaggatggagttgaactgggaaaggagaaaggctgggaagttagggttgccagatatgcattggaagatcaatgtcacggatcctagaagagctggctcaatgttgattggttaa

SEQ ID NO: 63202 - DNA, 1089 bp, Glycine max
  Peptide Sequence Number=SeqID_179980
atggccactgttaacagtgaaacatgcaatgaggaatggtggtatttggacactggttgttcaaaccatacgacaggacataaatattggttctgtgaaattgatgaaacagtgaaaagaagcatcaaatttggtgatggcaggtcagtaatggcaaaaggaattggcaaggttgccataagaatagtagatgggagcaaggtgactatcagtgatgtcctatatgttcctaacatggaaagcaatttgctaagcttgggacaattgctagagaaaggattcttaatgcatatggaaggtgaacacatggaagtagttgattctaatgggaaatgtgtcttgaaggttgttgtgtctaagaacagaacattcaaggtgggtgtgagcaccatcgagcagaaatgcttgactggtcaaagcaatgacagtgtgtggaagtggcatagaagacttggacatttgaacttcaacagcctaaacaagttgcagaagaagaacatggttgtgggactaccttcaattgaagtaccaaggcaaatgcttagaactgatggtgaaggagagtacacttcacttgaatttgagaatttctgcaaggaagaaggaataattcatgaggtaatggctccatacactcctcaacacaatggaactgctaagagaaggaatagaacaatgctaaatatggttagatgcatgttgagagagaagcatcttccacatgatttctgggcagaggcagtatccacaggtgctcacatcttgaatagatgtcctacaaagaggcttgacagtttgccactagaagaagcttggagtggactcaagcctagtgtgaaacacttcaaggtatttggctcactctgttacaggcatgtgcctgaacataataaaaaaaaaactggactcaagggctcaaaccatgatcttggtaggtcactaagacagatgtctccaccagtgaggtttcaagactatgatgtcttccctgatgctgctatcaatattaatggtgagctgatgaacttagtgctgttagcagaagcagaactagtttcacttgaagagacactagctagtccacattga

SEQ ID NO: 63203 - DNA, 207 bp, Glycine max
  Peptide Sequence Number=SeqID_179981
atgtcaccagacaatgcaaattcaaaactggtggtgacttgtgcaagttatgaattcgctctgctagctgtgagcctaaagttggtctcccccggaagccttttcgaggatgcagcgggtgacgacgttgaactccgccgacaccatcgcgcctctaactaccaattgggccctcaatctagatctctgcaaacaaggagaatgtga

SEQ ID NO: 63204 - DNA, 831 bp, Glycine max
  Peptide Sequence Number=SeqID_179982
atggatgttttgagtcttcaaaagttggtgaagacagcaccatctaaagcattgatcatcagaatcaacttggtctgtcttgccatctttctcgttgtttatgcgacccttcttctccgtccatcttcctctgtctatttcgagaatgcagcctcccttgtccggtgctccttgagcgagtgccatcacaagggagaaaaaagcacaacgatgaaagcagtgctggaggaaccacagctgaaatcaaggagggcaaagcagaacgcgactaagatagaggtgcctagcttctttggcgaaatggggaaaggaatgaagataggaatggtgaacatgcaagaagatgatgtgagtgaatggagcacctttggagaaacaagccaagtttattttgagagggtgtcacattttttcaattggacagatttatttcccgaatggatagatgaagaggaagagaccgatgttccatcgtgccccgagataccaatgccggaatttgcagcatatgaaggcatggacgtgatcgtggccaagttaccttgcaagtaccccgaagaaggatggggaagagacgttttaaggttacaagttcatctcattgtggcaaatttggcagtgaagaagggaaagagggattggaattggaagacaaaagtggttttgtggagtaagtgtaggccaatgctggagctgtttcggtgcaacgatttggttaagcaggaaaacgagtggtggtattatgaggttgatgtaaagaggttggagcagaaggtttctttgcctgttgggtcctgcaatttggctctgcctctgtgggaacaaggttag

SEQ ID NO: 63205 - DNA, 164 bp, Glycine max
  Peptide Sequence Number=SeqID_179983
ggactgcgttttcctctctctgttctcttgtttgctacgctgagcactggccttttccgcaaaagggtcgcacccggtttccctgtggaacagtgaagatggtgggtgcatttgttgttgttgtgtataataaagtaatggactttgctggtggagccttttga

SEQ ID NO: 63206 - DNA, 1107 bp, Glycine max
  Peptide Sequence Number=SeqID_179984
atgagctttgacaatgactcactctcttttctttttttcctcatttttttgattcctttatccccctctaaaggtttatttgacattcatacaaggaacattacaaagctttttcctctggctataacaaaaagaaaagactatacaccaagaatttcagatattgcatcaaatcttgttatccttcaaggcaacctcactgttatggaaactcatcatcaacaccaaaagaacacagaaaacgatgtgccaaagcaacagaatcaaattgaagaagcagtgaatagagaactagaccaaacatcttcgtcaccctcttccccttctcaagagttctccttcacaatctccctccaccactccacattcccatctgataattccaaagccccacctaattcatcatctcttgcacttgatttgtctcctgctgatgacattttcttccatggtcacttgctccctctacaactcctttcacaccttccttcgtcgcctcctcgctcttcaactaattccatggacagcttcaccctccccatcagagagttattagaagatgaaagccactccattaaggacagtagtggcagcagcaggagcagcacctcagacagcaataacagcagcaaaagagaccaagacaacaacaacaacaacataggaaaaaaggtacagggtaagtccaaatttgctttttcattatttggattaaccaaggggcacaaagggtaccaagataaggaagataaggtgaagcacaagaagaaggtgaggtttgatgtgatccatgcaataaaaaagtacttgagaatggtccagcctaggatgcttttcaaaggacaaagggagaaaattagaccccggggacagtgctattcttattcaggaaatgtaactccgaggaattataagcagggttggagaggacaatattcagcaccagcatcaatgacgacttctcctacaaacagtggtttattgattgcaaccacacctcttcctcctgctagtgacagtaccatggaagagttgcaagcagccattcaagctgcaattgctcactgcaaaaattcaattgcaaaagaagagaagctcaagtgctga

SEQ ID NO: 63207 - DNA, 378 bp, Glycine max
  Peptide Sequence Number=SeqID_179985
atgggttcctctcggtgtggggtttcaacagagaacaacggcggtttgtggtggctaatggtggctgtgggtgatggagaaagagcttggaatgttggaaatggttttggaagaaagaagggagaagaaatggcgtttttccaaagctacttgaactacaaggctcagaacgcacaagtgagcaatgctctcaggaatggaaatgttgcacacactacaaacatattctcaaagatcccaacgctgcataccaaatttcgagaagatccaatggttaacgaaggttgggaagcgtttttactgaggcaacttcatgtagcttccttgagaagcttcattaagaggcttcctcaagaagcttcctcgtggcttctttga

SEQ ID NO: 63208 - DNA, 2463 bp, Glycine max
  Peptide Sequence Number=SeqID_179986
atgttaaaagcagtggcatctgggcttgtgattacttctatcctcatatgtgtatctgcaaatgataatggatttcctagatgtaactgtgatgatgaggccagcttgtggactattgaaagcattctggagtgtcagagagttggtgatttcttgattgctgtggcctacttctctatccctattgagctgctttattttatcagttgctcaaacgtcccattcaaatgggtcctgattcagttcattgccttcattgtactatgtggattgacacatttgctgaatgggtggacctatggccctcacactttccaacttatggtggcacttactgtctccaaaatactcactgcattggtgtcatgtgccactgccataaccctcatcactctgatcccattgcttctcaaagtgaaggtcagagagttcatgctgaagaaaaagacgtgggatcttggacgtgaggttgatcatattatgagacaaaaggaggctgcaatgcatgtaagaatgcttactcaggagatacgtaagtcactcgatagacatacgattctgtataccactttggtggagctgtctaaaacacttggcttgcaaaattgtgctgtgtggatgcctaatgttgataagactgagatgaacctcactcatgaattgaatgggaggaattttaatttgactatacgcattactgatccagatgttgtgagaattaagggaagtgacggtgtaaatatactcagctccgactcagcacttgctgttgggagtagaggagtttctggagaggcaggaccggttgcagcaattcgaatgccaatgctacgggtttgtaatttcaaaggaggaacacctgagctaagacaggcttgttatgctatattggtcttaattcttccttctggagataatcaggagcctagatcgtggagcaatcaggagctggagataattaaggtggttgctgatcaggtcgcagtggctctatctcatgctgcaattcttgaagagtcccaacttatgagagagaagttggaggagcaaaatcgagctttgcaacaggcaaaaaggaatgctttgatggcaagccaggcaagaaatgcatttcagaaagtcatgagcgatggaatgaggaggccaatgcactcaattttgggactgctttcaatgatacaagacgataaattgaagagtgaacagaaacttattgtggacgcgatgctaaggaccagtaatgtcctatcaaacttgataaacgatgccatggataactcaactaaggatgaaggaagatttcctttggagataaggtcttttgggttacattccatgctgaaggaagcagcttgtctttccaagtgcatgtgtgtttataagggctttggttttatggttgaggttgagaagtgtttgcctgacaatgttatgggtgatgagaggagggtttttcaggtaattttgcatatggttgggaacctactggaacacaaccatgggggagggatccttgtatatcgagtttttgcagaaactggaagtcagggaaggagtgacaaagggtggacaacctggagaccaagctcttctagtggtgatgtaaatattagatttgagatagggatcaacagtagtgattctgaagttgggagctcaatttcttcaggatttgggggtagaaaatatagcagtgatagggttgggggcagattgagcttcagcatttgcaagagggtagtccagactttggtggaaggcggctattatgcagtccttcagtattccgctaaattttctttttgccagcctttagatgattcaccagggtggttgtttatccatatttttcatagcttgttttcattgttcattttctcttccttgaaatgttttaggcgtagctctgggaggttggagttgatgcaggggaacatatggttagtaccttgtaatcatggttttcctcaaagcatgactcttcttcttcggtttcaattacgaccgtccatttccatagccatctctgaccctggagaaggttcagagcgcactgattccaattcaatgctgagaaatctgcaagttcttttagtcgaaaatgatgatgtaaatagagcagtgacccaaagattgcttcagaaactaggttgtgttgtaactcctgttgcttcaggatttgaatgccttactgtcattggacctgcaggatgttctattcaagtcattcttttagatcttcacatgcctgatttagatggctttgaggttgccacgaggattcggaagtttagaagtggtaatcaacctatgattgttgccttgactgcaagtgcagaagaagatttgtgggaaagatgcatgcaagttggtattaatggagttatccgcaagccagttttgttgcatggaattgctagtgaactcagaagaatcctcatgcagggaaataatgtcctttga

SEQ ID NO: 63209 - DNA, 509 bp, Glycine max
  Peptide Sequence Number=SeqID_179987
gaatggaagcatcgccatatgtcgaatagatgcgatgacgctccgaagtctattatgcatttcttacgtgattgagaaatccttgaagagacataaacaatttgattttcctctcaacttgctgcacaagattaaagcccgtattgctttcgttgactttggatcaccttatatttctgccataatgttgcttcccaaggatgcttctggggggctaatttgtgattccttaggcaatcctagagccacgttccatcttaatctcagtctttgctatcgattgaagatgcgtattcatgtttcctgggagctcaaccttcatcatgtgatctttgagatggactcgcttgcggtggttcacattgttccccgtggttctttcatatcagccttgttaaagccattgttcaaggttatccgtgagagtttgtcattcattcttgtgtcctctttggtggatggtcgacaagtggtcgtgacagtggctggtttggttgttaatggcagag

SEQ ID NO: 63210 - DNA, 354 bp, Glycine max
  Peptide Sequence Number=SeqID_179988
atggggaagtgtgaaaatggacggttgtaccttaagcaatggccaattagaggagagagaaggtgctctaggtcgttaggcggtggtggtggcgttgtgatgagtcatcaagtcgacgagttcgtaaacaaagtttctccatcgtccaagaaggctccaagggacaatcaaaggattgttgaaagcgttaattaccaattgagagtttatttccaaccaaaggttatgccaacccctttggtgagccctttcaatggctctaatatagcaacgaataactcagcaaaaagagtgttccatggagttagccatattacccttcttgaagcagctagtcgtcagtgcaaaggctga

SEQ ID NO: 63211 - DNA, 450 bp, Glycine max
  Peptide Sequence Number=SeqID_179989
atggccgcgattcggaggcgggtgtggcagttatcttcaatcgcaggtttcggggcttcgagatcggaagtgtcgtcgtcattgtcgtcgtcccaaagagcaattttcgatccattttctgtttcggggaccagacacttttcccaagtggtgaaatccaaccgcaagcacttgttcctcgttgacaccttggcccttgttaggagactggaaggggaaggagtgccctcgaagcaagccgaggcgataaccgctgccataactgaggttttgaatgacagtctcgaaaatgtgtctcagtcgttggtatcaaaggcgcagatgcagaaaattgaaatgatgcaagaatccaacctgtctaagtttaaagcggaggtgcagagctcacagggcttgatactggtagtgaacatgttagggctgaatgaaagatttgcgtgttgcttataa

SEQ ID NO: 63212 - DNA, 192 bp, Glycine max
  Peptide Sequence Number=SeqID_179990
atggtcaagtatcgagtcaatgagtttcccatcgccagtcactttccaggcactgccaccggccaccgccagagttcaagtgacctctctggccgacaaacccaccatcaggagcacccacagacaatctaccaaatgtcatcgatggcgccaccatcagacaccaggcgtgccctcacgcgcatttcctag

SEQ ID NO: 63213 - DNA, 279 bp, Glycine max
  Peptide Sequence Number=SeqID_179991
atggctattgatatgtttttaaaagttgatggtgtgaccggcgagtctaaagactccaaccacaccggctggactgatattacttcatttacatggggtgcaagtcagccaggcaatatggctgtgggcggcggtggcggtgccggtaaggtcaactttgctgatctgagtgtcgatgctctaattgataaatcgacaaccgctattcttaagtattgctctagcggaaagcatctttctaaagttgagctttcaatctgtaaagctggtgggcaacag

SEQ ID NO: 63214 - DNA, 1503 bp, Glycine max
  Peptide Sequence Number=SeqID_179992
atgagcaactcgcctcagcaacaaaatgcgttgcagaccaccgagactttttccagcgatgaattcagcgcgctgctgaacaaagagttccggccgaagaccgatcaggccaaagaagcggtcgagaacgcggtgaaaaccctggcgcagcaggcgctggaaaacaccgtcaccgtttcttccgacgcctaccgcaccatccaggcgctgatcgcggaaatcgacgaaaagctgtcgcagcagatcaaccagatcattcaccacgacgacttccagaagctggaaggcgcctggcacggcctgcattatctggtcaacaactccgaaaccgacgagatgctgaagatccgcttcatgagcatttccaagcaggagctgggccgcacgctgaagcgttataaaggcgtgggctgggaccagagcccgatcttcaagaaagtctacgaagaagagtatggccagttcggcggcgaaccgttcggctgcctggtgggcgactactacttcgatcacagcccgcaggatgtggagctgctgggcgaaatggcgcgtatcagcgcggcggcacactgcccgttcatcaccggtacagcgccaaccgtcatgcagatggagtcatggcaggagctggcaaacccgcgcgatctgaccaaaatcttccagaacaccgaatatgccgcctggcgcagcctgcgtgaatcggaagatgcccgttatctcggcctggtcatgccgcgcttcctggcgcgcctgccgtatggcattcgcaccaatccggtggatagctttgattttgaagagcagaccgatggctcaaatcacaacggctacaactggagcaacgccgcctacgccatggcagccaacatcaaccgctcgttcaaagagtacggctggtgcaccgcgatccgcggcgtcgagtctggcggtgcggttgaaaacctgccgtgccacaccttcccgagtgatgacggcggcgtagacatgaaatgcccgacggagattgccatcagcgatcgtcgtgaagccgagctggcgaaaaacggcttcatgccactggtgcaccgcaaaaactccgactttgctgcctttattggtgcgcagtcgctgcaaaagcctgcggaataccatgatgccgatgcaaccgccaacgcacgtctggctgcacgcctgccgtatctgtttgcctgctgccgcttcgcgcactatctcaagtgcatcgtgcgcgacaagatcggttcattccgcgagcgtgatgaaatggagcgctggctgaacgattgggtgatgagctatgtcgacggtgacccggcgaactcgtcacaggaaaccaaatcgcgtaagccgctggctgccgccgaggtgagcgtggaagagcaggaagataacccgggctactacgccgcgaaattcttcctgcgtccgcactaccagctggaaggcctgacggtgtcactgcgtctggtatcgaaactgccttcactcaaatcgaatgagaattga

SEQ ID NO: 63215 - DNA, 216 bp, Glycine max
  Peptide Sequence Number=SeqID_179993
atgggcttggagtgtgtctcgccagaacaaatggcggtatgggcaagtcagcgtgtcgctgttgtgaatggcggcatcgtgcctagtcagcacctttctcgccattgcagatggcgaaacacgtatgtcgtcaattctgttggcggcagcaccatggaaacagaccccctccgtgaattgtctgaaaagggacccctttacgtaaatagtttgtaa

SEQ ID NO: 63216 - DNA, 384 bp, Glycine max
  Peptide Sequence Number=SeqID_179994
atgaagtctcagtcttcacatcgcactgtctcacattttggatatgtgttcaaaactccatcctcagtatatgctcctggaaggccaaggtttgttcttaaactatttgcaaagggggtctgttatggccatggatgccgtcagaagaactggcgagaagcttgttccgccatctgcaatggcgagataggagttgagctggcatggatgccgcaagttggaatggcgagatacgtccacgtaggaaacaccattgctgctggcgagaaccctgcaacccgtgagcaggtctcgcctatcctattggcgagacaggttctgctggcgagaacactgcatgaatgcagtgttgcaggaggtaggttccagtgttgcagggggtag

SEQ ID NO: 63217 - DNA, 216 bp, Glycine max
  Peptide Sequence Number=SeqID_179995
atggacagtcccaccattggctcctgcgagaccaaggctagggcacaaggctcctgcgagaccaaggtacatcagctagggcacatggctcttgcgagaccaagagcacttgcaatgacactcagcacttgcaaaaatttgacactgaagagagtatcaaatagtgtgaaagaggaagaaagtagcgtgaagagaggaagaaagagtttcgtttga

SEQ ID NO: 63218 - DNA, 354 bp, Glycine max
  Peptide Sequence Number=SeqID_179996
atgtcctttctcaattctcatcatatatctgttcaagtagcattatctttctatgttgtgtgtgtcagttttggagtttctcactactacttgttctttttgtttatacatactgttgcaatctacccttcggcggaagggcgatgcggggctcacgggtgcgtcttccaagggaggagaacgcacggagtcgccaccaacgtttattggaggaaagtgtcggaaaaactggaaaggtgtggtctacgaactttaatcgtgaaaggttcgggagttttttttacgcacgaggaagggtgtttccctcgctcctacgtattcctcaattgcgatgaggaaattagacctacgtag

SEQ ID NO: 63219 - DNA, 138 bp, Glycine max
  Peptide Sequence Number=SeqID_179997
atggagggacctagccatggtttgggcggtgtcaaggttgttggaggaaagggcgatggcaaactggaagagctagagaggggttggcttctctggggccatgagtgttatggtggagttggtttggcgcgaggttga

SEQ ID NO: 63220 - DNA, 1033 bp, Glycine max
  Peptide Sequence Number=SeqID_179998
caaaggaggcactaaccaatgcaaagttccagagagatatgttcgtccagatattgaccctccaattatatctaacaaagactctttgcctcagcttccattcattgacctaaataagttgttggctgaagaagtgaagggacctgaactggagaagctggaccttgcatgcaaagaatggggtttctttcagctgattaatcatgcaactagcatcgaattggtggaagatgtaaagaaaggtgcacaagaactcttcaatctttcaatggaagagaagaaaaagctttggcagaaacctggagatatggagggatttggtcaaatgattgacaagcctaaagaggagccatccgattgggtagatggcttctaccttttaactcttccatcctactcaaggaagccccacctatttcctaatttaccactacctttcagggaaaatttagaggtttattgtaaggatatgaggaaccttgccaacaacatgtatgttcttattggaaaagctcttggtacagaaccaaatgaaattaaagagtcattaggggaatcaggccaagcaatacggatcaattactatcctccatgtccccaaccagaaaatgtccttggcctaaatgctcacactgatgcatcttccctcaccatccttctccaaggcaatgaagtggaaggtctccaaataaagaaagatggaacttgggttcctgttaaacccatcccaaatgctttcatcgttagtctcggagatgttttggaggtagtgacaaatgggatatacaagagcagtgagcatcgagcagtggtaaactcacagaaagaaaggctatccatagctacatttagtggcccagaatggagtgcaagcataggtccaacaccatctgttgttactccagaaagactagcattgttcaaaacaattggggtagcagatttctataagggatacctttcacctcagcattgtgggaaatcatacataaataatgtcttgaggatccaaaaggagaacatcaaaggctag

SEQ ID NO: 63221 - DNA, 99 bp, Glycine max
  Peptide Sequence Number=SeqID_179999
atggcagctagcaaatcacaagttctgatactttatgctaatccagggcaactcttggcaataatgggtccctctggatactttagcagagtagcctaa

SEQ ID NO: 63222 - DNA, 294 bp, Glycine max
  Peptide Sequence Number=SeqID_180000
atgagcaagaggctcaaagaggattgggctagagctgctgaagaaggccctaaggttctcatgaaccttaggactcatcttctacttgaagtggcgtctccattcatctttctccttctccattccgctgccattaaaattcaagaagcaaaagactctattgatgaagaagatccatggcctacaagctccaagggagctacatcaaggcttatgacagaggctacttctactcagaggcaatgcgtgaatgttgtcatggactcttttgcaagctctcaaggaaacaagtga

SEQ ID NO: 63223 - DNA, 603 bp, Glycine max
  Peptide Sequence Number=SeqID_180001
atgtatgggagattctataagattaaatatgaaggtttacaccttctatgcttaacttgtggaaaattcgtcactataatgagggttgtccaaatagagggaaagatgacacttggaatggagcgaaggaaaatgcataacctaatacagaggaaggggaccctactcaacaatccattgctgaaagacctcggacagtttttaaaaagccaaggagaactaggaaacctgttgaaaaggaaaaagatgtcacagctaatgggcaccagtgtaacatggggagtaggtataattccctacaagaccatgaggaaacaactattgaggaaatcaatgaaggagaagaacgaattaatgatgaacaatgagaaaatcctgaggaaagtggttgtggaaggcataatggttattacattgggtaataatgagaagcaaaaaatgccaaaggagatagcccaactcgtgaacaataccaataaagaagagggaggaacgcctatggaaattactcatgagtttcctactgaggttcctatgcatgaagcccaatgtcttgatgagaactcaaaggttccccaacatgctcctagaccaccagtttag

SEQ ID NO: 63224 - DNA, 333 bp, Glycine max
  Peptide Sequence Number=SeqID_180002
atgagtgtggttataatcttgaatatgcccaggagaatgctagagcagattcgcattacaaagaatagattccccaatagtattccacttctagaaaaagcttgttgggaatccatcgggtccttcaatggtgattttcagtcatggagttacagtggaagacaaaggagaagaggagagaggaggcgtcatccactagggaataagccatggaaggagaagcttcaccaccaagagagtgccttggataagaagcttagagaggaaggttcaatggaggaagagaatgagagagagagagagagagagagagaaagtggcatggaaaattga

SEQ ID NO: 63225 - DNA, 288 bp, Glycine max
  Peptide Sequence Number=SeqID_180003
atgaatgcaaagagaagagaaaatatggttggtgtgcttccaaagagaaaaatattaatgcggtatggggagtcgcaggggaattgggacacgacagcatacaccatcatacccgactgcgacattcaatcaacggtgcaaggcatggcccagttcctccgcgctggtgagcacctccaccgcgtgataggcagtgatggctgcttccctgactggcgggtgcagttctacatgtcccctacacctgcacccgatcgacgttctgtgagctcagacggtgtttcttaa

SEQ ID NO: 63226 - DNA, 1281 bp, Glycine max
  Peptide Sequence Number=SeqID_180004
atgacccaattacttgttttccttgtattggtggtgttggttgctactttctcttcttttgtctctgcatatcatttgctttcaaaacctcttcttagagatgatggaagaatctacgtttgttctcatgacaacttttttgcatttgaaagcaatggtaccattgcatggatcatgcatttagactacaaatgcaaccttggtactgccccagttcatggaggtcatggcaagatatacttggtagctgataacagaatattggtgattagttatggaaacattggaacttctgagcctgaagcagaagttttcttcggtccgggaccaggtcatgtggcagaggctgaaattattgggctctcagtgagcacattaggctcaactatttatatcaatgtcaagaacagaggactctttgcatatcagtcacgtggacatttgctttggagtgtggaacctgtgctttaccaattcggctaccgtcaaggatgcaggaaaaatcttacaaattgttactttgcttcagttcctttgcttgatcattgtgagggtagtatatatatctcaaacacagagggtgaactctattgtttgtcagttcgtagccgttactttagatggattcaagattttagttcattagacaaaaatttcaccatcactctaggaaacaatggtcatctgtatgtaacagttccagccaaggctcttgttctggctctagatgtcttttcaggtaatgtgttgtggcagagaagtattgggccattaagcaaagttgactctgcacctgtagtggactctaatggatggatatctattggttcgttggatgggttcttatactcgttttctccaactggggttcttaagaaattctcaagaatgaatgcagaaaactctataattcaagttggtccttttcttgattgctctggatttgcaatctacagttcacaaatagagatggaaggaaaaattagccacacaattggtgaatacactgtagtttcagcaattcaaccaaaagctgcattgttcactatgttggttcctgcaactggatcaatatattggtctgaaagctatcctggtcatgtttctactttattttctaagagtgatctaagtcaatttgtcatgaatgaggagattcttcttgctttccttgctgcttcaaggttgctcctattaaatcaaaagatgagaagttggacacttagcagtggcctttcgaagaatgttgatcattcatttaaggaagtgcaagttggatag

SEQ ID NO: 63227 - DNA, 348 bp, Glycine max
  Peptide Sequence Number=SeqID_180005
atggagaataggaatgacacttttcctccaacccttcgatttgattgtggaaattttgttgacgttgtcggtgacttcactattgcgtttcaaatgagtatgccaccattcaaggttcaaggtaattctaccaacgtagtttctaacattactcttccatcatctgctcctaatggtagatataagacaacggtttctacaaagggaaaagagattatcaatgattccactgctattggattgaaatctagaatgtgttatttggtggtcatgggagatgttggtgcctatattgttgtggaggatttccataatgcaatatggaaaatgaaggaatatgatatgtag

SEQ ID NO: 63228 - DNA, 1632 bp, Glycine max
  Peptide Sequence Number=SeqID_180006
atgggatatgagcttcaggtccttgattgtaggagctgttatagtggtgtaacaactcttgctatttctactaagctgtccagggaggatgcacttttcattttacaggcgaagccagacgttccatgcgggtctagctcacactcattacttttgcataggtgtcacctgaggagtgggcatgtcctagagacacagtatgtgggggaggaagtgattctaggggttttcatcagtgattccttgacagaggaaacacgccatgagacttttgacagtgggtcttcctctttcgagaggttgctagacctgtgccatatcaacgagggtagttcttgggcctgtgagagggttctgccctcctctgttgctttggaggaagagcctatcctagtcacaacaatacttccttcttctcctttggtggccacagaaaggggtgactgtggcatcgttagggtttctgcttggagtaggcgtagccatagcactaggacagcgttagctgaagttggccaacccaaaagactcctgcaaaataacagcccaggcttacggggtcttgggtctaattctccctctaaactcctttcaatgcaccctgctagagcatttgaatgtggcaccttcccagcttcatcccaacagttgggcaatggattgcttattcaaggtcttcgtgaccgatgcggtggtggatgggttgtcactgattcagaccctaccaggttcaaatcctttgatgaagatctgctacccctggtggagagggttgacaaggctattctggagcaattgcccttggtgaagcaggtcagacctgctagtggcgatgtgtctcattcggctctcaagcctcttttattgtggttactcccaactcccaacatgcctccttctgtcttggccaagaggaaacatgatgacggggctggagtgtctggccgtaacaagttgaaggccatcttcattccccgagtccttaaacaggcatcagggttgatgcctgggtcgactcgtccttctctttgtagcactcagggtccaccttccgtctcattggtttctgtctccctacctactgtggcaactgcgccggttcctttggccgctcctattgtgactcctccttccaccactgttacacctttgcttagcgttggtgtggtgactatgagtacttcgaaaatcttgcctctttcttcttcaacttcactagttccaacttcagctatcttgttgtcaatgccaccttcctcctcttctcgccttagggtctccctagatcatgattatacttcctgtgatactaactttgtgtcttcttttgacaaaaacctcatccgttcagttggggaagctctgagcaaggttgcatctttagagaatgaggttgcaaagtggagcttcaatgctcggacaatgtggagagtggagcatcccaaggtggtcaatgctacaatcgcccttgccaaggatcggttgaaggagttagagtccaagctagaggagcctgagctcaagatgtcgaaagagagggaggccaacaaggagttggaggaggagttactggcgttcaagaaggaagctatggagcagcatgagaagggcttttacaaggccatcaggtag

SEQ ID NO: 63229 - DNA, 384 bp, Glycine max
  Peptide Sequence Number=SeqID_180007
atgggaaaaacaaactactcatttcagtatgcaaagcaaaagaatatgacaatgtcccacacattgagcgatacatcttccagtgaaagcagctctgaaggagagactagcatgcttgaagacatggactcctcaactaagggaaaagcaaagacacctatagtttcattggagaggctacacccaccgaacctgtctcagaaaaacgacgatctcggacactttcaccgtagacagtttctatggggcgtaggcctcccaaaaggtaacggaggcgtgcaaaggtttcctcgggccagacggagattggccctcaagtgcaaaggcagaagggagcttgactgcaagacacacccgtcgagcagggatcgtcgtgaaatttga

SEQ ID NO: 63230 - DNA, 387 bp, Glycine max
  Peptide Sequence Number=SeqID_180008
atgacaaaatctccaccctgttgctcctcttcttcacttagttcacttgagttttccatggaagaagaacacgcggtaaaggcgccactgtcggacgctttccttcagttcctggagaccaacgggctcgacccttccatttacactgctattgattccaccccacgatacattcgccttcaaaggttgaaatccggtttcgaatcatgtattgaagaggttgaagcagaggtgaaatgcaaactcgaaaaattagagtggttactgggattttactctcttccacctcacattcaaattgctggctctagggcataccgagaagggaagatatatggaattgatgtagcttttggagctgtagttatggctgctttaaatatatga

SEQ ID NO: 63231 - DNA, 210 bp, Glycine max
  Peptide Sequence Number=SeqID_180009
atgttgggaaactggctaccagagttccccaaagaagaagccaggcaacttaaaggatcattactgcaacacaatatatacagcaagaagctttttagttttgttagaattactcaggccatggtcgctgctcctcaacccctaaaacttccaccatttacagaaatacctcttaatgcttgtggccatcacatgacagtattaagatga

SEQ ID NO: 63232 - DNA, 2250 bp, Glycine max
  Peptide Sequence Number=SeqID_180010
atgaaggccatgcagatgcaatcgatcaccatactgttgctgactgcgttagcagtagcagctgaccaagccctgcccggctgcccgaactcttgcggaagcgtttcacaaattccgtatccatttggcataggcaaatcttccgtcaccggtgaaaactgtttcttggaggaccaattggagctcacttgcagagattccactttatatcgcggaaacggcaacgtccaaattctgaacataaccctcgacggtaaaatggacatgctcgccttcgtctcgaaggtttgcagaaaagaatctcttggtggagtagaaacagaaggtaacgaacccagtctcacaactccggctttcgccatttccagcgaggacaacaagttcgtaagcgtggggtgcgacactaatggctatctcaacagttatcgcaatggtgcgaaatcttcagtggggtgtttgacaagatgtaacagcgaagccagtgtgcaaatcatgcagagagatggaaactgtacggggatagggtgttgtcaggtggatatacctcccggaatgatgaatattaccatacaagcatttagctttaacaatttcaattcctcttctgacttcaacaactgcagctattcctttgtcataaaaaatgacaactatactttctcaatggatcatttaaagggtcttccgttccaaaaggcaccctttgttgtagattggactgttggaaatcagacatgtttcaattccacgagtaaaaccgactatgcatgtaagagtaatagctattgtgaggactcggctattagaaaaagttaccgatgcaaatgtaaagaaggttatgagggaaacccgtaccatccggatggttgccaagacattttagaatgtacgaatggtcggaacaattgcgcaagagatgaatattgtcgtgaaacccttggatctttccaatgtttctgtcctgaaggacttatcggaaatggaacaaaagaagatggagaatgtcgacaaaagcagcgaaatgacgtatttaccaaagtcgccattggtggaggtgtaggattaattgctctatttatggggatttcttgggtatacttgataaagcagaaaaggaaagtcctcaaattaaaggagaagttctttcagcaaaatgggggcatcattctaagacagcaactctctacaaggaaagactcgtctcaatcaactacaattttcactgcagagcaacttgaaaaagcaaccaactattttgatgagaaattagtcattggtaaaggaggttatggtacagtttttaaaggatttctgtcggataacagggtcgttgctatcaaaaagtccaaaatagtggatcagagccaaatagagcaatttattaatgaggtcattgtattatcacaaattaatcacaggaatgtggtcaaactgttgggttgttgtctagagacagaagttcctttactagtttatgaatttgttaacaatggtaccctttttgattatttacacaatgaacacaaggtggctaatgtatcctggaaaacccgcctaagggtagcaacagaggtagctggagctctatcatatctacactcagcagcctccatacccatcattcacagagatgtgaagactgccaacatactcttagatgatacttacactgccaaagtgtctgattttggtgcttcaagattggttccacttgaccaaactgaattagccacaatcgtgcaaggaacctttgggtatttagacccagagtacatgcaaacaagccaattgactgaaaaaagtgacgtttatagctttggcgtagtgcttgtagaactgttaacaggagaaaaacctttctcttttgacaggtctgaagagaaacgaagtcttacagttcattttctttcttgcttgaaaggtgatcgcttatttgaagttcttcaaatcggaattttggatgaaaaaaataaacaagagatcatggatgttgctattcttgctgcaaagtgcttgagacttagaggagaagaaaggcctagcatgaaagaagtagcaatggcgttggaaggagtaagaagaatggagaaacacccatggaccaataaaagccaaaatttccaggagactcaatacttgcttcatgaggcatatagcactcgtgaacatggtgatagtagtgaccttcaaagtactggatatgacagcctgagaaatcttgaattaatagactttggtgatggaagatga

SEQ ID NO: 63233 - DNA, 1806 bp, Glycine max
  Peptide Sequence Number=SeqID_180011
atgaatactcaattttgcagaacaccaccccatcacgtgcatgcacccatcatccccacttcccacttcccttccttgtacactgtctcaccctcccacccacgtttcttctttcatgccaatttctcagcttctcccactcccatcttggaagaagaaccttcttccaacacccccatcatccatgttgtggatgttaactttgatgttcagcagcaatattccaagccagaacctgagaacttgaacgagtttttatgtgggttgttcgaggatccaaagaccaaggagcttgcttttgactactaccaaaggttgaaagagaggccagagtttagacccgagaagccaacactgaagcatgtgatcaggtacttggtgagtttgaagagttgggattccattttgtcggtttcagatgactttaaggtttaccatgtgttgcctgatagggctacttgctctaggttggttaagttttgcattgagcataggaaattcagggttgctgaggccctgcttgatgtttttaagtctgatagtaaggttgctttcatggcttttagttctgccatgagaagttacaacaagctgcatatgtttaggaacactgttttggtctttgaaagaattaggtcgagtaatgttgttctggattcgagaggttatttacacattatggaagcttactctaaacttaatgagtgtgagaaagtggttcagttgtttcgtgaatttgagagtaggaagttaagaggtccaacatgtttagctcagatatatgagattctgtgtgagtcattagcgaggtgtggaagagcttctgaagcacttgattactttagagagatgactaagaaagggatttctgaatactcaatttactctaaattgatatactcttttgcgagtttgggcgaggttgatgtggctgaggaacttgtaagagaagctaaaggaaaaacgacgataaaggaccctgaggtctatttaaagcttgtgcatatgtatattgaagagggtttgttggagaagactttagaagttgtcaaggaaatggaggatgcagatgtcaaggtttctgattgtatactatgtactgttgtcaatggcttcagcaagaaaagagggttttcagccgcagttaaggtttttgaggagctgatttccaagggcaatgaaccgggtcaagtcacctatgcttcagttataaatgcatattggcgtcttgggcaatatagcaaagcagaagaggtgtttttagagatggagcaaaaggggtttgataaatgtgtttatgcttattcaaccatgattgtgatgtatggaagaacggggagggtgagaagcgcgatgaagttggtggccaagatgaaagaaagagggtgcaaaccaaatgtgtggatctacaactccttgatagacatgcatgggagggacaagaatttgaagcaacttgagaagctgtggaaagaaatgaagagacgaagggtagcaccggataaggtgagttacactagcattattggtgcttatagtaaagcaggagagtttgaaacctgtgtgaagcttttcaatgagtataggatgaatggggggcttattgatagggccctggcaggcataatggttggtgtgttctctaaagtcggtcaggttgatgaattggtgaaactcttacaggacatgaaaacagaaggaacaagactagatcagaggctgtaccaatctgcttggaatgctttcaaagatgctgggttgcaacttcaggcaaggtggatgaaagagagcttccttgtgacatag

SEQ ID NO: 63234 - DNA, 201 bp, Glycine max
  Peptide Sequence Number=SeqID_180012
atgtgcaatttcagttgggctaagcgcgcatccaccactaagcacagcttcagcgcacttagcgtgaaagaagaatctggcagagcatcaatatcaaggtcgtgcgctaagcgcgagatcagtgcgctaagcgcagcagttgtcatcaaccaggctcagcgcacgactggtgctaagctcaaacccacttactcgcgctaa

SEQ ID NO: 63235 - DNA, 108 bp, Glycine max
  Peptide Sequence Number=SeqID_180013
gttcaacgggctcggatacaattgagagtgccggagtacggttggaccacgcagaagaggttgaagccagaggtattggagtatagggaatgtggcatttatttttga

SEQ ID NO: 63236 - DNA, 249 bp, Glycine max
  Peptide Sequence Number=SeqID_180014
atggaaggaggcatgttaacaaatctaggatgccagcatagaggaagcaaaagaattcagtttgatgtttcaagaaacttggtttcagcccatcagttgatacagcacgtgcctgaaaaagcatttaacaccgaggcagtaatcagcccatcaaaaccaatcagcaaaacacactacctggaagaagaaaatcacaggaggcaaaccaaccatgtagaagcaaatgcaccacaaatcaaacttgcctga

SEQ ID NO: 63237 - DNA, 192 bp, Glycine max
  Peptide Sequence Number=SeqID_180015
atggcaaagctgaaatccaatggtattgttggtctagttgaggctaggattgaagtccaattggggaactgttttgtcacttcaaaaactgccaaagagattttgttgagtgtcaattatgaggggacaaaggacattaaattgaggaaaagttaccactctgatgagacaaaaaaggcttcaacatggtga

SEQ ID NO: 63238 - DNA, 153 bp, Glycine max
  Peptide Sequence Number=SeqID_180016
catgaacctttgaagatgcatggtgttagtacttgttcctttcaggttggtgacatttccaacttggagagagagctgaagatagatcagatgcaagcaacggagaagcaaaacttgggcatgttcagccaatctgagcttgatctcttcatg

SEQ ID NO: 63239 - DNA, 315 bp, Glycine max
  Peptide Sequence Number=SeqID_180017
atggcaacggtgcgggtcggggttgggttttgtttaccccacccccgccctcgactccccatttccctcctcgcccccgcccccgaaatcgacgggggtgtatatttacaccccatccccgtccccgacgagggtcgtcggggcgggttcggggacggattcggggcgggtattgagaatcccatccccgaccccgaacccgaatttggttatcgggaaaaacccgaccctgatcccggtcaactcagattttccctgtcaaaatcggggcgggtctggggcgggccccacgggttcgggtcccgttgccattag

SEQ ID NO: 63240 - DNA, 877 bp, Glycine max
  Peptide Sequence Number=SeqID_180018
atggcagaaactgcagtgtccttggctggtcagcatgcactttcaaaaatattggaagctgtcaaaatgctgagagatctcccaaaagaagttagagacattacagatgaacttgaaagctttcaagatttcatcaatgatgctgataaaatggctgaagctgaagaagatgatggaaggcgtcatagaataaaagaaagggtgatgcggctgagagaagcagcttttcgcatggaagatgccatcgatgaatataacatctcctgtgaggataagcaacctgatgatcctcgatgtgcagctttactatgtgaggctgttgacttcatcaaaactcaaatccttcgccttcaaagtgcgtacaagattcaggatgttaaatcccttgttcgtgctgaaagagatgatgaggttgtggggcttgatggccctagaggtatattgaaaaattggttgacaaagggaagagaaaaacgcactgtcatctctgtggtgggaattcctggggtgggaaaaaccactcttgccaagcaagtttatgaccagctttgcaaagaaaaaaaggaggaccgtcccaaggatgtttctaccatcgagttgttgacagaagaagtcagaaaccgcttgtgcaacaagagggatgagaaggttgcagaatattgtaggaaatcatcatttgttgaggtgcataagctagaaaaacctttaactgaagaagaatctttgaaattgttctgtaagaaggcatttcagtataattccgatggagattgtccagaagaacttaaagatatatctctagaaattgttagaaagtgtaaaggtttacctctagcaatagtggccattggtggtcttttgtctcaaaaagatgaaa

SEQ ID NO: 63241 - DNA, 300 bp, Glycine max
  Peptide Sequence Number=SeqID_180019
atggttccacctaaagaaattgcgaccatcatttaccacaatggtcacattgtagatgatccacttcaaggatcgatgtacacatatgtgaatccaatatttttttacgtcagtcgttctattacatttacacaattcattcgaaaaattaacaatcatctccctgctcgagcaactgaacaagttgctcaattgctatttcgtgtccctatttcatttcatttgggtcagacatgttttatttcagcacaactattcgacaatgatgatctcagaggcggaatggaaacaattgtctag

SEQ ID NO: 63242 - DNA, 597 bp, Glycine max
  Peptide Sequence Number=SeqID_180020
atggaaaagcatgcagttttgccttcttttgagagcacaaatgaagctcaacttgaaggttatgttgtgaaaggaagtgaagaaaaggtgtataagcttcataaagctttgtatgggttaaatcaagctcctagagcttggtacaacataattgatggctatttttgcagtcaagcaacaaagagagtgcttaggtgcttaaaagacattactcaacttggaatatggtataaactcaacgacaataagaatttattgggctatgtttacagtgattgggctagaaaccttgatgccatgaagagcactactggttatgttttttccttaggctctggcatgttctcttggaacttagaaaaacaagaaattgtagctcagtccattgctgaagctaaatatgttgcaacaacaaaccaagccatttggttgaagaaaattctatttgatttgggagtagagcagctaaaagctattggaatttattgtcaaaacctatcaacaattgccataattgaaaattcagttcaacatggaaagaccaagcacattcaagtgaaatttcatgttattcatgaggttgttaagaattgttag

SEQ ID NO: 63243 - DNA, 228 bp, Glycine max
  Peptide Sequence Number=SeqID_180021
atgagtgaaatagaggacgtacaggaacatatgaaggtcgatatggaggccatgaaagggcaaatggccacaatgatggaaggcatgatgattgttgctgcaagtatcgccacagaagtggacccaactcactcatcgagcctcaatcaagtaaatcctccagtctcagatatggtaggtcagggaggagaagcattgggaagtacaggtagtccccatgttgtgtag

SEQ ID NO: 63244 - DNA, 570 bp, Glycine max
  Peptide Sequence Number=SeqID_180022
catcaaattgccaaggaaatcactgccaagcaagtccagcattggccaaagaaagggaagctttctacagggaagctaagtgtgaagtatgcaatcctgcataggattggcactgccaactgggtacccaccaatcatacttccactgttgccacagagtcttttgctgtcaaattacccattgccttcccaactgtattgtgtggcattatgttgagtcaacatcccaatatcttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcattgatgatggagaagcagctgaggaagaagaagatgcagcagaggatacagaatcagatgatgatgattctgatgccaccccatga

SEQ ID NO: 63245 - DNA, 270 bp, Glycine max
  Peptide Sequence Number=SeqID_180023
atggctatcaattcatggggctccggacttgatggtggaggatgcatgaatgacaatcaattcatggggcttcgaataagatttgttggtggaggatgcatgaatgaaaatcaattcatggggctctggacttggggactcgatggtggaagatgcatgaataacaatcaattcatggggctccgaataagatttgatggtggaggatgcatgaacagcactaggcaatcaattcgtggggctccggactcgatggtggaggatgaatga

SEQ ID NO: 63246 - DNA, 510 bp, Glycine max
  Peptide Sequence Number=SeqID_180024
atgtaccctttcttgatctcagtcaacaacccaagtagatgtaccctctacttggaaagggaagaatcaaaagaattctcagactgtgtcgttttcaattctttgacaagggagaagggagacacaaaagaattcaagcggttagtccttcgttcttttggaaaagggagaagagagacacaaaaagaatccaggcggttagtccttcgttcttttggaaaagggagaagagagacacaaaaagaatccaggcggttagtccttggcgaattctttttggcaaagggagaagagaatgaaaagatgaatagcacaagttttcaaggtttagaaaaccagaatactttggaaagcttttggcacaaagaagaagaagaagttcaaagagattcaaggcttgtaaaggattgtataagattgattgaaaattgtgtcttgaaaagcaaatcaaagccttgcttttatagacccttcatgtctggcctagaggaccatttagaagagttataa

SEQ ID NO: 63247 - DNA, 102 bp, Glycine max
  Peptide Sequence Number=SeqID_180025
atgaggcttcactattatcaagcgagtcggagacccaacatgaccacagatcgacctttactctttatggctcacataaacccgggtggcatatgtgcatag

SEQ ID NO: 63248 - DNA, 519 bp, Glycine max
  Peptide Sequence Number=SeqID_180026
gaaactaagggagcctctggtaatcgattaccagcctgtgtaatcgattacacagagggatgggtcactggtaatcgattaccaggctgtgtaatcgattaccagagacgaaaagccttaagataccccttttacttgcatatcgtgatggcggcgcagctaatccgtgatcgagtagagatggagtgcctagagggagcttgggagaccttcgaaggcaacacgaggtgccgattttggggcaccattcgattcacggctacttctttggtgcatccagatgaacctgcacgggacgctgcagcgcacggtggagtggatactacccacgcctccaccatatcgtctagtggagccagtccaagtgatcgaggtgaacgccatccgaggaagaccccgaggaggatctggaggagctaccctcctgagcctgctgtggatgcccttgactttctagagggtgatgaggatccacttcttgaggtggattctcccgaggaagtcatgtcggcatcctga

SEQ ID NO: 63249 - DNA, 451 bp, Glycine max
  Peptide Sequence Number=SeqID_180027
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatca

SEQ ID NO: 63250 - DNA, 336 bp, Glycine max
  Peptide Sequence Number=SeqID_180028
ttcttccggaagtgcgcgtcttccggaattcttccggatgaaccacttcttccggaaagttcccggaagaggttttccggaagtcttccggaagaagtgttcttccggaagacgtttggttacttccggaagaacacttcttccggaaactttccggaaaaggttcttccggaacttccggaagaacccctaacggtgcataacaaaaccaaagctaagaagaaggccacctacctcgaaagcaaatgggtccaagggctgtcggagaagctcgcggagaagaagcttgtcggggaagagagaagagaagaagcttttgcggaagagacacagtga

SEQ ID NO: 63251 - DNA, 411 bp, Glycine max
  Peptide Sequence Number=SeqID_180029
atggcatctttgtcgtcatgttcatcaagtatacaaattaagtctagtccaatagatggagacattttatggatgcaacctaagcatgtttcagaacatgtttggaatgagaaatcagacagaaaattatacatcagacgagctgtccccatttatcaaggacaagaagaaataccagaggaaattattcctctgcttcaccaatctggtctacgtgttgatgggacaccattaattggtcaaactaattttgattgggctgaattatgtgaagaattgttgggagtcagaccacaggaaggtgaacttcaaggcagtgtggttaaattaagttggctggctcaccatttttcacaaataaataaccatgacggtaacgtagaacaactacaaaggtttactcgtgcatga

SEQ ID NO: 63252 - DNA, 162 bp, Glycine max
  Peptide Sequence Number=SeqID_180030
atgactgtgaaaaagaggctaagttttgaattgcaaaaagtagcagttgggctaagctcaaaattttcaaaggcactggtgcacaacatattccatagtgcctattttgggaaaaaagccctagaagcagcaaagaggaacaacttgtgcattgaatcctag

SEQ ID NO: 63253 - DNA, 222 bp, Glycine max
  Peptide Sequence Number=SeqID_180031
atgaagggaggagagcataaatatgggtttaacaacaataaacatgagaagccagagaaggtaagggtggtggatgatgaaactgacgacaaacatgagctgtttgaagtcctaaggatgccatctagatgtgtatttttcaaggtcttcatgtcattccttcatcattcaacgttttcatgtcattccttccccgacagtttgaaggactattctgaatga

SEQ ID NO: 63254 - DNA, 411 bp, Glycine max
  Peptide Sequence Number=SeqID_180032
atgacttcattgatgaagaagatccaaggcctacaagctctacatggagctacattaaaggagggtgcatctttgaatcgatctcctttgtttgtgggtgaacatttttctttttggaaaaagaaaatgaaaatctttattcaatcaattgatcccagtgcatggaatgccatttttaaaggtcctttcattcctactaaagaagcaaatggtgaattggtacctaaagaatgtgatgagatgaaagatgatgaaaaaagaaaagttcaagataatcaaaaagctaaaaacattttaacttttggtttatcttctgatgaattctttcatactgcaaggtgcaaaggtgcaaaagtgcaaagcaaatttagaatatgcttgaagtcactcatgaaggcacagtggatgtga

SEQ ID NO: 63255 - DNA, 189 bp, Glycine max
  Peptide Sequence Number=SeqID_180033
atggctagagtgcctaacggaaggaaatggaggccgaacttcgaaaagaaagagaaatatgtagaaaagtttatgagtaaaggaaatatgaagaaaatgttgatacacataaaacaaaaggaatatggcaccccaggaaatgggttcccaaatcaaggtaataaaaagtcaggaaaagctacagagtga

SEQ ID NO: 63256 - DNA, 541 bp, Glycine max
  Peptide Sequence Number=SeqID_180034
gaatggggtagtcagagtaccaaggaagtgttggaggaaagggcaaaggccttggaaaatcaaggcaaacgggctttcttttattgacatcttggcgcttttgatctttggagttgtcctctttccgaatatggaagggttagtggacctagcagtgattgacgctttcctcgcctttcatcatggcaaggaaagcccggtcatcgccattttggccatgattcgatcttcatgcgaaggatgtcccatgagaggagtgccatcagacgaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaagtccatagccatcaaagtctga

SEQ ID NO: 63257 - DNA, 1272 bp, Glycine max
  Peptide Sequence Number=SeqID_180035
atgaagccagtcccaaatgaacccacatgcttgacatatatgatgtcgtcaagatcgagcctcactctctgtcattcgtcatctccttctgcagcctcgcctgcaacatcaagtgtcaaggtttgccacaaaatgagcctctctttaatcatccccagccgtagcaaccacctctccggtgagaacaagttcatgcggacaacgctgttgaacgacatctcctgtgaggcacgtgacagcgagataattgtgggacgatgtaaagaagaggaggaacgagaagagggaaatggttgggatcccttagttctgttgttgttgggtgtcattgcggatctgaatccagatccaaatgggatgaaaaaggcgccgtataacacaccgccggcgcttattgcctttacgctgactgtgcttgtattgtgcttcgtggcgttcagcatcgtgtacatgtgcaagtactgcttctcgagcgtgatccacacttgggccttccagcgcaccccttcgggttccctcattcgcctcacgccccacaggtcccctcctcggggcctcgaccctgaccttctccaagtcttccccaccttcccttactcctccgttaaggacctccgcaaggatcagaagtacggccttgagtgcgccatctgtctacttgagttcgaggatgacaacgtgctccgcctcttgacgctctgctgccacgtcttccaccaggactgcatcgacctctggctccgctcgcacaagacctgccctgtctgtcgacgagacctcgattcacccccgccagacgaaacgcagaaagctaacgagggtgtggtggtgatgtccaccagcggggagatacgcattgatgtaacagaagggcaagactgcggtggtggtgatgataatgatggaaatccaagacaagagcatgaacgtgagcatgaacacgaacatggttatggcaatcacgaggtcatgattcatcaacagggggaacagatgtttgcacggtcgcattcgacggggcactcgatagttttgattagaggagagggagatgagggaaaggatgatgacaagtatacgttgagattgccggagcatgttttgagagtgaggcataataataagcacaattgtacgaggagctgtgcgagttacaaggacattgctaagcttgttgctcctcctgctgctgctgcaccttgtagtaattgtggctttgttcaaccagttcctccatctagcacctcctcccctgaccatactcgaaaataa

SEQ ID NO: 63258 - DNA, 489 bp, Glycine max
  Peptide Sequence Number=SeqID_180036
atggatgactggaacattccagaaatccctcaggatcaactatacgttcctgaaacaataaaagacaaacacaactttgattacataatcaaaacagtagaaaacaatattcctctaggacaagatgtaggggaagaatttcatttactttcaaaaaattcaatttatgaacatagccgtaagtataaatatctacacatcggttgtgtacaagtagccatcaagcccttaattgatatgggcatagatgcagcagttttaatgtgtctaagagacattaggcataatcaatttgaagactccctaattggaacagtcgaaaccagcctaggacaaggtccaatatattttaactgttatccaaacaaaacagtgagtctgatggacagaaacattcttgactctctgttcctaaacatccactttcatggccttgacatgaaagaaggatcaatcccagcagccttaatatataggatccagtacaag

SEQ ID NO: 63259 - DNA, 336 bp, Glycine max
  Peptide Sequence Number=SeqID_180037
atgaaggaacctaaacctactaatatcacccaacaccttcttgatcgttttgtggtccatcctagaagggtgatagaggatgtaatggttaaggtaatggttgaagtcaagcttggtagactcaccctccgattgggtgatgagaagcctcaccgaagtgtggggaaggaagaccctcttgaaaggaacatcattctaaaggatcaccatggaaggggtataagaaatgagaataggagagatgacaaaaccattctagctcttggctatggagtggatgatcatactagaggatcatttcatgaaaggatcatcaccccgttcgaggttggttaa

SEQ ID NO: 63260 - DNA, 1143 bp, Glycine max
  Peptide Sequence Number=SeqID_180038
atggatttcgctcgggacggcaacgtggtgcaaataatcaccggcggtggaggcggaggcggaggcggagagagctggtccggcgaccaagccgattgggcgacggaggacgagtaccggttctggaacaacaacaacagcggtggggactcagaaacgacgccgtcgaactcgaattacgaggggcggtcgtcggagccgccgagcaaaaagtcgcggaattcctcgcaggaagggagctcctcgaaccggtcgaaggcgatcgggaagatgttcttcaagacgaagctgtgctgcaagttcagggcggggacctgcccttacatcaccaactgcaacttcgcccacagcatcgaggagctgcggcgcccgccgcccaattggcaggagatcgtggcggcccacgaggaggagaaggcggtgatgatcgagccgccgagggaggagtttcagattcccacagtggggtctaccaccttctcaggggaaatgatgcagaggtcctacaagggaaggcattgtaagaagttttacacggaggaagggtgcccctatggagatagttgcacctttcttcacgatgagcaatcgaagaatcgcgagagtgttgctataagtttgggccctggtggttacggtggcggcggcggcggcggcggcggtgttggtggtggtgccagtggtggtaatggtggtgctaatgctgctgggaatgggcctaattcgaagccctctaattggaaaaccaggatttgcaataagtgggagatgacagggtattgcccctttggcaataagtgtcattttgctcatggtgccacaggcgaaagtctgcctgggaatgcttgtaataccagttttaccttccagtggatctatgattggccttacggagaaaatagagatgctgcttctgcagttgctggtgacacaaataagggagtgccttcaaaagcttctgccgataatgtggttgcagcagttactcttgtcgctcattctgatgtgtatcatattggagtcccttcacaaaggccttcttccatggtgattcagaggccaggacagagagcacatcagaagtggaaaggtccagataaaatcagtaggatatatggtgattggattgatgacatcgaatag

SEQ ID NO: 63261 - DNA, 177 bp, Glycine max
  Peptide Sequence Number=SeqID_180039
atggaaagagattgcagcaccacacatggcgattattcagaatttgcttccatcctgacctcgattggagccacagaactcaaccccacattagtgtgcatacagcataaatatggagttatcttcaatgatcctgtatatgcatacagcatatgcaggatcagatacagcatgtga

SEQ ID NO: 63262 - DNA, 432 bp, Glycine max
  Peptide Sequence Number=SeqID_180040
atgaggcttcactgtcatcaagcgagtcggagacccagcatgaccacagatcaacctccacttcctatatttccatggacccggattaaatggcttgactctaaagaaaaatctccccagtggagtcgacaactgtcgcaacctaccattcggcgggagggcaaggcgagactcaagggtgcatcctccaaaagagaaaaacacgcgagagtcgccaccaacgtttattcgaggaaaatgttaggaaaaccaaaaaggggtatgccgatttcaaagaaaagggttcgagagatgtttacgcgcggggaagtgatgcaatcctaccccgcaagggcattggatagaaaactccaagtagattgggccagagatgcaagagaaggccctagggttcttatgagccttagggtagatttcgggcccatgggctaa

SEQ ID NO: 63263 - DNA, 333 bp, Glycine max
  Peptide Sequence Number=SeqID_180041
atgcccacatgcatgaccctccagttagctgaccgctccattacaaggccatatggagtcattgaagatgttttggtgaaggttaaacaccttatatttccagctgattttgttgtcatagatatagaagaggatgctgacattcctctcattcgtggccgcccattcatgtctactgcaagctgcatggtagacatggggaagaagatgctgcagatgggcatagaagatcaaaagatcagctttgatttgttccatgaggacagagatcaccctagtcaaaatgtctgtcttaaagtgcatgtgatggaggaaaggagacatgagaagaag

SEQ ID NO: 63264 - DNA, 1115 bp, Glycine max
  Peptide Sequence Number=SeqID_180042
ctttcagtatgacaccagccatgtacgagcgcgtgcgtaactacttcgttgatgccgggcttaccactggcttcattgttcaattgcttgcatgggacgacacaacgaagttaacggacgcattcatcgtgttccggcctaacggcggtaccgacatccgaaatgacctcggatctgaccactacgtgctggtggatgtcatttctgccaaggataagcgccgggcagccgctgaaaaggctcaggaaattatcaattatgtcgaacagaacgacattaccgacgaatgccttggccttattcaaaacctcggcaatgtgccagcacctatcctgaccgaagagggccgcctggtacacatgcaaggctgtgctaatgattttggcaagctgatcgggaaagtagctgtgctacgcatggcctatggctgccccgacgcagtgccagcgctttccgagtggaagcgtctcggcgctatgacgaccaagggtctcgattattcgatgaacactattaactccgaggctgatgactccaaggggctggttgagaacctggtcaataacatggacattacaatttctggtgaaggtgaggctcgcaagagggacaaaagcacagaaattggcgcctggagaatgggcaaatacatcttcgatgaagtgcaagccggtcgacagccgacgctctgggttagatttgattttgctggcgaagatgctggcacttacattatgggttacttcaacacaacctcttggtctggtgactttggcacaaacgacattgccaccttctccggcgagtggaaggtctacgacgccgacaccgttgtgtttgaagtcgctgattccatcgcggccactggcgttgaagttacgcctgcaactgcatctctggtcgttggcgcaacccagcagctgagcggtgcagttcagccaaccgatgcgactaacaaggcgatcacctggacgacttcggcggcatctatcgcaacagtcagctctaccggcctggtaacggccgtctccgctggcaccgcgactattacggcaacaactgcagatggtgacttcaccgatacctgcgctgttaccgtgacagccgcgccgtaa

SEQ ID NO: 63265 - DNA, 339 bp, Glycine max
  Peptide Sequence Number=SeqID_180043
atggcgttagggggcaggcggaaatacccaagtggggcaaacgagcccgttgacgcgcagagattaacatcttcttctgcaccttttgtcgtcctgacccgtgaaccaggggcaaacgagcccgttgacacgaagagactaacatcgtcctctgcaccttttgccatccagggacaacgagtcaggtggcaggcggagataccttatggtcatccgcacctttcgtcaaccgaggggaacaaatgcgacgatatcaggatgatgttggttggacgattgagtgcaatggctaaggaaggtgtcgtggttgtccaactttgtcgctttcaagacactgaa

SEQ ID NO: 63266 - DNA, 144 bp, Glycine max
  Peptide Sequence Number=SeqID_180044
gaatgtcctgatttgaagttggtgtcacatgggaggaaggtgacactgattaggaggccagtgcctgagattgaaggactggtggcacaacgagaccagcaccttccacctttcggtaggagagttaacgatcacattggatga

SEQ ID NO: 63267 - DNA, 552 bp, Glycine max
  Peptide Sequence Number=SeqID_180045
atggcaacaaaccaaaacctgatcctctggccgaccatcagtcagaagccgaaaagtccggtgataccacggtcgaaagttgaccccacaatgtcgcgcaagtcagtcagtaagatggagcgcgacattgaggatcggtattacgcgataaaggtggcgctgaaagctctgtttgaccagcgccttaccgggcgagagcgtgaaggtaacagccataactggcacttcctctgccacgacaacggcgaggatatgcggctctaccaggtcaacgccggcaagttcatctacgacatgtcggcgcaggaactggctgacttgcttgaggcggtgcagggcattctcgacgaatacctgctgggtggtggcgagcaaaacctgtgggcgatggattacgtcgtcgctgaggcgcagcgcggcacgctggaggcattcaacaacctctctcagcagtcgcaggtgtacgccagccagacgacgttacagcagcttttaagcagtccgggctacctgaatcagatagcgggcggccaggctgacaacgttcagtga

SEQ ID NO: 63268 - DNA, 383 bp, Glycine max
  Peptide Sequence Number=SeqID_180046
atgaagagcaaggaattaaagagaattcaccgaacaaaaagatagaggaagcaaaagaacatcacctagatgaagatgctctgataccacatgatgtaagcttcgttggagcttgtaggcctgggatcttcttcatcaatggagtcctttgcttcttgaggtctgattgcagtggaatggaaaaggagaaagatgattgcagcggaaggagaaggaagagagagaggagacgccacttcaaggagaagatgagtctagaagaagctcaccaccataggaggccatggataagagcttggaggaagaaagagatgaatgaagggagaggaaaagaagagcacgaaattttgtgctttaaaagagctctaaaatctgaagtttaa

SEQ ID NO: 63269 - DNA, 202 bp, Glycine max
  Peptide Sequence Number=SeqID_180047
aaaaaaaaaagaaggagtagagacgagagtcgtcatcacggaaagggctggacggacgaaatcagtgtcttatctttgctttcctcttatctctgatgagagatacttggcaccctttgttgcacaatatgtgaagtctcgagacgtgccgaaaatcaaaaggaagcaggcttacgcgatccgtgaaaattccgtaatgtga

SEQ ID NO: 63270 - DNA, 300 bp, Glycine max
  Peptide Sequence Number=SeqID_180048
atgaccccaattttgaaggtgacaccttttttgaagatgagctctggtagagccagtttgaatcctttgccacgtcctcttcctcctcgtaagagagagaatgcttgccttaggaagcatgattgtattgactctttgtttgaggataccaccataacctatgtcagaggcatctgtttcaacaattttgaatgcctacagaattgggagatacagatattttatggtttgaactttgagcttgatatccttgactacctgggtgtgaatatcaaaccaaggaggaggattctttcttaa

SEQ ID NO: 63271 - DNA, 980 bp, Glycine max
  Peptide Sequence Number=SeqID_180049
atggcaaaacagcgggtaggtatcgtatttggcggcaagtcggccgaacatgaagtgtcgttacagtcggccaaaaatattcttgaggcgatcgataaaaacaaatacgacgtggtgctgctggggatcgacaaacagggcgagtggcatctcaatgacgcttcaggctttctgctcaacgccgacaatccggcgctgattgccctgaaccgctccggtgaaaatgtagcgctggtgcccggcagccgcgcggaacagctgattacgcgtcagcaggcgcagccgctgtcgcagctggatgtcatcttcccgattgtgcacggcacgctgggcgaagatggctcgctgcaggggctgctgcgcatggccaatctgccgtttgtcgggtcggatgtgctgggctccgcggtcagcatggacaaagatttcaccaaacgcctgctgcgcgatgccggcctgaaagtggcaccgtggctgagcgtcacccagacgcagcgcgcggcgctggatgtgcaggcggtgattgcgcgctttggcctgccgctgtttatcaagccagccaatcagggatcatccgttggggtgagcaaagtgacgcagccggatgaattcgacgcggcgctggatctggcgttccgctttgaccgcaaggtcctgattgaacagggcatcagtggccgtgagattgagtgcgcggtgctgggtaacgaggcgccagaagccagcccgtgcggtgaaattgtggtgcacgacgccttctactcgtatgacaccaaatatatcagcgagagcggcgcgcagatggtggtaccggctgacatcagtgcggaagccagcgaggccattcgggctgtagcgattaccgcgttccacgcgctggagtgctttggcatggcgcgcgtcgatgtgttcctcaccgatacgggcgacattattgtcaacgaagtgaataccttacccggcttcaccaacatcagcat

SEQ ID NO: 63272 - DNA, 1582 bp, Glycine max
  Peptide Sequence Number=SeqID_180050
atgatggaccagaagcagaatgccgtggagcaggatgcgcgttctgttgctcgtatcgaaaccaccgtggatgacacgctgttaaaaagcgtggcgtggatttgcaaacactacaaacgcgagaagagtgaagaggcgctggtcgccggcctgccaaaagcgacgctgctgtcgccgtcgcaggcgatgaccgctctggagaacgctggcattactggcggcatggttgaacgccgcctgcaggatctgccggagcagctgatgccgatgattctgctgcggcagaacggcggcggctgcattttgctgtcgcggcgcattcacaccaatgaggagaatcagcgcgagctgcgcttccagctgattatgccggaggtgagtgataaagcggtggagatgagcctggcggagctcaacgagatttacgccggctttgcggtgatggcgaaaccggcggcggtactggatgagcgcgccagcgaaatgctgcctgaggtcaaaggtcactggctgttcagcaccctgtggcgctaccgtcgttactaccgcagcgccgctattgccgccgtgctgatcaacgtgctggcactctccagcatcttcttcaccatgaacgtctacgatcgcgtggtgccgaaccaggcgtttgttacgctgtggtcgctggcgattggcgtcaccatcgccatgatcttcgaagccattacccgctttgtacgggcgcatctgctggacatggcgggcaaaaaggccgacctggtgctgggcagcatgctgttccgtcaggcgttatcgatccagatggagcacaaaccggcctcatcaggcactttcgccaaccagatccgtgaatacgaatcagtgcgcgattttgttgcctcggcgacgctggcggcgatttcggatctgccatttatcctgatgttcgtcggcgtgattttctttatcagcggtccgctggcgattattccgttgatgatgatcccgctgatcatcatcgtcagcgccgcgattcagtggccgctggcgcgcatcatgaaggagaacctgcgcgatgcgtcgctgaaacagggcgtgctgattgagtcggttgaaggcatggaaacgctgaaagccgtgggcggtgaagcgcatatgcagcgccgctgggagaactttagcgcgctgcagtcggctaactcaatgaagtcaaaacgctattcgacgctggcaaccggcgtggtgacctttctgcagcagtttcagaccgtgatgctggtggtggccggggtttatctgatcaacgccggcaccttcaccatgggtgcgatgatcgccaccgtgatgctggccagccgcgccaccggcccgctgggtcaggtgattggtctggcggtgcgttatcagcaggccaaagcggcgctgacctcgctgaataagctgatggagatgccggtcgatcgcgacagcagcaaaacctacctgaccgatccgccgctgaccggcgagatctccctcagcaatgtcagcttctcttatccggcaccgccgatgaagcccaatccggaaatcctcaaagacatctcgctgaccatcaaggctg

SEQ ID NO: 63273 - DNA, 1179 bp, Glycine max
  Peptide Sequence Number=SeqID_180051
atgccctcgccttcagagggctacagtaccctcacctttagagggctctgcgccctcgccttcagagggcaacacgccctggccttccgaggactacgcgtcctcgccttaagagggaaacacgctctcgcctttagacggctacacgtactcgcatttagagggctgcacgccctcaccttcaaaggaatgcacgcccttgccttcagaggactacacgtcctcgccttcagaggactgcacaccgtcgccttcagggaactacacgtcctcaccttaagaggtcaacacgctctcgcctttcgacggctacacaccctcgcctttagaggtccaaatgccttcgccttcagagggcagcacgtccaaaccttcagagggctacacgccctcgccttcagaggactgcacgccctcgccttcagaggactgcacaccctcgccttcagaggaatacaggtcgtcatcttcagagagctgcacgccctcgccttcaaaggtaccctcacctttagagggctctgcgccctcgccttcagagggcaacacgccctggccttccgaggactacgcgtcctcgccttaagagggaaacacgctctcgcctttagacggctacacgtactcgcatttagagagctgcacgccctcaccttcaaaggaatgcacgcccttgccttcagaggactacatgtcctcgccttcagagggctgcacaccgtcgccttcagggaactacacgtcctcaccttaagagggcaacacgctctcgcctttcgacggctacacaccctcgcctttagaggtccaaacgccttcgccttcagagggcagcacgtccaaaccttcagagggctacacgccctcgccttcagaggactgcacgccctcgccttcagaggaatacaggtcgtcgtcttcagagggctacacgccctcaccttcaaagggttgcacgccctcgcctttagaggactgcacgccctcgccttcagaggactacacgtcctcgccttcagagggatgcacattctcaccttcagaggactacacgtcctcaccgctgcacgtcctcaccttcagaaggctacatgtcctcgccttccaagggcgaaacgtccacgccttcaaagggctgcacgtcctcgccttcagatggttgcacgccttagcctttag

SEQ ID NO: 63274 - DNA, 222 bp, Glycine max
  Peptide Sequence Number=SeqID_180052
atggataagagcttgaaggtaggagaagatgagtggatggagagggagagaaggagcacaaaattttgtgcctcaaatgagggactacgagcgacaatgcatcaccaaaagaggaaaactctagataaggcttcattattatcaagcgagtcggagacccagcatgaccacaaatcaacctccacttcttacagctcacatagacccgtgtatagggcctaa

SEQ ID NO: 63275 - DNA, 255 bp, Glycine max
  Peptide Sequence Number=SeqID_180053
atgtcagcattcttggaagcaacagtgaaattattcatgcaaatcgctagcatgaacagcgccacactcaggcacgcgacacgtggctgtgtcgcctctgccactggcgacagcactgatgtcgccacctgcaatggcgttttggccatgcagggtggagtcgctggtcaaaccagcgcttccccacgcgtatcaggtacagcttttgcaggtgaaccagcttttgcagtgcagctgaaaacgccaggtccttag

SEQ ID NO: 63276 - DNA, 1827 bp, Glycine max
  Peptide Sequence Number=SeqID_180054
atgggctcgaaatctaccctaaggctcatgagaaccctagggcctttccttggatctctagcccaatctacttggagtcttctagccaatgcccttgcgggtttgttactcgaattcacagatgtttttcaggaaccatctggtcttcccccttgtcgagttggccacgatcacaagattcctttaatgcaaggagctaaccctatcaacaagaggccctataggtatgctaaacaacaaaaggacattattgatggattgattcaggactatttaaaggatctcaataaggaaattgtcaagaacaaattccctataccattagtagaagaccttctggatgagttgtatggtacaagattaggccctaccataaaacttgaagcaattgaggagtttcttgggtcttgcagcaaaagaagcatttcaagaattgaagcaaaggctagtagcatcaccagttttggccctaccagatttttccaaggaatttgtggtggaggtggatgcttctggatccaacagcttgattctagcatgctctctaggatccaacagtcatggcagaaagatcctatcttacagcagcttgttagtgacttaaaaaataatccctcttctcacaaacattatacttgggtccggaataagctgaggaggaaaggcaaattagtcattggctcagactcccaactaagacaagacattctctcttggattcatgcttcagcttgtggtggccattcaggtagagatgctaccttgcaaaagatgaaaaatatggtttattggataggcatgtccaagaatgtcaagttttttgtgtttcaatgtgccactttccaaaggagtaaacatgacacagctgcatctccaggcctacttcagcccttacctattcttgagcatgtatggcagcacatcaccatggacttcattgaaggtcttcctttttcttttggtaaacaagtcatttttatagtagtagataggcttagtaaggcaactcatttcatggccttattacatccttatactgttgcggatgtggcccaatgcttccttgatagtgtctttaaattgcttgggtttcctgacaccattactagtgatagggatcctatttttctttcaatagcttatcacccacaaactgatggtcaatccgacatggtgaatggatgccttgaaacatatctcaggtgcatgtgtagtgactttccagcacactggtccaagtggttgcctcttgctgaatggtggtacaattccacttaccacaacactattaaagcaagcccttatgagattgtgtatggccaagctcctcctattcatttaccttatcttctaggggaatttaagattgctttggttgatagaagtttgcagaaatacgaggaaatgagttttcagattggtgacttggtttatgtaaaattacatgcttatcgccaagtttcagtgcaggccagaaccaatgcaaagttggcccctaagtactatggcccatttccagtagaagacaagattggtgttgttgcatacaagcttaaattgcctcttggatcaatggttcataatgtcttccatgtttcccagttaaagaagtttaatggtactactactgttgggaactttagtccttcacctttattggatacttctcagaaggaacctgcaactatcattgacagaatgacagtcaagagaggaaatcatgttgtaaccaaagttttggttcaatggaagcatcagctacctgaagatgcaacttgggaattcttttatgacttgaagcagaagtttcctcactttaatccttga

SEQ ID NO: 63277 - DNA, 966 bp, Glycine max
  Peptide Sequence Number=SeqID_180055
atggcagagaacacacgcagtcaagcttcccttcgtgaaatggaagaacatctcagcagtagaatggaatcaagatttggcgagctcgctgcttccatgcaacaaacaatacacataatgtttcagcaaaggcgacaagattctccaacaacaaacaatccacctagaggattggagaatttgccttcttggaatgaatatcagatcttgttacctaattgttttggagatgtttgtgaagatcccatggcgaatttaatgaagctcaggcagacaggatccatcatagagtatcatgaggagtttgactcaattgtatcaagagtggatctttctgatgagcatcaacttagctgctttttaggaggattaaaacaagaggttcagatgattgttcaaatgtttcaaccaaattatgttcgaaaggcttattcccttgcaaagatgtatgaatcttccttctccaatacacaagctagaccatttgtcaagaaccagaaatcttcctttgttcctaaaccacccctacttccaaaccctcctagatcaaccaatcctttaaccatcaatccctctaccaaaccacaaaaacctaagcacctaactcccaaatacatggctgaaagaagatcaaagggcctatgctacttttgtgatgaaccatttacacctgaacatggccttacacataagagattgcagatccatgtgttggaaattgaagatgaagaggagggccctggacctcaacaacctgatgctaatgtggttactgaacctgattcagaacctttaatttctgtgaatgcattaattggagtatctaattttcgaaccatgagagtcactgtattaggaattgaatggctagtaacactaggggatatgacatggaatttcaacaaattgacaatggaatttgatggaagcttgcttgtggagcttctatggaggctggatctttga

SEQ ID NO: 63278 - DNA, 2913 bp, Glycine max
  Peptide Sequence Number=SeqID_180056
atggaagcaagtactggactttttgctggtaccccaaacagcaatgagcttgtggtcattcaaggacatgatgagcctaagcctgtgaagaacttagatggtcaactctgtgagatatgtggtgattctgtgggacttacggtggatggagacttatttgtagcttgtgaagagtgtggtttccctgtgtgcaggccatgttatgagtatgaaagaagggaagggactcaagtttgtcctcagtgtcatacaagatacaagcgaaccaaaggaagcccaagagttttgggagatgaggatgaagatgacgtggatgatattgaacatgaattcaagcatgaagagatgctacaggggaacaagacccatagagatagtgatgtgggtttagcaaaggtgaatggggagttgcccatatcttctaacagtgttgaagaacctggtgcaaagttggatgacaaggagaaagtagatgagtggatgttgcaccaaggcaatctatggcctgaaactgatgcgtcagatgatcccgtaaaggccatgaaagagccactgtcaaggaaagtaccaataccatcaggcagactcagtccttacagaatgatggttgtggctaggctcctccttctattactgttctttcagtacagaatctttcacccagtacctgatgcaattggactatggttcatatctgtgacatgtgaaatctggcttgcattatcctggatgattgatcagcttcccaaatggttccccattgatcgtgagacatatcttgaccgtctttcaatcaggtttgaaccagagaacaagcccaatatgctttctccaatagatatcattgtcactactgtggatccaatcaaggaacctcctttagtaacagccaacactgttctttcaatcttggccctggattaccctgctgacaaaatctcatgctacgtttctgatgatggagcttccatgctcacctttgaagttcttcaagaaactgctgagttttccagaaagtgggtacctttctgcaaaaaattttctgtagaacctagagcaccagaaaagtacttgactgagaagatagattttctaaaggataagcttcaatccacttatgtgaaagaacgccgcactatgaagagagaatatgaggaatttaaggtgaggataaatgcacttgtggctaaatccatgagagttcccccagaagggtggactatgaaagatgagacaccatggccaggaaacaactccaaagaccatccaagtatgatacaagtccttcttcctcacaatgtaggtaatgaacttccttgtcttgtctacacatctcgtgagaaaaggcctgcattccaacaccacaacaaagctggcgcaatcaatgccatgcttcgtgtatccgctgtgttaaacaatgctccttttgtgctcaacttggattgcaatcattatgtaaataacagcaaagtcgtgcgagaggccatgtgtttcttcatggacatacaacttgggaatggcattggctttgtacagtttccactaagatttgacagcctcgataggaatgatcgttatgctaacaaaaacactgttttatttgatattaacttgaggtgcctagatggaattcagggacctgcttatgttggttcagcatgtatcttcagaaggaaagccttaactggctttgattctccaaaggcttcaaaacgcccaagcatggtgcaagtacactcaaaacaggacgagaatggagaagaagcaagcaaaacagcagcagcaacagatgaggacaaggagctattgaagtccgagaataaatttgggatgtccacaattttcatgaattcttcatggacagaagaaggtggtgttgatccttcttccagtcaggaagcccttcttaaagaagccattcatgtcatgaactccagatatgaagacagaactctctggggatatgaggtgggtttgagctatggatccatagcaacagatactctgacaagtatgaagatgcattgtggtggttggaggtctgtatattgcatgccaaagagagatccattcaggggtacagctcctatcaaccttacagaaagactcaaccaggtgctgagatgggcagtgggatcacttcagatcctattcagcagccattgcccacttgtgtatggcctcaatggaggaagactcaagggactccaacgaattgcctatattaacagcactgtctaccccttcacctcaatacccctcctaatttattgtaccattcctgccatctgcttgctcactgataagttcattacaccatcggtaggcacttttgcaagcctgatcttcattgcattgttcatctcaatctttgcctcggcgattcttgaattgagatggagtagagttagccttgaggaatggtggagaagccagcaattctgggtcattggaagtgtgtctgcaaacctctttgccgttttgcaaggcattatgggagccctgccactttctagtagagtcaacaaaaacttcagcattgtatcaaaggcaccagatgaggtagagtttcgtgaactctatgccattagatggactgcacttctaatacctccaaccacaatcataataatcaatctcattggtattgtggctggcttcaccgatgccataaacagtggtgaacattcttggggagctttgcttgggaaactgttcttttctttatgggttattgtccatttgtaccctttccttaaaggtctaatgggtaggcagaacagaacaccaactcttattgtcatatggtctgtgctcttggcttctatcttttccttggtttgggtcagagttgacccttttgtgttgaaaacaaaggggcctgatgtcaagcaatgtggaatcagctgctga

SEQ ID NO: 63279 - DNA, 867 bp, Glycine max
  Peptide Sequence Number=SeqID_180057
gtggagtttattttctatatggatatggtggcacaggcaagacatttgtgtggaaaactttatcatctgctatacgctctactggcggcattgttttaacagtagcttcaagtgggattgcctcaatactattgcctggcggtagaacaacatattctaagtttgctattcctgtccctgcaacaaaaaattctacatgcaatatctatcaagggagtgatttggctaaattgttgcatatcacaaaactcatcatatgggatgaagctccaatgtgtcacagatacaatattgaggcccttgacaaaagtttacaggacatcatgcacaatggcaatccttttggaggaaaggtcattgtttttggtggtgatggtaaacttgcagaaccaaatgatggttatggtgaaatcaccatcccaaatgagtttcttatcaaggactttcaagatcctatccaggcaattgttgaagcaacatatccatacatattacacaactacagcaatggcgatttattgcaaaaaagagttgtccttgcctttacaaaagatgttgttgataaaataaatgactatgtcctgtctttgattcctggtgaggagaaagagtattgtagtgctgattctgttgacaaatcagatgaactactcagtcctgcatttggagtactaacagctgaatttctaaactcattgaagatatcaggcataccaaatcacaagctcataatcaaggttggtacgcctatcatcctactacgaaatctggaccaagctgatgggttatgcaacggaactaggcttattgttacaagacttggttcaagtgttgttgaagcggcgattattactgggcccaacatag

SEQ ID NO: 63280 - DNA, 201 bp, Glycine max
  Peptide Sequence Number=SeqID_180058
atgtgggacagtgtgggagaatgtgggtgtcaagggagctgtttccagcagatttcaggcgggaggagaaaaagaagagcgatttcaggcaggcagacaaagagaatagggagggcaaggtccttaaatgaccgctcaatgatgaaggaggcagggatgcagagactaccaagaggtttgcctagaagtggccacccttga

SEQ ID NO: 63281 - DNA, 267 bp, Glycine max
  Peptide Sequence Number=SeqID_180059
atggagtatcgctcccctggctccaaaaccaccaaggtctccaagaagggccacatcaatgcgaccatcaggctgcctggtcaaggctttatgccattggcgcttctcgagctctcggcggaactagtcatactctgtgatgtggaggttaatattcctctcggggaggatgttccacgaatggacgttttgctcataacgctcccaagcgacctcggagatgaatctcatcgtgtcatatggttcctgaggtcgggaggcggttga

SEQ ID NO: 63282 - DNA, 630 bp, Glycine max
  Peptide Sequence Number=SeqID_180060
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatggccggccggatacaggaatcaaccgccgtcactgaaggccacgaccctgcgccgctgccacttcggcacctgggcgcctgcctggcagcctacttctgctgggccggtggctacatcatctatctcactttcatttttgcgtggctgcgcgaccacggactgtcctggcagcagggcatcgccgtgatcaagcttatcgataccgtcgacctcgagggggggcccggtaccagcttttgttccctttag

SEQ ID NO: 63283 - DNA, 246 bp, Glycine max
  Peptide Sequence Number=SeqID_180061
atgtcgcagaacttcacggatttcttaacgatgggtgtcaagttcctcgaagcggtcaagcgaaggttgcatgtcatcatacaatggtccccggacgaaattagggcaatcaattcgtggggctccagactcaatggtggaggatgcatgaacaatgctaggcaatcaattcatgggactccggactcgatgatggaggatgcacgaacagcgctcgacaatcaattcgtggggctccggacatga

SEQ ID NO: 63284 - DNA, 219 bp, Glycine max
  Peptide Sequence Number=SeqID_180062
atggcacaacctccaccccgtgagaggactctaagggaaatggctagacctgatttcacctacgaaagcttgtgcatccaataccctgatgaatatttcccatatgttcttaaaattggactgatccatttgcttccaaagtttcacggccttgcagagggagtgacaaaggactgggctatattaccttgctccaaggtccatcacaagccgggatga

SEQ ID NO: 63285 - DNA, 195 bp, Glycine max
  Peptide Sequence Number=SeqID_180063
atgaaattaagggtcatggtagctcgcccaggcgagctgttgctccatcctgaagtaagctggctcgcccaggcgagctgggaagtaaagataaggacactaattttgttcgagcgatctagctattcgacagggcaattggaaaaaaccaaggaagtgaaaccaagaaaacatgaggacattaaagttctgtag

SEQ ID NO: 63286 - DNA, 663 bp, Glycine max
  Peptide Sequence Number=SeqID_180064
atgttgaaggatgtgagtgacgcgaataggattcgtcccttctccataacaagagttatgcctatggatctcttgataaaggaaatttcgagtagtgggcagagaggttcatgggacctaggggaattagcgagtggtgactacccgaaatttgatgcactcatttggcgtgagaagtttatagaactcactttgctattcctgactagctttgagactatgctttttgagttgagagctggggatcgatgtacaatgtatctgtatgtggtgatcacccctgactgtcatccacataaaaatgtaagaccatcatgcgcatgggtcgactcacacttacaacaaccaacttttcaggagcatgtcatagagcatccgtggattttgttcacatggatcaataattaccactacagttatacgttagaggaagaggaggaactagtagatctaccttctttacaagataaggttgtcaaagtctacaagaatgtgggagattttatcaacaatgaagatctcacgccattcgagatcactttctattggggtgttttcgatgaaaagatatccggggaagcgatgctttcgtccgatgaggaatgggattcctcaggaaatgagagcgacccttctgaggactattttccctttttgatgtag

SEQ ID NO: 63287 - DNA, 375 bp, Glycine max
  Peptide Sequence Number=SeqID_180065
atggccgtctcaggcacagtcatcgttcttgctctgcgcctccaacgatctttcctagccatccaattcccggttcatgaaatttctcacccatctactccaattctgcgatcttgcatatcctcagttcggaacaagagggagaagaagagggtgcactttgcggatgatgtggtggattcatgtggggacggagaagagttcaggaggcagcaacgtgttaatagaaacttttggtgttcaaaatcagaatctaaggttcggaagaattgtgaaggcaagagtgatgttagaggaatgccagctaatagggtagccctctataatggaattctcagggatcgtgtggcccaaagaatgacttactcgtactga

SEQ ID NO: 63288 - DNA, 558 bp, Glycine max
  Peptide Sequence Number=SeqID_180066
atgaaggttgtagaagaagatgctaagaaagaagctaaaaagaaagcaatgattactgaggtccttgttgatcccactatctctagtgcactacaagaagatggagaacaagtagtgtcccctttggagtccaatgcaacaaagactaatgaggttgttcaaacatgtcaacatgaacctacatctaagcagattgacaccttaaatgaagcctcttcaatgcaaaaggaggttcccattgctgttgttgtcttctcttgcaaatcaaataatgttccaattaactttgttgcccccagtagcttacttgaagatcgcgtccaagcagtgcttgatctagctttgataagaatctacaataagctcaacaaaacatgttgggaaggacataagggaatagaaggaataaacaagaatattcctcttcggttattttctctaaggagaagaagcacatgcagttgtttgtactatattctttctctctccgatcaaagtgcaacacgtggcactacctccaactatgagacaatggtcatatcaagaaaccagtgttga

SEQ ID NO: 63289 - DNA, 1206 bp, Glycine max
  Peptide Sequence Number=SeqID_180067
atggacctaatggtggtgtacctggacgacgagcgttgtgcagttgaagacgctgctcgaaaatttgaacgcctagggaatcacgcgatggagcgcgtgaggggatggtgcgggatgaactctgaatcaaagccattattgttcccaaaaattattttcctccgtcatcaagctccaccatgcagccacacaggttcacaatctcctctgtcgtggcatcaatctagtgctggaggcacttctcctccaccagccacgcgttccgatgcgaggttgttttgggaggaggctctgatggagtgtaacctaaatgagaggaggaagacagaaagtgaggtggtggaggagaatgaagatggtaacggagtgaagaagacagtccgtggaaggagaagtagtgaatgcaaagtggtacgcatttcgttgtgtgagaaagaagatgtgttgtcgcttgagcaacagcctggtagggttgctgaacctgctctccttcctcctgtcgatacccattctggtaaccggcgtgtggctgcacaagcaagcggaaacggaatgcgagagatggctggagaagcccctcatcgtcttctcggggcgtgttgccgcctctcgtgcctcctctggctctacctcttcgtcatgttcatcctcatcatcgttgtctccgccttcaccgtcttcgcattcgttgtcaccaacaagggcgctggcgaggtagtttctaaccgcggttacagggagtaccggcttggcgactactcaaactggttgcagaacagagtgaccaacccccacacgtggaaccggatcaagagctgcctccagtcggccaaactctgcgacaaattcgaaactcaatttgccaacgactccgcgcagcagttctacgcggagaacttgtccgcgctccagtccgggtgttgtaagccatcaaacgactgtaattttgcgtatcagggtccatctgtctggaacaagactgatggtgtaaatcattccaaccctgactgtaatgcttgggacaatgattccaatgttctgtgcttcaattgcgaatcttgcaaggctgggttcctgcagaaccttaagactgactggaagaaggtgacgattgtcaatgtgatattccttgtcttcctcattattgtgtactctgttggttgctgcgcgttccggaataacatgagaggcaattggaagtactag

SEQ ID NO: 63290 - DNA, 324 bp, Glycine max
  Peptide Sequence Number=SeqID_180068
atgaagcaaatagcctcaaggaaaaccatctccatcaatattccacttgcaaccattgctagaagccatatggatccttcaatggacgtggattcccccttcaaagctcattctaatcaatccagccaatcccatctcgcatatgttgagtactcaacgataggtggcatttttgctcaaatgtatgctttaaatcaggctataacatacccacctagtcttcataccagtagaaccattgacattttgatggtgcatgatcgttattgcccaaggctacctctaaaggatgaagggaaaaaaaggcttcaaggtctactttga

SEQ ID NO: 63291 - DNA, 288 bp, Glycine max
  Peptide Sequence Number=SeqID_180069
atgtacgacactgccaagattaatgaggttctcatttacctcactatatctagtgttgtgcatgaagatgaagtacctgaagtgtcctatattgcgtccaatgctgcaaaggctaatgaggtcattccaactggtccatctgaacctgtgtccaatttagttgccccaagttccttaatagttgataatgttcaagctaggcttgatatggcattagttaagcaaaaggaggagactcaaacgatggtgaatgaagctcaggaaaagcaatatgaaaatacacgatga

SEQ ID NO: 63292 - DNA, 585 bp, Glycine max
  Peptide Sequence Number=SeqID_180070
atggagacaataagttacaacattgagagctctagagaatctggattacatgtcccttctggagctcattggaatcttgaagaatgtgaaggttacaacaggtcagcaaaaaccttaaatgaaaaacttttgaagaaagaagatttaaaggatcagcctcaggatgttataaaacattgtgaggcgattgacaccttaaaatctacattgaccacgtttgttagtagaagtgaaagtcttgacaatctaataagatattatagatgtctcatagacagatctagcaatgtgtatgaaggaataatttatgttcacgatgaagatattgttgtatgttacgtttgtggtaaagttgaacatatgacgtccaagttcaggaatcgatccagaaagggtgcatccaatgcatttaaaactactaaaagaggacctaaaaagatttgggtacctaaggaaaagataatccatgttgtagatgtccttggcagtaggaacaaaacacctatcatggtacctggacaatggctactcacgacacatgacaggaaaaaggtgtatggtccaatgcttgactccctatcatga

SEQ ID NO: 63293 - DNA, 540 bp, Glycine max
  Peptide Sequence Number=SeqID_180071
atggccaatttcaaggcagttggtatcattcccaaagacctcacttggcagcaaaggaagaaatttttccatgatgctcgattttatatatgggacgatccatacttgttcaaggtaggtgttgataatctccttagacaatgtgtgacaagtgaggaggccaagggcatattgtggcactatcataattcaccatgtggagggcactatggtaatgaatacattttggtggctgttgattacgtgtctaaatgggtggaagctgtggccactccaagaaatgatgctaagactgtggcatctagggagcaaagaaagattcagctcttggagttagaagaaatgagacttatagcttatgaatcttcaagactctacaaagaaagagtcaaggtctatcacgataaaaagttgttgaagagagactttaaaccaagacaacaggtgtatgactcgctaagcgcatcatgcttactcgctaagcacagtatacctgtactgagccctgcttcgattaagccaattcatgggtttaattga

SEQ ID NO: 63294 - DNA, 453 bp, Glycine max
  Peptide Sequence Number=SeqID_180072
atggtggttccaaagtcgaaaaagatgcaaagacaagctgaatctaacaaggaacaagcggttcctctcggtgtggagtttcgacggagaacaacggcggtccgtggcggccaccggtggttgtgggtggttgagaagaagcttgggacgttggggaaggattttggaagaaagaaggagaaagggatggatgttttccaaggctacacaaaaaataacatttgcaactctcgggaaaggaagcgtttctcacacgccagatgtcatatcgcagattgcaatggtcagattgtggatgtctatcctgtgaacctccagaccaaatttctagacgatccaacggttaacaaatgcaggagagcatttttaccgagacagcttcaagtagcttccttgagaggcttccttgagaaacttcctcataaggcttctttgagaagcttccttgtttga

SEQ ID NO: 63295 - DNA, 168 bp, Glycine max
  Peptide Sequence Number=SeqID_180073
atgagaaatcgcttctgcaagctctgttctgtgtccgcgacgccaggcactggttattttgggaaatgcaaaaaatgtgaaaggaatctagctgacgtggcaggttcgttgaccgttcagagtttgcggaccctaaccggcaccatcacgctggcgccgtggcgttag

SEQ ID NO: 63296 - DNA, 180 bp, Glycine max
  Peptide Sequence Number=SeqID_180074
atggctaagcatttgagacaaggatcattttttattgatttaattctcatcgctactgacatgatatccaatggtaatggcggcaacaacggtggatatcatattagtaacgacgacgataatcataacgacgatcacgatattggtggtgaaagtaatgatgacaatagtgatggttga

SEQ ID NO: 63297 - DNA, 585 bp, Glycine max
  Peptide Sequence Number=SeqID_180075
atgaccacattttctgggttgtcgtttgaactcaatggagatggagttttgtacaccatctctaataattatgactcacatttgtcttctatgttttcagagatgcttatccaaccatatccaacccaacatgaaaaaggttttcagagatgccttcaagaggtgggtgcaggccaccacaggggttttgaggctcacggagacaacctacgacaatgccgacatcaaggtagggttcagaatattcaacaatatttaggaccaggggacatacgcctcaaaggtgccatatggtcgctgccgagtgaaaacgagagcctgtcgtgggaggacggagttttggacttggagagtgcggcgatgcatcagatagggcatcttctagggcttgaccactctaacaaagaggactctgttatgtaccctaacgtattgccatggcagcaacgaaaggtggagctctcggtttctgatatggaaaacattcagcgtcactacactaacggcatctctggccacagtgggcgttggggagtgcttttaatgaatatcttgtctcttggatttgcttacgagcttctttaa

SEQ ID NO: 63298 - DNA, 354 bp, Glycine max
  Peptide Sequence Number=SeqID_180076
atggattggtcgagaaggataaggaataataggaatattggacgtaggtacggtttcatcttgaagggtagcacacacggtttgaagggtcttcaattcatcattaacaagttgcccactaggaataataagtacgggctcaagtttcaaggttgcccattagggataacaagtgcgggctcaagtttccagcagtacaactattgcatgggggactggttttgtgttgctggctgcggttttgggtttggagtcatttggcacttgctcttgttcttggggagtggggacaacttgtccattaaagttcatgcatctgatagggtcggggtcagcagtggcgtgacagggtga

SEQ ID NO: 63299 - DNA, 123 bp, Glycine max
  Peptide Sequence Number=SeqID_180077
atggagaaaggtacaagtcttcctatggagaaaggtttcaagatcctgttgtttcctatcattgatagtctaggaaatcccttaagaatttttttacatgtggtatcagagcttgtgttatga

SEQ ID NO: 63300 - DNA, 370 bp, Glycine max
  Peptide Sequence Number=SeqID_180078
atgcaggaagagaacgtcaatatcatgctgccctcattagcaggattaacaacttcaaaaccgctgctaggaatcttttatagttgtaggctggttgtgaaatttgaaggagccacaacactggatgaatataggaagcacatcgaaaaggatccagctctggagaggcgattccagccagatgaaaccatacaaatactgaaaggacttagagaacgctatgaaattcaccacaagctccgttatacagatgtgcagctgtcacatttgaacgttctgctcccttttcgtgatcgatttttgtcagacaaagctatagatttaattgatgaagcaggcaggctctcgagtccgtcttcaacaggcacag

SEQ ID NO: 63301 - DNA, 168 bp, Glycine max
  Peptide Sequence Number=SeqID_180079
tttatggtatttgcgatgaaaatgatcatggcagtaatatgatattgtatgatgttttatcgatcacggtggtggtagaagtaacaatgacaataatcatgacaatggcgattggcggtggttgcggtgacagctatgatagttgtgacggaaacgatcatgacggtg

SEQ ID NO: 63302 - DNA, 381 bp, Glycine max
  Peptide Sequence Number=SeqID_180080
atgaaaccttgtggttctgttgggaaggggcaaaattttgctttccctatcagaagtaatggtgctgagctttgtaagggacgcattgtgagaagtagagtcaacttaagcggagattggaatttcatgggaggatccagaattattgtgaaaccaacagctacaagattgcttcttcattatccaaaaaggggtcaaatgaaagtttcatttttccatttctcagagcttcttacaggtgaacttggagattttgctattaggtctctttgctttaaacttactcagtggtctgctgtaattttgacccttggaaaatttccctgcattctgatttatataaatatatcactggtggaagctgtttcttcatcgatataa

SEQ ID NO: 63303 - DNA, 402 bp, Glycine max
  Peptide Sequence Number=SeqID_180081
atggagagtagtataccgtatgtagtgcttagcattctatatgcatatttgttgtacctttcttggacccctgagacagttcggttgatttttgcaagtaaatacttgctaccagagctgcctggtatagcaaaaatgttctcgagtgagatgactttggcctctgcttggattcacctgttggttattgatctttttgctgcaaggcatgttttccaagatggactgaagaatcagattgaaactcggcattctgtttctttttgcttgttcttttgccccattggaattcttactcatgtcatcaccaaagccatgaccaaacctgccacaaaagagggtcatggtactttatatctgtcacaaggtggcccaaagggcattgcaatggcaggcaattga

SEQ ID NO: 63304 - DNA, 324 bp, Glycine max
  Peptide Sequence Number=SeqID_180082
atggctatatgtgtttctgggtcgcacacactttttgtgaaccgttccaatttgaagactgcggcggttatgagcagagagaagaagatgcgtgcccagtacgatctgaagcaagggaagagtcgtaatttccacgagctccccagtggtctaagcatggaggtgattgtgcaaaagggtgctgaaaagaacacaaatgtcgaataccctcctatggtttttgttcatgtaagctactacgctgctcggtgctgggctgaacactggttgcccttcttttcatcttctggccacgatggctatgctattagcttgttaggacag

SEQ ID NO: 63305 - DNA, 267 bp, Glycine max
  Peptide Sequence Number=SeqID_180083
atgaccacattgaaggatttcataacaaagcataatgttcctcatgatgtcccagatgagtcattagaagcttcttcagatgatgatgatgctgatgatattcctgagaagcctcaagcgaagtcaaagaaaaccaaactacaaaacgtaccaacttatagcgttatggaagcaaggttatgtttcactgttcataagttttcagttgtttttttctgtctgtctctgaaaattcaagatacaaatgctgggtacaatggtgtttga

SEQ ID NO: 63306 - DNA, 333 bp, Glycine max
  Peptide Sequence Number=SeqID_180084
atggaggatcatgttgttaaaagatatcaagagctaatgaaagaaagttcgaggatgtcattatttgatttaagaaagctgaatgcatcacttccagttccttcagtgacaaactgcccttttgaaattcttgtgatggatgcaaaggatgacttcattgtggatacagagggactcgtagaaacagcaaagttttatgatgtgtcaccagtaagtgttgaagcagttgctcatgacatgatgttggatgtttcgtgggagaaaggtgcaaaagttattctttcatggctaaagggtctagaaaagtgttctaagcttcaaggtaggcaataa

SEQ ID NO: 63307 - DNA, 141 bp, Glycine max
  Peptide Sequence Number=SeqID_180085
atgacaaaagcacccccaagtaacgcagaaacgacggcgttgcatgggtcggtgcgactactaaagtctaaagaaggagaggaatgcgagaaggaagtaaaggcaccatgttgttgccatcacggggccacgcgtaagagg

SEQ ID NO: 63308 - DNA, 390 bp, Glycine max
  Peptide Sequence Number=SeqID_180086
atgtatccgtttatctccatgaaacttcctttttaccctgaattggttaaagccttttattctaacttggaaattcaagaagattccttgatttccgaagtttatgggattaagatggtcatagaccaatcccttttctttgaactcactcaattatccagtgacggtgtaccatttgagggtacacttgatgatgagtggaaattcgatttttctatttctgatgcccgccagatggtttgtaccaaccaagcggatatgatcggaaggcttattgccggttcattggcattcgaatgtcacatcatgcacttcttgattgtgcgcatcctactccctagatcatccaaccttgcacaagtttctgaggaagatttgacaattatgtag

SEQ ID NO: 63309 - DNA, 265 bp, Glycine max
  Peptide Sequence Number=SeqID_180087
atggtcgagtttggaggagaaagaggaattagggttagggcgataaagtttgtcatatttgtccaccatgtgttcgaggttgttgtcattggtgacaaagatgagggcgtcgaggtcttcgtcggagagctgggcggtgagcttagagaggaagtcagggaacttaatagagtggtcgacaatgaggatcttggtctcaacaactcgatctcgcatgagcttggtgaggactcgcttgagtcaaggtaccatgagagcaagagag

SEQ ID NO: 63310 - DNA, 528 bp, Glycine max
  Peptide Sequence Number=SeqID_180088
atgtgggtgtcgagggagcggtttccggcagatttcaggcgggaggagaaagagaacagcgatatcaggcaggaggatgacaaagagaagagggagggcaagactcttaccaggccagtttcaatggaggaggttaagcaaattgtattctctatgagcccttgcaaggctccaagtccagatggcttccaacaaattttttccaggacttattgggacattgtttccattgaggtcagggagttgataagtacaacctacacaactggtttagtctataggctttgcccaagtatgtactctctcattgatccttttcatagcagttttattcccaatagaagtactactgataacacctttgttgctcaagagattgttcataggcataagaagaaaggtaggacagactatctcttttttaaaattgattttgaaaaggcctgtaatagggttaatttgatttcctcagagccactcttttacatgcaaaacttatggtttccggagttatttgcaatcaaatag

SEQ ID NO: 63311 - DNA, 147 bp, Glycine max
  Peptide Sequence Number=SeqID_180089
atggactttgaatgcagagaactccagtgtgggcataggggacatgtagaactgcattcgtcagtcaggggagcaatcgtcgctatccatcacgtgacggaggtgcttgccggtgcggaaggcttgggtcaaaccttacatcgttga

SEQ ID NO: 63312 - DNA, 225 bp, Glycine max
  Peptide Sequence Number=SeqID_180090
atggaccaattaaagcgcctaagcatcccctcagaaatacttagattctttaacctcgcttgtcacccacgcctaggtcatccgacaaggtcagtgcacttaccccccatgaacatacaatacatattgtcgcaacctacccttcggcgggagggcgacacgagactcacagacgcgtcttccaagaaaggaaaatgcgcggaatcgccaccaacgtttatttga

SEQ ID NO: 63313 - DNA, 201 bp, Glycine max
  Peptide Sequence Number=SeqID_180091
atgcgttctgcgaaatttcgactggcccagggcaccgttactcttttttcgaatttcactcctcaaagagggattggtggtggtattgttttttgcgggggttttttctccaatggtgcagaggaatatgtgatgggttctgtggagagtcagggtttcagaggtgtggatgagcgttttggagagtgcttctcctgttga

SEQ ID NO: 63314 - DNA, 913 bp, Glycine max
  Peptide Sequence Number=SeqID_180092
atctactgcaggtgatttgatccccatcgttttggagattaacgctacttgcaggaggcgcaatgcagagaaaaataggaaatttttgcaagacttagaagcagcagcaactccagaagaaaaagctcgatcttccgaggtgtcttctagatttcctattccagggaaatctcatatagatttaattgaagaagttatcatggctgaagagccaaggagagtgaccctagaagattactgtcaagtgtgctgtaatttttcaccagcattgcacaaccaaagagaagctaagaggtggcttcactcgttcaaaggcaacagtcttaagacttgggacaaagtggttgagaaatttttgaagaagtatttcccggagtttaagactttgaaaacccctgaagaagccatggatcttattgaaaatatggctgcaagtgacatttctattcttaaagatagatcccacataccaacaaagaaaggtcttctagaacttacatcacaagatgcgttgttggcacagaacaagttgttgtccaaggaattggaagcattgaccgaaacactaactcataattctggttgttgtatccccaatgaagaaccagtttatgaagccaattatatggggaatcagccaagacaaaatttcaatgcagtcccagtgggacagctggcaaaacagttggcggataggctgtcaagcagctttagtgctaacactgagaaaaatccaaaggatgaatgtaaagctgtaatgacaaggagaagaatgccaattcaggctgatgaaagtaaagctgaagagaaggtggagggatataaacaacagctagcagctgagccaacactggaaccagtttctgattttgttgaacttgaggaagttgtggaagatgaagatgaccaatag

SEQ ID NO: 63315 - DNA, 686 bp, Glycine max
  Peptide Sequence Number=SeqID_180093
gtgaaggtggaggagttgtcaatggagggcaaggtcatggcagtggttttggtgcaggtggaggagtaggaggaataggaggaggtggtggtggtggtggaggtggaggtggaggagttggcaatggaggccaaggtcatggcagtggttttggtgcaggtggaggagtaggaggcattggaggaggtggtggtggtggtggaggtgaaggtggaggagttggcaatgaagggcaaggtcatggcagtggttttggtgcaggtggaggagtaggaggcattggaggaggaagcggtggtatgagtggcatgggaggaggtggtggtggtggtggtggaggcggaggtggtaatggatggcaaggccatggttatggtagtggtttcggtggaggtacaagtaatggaggcatgggaggaggaggaggtggaggaagtggtggtggaattggtaatgaagggtatggtcatggtaatggctttggggctggcattggcatgggcgtgggtggagatggaggcaaagaaggagattataagggtagtaataatagcaaaggtggaagcaatgatcatggtgttaacaatggctttggaataggatttggtatgggtcttgggtttggttttggcataggaagtaatggtgcaaaggtcaccaatcaaggtgatgtgaatgatccttag

SEQ ID NO: 63316 - DNA, 441 bp, Glycine max
  Peptide Sequence Number=SeqID_180094
atggtgaaagaagaaacaacttttggaaaaaacaatttcgtggttgcaatcttcggacttctcttgcgtcggaaaaaccacgtgattgtgttatcgacgggtgcggtttctgttcttgttaatacgttagcttctccgggtaatgctaatcttgtaactgattccttggacattctagtggcattggtggagagtgtggaaggggcttatgcactgttacgagttgaggcgttgcctttggtggctaagattttgcaatctgctacttcgcgctcaggggaggatgttctggccaaggagacttcgattatgtcttcgctgtattcgcttttgacggatggtactcttcacgcggccaagaaagcacgtgcactcatcaatgttatacttaagttcaacgagaagagattttctggaaccgtgggttcctctgtctcgtga

SEQ ID NO: 63317 - DNA, 579 bp, Glycine max
  Peptide Sequence Number=SeqID_180095
atggcgttgctaaactcaagtgatccaatcaaaatattgaagatgattgacaccatccaaaggttaggaattgagcatcatttcaaagaagagatcaacgtacaacttggaaagttaggagattgggatgtcactcaagacctctttggcacagcccttcaatttcgcctacaaagacataatggctggcctagttgttctgatgttttcaagaaatttttggacaagagtgggactttcaaggaatcaatcaccaatgacatttggggtatgttaagtctatacgaggcatcatatttaggtgcaaaaggtgaagaagtactacaacaggccatggacttctccaaggctcatctacaccagtcactgccacacctaagtcctgaactacgaaagcttgttgccaaagccttaacacttccaaggcacctaagaatgggtaggttagaagccaggaactacatggaaaaatatagccaagcaactaaccaaatacctgctcttatggaattggcaaagttagactttgccatggttcaatcaatgcaccaaaaagaattagcagaaatctccaggtaa

SEQ ID NO: 63318 - DNA, 666 bp, Glycine max
  Peptide Sequence Number=SeqID_180096
atggagcaattgcctgaatatatgaagatatgctatatggcattatttaacaccacccatgaaattgcatataaaattcaaaaagagcacggacaaaccgttgttgcttgcttgaaaagaacatggatagacatatttgaagcttttctaaaagaagccaaatggttcaacaacggatacatcccaacttttaaggaatatttggataatggggtgatttcttcaggatcatacatggccttggtgcatgcaacttttctcattggggattccctatcaaaggaaaccatttccattatgaagccatacccaaggcttttctcttgctctggggaaattcttaggctttgggacgacttgggaacctcaagggaggaacaagaaagaggagacaatgcttgcagcatacagtgtctcatgacggagaataatctttcagatgaaaatgttgccaggaaacatataaggcaactaatacaaaacttgtggccagagctaaatggtcttgctatgaccacaaccgctctgccttcgtcggttatgaaggcttctcttaacatggctagaactgctcaggttatttatcaacatggagatgatcaaaacacatttacagttgatgattatgtgaaaacattgatcttgacaccttcttccaactattga

SEQ ID NO: 63319 - DNA, 423 bp, Glycine max
  Peptide Sequence Number=SeqID_180097
atgacaaccaaaggaattgcacttaaagccttatcttcaattcaagaagaaagtgacaaagaggacttgaatgaaatagaagaatatgatgatttcagactctttgtgaagagattcaacaaatttctaagaaacaaaggaaatcaaaggagatcaaatatcaatcgaaagaagaaaggagaagattcctccttagccccaaagtgctacgaatgtgatcaacctgggcacttaagatttgactgtcttatctttaaaagaagaatggaaaaatctgacaagagaaatttcaaagaaaagaaagaaaagaaagcatgcatcacttgggaagataatgacatggattcatcaagtgattcagaaaatgaaatcataaatctcgatctcatggccaaagactatgaaagcggagaagagaattag

SEQ ID NO: 63320 - DNA, 102 bp, Glycine max
  Peptide Sequence Number=SeqID_180098
atggagcaaaatcctgaaaataaagtgaaatgccaaattgtagacataatggaagagttatcagcctctgaatcacctactaactcaagtgctcaggtttga

SEQ ID NO: 63321 - DNA, 1005 bp, Glycine max
  Peptide Sequence Number=SeqID_180099
atgtctgtctccgccatcttactgcttgttgaaatattatcgtccattggagtactagaatttacagctgcagcaccacttgtagcaccaattgtaggaatttgctatggaataaacggtaataatctaccatcaaagcaagaagttgtggatatgtttaaatcaaggggtatacccagaatgcgcatatactctccagatgaagaaataattcaagcccttagaggttcaaggatagagttggtgatggacgtggctggagataccattcaatctcttacagatcccaatgttgctgctgattgggtccatcgttatataacatcctattcacaagatgtcaatttcaagtacattgttgttggaaacgaagttcaccccaattacgatcttgccccttacattttacctgccatgaccaacattcagaatgcaatttcatcagccaatctggtaaccaaggtgtcaacagcaatagacaccacgttggttaccaattcctacccacccaacaacagtgttttcaccgcagatgcaagcccatacatagggcccattatcaatttcctagtgaagaatgaagccccacttcttgccaacttgtacccttactttgcttatgttaataatcagaaagacattgatcttcactatgctctttttactcaacaaggaaccaatgatattgggtaccaaaacctcttcgatgctatgttggattcaatatacgctgctcttgagaagataggtgcacctaatttggaggttgttgtatctgagagtgggtggccatctgctggcggagacggagccttggttgataatgcacatgtttattactttcgtttgataaagcatgcctatagtgggagtggaactccaaagagaccgggtaggcctatacaaacatttttgtttgccatgtttgacgaaaaccaaaagccaggtgcagaagttgagcgacattttggtatattcaatcctgataaatcacccaaatactga

SEQ ID NO: 63322 - DNA, 144 bp, Glycine max
  Peptide Sequence Number=SeqID_180100
atggtgaatggcttggacaagtataatggagttggacatggatccatggacatagggatcccttgtatcgaaagtcttcctagcaagaatggaaaagttgaacaccatataagtgaggataaaacttataaacctgagccttaa

SEQ ID NO: 63323 - DNA, 273 bp, Glycine max
  Peptide Sequence Number=SeqID_180101
atggataagtgccaaagacgatctccacaatgtggttgcagtcacggaagcgcaggcaactttgacacaaggagaaagaagaagaacgatagggttcaagcgcaaggagaaagaagaagaacgatagggttcaagctcggtttttacaaaaccgatgttaacaatggcatactaacatcggttttgaaaaagccgatgttaactaagtctacttatttacaaaaatgtcaccgcgctttcgttaacatcggttttagctataaccgatgttaa

SEQ ID NO: 63324 - DNA, 435 bp, Glycine max
  Peptide Sequence Number=SeqID_180102
atggaagctagacaaattggagaaaatggatcagggagaaagggggtcgaggaaagtgatgtagagatcaaagaaaatgaagaggttttaaagaagattattgcaagtcatcctttgtatgaagttttgattcaatcccacatcaactgcttgaagactctagtgtcagtgctagatgggtcaataatatttggaaaggtgggattaagcgaagctggagagtttgatgcaacaagtgaggcatggaacaagctggttaactcgaagtccaaagcaactccaagtccaaacacttcagagttagatcacttcatggaagcgtattgcatggcactgagcaagctgagggaagcgatagaggaaccaacaaaagaaaccaatgctttcatcagagctacgtatcttcaactaaaggaactcaatgaactgaattga

SEQ ID NO: 63325 - DNA, 571 bp, Glycine max
  Peptide Sequence Number=SeqID_180103
acctgtctatcccctacaaggtcaccacatttgccccgagaaagggaaggcgaattgggagcacctcttggccaatatggtagaggcatccgttaattggttcccccgatggaaggaaggaagagtcggggttttgtcctcatgtgaggggttctcaaacatccccttgatgggaatgaggggttgtatcaattacaatctcatccttgccataagacaacttggttatcccatgagaagagcatccgcaatgcaaaggaaggatagggagcttacgggaagcagcaatgggatcatcggcaactatcacaagtggctgaaaactaaaacacaagagttagattggctctcgaagctaaaggcttcaattgaggaagaggctaaaacccctaaggagagtgaggaggtgcaagccttaaaggtggaacttgaaagggcacaagaggtcaaggaaaagttcaagacaacggccatcaaggttcagaaagaatgcaacaaactgagaggcgtcaatgtggccaccgtcgaagcattggaacgggaaacaaagagggcccgaaaggaagaatag

SEQ ID NO: 63326 - DNA, 198 bp, Glycine max
  Peptide Sequence Number=SeqID_180104
atgactgatgtgattaatggggctgttcttgttcttcaacttgccaaggctgctcaacttgttactctgaagggtgcatcaagtgccgctttgaggattgcaattgccaagaatgcagagactttatgctatatgctgaaccttaactgcgctctgcaaagtgccatttctgacttgactacatttgcacctacatga

SEQ ID NO: 63327 - DNA, 306 bp, Glycine max
  Peptide Sequence Number=SeqID_180105
atgattgatcaaacaagcgcagcggaatttgaatccgtagggggtgttcttcagcacagggcccatctaggcccatcaggaagcttcaacaggaagcaaccagctcgcctggccaagcaaggttacttttggaggaagcctccagctcgcctgggcgagctgagtggcaacctcctcccctattttggctataaaagggtgtgggaggctatagggaagggttcaacaccctgggaaagcatatttcacttaaaattagtgaaaaggagaaagaagaagaaaatcaaggctgaagcgcttccgtaa

SEQ ID NO: 63328 - DNA, 507 bp, Glycine max
  Peptide Sequence Number=SeqID_180106
atgcgcatagacgaattctgcgtcctttatcattcaggaagaataagttgggtggtaaacgcgcagagacagattctgcgccttttatcattcaggagcagcgagtcaagtgatttcgcaagttgggtgataaacgagcagagacaaattctgcgccctttatcattcaggaacaacaaattgggtgagacaaattatggtcattccgcgcaccttttcgccatccagaggcgatcgtgtccggtagcacgcagagacaaattatggtcattctgtgtctcgccgcccaggctcgatcatgtccaacaaaacgcagagacaaattatggttattctgtgtcttgtatcaaccaaaaggaacaaattcgacagtatcaggatgatgtgtcggtactgatcattttcaaatttttggaggttctgctggcagggaggttcactggccgaatggtgtttcacttgaacgaaattagtgtcttatctttacttcccttttatctccaataa

SEQ ID NO: 63329 - DNA, 405 bp, Glycine max
  Peptide Sequence Number=SeqID_180107
atggcggggatgagtgaatacacccatatatacgaatatcttgttagaaagtttggttccgtccttcccttatcggatttccaatgtgtcattttgtgtaccctgaactgtgctccatcccaacttcatccacgtttgtccatgcctttgagctcttatgtgaagggttcaacaaaactccaattgtcaattgctttgttgaaacttcatagtgatgaggttgttttaagggattatatatgcaattttattccaattaccgataccgaggatcatcttcatcaaggctacaagcaaaagatgaagttgcaggcggaaacggttggcaaaccttttgcagaagggtcatccagtctgctatttggcgcttcttcaagcttagtgtttgtggttcctaacccttaa

SEQ ID NO: 63330 - DNA, 372 bp, Glycine max
  Peptide Sequence Number=SeqID_180108
atggtggaatgcgctggctggttatcacctaaatcggggtggtatttttcaagagatgaaggtgacgaccagcgtattcaagccactatatgggcatcttcttctgcctatctggaatcatcataccttgccaactcgttggtggacccccatgagtcagatttacatgacatcagagggtctgatgacaaaagagtcatctttgacgttgatgtgggaagaaagggtgccttgtcaatagtgtatttcgacgatgtgcaagatttttctggtagtgaagtagggaatgaagaagtgagggatggagagttcgatggtgagattggtgatgaaatcggtggtgaggtcctagccgacactgaatatgactag

SEQ ID NO: 63331 - DNA, 351 bp, Glycine max
  Peptide Sequence Number=SeqID_180109
atggagggcctcataacccaatgtgctgagtatgttaagaaatttggccttgagatgagtccatcatcagggtgctgctacgagatcaagaatgcagatactccatgtttgtgtcagcacttcaccaaggcattgctggagtttattgacattcagaaggacatttatattcttagaatgtataatgtgagaggcttaactcaaccccaaaagctagctcaagggacttggattatttccaacacaccccctcacgccaagcacttcttgaacttgatgcgtgaaaaacaaatggtgggtgcttgtcatcacaaggcgagggctagcggaagcgtggtcctaggatcataa

SEQ ID NO: 63332 - DNA, 309 bp, Glycine max
  Peptide Sequence Number=SeqID_180110
atggaactcgattgggtgtgcactggttacgcatggatgagccgcttactgatactagcacttcagatgaaattacattacacgtatttctgtgtccgtggttcaattatggaatgtcaaaaggtcaaggatttcatgaaagccatagatgaacagtttgaaacttctaataaggttttggcaagcaccgttatggcaaggttgtcgtctatgaagctcattggagtcaaaggtgttaggaaacacattatggagatgagggatctttcggctcaattgaagtcacttgaagttgatatttcaaagtaa

SEQ ID NO: 63333 - DNA, 882 bp, Glycine max
  Peptide Sequence Number=SeqID_180111
atgtgggtggaacgtttagtcttcgtctttgtcgttgtggtccatgcgttttcggggctagggtttggtgcgattggaggaagattctggtgttacaacttgtggtctcaaaatatgtgttggggtacacatgaggtctttttcatgtatgctggtggagacaaatctttgttgcttgacatagatgaggacaaaaagtgcaatttgcctcctccaatagttgaggaactagagaatgaaggcattgttattcaaccagtgaatgaagccaatgcagcaggagtacctcaaaaaaaccctggttcaaagactatgaaaaaggcaaaattatcatcttcaaggtctgtcaaagcacaaccatctggtatggctacttcactagcacaactagcttctcaatcaacttctgaagcacaatcaccttctcaagcagcttctcaagcagtaacaaggttgtcttttgagagtgcaaagtccaccaagttgggaactggagcacctaccaaaatggtaaggaagtctgaaagatcaacacctattcaaaatgtattccttactagaattgatagcttgaaaaagttcttagagcttacaaaaggccaatctataaataatgtttctcaacaacaaggagatagaagggttgaggacaaggccaaaggtacatcctttgtggtacaagtagagggtacatctacttgggttgttgtaactgagaacaagagagggtacatctcttgtggatcagttcaagtggagggtacatccacttggttgttcaaagagaacaagggaaggtacatcccttgtggatctttgcttgtaaaggattttacaaggttgaaaagaaatctcaaggaccgtaggtcgcttggggactag

SEQ ID NO: 63334 - DNA, 537 bp, Glycine max
  Peptide Sequence Number=SeqID_180112
atgagtaaaggtactcttactgtgactcataataacgggaaaaaggaaaagaaggaaaagaaacacattcctcccattgccaaaattaagaaggagtctacgtgtttttcctataagaagaaggggcacatgaagaagaactgctataagtataagacttggcttggaaagaagggttattctttttcttttgtatcttttgaatataatatgattgatattattcatgatacctggtggattgactctggatctacgattcatatttctaagaccatgaaaggcttctcaagccagaggcaaccaagtaaaggcatggatgtctttaaagttttcaaggcaatagtaaagaaacaatgcgaaaagcaaataaagattgttagattagatagaggtggagaattttatggcaaatacattgaaaatggacaagcacctggtccttttgcaaagtttcttcaagagcatggtattgtggctcaatacaccatgcctggctcatcggatcaaaacggtacgtctaaaagaagaaactaa

SEQ ID NO: 63335 - DNA, 339 bp, Glycine max
  Peptide Sequence Number=SeqID_180113
atgggagataaaccaatcccagctccaaaatcaaaaattgatcttattgaacataagttggcacgtattgagtttgagggaggttttgagatattagatattggcaatggctattttatggttatggatgaaggaccatggatgcttttcaatcattatctcacggtgcaacattggactccaaagtttttatcacccacgataaaggctgagaagacgttcatatggattagatttccaggtcttaatctcctctactatgatgagaacatccttcttgctttggtggaaacaattggaaatccagtgagggtggacagtaacatgaaggacatctag

SEQ ID NO: 63336 - DNA, 264 bp, Glycine max
  Peptide Sequence Number=SeqID_180114
atggaattattgacacaagttggttttcttggcattgcacaaaacacatttttcctgtatgataataacttgatatcaacacttgtcgagcattggaggccaaagacctacacgtttcacatgctagttggagtattttgtagggtttacccgttaacggtggttacaatggttctgatgggtggaggttgggtgcagtggtcatggaggtataggggagaggcaactgcttggaaggggaaggataagaatgaaatattatga

SEQ ID NO: 63337 - DNA, 585 bp, Glycine max
  Peptide Sequence Number=SeqID_180115
atgattttgaagctcatgcaggggttttttgggactggttctgaaccagaagacttgactaaaaagggaaaaagaactaaaggaaccaaacgttatatgcctcagaggaactctgtggcatatgcattgttgataaccctttacaggggaacttcaagcgggaatgaatttatgcataaacaggaactaattgacgcttccgaagcaagtgggctatctcgagtgccgattgcgccagaaaaagggaaaggaaaacctggacattttggaagttcttcacgggattggtatagtggatggagttgcatgaagaccttgatagctaagggattaattgtaaaatcaagttgccctgctaagtacatgctaactcaagaaggtaaggaagcagcacgcgattgtcttgcaagatctggaatggcagaatctatagagatgtcgtcttctgttgaaattccttcttgtatggataaccaaaacttgttggatgtggagctcaatggtcatgacttggaatcagaggtgttgtcacccttgacccagcaaaagaagccaatagatgttcctcttgattgccttgagagg

SEQ ID NO: 63338 - DNA, 372 bp, Glycine max
  Peptide Sequence Number=SeqID_180116
atgggttactccaaggagcacattattggtgctttcactgaagtttccaaaagccatccaaataaagatgtctcatctctgtggcctgctgttttatgtcatcttcgagaggaacaagtctatggttcacagccagaatctcaaaggtccagagacctcattgtaaaagacagcagagctgtgagcttgcatgtgcgaaacatttgttctcatgatattcctcctttcaccttgagagcttgctcatcagctgtatggtttgatccatttgcaaaaattgatctactttttatattgtgtgttctttctaatcggcgcggtgctcctctgcaagttcctgttaggcttgaacgcgggtcacaagcgggtcag

SEQ ID NO: 63339 - DNA, 636 bp, Glycine max
  Peptide Sequence Number=SeqID_180117
atgcaaaatcctaacaaggatgagcttgtatcaaagttgaacattttaaatgtgccaccattgagcttgggggagagatttgaggatgcttatgacgtagttttaattttggatgatcgggagcaatttgccacacagggatcaagatccaggaaaattattgagaatatccgcagccagttcaaaatccagatagaggttttcagtttatgtggaaatagtataataggaaacgaacaaaagataggtagagaaaggagaaaggaagggttcttttattcagatgagcagaaagggaactcaagaggcagaatcctcttacaaggggaagttcgacgattgccagtcggagatgggatttggatagcgcgccataaaactctgaacagtgaatatgtgttggattttattgttgagaggaagaaaactaatgatctatgcagttcaatccgggataaccgctataaggatcaaaaactaagacttctgaattttggtgaagatatcattcagtggctgctatataatttaaaagcatgccatactgacatagcctcctcattccccacttctcaatccaattgctcattgttagaggtgtgggctgaagaagctgatatatcttgtggaaggtga

SEQ ID NO: 63340 - DNA, 717 bp, Glycine max
  Peptide Sequence Number=SeqID_180118
atgactacaccaccaagctcccttcctcctcctgagtcagcacctttgtcatcttcgccgaagaagactagaaaagcaacacagctcagatcattagctaccaaacccgtcgggatggagagactagtggttcatgtggatcctttcgctaggaaagttgatggtccccacaaaaagaaattaaggacgtatttggggattatctctcgatacaagattgaatttgatattccagaagcatccaaccaaaggacaaagaagaaaatccttaagacgagtcgtagagacccttcatgggaggatgttagaaagaaggctcaggccatccagaaagtaaacactgcccctcacgtgttgtctcatggaggaacaatcattgatcctccatctcccattagacgacatgtgaaatggaagctggctcgcactaaaaaatctagagagatgacatctgaggtagcacaggaaattgtagataggattcagtcagcacagggcagctttgttgcccatggacatcaggatgtgctgactactgccattgggcaaccagagcactctggtcatatctgtactgttggagctagtctcacgattagacaatactttggaccagattcaaaaagctcccgcacatctacatccatcactcccaaagagctggagctgttggcacaaaaaattagggaccaactggagtaccaaatgcagtcctag

SEQ ID NO: 63341 - DNA, 216 bp, Glycine max
  Peptide Sequence Number=SeqID_180119
atgaatgtagaattcacagagagatgtctactttggagcttacttgaatggggattcaacgatattcaaggaagtaaattcaaggctactactaaatggattccaattaaatattttactaatccaacaccattagaaccagagagattaaaggcaattcgcattcagtgggcaagatgttatctcaaagttaaaaataaaacactaggtgtttaa

SEQ ID NO: 63342 - DNA, 210 bp, Glycine max
  Peptide Sequence Number=SeqID_180120
atggatgaacatcaacaaaactggaaggaaatggctaacataatgatgaagattcacaaagaatcagatgaattgttcaacactgttcatgttactgatcagccttacggtgaagtgggtaggtcatttgctataagatggaaaaatgaattagaacctatgtggcatctgctactgatcgaggccgtacccgaatcaaataaacattaa

SEQ ID NO: 63343 - DNA, 510 bp, Glycine max
  Peptide Sequence Number=SeqID_180121
atgataacaaaagatgatgacaaaggtgatgacaaaaagcttaaaggtcaatcaaagaacaactcaaggtacatcctttgtggtacaagtagaggatacatctacttgggtttgactgagaacaagagagggtacctctcttgtggatcagttctagtggagggtacatccactaggttcaaagagaacaagggagggtacatcccttgtggatctttgcctgtaaaaggatttttacaagtcactcgatccaataaagcagaggttgttgagctgggtgatcgcatgcgacacgcagcgagagcactagtcgttggtgaggtcgctgtgacactggaagaggccatagacgacatcgaaggatgtggggataatgaagttgttgtggttgggaaaggcaatggagttgatgagggaggtgaggagcgagttgaaggtgtttttataggcgaaacccagcatgaacttgggttgggagaaaacttggatgacaatgatagagattcttag

SEQ ID NO: 63344 - DNA, 438 bp, Glycine max
  Peptide Sequence Number=SeqID_180122
atgttgttgtattttgattggttattgatgaagcacattaaggataagctcatcttaaccaataatggttatgacgagaatgtaaccatcaagttgtgtttggcgggtgagccagaggaagttatcaaggcaaggtcgatgtattttgattggttatcgctggagcacattagggatgagctcatcttaaataatgatggttatgatgagaatgtaatcgtcgagtcgtgtttggcgagtgagccagtatgtttgcgaaggtcaactacgccgatcacccctcaaatgaaagccataaacacgattgtgatgaagaagacccatatctctaggaaaaggcctcagacagaaggcgccaactatgaatacattcagattaacttcgatgaagggcaccaagccaacttggctaggagcgatgggaaaatcgcccattaa

SEQ ID NO: 63345 - DNA, 231 bp, Glycine max
  Peptide Sequence Number=SeqID_180123
atggcgccagtgaagctggcgatacagctgagtagccattggcactggcgatttggaggtgtttcgccattggcattggcaaaacacgtgacgtggaggtggggcggtgtcactaacatggctggcgattatcttttgaataaagggtttgcaagtgggagtggcggaataaccttctcccctataaaacgcccttatacgaatgaatggaaacaagctgtacggaacttg

SEQ ID NO: 63346 - DNA, 180 bp, Glycine max
  Peptide Sequence Number=SeqID_180124
atggcattcaataggagggacgagttcaacgcatttcagactcacccgaatgaccttgagtttactggagtattttcacctgctattgagaagattgtggtgctggatttcccatctaaccttgtgaaagcaccagcatgggatgaggtaggcttgttctttactcgtacgggaaagtag

SEQ ID NO: 63347 - DNA, 430 bp, Glycine max
  Peptide Sequence Number=SeqID_180125
ttgttttacaactgagattctggagggatttgatgttcagagaacaagtggcttaggtgatactctaaggaagtatggttatcttacccaagcaatttctcaatattacaagtcagaaatttttgaagacaatgttaaaggctctggggcatgtcctccctttgatgaatttattaaaaggtgtcaagaccttgaaaaaacaacagttagtgatgtatttgccatgcagcttatgcaggtcccccaagttacggaggaggttgccatggctgtgttggatttgttccccacacttttctctcttgcccgtgcttactcactactcgatggtgatggttgtgcccaggaggagatgcttcgaagacagagtaacagtgtgatcaatgcagttgccagtaggaacatttttcagttcgtttggggcagctga

SEQ ID NO: 63348 - DNA, 387 bp, Glycine max
  Peptide Sequence Number=SeqID_180126
atgggctggtttggcctagtcaatggttggggctggcttgtccattttgccactcctacatgtagactgtgggaattgctaggggcacccagcaagattgctgttgcacccagcaattttttagaattcccaaaataccccttaatgtttccgcgtaagaacctttttccgccgttaatgttacaactgtggaagaaccttcttccatgccatctcatggaagaacttcttccgcaggaagccacggaagaaggttcttccgtagttgcaaattacaattacggaagaaccttcttcttcacagttgtaacattaactgcggtcttccgtgtcatctcgcggaagaacttcttccgtaggaagccacggaagaaccttctttcgtga

SEQ ID NO: 63349 - DNA, 267 bp, Glycine max
  Peptide Sequence Number=SeqID_180127
atggtttcttttgtacaagacaattccctctcaggaggaaaccggctgccaacctccataatgtcctcttgtcgttgtcagaggcctcaggtggaccctaattttgtccggggactatcattcgctaacgttttgagtcccgctagccgaattgagttgttcgacactagttaccacgcaagacgaaagatcattcaatgttttggtgaggaatgcaaaaaatacccaaggggagggaaaaaggatcattttaggcttttcttctag

SEQ ID NO: 63350 - DNA, 318 bp, Glycine max
  Peptide Sequence Number=SeqID_180128
atggtgagaaaagagagtgagacatgcaaagtgggaaagataactttaactttcaattctgttatgcaggacagtgcacccagcaaaattgctggtgcacccagtaattatgtgatcggacaaaactgtccttgtttaaaaaacgcgattttaaactgcggaagaaccttcttccgcagaaagccacggaagaagattcttccgcagttgaaaataacaacagcgcaagaaacttcttccatggattcctgcagaagaacttcttccgcgatatcgcacggaagaaggttctcccgctgttgttattttcaactgtga

SEQ ID NO: 63351 - DNA, 2709 bp, Glycine max
  Peptide Sequence Number=SeqID_180129
atggcaacccaacgagtggcagccctcttccatatccaccttcaggaacctgggcccgttactttccccacctccattcccccacccatacatcgtcttcttcagaaatactcacctctgttccaaccacctgaatctcttccccctccacggccaaccgaccatgccatacacctagagcctaacactaaacccgtcaacgtccgtccatacaggtacccgtattttcaaaagcacgaaatcgaacgccaagtcgaggacatgctccgccggcagctcattcgtccgagtcggagtccttattcttctccggtactcctggttaagaaaaaggacagcacgtggcgcttttgcgttgattatcgcgccttaaacgaggtcacgatcaaggaccgttttccccttcccactatagatgagctcctcgacgacctcggccactcttcttggttttcgaagctggaccttgcccaaggcttccaccaaattcgaatggttgactcagatatacccaaaacggcgttccgtactcatcagggccactatgagtacgtcgtcatgcctttcggcctctgcaacgggccttcaacatttcaggccaccatgaatgatctcttccggccgttcatcagaaaattcgtattagtctttttcgatgatatcctcatctatagccgtgatttccagactcacttggaccaccttgaacgtgttctccaaactttacaacagagtcactttcatctgaaggcatccaaatgcatcttcgggcaacgccgcatcgaatacctcggccactttgtatctatcagaggtgtcgaacctgacccttcaaagcttcaggccatgcaacaatggccaaccccgacatctccgcgccagatcaggggattccttggtctaaccggattttatcggcgttttgtcaaaaactatgcccgcgttgcaaagccactcacgcgacttctacgcaaggaccaatttgcgtggtccactgaagcacaatcagccttcgatgatctgaaagccgccatgacttccacccctgtcctctcccttccagatttcacgattcccttcgtggtggaaaccgatgcctcaggagcaggcatgggagccgctggtcatagtaacgtcgtagctgacgccctttcgcggcgggcggaggacgacaacactgccgcaatgtattccatcctgtccatacctcaccccaaattcttggaagacctgaagcgtgaactggcttcatcagtagaatttaatgccctcaagaagcgtgtcaccgacgaccctcaacaacatcctgcgtttactctcagggatgacctcttactatacaaggggcgaatttggatcaacagtagcagcagtttcattgctctccttcttgaggaatttcacaagtccctattgggtggccacatgggattggccaagacccttagtcgaatacaacagagcttctactgggaaggaatgcaccaggacacacaaaaattcatcaagcaatgcgtggattgtctgcagactaaatatgttcctcagaaaccggcggggctcctccaacccatcccaccaccatcacgtccatgggaggatttggctctggatttcattaccggcctccccaactcccagggcgccaccgtcatcatgattgtcgtggaccgtttctccaaaggagcccattttgggtctcttccttcccatttcacagcccacacggtggcccaacttttcattgattcggtttgcaaacttcacgggtttccccggagtttgatttctgaccgggacccaatcttcattagccgattttggaaggaacttttccggctctgtggcacaaagctacgaatgagcaccgcctatcatcctcagaccgatggtcagacggaggtgctcaatcgcgtgctcgagcaatatcttcgtagcttcgtgcatcacaagccaactcagtggggtaagttcctcagtctcgcggaatggtgctacaacaacacttgccactcctccactaacctctctccctttgaggttacttacggcaaaccaccgccggcaattataaactatctaccaggctcgtcttctgtggaagcagtagattttctactttcctcacggcaacacttgttcgagacccttcgccagaaactcgaacgcactcaggcaaagatgaaaacgcttgccgatactcatcgccgagacaccaatttcaatatcggtgattgggtctatgtgaagttgcgaccctaccgacaaacctccatagctgataaataccagaaattgggcaaacgtttctttggaccctatcagatcactgattccataggcaaagtggcctatcgactagcgctacctccttcagccaaaatccaccccgtcttccactgctccaaacttaagcttcatcagggccccatcactacagatcacttacttcctccaacttcttgggacaacaatcctgtgatagaaccgttgaccatattggatcataagtgggacattaacgacccgccccagctgttagttctggttcaatgggccagtctgcaacctaaagactccacgtgggaaaattgggctgaactcaagactcagtaccaccttgaggacaaggtgtttttcgatgacatgaggaatgatagcacagcagcatcaaggcccaaacgagcaacaaagaagccattagactag

SEQ ID NO: 63352 - DNA, 885 bp, Glycine max
  Peptide Sequence Number=SeqID_180130
atggcaagagtagcaaaagtggtcaagatattggcacaagagttagaccgagtgaagcaaaataggaatggggtggtagggataccaaggaagcgcttggaggagagggcagaagcttgggcagatcaaggagacaaggaaaacccaatcatcgttgtcttggacgatgcatatgacacattcgacctaagatgcgaaaagagtagcgtgaggattgtctattgcacacccgctctttatgtgtggttggtttcccatgtttttcatcatgaaggtatggtaggagcatccgttagttggttcccccgatggaaagaaggagggaccaaagtgttgtgctcgtgtgaaggattcccaaacgtccccttgatgggaacaagggggttcaatgaaggcaatgcgaaaatacttcagagaatccataaagcatggaatatagtggaaaggaaagataaggagcttatggaaagcagtaatggtgtcatcgacggctatcataagtggctgaggtctaggatgcaagggacagcttggctcccaaagctaaaaggcctaagtgggaaagaacctgaagtccttgaggaaagcgaagaagtgcaagtcatgaaagtggagtttgctatgcaagacggaacattatttgatgtttcgataataatgcggaaaatacccaaatgggacggccaaagggtcattttagagctttttctgacccctggcttgcccaggctagcttctggctcacttgggcccccaaatagcttagggatcaaccaagtcccctcatttcctataaataagcgtgaggaggggctaaagaaggggctcagctttcaaacattgaaagaattcagtgaaattgaggaggagaagaagaaaaaatga

SEQ ID NO: 63353 - DNA, 309 bp, Glycine max
  Peptide Sequence Number=SeqID_180131
atggagaggcttgatcttgaagaaatgtctgtggtgaaaggagagcctcttgcaatcagctcagtacttcagctgctcactcttttggccactgatgatgcaatggtctacatcaagagctcgccaggtggaatcattgtagaaaaggacgtttgtggagctagtgatggtggtggtgattatcatcaactggacgaatctcagcgtttgttattggacgtaatgactacacaaatgcaacgattgctgaattgtaacaatgaaaagctctatagacgaatagaaggtcttgagaaccaactgaattag

SEQ ID NO: 63354 - DNA, 342 bp, Glycine max
  Peptide Sequence Number=SeqID_180132
atgaatggggaggataggggtaaatacctgacccatactctgaacacatgtgccaagtttattgaatcaggcagcttcatgagtgcagatattggattggactatattgctcacattgcatccctttatggtgatgcgatgcaaagggtagccacctatattagtattggtctagctttccaagtcctaaaaaatttgcatggagtacctaaatcaatcaatttgccaacaacaatgtcaacctcagaagaacaacttgttaagagtcatgccattgctgaagctatggaagcagaagaagtgatccacatcattgatctcgatgcatcggatgctgcttag

SEQ ID NO: 63355 - DNA, 543 bp, Glycine max
  Peptide Sequence Number=SeqID_180133
catgaaggtgcttctgaagcctttgaagatgctcaaaagcatatgaaaagcatatcagaaacaattaaatcaaaaactgccagcatttctcaaatcaatagtgatatagaaaagaggaagcatgaagcttcagaagctcaccaaattgaagaagaatgtatcaaagagcaagatgaattgattcctcttgaacaaagtgctagacagaaagttgcagaactgaagtctgttctagattctgagaagagtcagggatcagttcttaaagcaatcctgaaagccaaggaaacaaaacaaatagaaggaatatatggtcgcatggagaagcaagttgatcttcttctgaagttgaaaaagaatgtaagcactctagagggggttccacgcctttttgatttagtgaaagttcaagatgaaagaatgaagcttgctttctttgcggcacttagaaacactgtggttgctaaagatcttgaccaggtcagttgcactttcgtagcaggatgcttcattctgatgataaatattaaggatccatcataa

SEQ ID NO: 63356 - DNA, 615 bp, Glycine max
  Peptide Sequence Number=SeqID_180134
atggctgctcctcttcaattcttctttctcttcaccctcactctcttctcatcatcattctccgagcaatcccacatcgaactaccctcaaacaacaacaaccctaaccctaaccctttacaaaaactgtccaatctccacttctactaccacgacataagagacaacgaaaaccccaccattgtgcaaatcgtggacaccccaaagaacgttccgaacgggttcgggtctactttcgtgatggacgatgcgatgaccgaaggaccagagctgagctcgaagcacgttgggagagcccaggggctgtttggcttggcctctcttcaggaccttgggatgttcatgctcaccaatttcgctttcaccgaaggagcttatgctggaagcacgttgagcatgcttgggaggaatcccatatcggagcagaatagggagttgcccattgttggtggcactggcgtgtttagatttgccactggctatgccattgctaatagcgttaattccgtttctacccctcaacattttgttgtcgagtacaatgttacaccgtttgtagtgagaccatgggagtatgtatgccttgtggcacctagagttagaagtagcaagtga

SEQ ID NO: 63357 - DNA, 765 bp, Glycine max
  Peptide Sequence Number=SeqID_180135
atggatggagacgaggagcacgcgtttgctgtcctgctagtcttgaattctcgagagtcccattccgctcgagcgcctcgtgttgcaacagataatataaaatatagaaacatcattgattcgaagcaaactaaaacgaaaagcatctctacaaataagtgctttattggcattagatggcatgccacaatggttgtccctcttaggcactttcttgttttctctctcaccctcatatccatcatcttccacacccatggagcgttctctgagcaatcaataatcaagttacccacagaccaaccaagggtagagaaactgacccacttgcattttttctaccacgacatcttagagggcaagaacatcacggtggtgaaaatcatcgagccatcagcgagcgaggttcgtgaagcaactgggtttggaaccactttcatgatggacaatgttttgaccgagggtccagagctgagctcgaagcacgttgggagggctcaggggctgtttggcttggcctctttggaggaccgtggaatggtgatgctcattaacttggctttcagtgagggtgagtatgctggcagcactctcagcatgcttgggaggaaccctgttcaggacactgttagggaaatgcccattgttggaggcacgggcgtgttcaggtttgccaagggctatgccattgccaagagtctttgggaaatttctgacaatgagcattttgtggtggagtatcatgtcactgtttctcatccttag

SEQ ID NO: 63358 - DNA, 228 bp, Glycine max
  Peptide Sequence Number=SeqID_180136
atggcttcacttctatctctcctctttgcctgccatctcattgttagcatcaccctaagcattcttgggagaaaccctgcattggaaaatgttagagaaatccctattgttgggggtagtgggatcttcagatgtgcaaggagttctattgtgtttaccacatatatgtataatgctgattttggtgctgcaattgttgagtacaatgtatctatactccatgtttga

SEQ ID NO: 63359 - DNA, 204 bp, Glycine max
  Peptide Sequence Number=SeqID_180137
atggccaaatttggaacaccatcatcagtagacatggtcgctatagtcggggatgtggatggggatggtgtggatgtaggtatcggggacagtccacgtgcatcaatcgaagatggaaatggtctaccttcagttggaggtgtagatgatataggtgcaacatccgcaaatctgattggcatagatacactagacgaggattag

SEQ ID NO: 63360 - DNA, 264 bp, Glycine max
  Peptide Sequence Number=SeqID_180138
atggtgagcttcaacccgttcgcggcggctcgattgcgaagtggttttgcttttttcctttttcgccttgtgccgccacacgactggccgtctcgtggctggcgcgtggaccatgaggagctcgcgttcatatgcgagccgcataatttgtttgtgaaaagggaagaggagatgctggaggaggtggagagctttggatattggattgggaaaagggaagaggagagaagaaagatgcggaacggacgcgaaatatggttgtga

SEQ ID NO: 63361 - DNA, 420 bp, Glycine max
  Peptide Sequence Number=SeqID_180139
atgggtgccattaattcaaaaggtttttcttgctgggttgaaggtaaagttatgcaaattagagggaaaaggaagtttatggtaatgcaaggaaccaagcaaggaaatttatacatccttcagaggtccattgtgacaggctctatctctgttgtttcacaatttggtagccatgtatccaatggcttatctgataattctctatggcatttgtgtatggatattctgagcaatcgaggcttatgtagaaatcacaagatgaagttcccaaaggttgtgcacatagcaaagcccatgttgaactacatccattctgaatactgggggccttcgaaagttccatcactgggaggggcaaggtatttcctctccaccattgatgattactccaggatgacatgggtattcatgatgaaatag

SEQ ID NO: 63362 - DNA, 372 bp, Glycine max
  Peptide Sequence Number=SeqID_180140
atgacatttattggccctccgaatgaaggaaggtacatcactaaagaacatcttgatgagctaaactctattctgctagagctatgtgacattgatgtcaagatggaagacaaagatctaaaaatggttctgttaacctcttctcctccctcctatgagaattttgtgagttgtcttagtgtaggcaaagactccattatacttgaagaagtcaaggagaagaaaaagaaaggcaaaggtggcaagaagagaaaaattgatctcaaggacatctacatttactgcaaaaaaatagatcatggaagtgagactgttcaaagaaagcaaaacaagattatgttgttgctcttgttcaaaatggctccttattag

SEQ ID NO: 63363 - DNA, 897 bp, Glycine max
  Peptide Sequence Number=SeqID_180141
atgggtgaaatagaggaggttcaagagcggatgaaggcctacatggaggccatgatagagaaaatagccacaatgatagaggccatgatgagcatgaagaagataatggaggtcaatgcggctgcagttgccgctaccagtgtcattgctaaggtggacccgactcccccatctggcctcaaccaaataaatcatccaaccttggatatggtaggtcggggaggcaaagagttgggaagtacgggcgacccccattttgtgcaagttcagaacaagcatgccttcccaccatacagcttgcctcccaactatacacctcccaatgtttcgcacactcccgatgagaatgtcgatagctctgctcccatacccattgagagccaacaaccccaatctgatcatgcacatgtctctcaacccatgggggagacacgtgaagtaccccaccacaatctagccgacttcgagcctcgcctcggatatgccactgagggacaaacagttggtggtgtacccctgccaaacactttggagggccctcaattttgcccacaaccaccacccttgcgttttgcggtaaggagagtccctcctgctatggtggaaagggaaaaatttgatcatatagaggaaaggctcaaggccattgaaagaggtggagattatgctttcgctaacatggcagaattgtgcctagtgcctgacatcgtcatccctccaaagttcaaagttccagatttcgataagtacaaggggactacctgccccaagaatcacctgaaggtgtactgcaggaaaatgggaacatactcgaaagatgaaaaattgtttcaaaaatcaaaatattgttttaaggtccaacgccttaatgattctctccacttttcaaagttttaa

SEQ ID NO: 63364 - DNA, 789 bp, Glycine max
  Peptide Sequence Number=SeqID_180142
atggcttggcttgcagctcaactcgaatttgcaaatgatgatacactgatacatataaagctcatcaaacatataacaagaattatggaacaaagcaataggcagaaagaagcaaagaatggaaatagaagctgcctatcggctgccatcatagatgttgtatcacacattggtgtattcgaagaagcaagttcaaaggccgaattcaatgatgttgtatcgcgcattggtgtaatcagagaagcaggtccgaagctcagattcagtgatgagttcccaaacaagattggactctttcccacaaacttcgacaatccaagcggctacgatctcgatggatacatcgtcgaagttttccttttggatcctgtcgccgatgtggtctatagccttcaagattatgaggtctttacattgttctcaaccaacacattcgtcatggagatacctttcacaaaggaaaactcatatttattgatatttaaaaatgaagatgtggagataggaagaattataatgacgatggtactcaccgaagacaccgacattgacaatgatgatagaggagctagagggagaatccatgaaatggaagaaaagattgaggagtgtggtagagagaaagaaaagaacaatgaagaatacaagatgggtgcttgcacctcaaaggcaaaagtagtaggtaatgagtcgagtcgagttgagcacgattcaactcgactcgactcgataagaaatgacttaactcatagattgactcgagttcgatatgatccattgtttctctaa

SEQ ID NO: 63365 - DNA, 369 bp, Glycine max
  Peptide Sequence Number=SeqID_180143
atggacgaaattgaaatccctgcccatttcctctgccccatttcccttcaactcatgagggaccctgtcacggtttgcataggaatcacttatgatagagaaaacatagagagatggttattttcatgcaagaacaacacatgccccgttactaagcagtgcctattagaccatggtctcactccaaaccacactctacgcaggctgatccaatcctggtgcaccctcaatgcctcacttggagttgaacgcattcctactccaaagtcaccaatagacaaaactcattgtgaaactcctcacagaagcaaaaaggttcccagagaagcaagtcaagtgcctcacaaggcttcgatccgttgcctttga

SEQ ID NO: 63366 - DNA, 249 bp, Glycine max
  Peptide Sequence Number=SeqID_180144
atggtgtgcgtcttccattcaggtgggagttgtgcctccataatcccgtcaatgactaagtgccagcgtttgatgctctctgaattggttgtccgatggagggagtcccttcatgccacgtggttgaagggaagttttccttcggccccacgatggatttcaaatgttctttctagatttggtagaatctactcacggtggtgttcgtctgtgtactcctccatgaatggtggtggggtgtacctgtga

SEQ ID NO: 63367 - DNA, 444 bp, Glycine max
  Peptide Sequence Number=SeqID_180145
atgagtagggaaatagaagaatccatagcccaagtggtaacaaagaatgtcggcctctttgcatggtcaacattagacatgctaggaatcaaccccaagttccacaatcataggctagccatctatctagaggctagaccaatcgcacaaagaaaaaggaaactcaacactgcaaagatgtgcaccaactacacagacctaaacaaagcttgccctaaagactcataccctctttcgagtatagatcacctaattgatggagcatccaaattctcatcctcaatcccgatgtgtaagcaggatgaggagaaaattgctttcatgactgataccgataactattgctatttagttatgccattcagtcttaagaaagtcgaagcaacttatcaaaggtttatggacaagatattcgtgaaccatctgggaaagaaatctatgtag

SEQ ID NO: 63368 - DNA, 492 bp, Glycine max
  Peptide Sequence Number=SeqID_180146
atggcccaaatttcccaccagctcaacaatatcaatactcagccaatattagcccttctcattacccaccaccctatcaaccaagaacacttaatcatccacaaaaggccacccctaaattatccaataccaaacaccacccttaacacagaccaaaacaccaaccaaggaaggaagtttccagcaaagaagcctatagaattcaccccaattctggtttcatatgctaacttactcctatatctactcaataatataatggtagccctaacccttgtcaaggttcctcaacctccattttttcaaagatacaactcgaacacaacatgtgcttaccatggaggagtttcggggaattccattgagcattgcatgaccctgaaacataaggtgcaaaatctgattgatgcagtgacttgcgctcctgagttgatctccaagtctgttcaattagatagtgctcattctatacgtttggtaagggtgtcataa

SEQ ID NO: 63369 - DNA, 291 bp, Glycine max
  Peptide Sequence Number=SeqID_180147
atggtgctcatggttgagattaatattagaccgctggagagtgcccttatcaagaaaagaaatgtgagcttgaatcttatgcaaaagattaagaggaagaccggtaagcttaaagaagaccaatggttcaaaaagattgagcttcatcacagtcacgcaacacatgcatggtggtctccgaagcatcattgcaacgaggacacacatccgaatccgtcatatggcaatgattcctctcctggttgcagggatggagccagagttaaatcgttttgggggccatgtagctaa

SEQ ID NO: 63370 - DNA, 594 bp, Glycine max
  Peptide Sequence Number=SeqID_180148
atgggattggatggatcagttcctgggttttctagtcctagcagccattctgctctagttctgacaattgagtatgataatgattcagtgtttggagtatcatttatatcaattgagtactctatggagatgtcttcagctgtatacaagaattgggttttcactgcccaagcattaccaactgatctcatcaagagaggattggcagttgacgatcacacttccccacatggccttcgccttgtgataaaggactatccttatgttgttgatggattagaaatatgggatgctattaagacatgggtccaagagtatgtcaacttgtattactctaatgataaggcagttgaaaaagatactaaactacaagcatggtggaaggaagttatggagaaggtgatggagatgttgtcaagacattcctctgatgagatctaccttggacagagggacactccaaattggacctctgatcagaatgcaaaagatttctttgaaacatttacaaaaactcttgtagagattgagaaaaaaatcttagaaaggaacaacaaccaagagcttaaaagaaaagaaactaagcaacactaa

SEQ ID NO: 63371 - DNA, 238 bp, Glycine max
  Peptide Sequence Number=SeqID_180149
atggggttgacgaatttcgtgctgacagtggcgggtgtaagcgccgtcgttcttctccttaggagtgacgtgaagcaatctgcctccatcttccggcgcaacgtcaagcacattcgcaactggctcgaagaagaaagcgccgcttcatccaaggagagcggggaactgatggcaagtgggaacacccatttgttctctgcaaatgttgatgatgatttagatggtgatgatgcgtcgg

SEQ ID NO: 63372 - DNA, 642 bp, Glycine max
  Peptide Sequence Number=SeqID_180150
atggggtgttggaacattgttgattgcaatcgaggatggagccatttcccacaagcacacgaaggggagaggaaattgtgggtacttccactatctatgaagattgtgaggcggacatggtggatagttccaaaaagaagaaaagtttcagaggaaggaagacctgataacgtgcgaagactgatgtggggaaggttggtactggttatggagtcaggggtaatagtagttatagcagaggcctttctctttactgaaagctatttcatccgaggagcattgaatatatggtggttttggcttggggttggagttgtgcaattgcctgaggaagggatattggttgaagtgctagtacctctcggtgaatctccaaatgttggcgcgaatctggactcgagtgcttgtaagaagtcagaccaggaggtgatgaacccattgcggtacatccacagataccagcttaaggcggtgccgtcgagcgatggcgtctttgagcttatccatggtggtcttcctggttgcatggtcagccatggcgatggtgacggcggcaggtcggaccagtgttatgtgcagggtaggggagaaagagaaaaggctgccttagttcgaggcaaggctcctcctgaatatgagtga

SEQ ID NO: 63373 - DNA, 501 bp, Glycine max
  Peptide Sequence Number=SeqID_180151
atgagtgtctccggcgtcgctgcgattatcttcactccgtcaaaaatgttccaatggattttccccgaacccatgtcggggggccaaatgcgaaactggagcaaaagtgggggaccaaaagtgcaattttgtctcgtaaatacaatcttaacagcaaagaacttggttcttataccaattaaagggtcttcaagtccttcaatgttgccctccatccgccaaaagcttctcgcatcactgaggtcctttagcaacgccctccttcgggtttgtttaagtgtaacactgatggctctttttgggggcaccttggagaagctgaatgtgggggaattttcagagatgataaagctctcccttaagccattgaaacaacttatgagaagcagtggtattcactttggctcgaatgtgacttggctctcgtcatcgaagctcttcaaaacaataatctggtcccgtggaagctcagaatcaaatgggctaattgtgttcatataa

SEQ ID NO: 63374 - DNA, 1866 bp, Glycine max
  Peptide Sequence Number=SeqID_180152
atgactgattacacttcctttgtcatgaagttcaatcatttgggccaaccggtggaacttcgggcagacgtaacaaatgggccagccggtttcaacatctcaagtctaacgcctgattcgaatcgggtcaacttcagtgctattccacttgtgcctcttacccgcaaccaaacccgacccaccactacatcttcctcacccgatccctacaatctcagctttgctccatcagtatcaacatctcttccagactccaaccaaccttccaccaccatggggagtagtccatcgaatcaatcttcttcaatcaactgccccgatgagttggggtacgcatcatggttctcaaagctggatttaaggcaaggattccaccagatactcatgcatgaacctgacatcgagaagacggctttcaggatgcatcacggacactacgagtaccgtgttatgccattcggccttgactccttatcatcccacctccagcatttggaactcatcttccaaacacttgtaagagagcaattctatctcaagcacacaaaatgtctattcgcacagaatcaactggagtatctagggcatgtggtttcgagcaagggagtcgaaccagagccatctaaggttcaagccgtggctgccttcaaccagctcaaggaagcaatgactagtgccctgattttggccttacctaactttgcaaaaccattcatcgttaggacggatgcttccggcaccaccatgggcgtcgtgctaatgcagctgaatcaccccattgcattctttagtaaagccttcagaccacgcctactccacgcttcaacctacataagggagctccacgccattgtcactgcagtccgaaaatggcgtcaatatttgttggggagatcattcaccattctcacatatcataagagccttcgagagctcatgacccaagttatacaaaccccaaaacaacactattacttgtccaagctactaggcttcgactacactatccagtataaatttggctcctctaacgtcatcgcagacgccctttctcgcgtgccgtcagagtcaggaggccaactactcttactcttggtacctcaacttgacttccttgatgattttcatcgtacgttacaagccagttctaagttccaagctcagctatccgagattcataccaatccctcagcctaccccgactttcacattcacaacgacctgcttctattcaaaggacgcgtcgcaaagaccactcaccgcctcgaatccaacttctattggaccaatctacaacaggatgttaaacgctttgtgcgtgaatgtagtgacctctctatggattttatcacccacatgccgccatctcaaggattcacagtcatcctcgtcattgttgatagatactcaaagggcgttcatcttggcgcattacccataaacttttctgccttcaaggtcgcatccctattcctagatttggtctgtaaacaccatggattctctcgcagcatcgtcttcgatagagacccagtgttccttagttccttttggcgagaaatctttcgaatcagtggcacccgttttcgcatgagtacggcgtaccacccgcagaccgatgggcaaaccgaagtcatgaatcgtgtgttagaacagtaccttcgatcattcgctcactcccagccggcgacttggttccgatatctagttctggctgaatggtcctataatacatcccttcattccagctcaggctttactccattcgaagtaatctatggcaaaccatcgccaacattgccgcaataccttccgggaatgacaaacaacgaggcagttgattccttggttagctcccgtcagtag

SEQ ID NO: 63375 - DNA, 270 bp, Glycine max
  Peptide Sequence Number=SeqID_180153
atggacaccaccactaccacacccttcaaataccaccttttagaagcatcctcgaaacctttcttcaagaagacaacactcacctccttccataaacatgatgagtccgagaccacatcgttgatctcccttcaacctcaaagaataacatatggaagcaatgccttccaagattattttgatgatgccaaagaatcaagactcaagcaagttccgaagaatcaagagtcaagcaagtttcaagaatcaagattcaagattcaagaataa

SEQ ID NO: 63376 - DNA, 171 bp, Glycine max
  Peptide Sequence Number=SeqID_180154
atgttgtcattgtgtggtggtcgccttccactctatatgggtgttgaggatcaacgaggggtctctgggaaggccatgaaggagggtcggttgtgggattgggaaatgccaaatgggttgtggtggtcttgggcttggaagcataaagaggtacagaaagtaatatcctaa

SEQ ID NO: 63377 - DNA, 255 bp, Glycine max
  Peptide Sequence Number=SeqID_180155
atggttaatttaattgatcagactgagaaagcaaattggtggtggaagaagggtcttcattttgaaagaccttgggtagagattgattggatgatgtggcaacaggcagtgggagggtggggcgggggggatttggttgttgaacttaaaaatacttcgaattttgcaaaactgaaatttggtaaggatatgatgataggagatggagctaagccaaatcagattgttggagatgcattgttcaaggagatttga

SEQ ID NO: 63378 - DNA, 315 bp, Glycine max
  Peptide Sequence Number=SeqID_180156
atggatcaaagttggatgaacgaaagtcatatgagccctgcgtatgaggaaggcgttgaacagttcttgcaatttgcttctgaaaaaaacatgcagagggggtcccaatctgaaccgtttgatgtagaaatggaagatcgcttagaggatatgatttgtgatcttggacaagagtcttttcaacaagtacatacatctatgtatgatacattgcaaagtgattcaaagaagcctttgtattcggggtgcaacaattccttgacgttgttgtcaacggtgttaagtctggtgaatgtgaaggccaaatacgggtga

SEQ ID NO: 63379 - DNA, 1218 bp, Glycine max
  Peptide Sequence Number=SeqID_180157
atggctacaccacccagctctcctcctgctcctcctcttactaattcaacatcacattcaccttttaccatgaagaggacaagaaaagcgatttggctgagatcattggctacaagaccaattggggcagagagacctttgttccatgtggatcttgcaactaggaaagccgatggttcgcgcagaaagaagttaagaacatatttggggatcgtcgctcgggataaggtagatgtgacatatgagaattggaaacaagtccctgttgcccagaaggatttgatatgggaggatattcagaaatgggcacttgcagccggcaaggatagtgtcgatgacgttgtttgcaaaaagtacgacattagcaaggaaaagtggacccaattttgtcagagtcgcagagaccctttgtgggaggatgtgcaaaagaaggcacaagccattcaaaaacaaaacactgcccctcacgtgttgtgttgtgggagttatgaatttttagaaaacaagttgatggaggagaagaaaaagaaacaactggaggaagctgctaagtttggtagcactgacacccttattgatcctccatctcccgtcagacgacacgtgaagtggaagatgacccgcaccaagaaaattggccaaatgatatctgaggcagcaaaggaaattgctgacaagattgatgtattgacagctgccattgggcgaccagaacaccctggtcgtgtgtgtgttgctagagccgatgtcacgattaaacaatactttggactgactccaaggacctcccgcacgtcttcgtccatagcttctgaagacctggagcaattgatgcaaaaaataagggaccagctggaggattcgatcatagaaaaaggacttgcactgcctcctgagcctgaggttggtctttcaactgctcgtgtcagcacaaaggagagttgtatgtatccctcagggaacgatccagacacgggtgactcagagaaatgggggttgtacatcaaagaaaatcctccccgcctggttgccctaggaagactttatgaggggtcgacaaccattcacgacatccatttgcgcaatgatcaagtcaaggttggtgttgaggaagttagagatgcagatgctcccattcctgtacccactcaagaggttcagttagtggggcatacacttaacaccttcgttgcttgtccgacacatcttctcaattaa

SEQ ID NO: 63380 - DNA, 1088 bp, Glycine max
  Peptide Sequence Number=SeqID_180158
gattgccaaataaagatccttacacccacttggccacttacatagagatatgtaatacagtcaagatagttggtgttccggaaggtgctattcgcctcaacctattctccttttcccttgccagtgaagttaaaagatggcttcacttgttcaagggaaatagcctaagaaaatgggaagaggaagcaggttgtgctttgtgcggcggagctcatgagtcaggctcttgcatgaatcaagaggaagcatcaaaagaggtcaattatattgccaaccaaaatttccaagggtataatcaaggaggcaatgtaggttaccatccaggaggcaatggccaactcgctaagcaattagctgagaaacccaatgggcagtttgtgaccaacacgaagaaaaatccaaaggaagagtgcaaggtggtcctcactagaagcataagaaaagagggtctagagaaggaaatgagaattgaggaagtagaaaaagatgagagagtaaaagaggcaaggaaggaagcactatctgtgcctgtgagggatattccatatcctttgatgccaatgtactccaaattcttgaaagatctccccacaaagaaaaacaagtacatcaataatgaaaacattgtggtagaagagaactatagtgctgttactaagagaattctaccacaaaaattcaaggatcctgggagtgtgactattccatgctccatcaagacaatgcttgtgggaaaagctctcattgatccgggggcgagcatcaacctaatgcctttatcaatgtgtagaagaattgggaatctaaagatagttcccaccaggatgattcttcagtcagcggatcattctatcaaaagaccatatggtgtggttgaagacgtcctggtaaaggaagacactgaaattcacctcatcctaggtagacctttcatgctcaccgccaactacgtggtagacaggggaaatgacaatctggagatgagtgtgaaggaacaaaaggtttccttcaatctatttgactcaacaacgctcaccagtattgatgacatctccttcactaagggaacaattgatcctaacccatga

SEQ ID NO: 63381 - DNA, 660 bp, Glycine max
  Peptide Sequence Number=SeqID_180159
atgtgcgctctgcaaggaatgatcccgctaagcgcgatagatggttaccgcctaaagtcactaagcgagacactctcgctgagtgtgatagtaattaatatgtctaaaactatcagagttgcatgcttagtgcgaaactcacaactttttaaaccttttcttcttccctcttctgttttctttctccctacgcttccaaaactcttctcactccctcacaccctcattcactcatgctctcacgcattcacattctctgtgcttctcctccctagtgcattcattctcaccctcccaacgtgcacccttgggctaagcctagcctcattaactgagtgttttgctaatggtggtgctaagcgcccaactgtgggcttagcacccaactgtgggcttagcgtcgaatggcctccaagaaatgtcaagcctccaccagtagacctcaggttgcaaaatcagcctggaattccaccagattcacctctgaggtggcttggcatagatatcaagataattttcatctttagaacatttttccagagaggaacgtccaaactggcctataccgactatgacgagttcttggaggagctcgagaagagacattgggacaggaagctcacaaggcttgcaaagaagaacatagagtggccttggtga

SEQ ID NO: 63382 - DNA, 252 bp, Glycine max
  Peptide Sequence Number=SeqID_180160
ggaaaagagggagaagcttgccacccagctcgcccaggtgagctaggttacttcctccagaaggcaccgccttctggaggaacatcctggaaggcccaagtaggcctggtcgtgcaacaatgctctcttttgacttctggcatgttatggaacttcacgtatcgtgcaacaatgggtgccaagtacctcgaagcggtcaagcaaaggttgcatgccatcaaacaatggtccccggacgaaattaggttatga

SEQ ID NO: 63383 - DNA, 1302 bp, Glycine max
  Peptide Sequence Number=SeqID_180161
atggataagcacgcggcccgccagggcgatgacatcattcattccagtattttcgccgatatcaccagtatcgtcgctgaaggtgcggtctacgccgcgatgggcgcgattgttgccggtgtggctaccgtagccgctccgctggttggcgtgggtgcgctggcggcggtaggcagtagctgtctgctgagcggtatcatcgcgggtgcggtggcgaatgtggcaggtatcacggacgacatcagcgcggctgcggatggcattggcgacatgctgttcccgccgtcgcctgcgggtgtcattgccagcggttcggataatgtgatcatcaatggcttagcggcggctcgcgcggcaggtgaactgacggcaggcgatacgccgccaccggaagcgcagtcggccggattttttgccgactatgccggcaaactgctggcggttgccgaccagttcgccggggcgatgtggcagccgacgattgcctccgctgccgcaggtacctcgccgctggaacaggataaagttgcgtgcgagaaacacagcgggccacagtatctcgctgaaggatctaaaagcgtattcatcaacggccagccggcggcacgtgctaaagatcgcaccacctgtggcgcgaccatcagcgatgatgtttcagccaacgtcatcattggcggtgaaacgctaacggtgcgggatatcaaaagcggcaaacagcccggtctggcgctggcgatgatcggcctgtcgctgatccgcggtcgtcccggtcagatcctgaaaaatatgccgtgtgcgctggcaatggcgggcggcggcatgctggccgatatgtctatcaacgcgatattctccgcgctgcacccggtacatgccgctaccggcgtgaaagtgctgaatgatgatgccgagcgtgatttctcgctgccgggacgttttcccctgcgctggcagcgcagctataacagcctgacgcagcgcgccggcctgtttggccgtggctggtcgacggtgttcgacagctatctgacgctggaaggcaatcaggccacctggtttgatgacaacggccgcgaactgcgttttgccttgcccggtgaaaaagaggtgctttacagcatcagcgaaggactgatggtgcgacgcaatgcgcacggtgacgtggcaatcgctgacgatgacggcgcggtctggcgcttgtacaaacccaccgccagaaacccgcagctcttgcgcctcgcctcgctgagtgatgagtacggcaacgcgctggagatgggctgggatgagctgagccggctg

SEQ ID NO: 63384 - DNA, 147 bp, Glycine max
  Peptide Sequence Number=SeqID_180162
atgggttttccattgccagcagtcatttaccctgccgaaaatttatctgcattcgttattcgctctcccttgaggagattctgtgtccttttcttcgggggaaaggatgaggattcttttcatgggccaaggttcaaagtagcttaa

SEQ ID NO: 63385 - DNA, 966 bp, Glycine max
  Peptide Sequence Number=SeqID_180163
atgggactgagatcaattgcagcaaaaggtcatgtgggaattaagagttttgatgttgaactagttgatcaagaagggaactctataccttcatatgaaacttaccttcatcatgggtttgcaataaagtaccatgaaaatattactatgtcacccaatcctaagattgaatcacaaggaactacctcaaacattctcaagccttatgctatagaacaaggtaaccctacaaaaattaaaaatggatatgaagagaaatggttgctcaacatcatggccattgatacacgtggagcacaagataaaaaacctagcactgaatgtagatgtgaccatatgaatctctcgaaggactttcataatgtcacaagggatatacataagcaaccattgtctacaaattataaaggagagtataccattcccacaaatgatggtggtgaatctcttcacgcccaaaaggcaaacattgcaatagaaaaaagaggttatctcatctatggcactgctaatatgcattcaggcgttgtaaatgtaactttatatggacagggtttcgccgttatcgctggtgccctccttgatgctcttcctcctctaggtgaagatgtaattgtagctctgactgatatcttgaagctacctctaatggataaaagcaatggctgcagcttctctagcatatcttcaattgctgtcttttcaagtgctgtttttgttgtctccttgattttggttcgtctcctttatgtcttatactgtagcagcaagcccttgagcaaaagggcttcaaaaccttttagtacccttattattttaggatcaggtggtcatattgctgagatgcttaatctactagcagtgttacagaaaggtaggtttaatccaagattctacattgttgttgctactgataatatgagtcttcaaaaagctcagttgttggagaattccctggctgctgag

SEQ ID NO: 63386 - DNA, 216 bp, Glycine max
  Peptide Sequence Number=SeqID_180164
gagcaggcagccaaggaagcaactgcaacagctaacaagaaagcttttgaggcaaaatttggaaattgttcggaggatatactagcggcaagagagcttgctgcatcttctactgaagctgtggaaaaatccagaaaggttagaggtgttcatgttagaggttatggtgttcatgttcgatttatagttatagaccattttttggctagtacctag

SEQ ID NO: 63387 - DNA, 879 bp, Glycine max
  Peptide Sequence Number=SeqID_180165
atggtatgttcatgggtcatgttgttttgtgctgtgtctgatcgcactttctcattcattgtgtatctaccatactccagcgtcatcttcacccatcatgttgcacctaacattaaggaagttgattctgaatttgaagctactgatgatcctgatgctcttgcacttgaagtgtatgatccccctccatcaagtgagtatgttagcagaattgagcttgagttgcttagaacgaggaaagcatttgctcaagctctggatgatagacgctatgctgaagatcaagctgtgaagtggcagcatctaattgtagacttcttttacaagaagttagtggttgggaaactccaagaagtccttcccctcctggaagtccaatgcgtacccttccttgttcctattgatttgtcatcagactctgattcttttggtgaggagttctttaggaagcttgatgaggattttgctactgccaagcaaaaaggggagaaaaattgcatcttatggggacaggcctttctttctggggaaccaagtattgttgaggctgctgcattgcataaggccattgttacacggaatcccaaagctatggtctgtctgtacatattttgcactggggtctggtctattttcaattgggcaactcttttctgtcacccatgtccatcaagcatttcatggtgggaagagactgcagtttcaatttcattgcctttggcaaaacgtagtgttcttggtggacttctccctaaatctttgttgtacgtactagagcgtagtggtccagcagcatttgctgcagcaatggtttctgattctgacaccccagagataatatggacacacaaaatgagggcagaaaatctaattcgtcag

SEQ ID NO: 63388 - DNA, 210 bp, Glycine max
  Peptide Sequence Number=SeqID_180166
atgattgctgatgcagaggagaagggacttatcacacctggacagcaactttattctcagttcaggtccatattctgtcttcttccgttcttgaaaagttggactctcctcaaaggcttccaaagacatatctttaacctagaaggtttcttcaatctcggtgccctccgaaggaagaacaacattcattacacacaggagtcccattaa

SEQ ID NO: 63389 - DNA, 192 bp, Glycine max
  Peptide Sequence Number=SeqID_180167
atgtctatagaggggcaagctgtgcagaacttgctcaacgaaggatggtgtgacagcagaggaacgttggaagacattaagacaaagatacaaatgaggcaagaaggagctttcaaaagagaaagagcaatggcttactctcttgctcacaagcaatgcagggcaacaccaagcctttttcctcatttctag

SEQ ID NO: 63390 - DNA, 329 bp, Glycine max
  Peptide Sequence Number=SeqID_180168
atggatgtagatggtgagtctatacctgagaaggttatcattaactctacgaaagctcactctaacaatgagcaaaagagggttgaacttgaagagttggaaagaatacaatttgcaatagagcatggagctgaactcgtgtctctgctgctaaaaaatgaagttgtgttgcagcaagaggaaaaaggtgatgttgggcctcatatcttggatcctaaaatgcagcaattgaaacttgacaagcttaatctggtcaaactttggaagcaaggattcctagggattgatcccttgtactatcctattgggaaacacttcccgaagaagaa

SEQ ID NO: 63391 - DNA, 150 bp, Glycine max
  Peptide Sequence Number=SeqID_180169
atgggtcgtaccagaaccagaagggtttccaagtgctataaagaaggatatgagattgaagcctcaattttacagtctctgtgcaaggtgcatttctctctctacagatattacttcacaaatcccaatgatgaaaatatgccaaaatga

SEQ ID NO: 63392 - DNA, 221 bp, Glycine max
  Peptide Sequence Number=SeqID_180170
gtgtacggtcacaagatgaagaggaacatagaagaaagattttggaggatatttggaaagtgccaaggagaaatgaataactcttacatcaaaagtcaagaacacaatggcttaaggaaggggataacacaaggtacttcactaacttggttatgcgaaggaggaggaaaaccaatggtttgcatgacatatttaaggatggatgatccaaatcttgtcaa

SEQ ID NO: 63393 - DNA, 216 bp, Glycine max
  Peptide Sequence Number=SeqID_180171
atggagtttatagatattcctatggttggtaggactttcacttggtatagggcgggagatatcttggacctttgtcccatgatcttgaagcataagatgttcaattggggccctaaaaaatttagggtactcaatgcatggttaaacgaagacgaattcaacatgtttgtaagaaaagcatttgtttttagaagtacatcgatgaagggcatatga

SEQ ID NO: 63394 - DNA, 471 bp, Glycine max
  Peptide Sequence Number=SeqID_180172
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccgtga

SEQ ID NO: 63395 - DNA, 264 bp, Glycine max
  Peptide Sequence Number=SeqID_180173
catcaacttccttcttgctcaaaaggggtgaagcaggtttgggtagagcttggggttaaggaggtagaaattgaggtggaaatgctagagaaggtgaagattcttgtggcttgggacgaaaagatggttgaggtgaagattgagtttgattttgaaggaattaagggtggttgtttcttaggtttctttcattggtctaaggacttagggttaaaggatgttggaggtgggtcattccatgagacaaacatcatatccctttag

SEQ ID NO: 63396 - DNA, 348 bp, Glycine max
  Peptide Sequence Number=SeqID_180174
atggagcaattagtccctatgcttttcacttggttgatatactttataaggaagcagctgataagcatatttggatttatgaaaaagaacttatgtgatgcaatgatgtcaacgaggcttgctgctttggggtaccaatcgtctttgtgtcaaactggcccgcgcttccgtgactgcaaccacattgtggagatcgtgtttgtggagatcgtctttgccacttatccattgaggtcgaagaaaagtaggaaaggaaagagtcccgaaaagggtactcccagggcgttattgttgtttctccttctgcctgagttcgtgtttgtcgcaaactgggctgcgcttccgtga

SEQ ID NO: 63397 - DNA, 367 bp, Glycine max
  Peptide Sequence Number=SeqID_180175
ggaaccaggtcaaacaggtggaggcactggtatgcaatatgactctgctttctttttgtttctgtttagtactagaaactatgctcagttagtcttatttggaatattttttgtgtctatggctttgcattggcaattcaaattgcttggctatcatgtaagatcatctgctggaccgatgaacaacttggggctggagatgttatcaagcatgtttggtggactcggagctggtagcctggctgttcctaacagatcaaatgagccgccggagcaattgtatgccacccaactttctcagcttcaggagatggggttctttgacacgcaagagaacataagggctcttattgctacatcagggaat

SEQ ID NO: 63398 - DNA, 1572 bp, Glycine max
  Peptide Sequence Number=SeqID_180176
atgcagaactctgagttagtcatgaagatcgacgccaccatcatggccactgcttcttctcccattcaagggtctcatggagttggagagaaggcactttgcctctcaccacagttggaaattaagagtggtggtgatgatgcagttgtggcgcctaaaggggacgaagaagtggatcagaaacccaccttggttgggattgatcacaagagaaaggcttcaacggaaatcgatccgttttgcgaatccgatccagatagctgccacggttctaagcatctcaactctcctcctgtttcaaccccaattgtggaacaagaacaacaagttgatgaagaaatgctgcctctagaagttggagacgacaacgagaaaatggaagaagacaagggcgtgtctgatggaggacctttggagatggactcggaccaaaacaaaggagaaggattaataatgaactcacccaacaatgttgaagaagaaaaagtggagactgaagctattgagagcatgaatgtagagcctgaaggtaacaagggcaagaacaaagaaggaacagtgaactcacccagtaacgttgttgttgaagaagaaaaagtggagactaatgctactgagagtatgaatgtggagcctaaaggtgacaagggcacgcctcatggaggagaaggaatagtgaactcacccagtgatgttgaaaaagagaaagtggagactgatcatgctgctatgaatgtggagcatgatggtgacaagggcacttctcatggaagacattttgaattggacctaaaccgaagagttgaagaaatagtgaactctcccagttatgttgaaacagaaacaacaaaagtggagactgaagctatagaaagcgtggatgtgaagcctcaaggaaacaatggcatgcctcgtgtagtgagacttttggggattgatctaaatctagaagctgatcaaggaaacaatggcatgcctcgtgtagtgagacttttggggattgatctaaatctagaagctgatcatcaaggaatgatgcagcactcctccaatgatgttgaaagagaaactacaagagtgcagcctgaaattggacacaagggcatgcctcatgaatgtcattctttgttggacctaaacaaaggaaaacagatggtggaacatgattctgtggatcagaacattgaagttgagccttatgttgcagaaaacattgaagtgaattgtgcaatagagaaaatggtccaaatgggagtggagcttctttgcgacttgaacgaagaagcagaccctttttctgatgaaaatgagattgaagctgagcctgcagctaatgccggattgaagaagaagactgaagtggagtcttgtggtgctgataaggttgaagttgagcaatgtgctgaagagaacaatgaagaggaggatgatgatggtgtagagatggagaagagagaagttgtgcttgcacttcctgctgttattgaaaatgatgaagtggagacatctcctccaagggactatgttattgatctcaacaaaactcctcctggatacaatgatgaaaactag

SEQ ID NO: 63399 - DNA, 768 bp, Glycine max
  Peptide Sequence Number=SeqID_180177
atgcagaaccagaacccttctgaagatgattccaccaaaaagtctccatcttctccctctgatgacacatcccatccaaccaacaacaacaacaatccgcagggtgaaagccttgtcatgaaaaccgtttggcaagtgttggaggaacttggtggcagtggtgatgatagtgacggtgacagtggctttggtgatggggcccctgtggctgtggcagtaggtggtggtggtgatgataatggtgatggtgatggtagcgttggtggtggggccactgtggctatggaaaagagtgatgatgatagtgacaataatggtgacaatagtggtagtaatttggctgtggctgttgtcgtgggtggtggtgacggtagtggtagtagtggtgttggggccactgtgactgtgtctgtggcagtgagtggtggtggtggtaatcatggtggcggtagcagtggtggtggtggtgggggtcctgtggctgtttctgtggctgtgggtggtggttcaacggtggtggagagtgtggttgtgagtactgaaggagtgcaggggagaaagagaaagacttctatcgtgagagaccctcccacaggaagacctacttgtcctctttgccaaaaagagtttccaacctggaagggcgcgtttggccacatgcgtgcacacccagaccgtgattatcgcggtttctttaaacctcctgtgtttggatccccatcctcaacccaagatcaaccacctagggatgacaagggtaataactaa

SEQ ID NO: 63400 - DNA, 198 bp, Glycine max
  Peptide Sequence Number=SeqID_180178
atgtatcggactcgccgtctctggatgacaaaaggtgcggataaccataaggtacccccgcatgtcatcgtactcgccgtctctggattacaaaaggtgcagataaccataagcggtctcgcttgccccttgttgacaaaaggtgcagatgacgacgttagtctctgcgtgctaccggactctgagtctgacggatag

SEQ ID NO: 63401 - DNA, 1085 bp, Glycine max
  Peptide Sequence Number=SeqID_180179
agacgacgagtccgataacatgtggggtaccttatggttatccgcaccttttgtcatccagagacggcaagtccgatgacatgcgggggtaccttatggttattcgcaccttttgtcatctagagacggtgagtccgatgacatacgggggggcaagcgagcccgttgacacgcaaagactaacatcctctactgtacctttggcatcaagatacgaggagtccgatgacatgtgggggtaccttatggttatccgcatcttttgtcatccagggacgacgagtccgatgacatatggggtgccaagcgagcccgctgacacacagagactaatgtcgtcttctgtacctttgtcatccagatacgaggagtccgatgacatagacgaccagtctgatgacatgcaggggtaccttatggttatccgcaccttttgtcatccagagacggcgagtccgatgacatgcaggggggcaagcgagcccgttgacacgcagagactaacgtcatcttctgcacctttgtcatccagagacgacgagtccgatgacatgcgggggtaccttatggttatccgcatcttttgtcatccagagacggtgagtccgatgacatatgggggggcaagcgagcccgttgacacgcagagactaacgtcatcttctgcacctttgtcatccagagacgaagagttcgatgacatgcgggggtaccttatggttatccgcaccttttttcatccagagacggcgagtccgatgacatgcgggggggcaagcgagcccgttgacacgcagagactaacgtcatcttctgcacctttgtcatccagagacgacgagtccgatgacatgcgggggtaccttatggttatccgcatcttttgtcatccagagacgacgagtccgatgacatatgggggggcaagcaagcccgttcacatgcagagactaatgccatcttctgcacctttgtcatctagagacgacgagtccaatgacatatggggctacctttcggttatcggcacctcttgtcaactagaggcaagcgagtccattgacacgcagagactaacatcgtga

SEQ ID NO: 63402 - DNA, 2849 bp, Glycine max
  Peptide Sequence Number=SeqID_180180
atggacgaaaaaaggggtgaaaaggagtgtataagagatattataattgttgagcactgctgcaaacatgttgttttagctgttgtgaatgccatacctggaaatctccctgtgtttgatgggaaaggttatgaagattggtgcgtgaagatgaatgctattcttggattccaagaacttgatgagatcgtgagagatgggtttcaagaaccctccaagaatcctactgcagaacaagaggatttgcatcgagagaacaaacgactagactgcaaggctcgagttctttttcatcaatgcatttctacaaacgtgtttcagaaaatttcaaaggctgcaacctcgaagcaagcatgggatattttgcaacaagtctatggcaatactgggagaacaaagaaagtcaagctacaatctctcataagacaatatgagttgttatcaatgatagagcataaaaccatcgtgctcaaaacattaaaacccaactttgatcatattgtagtagccattgaagaatcgaaagatcttgagaatatgactatggaagaattgcaaaactccctggaggcacatgagcaacaggaagaggaagacatagaggaggtagaagtagtgattgaaatgcagaaacacaaagttctacttcccaagagcatattcttggaagcaattcaaatgagcaattctagaggaggcaactcgttcagaagtcgaggtggtaagaggctcattgacagaagaaagatccaatgttacaattgtgataaatttgggcactttgcccatgaatgttggcagattggcaacaacaatgcccatagcaaatgcaagaagaatgatcaggcacacttggcacaggaagaagatggatctgattcagaccaagtcttgcttatggtaaccacgagcagtaaagaagactgttcttcttggtatctcgacaccgaatactcgaaccacatgacaggcaatagagactggctggttgatttcaacccaaatgttaccactagtgtgaggtttgtgaataatagcaccattctggcagaaggtattgggaagcaactccttgagaaaggatttaccatggaaatgcagggaaaccatattgagatctttgatgataaacaaagactagtgctcaaggcaccattatctagaaataggaccttcaaggcaccacaaagagccaaacaacctcttggaatagtccattcaaacgtgtgtggaccctttgatactccatccattgatggtaataggtatttcctgacttttgtggatgaatttaccaagaagatttggatatatatgttgaaagagaagtgtgcagtattttctctctttgtgaaatttgtcaaatcaattgaaagacaatcagaattgaagctaaagattcttagaatagatggagggtgtgaatataactctaaagagttcaaagaattctgtgaagctaaaggaattgaacatgaggtaatagcttcctatacacctcaacacaatggcttggcagaaaggagaaacagaaccctattggatatggctaggtgtatgcttaaagggaaaggactaccaaattgctactggggagaagttgttaccacaacaacttatattttgaacagatgttccaccaagagacttcaatctgtaacacctgaagaagcttggactggagacaagcctacagtgaatcatttgaggatctttgggtctcttagctacagacacatcccagacgaaaggaggaaaaaactggatgataagattgaagctcttatcctagttggatatcatccaactagtgcatacaaactttacagccccttgaacccaagagccaaggatgttaaccctgctagctcaatgcaacctcctataagaaggtcacagagatcaagatttccctccacaagacgtgcagattatgagctgtacagtaacagttcaatctctaatgctagtgaaatggatgctatgaaagaagagttggatgccatagagaaaaatagaacctgggagctggttgatttgccatataataaacatccaattgataaacaaggaattgattatacagaagtatatgccccagttgcaagaatggaaacaatcagattagttattgttattgctagttctaaaaattggaccatatgtcagcttgatgtcaaatttgcctttttgaatggtccattagaagaagaagtatacatcttgcagccaccaggatttgaaataaaagggaaggaacacaaagtatacaaattacttaaagctctttatggcctcaagcaggcccctcgagcttggaacatggtgattgacaatttccttagcaaacaaggatttgtgaaatgcacagtagagtttggtgtgtatgtaaaggaaactcaacacaagaacttgctatttgtatgcttgtatgtggatgatttgatcattacaggagatgtggatgaagaaatcgagcaattcaaagaaaagatgaagttagagtttaacatgacagatcttggaatcctgcattattttctcgattttgaatttatgcatacacaaaagggaatcttcctacaccaaagaaaatacactggtgaggttctgaaacgctttaatatggagaattgcaacatagtcacagtacccgtgatgccaaacttgaaattaacagaagaactggatgaaaagccagttgatgcaacattgttcaagcaaattattggctcactcagattcctatgcaacaacagacccgacattagttatggagtgggattgcttcgcagattcatgagtaatcctcgagctcctcacatgactgcagctaagcatatcttgag

SEQ ID NO: 63403 - DNA, 906 bp, Glycine max
  Peptide Sequence Number=SeqID_180181
gggtaccttacggttatccgaaccttttgccaaccagaggaaagcgagcccgttgacaagcagggacaaacatcgtcatctgcaccttttgtcaacctggggcaagcgagcccagacgacgagtccgatgacatgtgggggtaccttatggttatccgcatcttttgtcatccagagacgacgagtccgatgacatatgggggggcaagcaagcccgttcacatgcagagactaatgccatcttctgcacctttgtcatctagagacgacgagtccaatgacatatggggctacctttcggttatcggcacctcttgtcaactagaggcaagcgagtccattgacacgcagagactaacaacagaagacgagtcggatgacatgcggttgtaccttatggttatccgcatcttttgtcatccagagacgtcgagtccgatgacatatgggggtaccttatggttatccgcaccttttgtgaaccagaggcaagcgaggccgatgacatgcggcagtaccttatggtgtctgcaccttttgtcatccagagacggcgagtccgatgagatgtggggcaagcccgctgacacgcagagactaacgtcgtcttttgtaactttgtcatcaagagacgacgagtccgatgacatgcgggggtaccttatggttatctgcaccttttcttatccagagacggcgagtccgatgacatggcgggtaccttatggttatccgcaccttttgtcatccagagacggcgagtctgatgacatgcagggggcaagccagcccgttgacacgcagagactaacgtcatcttctgcacctttgtcatccagagacgacgagtctgatgacatgcgggggtaccttatggttatccgcatcttttgtcatccagagacg

SEQ ID NO: 63404 - DNA, 99 bp, Glycine max
  Peptide Sequence Number=SeqID_180182
atggggttcgatagggctatggcgtggtctgttgcagaaaacacggccattggccctcacaaatgctgctatgccgatgctaatgcccgcccacagtag

SEQ ID NO: 63405 - DNA, 472 bp, Glycine max
  Peptide Sequence Number=SeqID_180183
gaccggaatcactgaaagcactagtgttaatggaggaatcagtagcattaacagcaataacatggtgtttccgcgtgtggaaactgggaacttgaaggagttcaatttcgcggatcagaaagcagcaaccaagagtttcaagtcggatgcattgcttggtgaaggaggctttggcaaagattacaatgcaaaaatttcagattttggcttggccaaattaggcccttctggggaagattcacatgtgagtacgagtatcatgggaacatatggctatgctgctccagaatacattgcaacagggttaagggcacttgacaaaaaccgcattatagagcagcagaatctaattgaatgggcaaagtcttctctctctgataaaagaaagttgaaaagcatcatggatgagaggatagaggatgttcttgacacattggaacgcatcgaagctatcaaggatacaacgaagtaa

SEQ ID NO: 63406 - DNA, 297 bp, Glycine max
  Peptide Sequence Number=SeqID_180184
atgtcatttaggacttgtgggaaagcttgggcagagcaaatgaggaaaatgagtgatcaaaaaaatgcttgtgcattgctggttacgggaaagcttggaggggttgatggggacccggtgttgagaggaacgaggataagggctacgtgggggtgcgtgagctcagttgaaggtgggcaactctggatgagtggtacctggagatatgtcgcgggggtcaggagaccttggggacgtcaggtggggtgctattgcccaaaaccaagcttgaccaatcccgacccaacctgggcatag

SEQ ID NO: 63407 - DNA, 279 bp, Glycine max
  Peptide Sequence Number=SeqID_180185
atggttgtcatcatcaaaaaggggaaaaatgtgaatcatgcaggttttgatgatgctgaaaagaattcacttaataatgattgtcatcatcaaaaaatgggagaatatgaatcatgcaggctaaaagaagagaaggttcaagtagttgatgtctcgctaagcgagctgcatgcctcgtttagtgtgttgggaaatcctagaagaggatcattcagagatatgctcactcagcgcactgccatctcgcccagcgagttgtttgtctcttctcgcacttag

SEQ ID NO: 63408 - DNA, 750 bp, Glycine max
  Peptide Sequence Number=SeqID_180186
atggctgctccaccacttctacaagttttaaatcttctgagcttctccattttgtttccgattacttctacaaaaaacccaaagcttaagatgattccaaacttgcttgatgatctccatgtgatatacaagttggaccggaaggaggaagacagtgatatagcacaagactatacaggggaagaaaggcaaggaaacagcaacaattgccaaccatcatggaaagtctttcctgttcttgatcaggatctcaattgtcttccttatgaagacgacgagtctgagtcactggacaatgagacagatgttgaaagctcaccaggtttgctagcaaagaaaaagagggcacccagtgatcttgtagcaaaaatttctttatcagatttggtcaagtactttggtatgccaattgtagaagcatcaagaaatctaaatgttgggctcactgttctcaagagaaagtgcagagaatttggtattccccgctggcctcataggaagatcaaatcacttgacagtctcattcatgatcttcaggaagaggtaaagagccaagaattggaggacagggaagcagctttggcagtggccaagaggcaaaggatgttggagagtgaaaaggaaaacatagagaagaaacccttcatggacatacaaagtgagaccaagagattcaggcaagatgttttcaagagaagacatagagctagagctgttggaaaacacaattcaacagtatccagcacatag

SEQ ID NO: 63409 - DNA, 447 bp, Glycine max
  Peptide Sequence Number=SeqID_180187
atgaaggggtattcagagccactatggcatctggaggcagagcctcataagcagcagatagagtgtggacatgatcatacttcatccattggagtgggagttggagttacctcactgtctgacgaaataaagtcaccggaggatggtattctgatgggttcctttggagtcatggacttgcatccagctcgtgtcttcttcttctttggaaaaaaaggatgggatgattggctaatcaagcttctatttcttttggatagtgtcacaacctacccttcggtgggaaggcgacgcgagactcacgggtgcgtcttccaagggaggaaaacacatggagttgccaccaacgtttatttgaggaaaatgctagaaaaaccaaaaagcgggtctatgaactttaagtatgaaaggttcgggagtttgttttacacaaggggaaggtattag

SEQ ID NO: 63410 - DNA, 1839 bp, Glycine max
  Peptide Sequence Number=SeqID_180188
atgaccgaacctcaagaccccttctcctaccctcccattgaccccgtcaacttcgatctcatcatcgtcggcaccgccctatcggaatccgtcatcgccgccgccgcctccgccgtcggcaaaaccatcctccacctcgaccccaactccttctacggcagccacttcgcttctctctccctccacgatctcacttcctacctcacttccccgcactccctcccctccgccgcaaccgccgccgcatcctccgactctgacgacatcgttgtcgtcgacctcgtccaccaacccctctgcaccgacgcggaaaccgcgacctacgatgaatccgcgtttctcagcgaaaattcgcgaaaattcaacatcgatttgggaggtcccagggcgctgttctgcgcggacaagacgatcgatctgttgatgaaatcgggcgctgcgcagtatttggagttcaaaggaatcgacgagagcttcgtctatgaagcgaacgcgggtttggcgaacgtgccggattctcgaggagcgattttcagagacaagaagctttcgctgaaggagaagaaccagttgatgaggttcttcaagctggttcagcagcacctcgatgatactcaggaggagaagattcccaaggaggatttggagattccgtttgttagtttcttggagaagatgaagttgccgcctaagataaaatcgtattcaccatttctgtttactaccatgctagattatgatcaagacaacaacgaggtttgtgaagagttacttaaaacaaaagatggaatagattgtttagctcaatacagctcatctgttggaaggtttcccaatgctcctggggctttgctttatcctatttatggtgaaggagaactaccacaggccttttgtcgtcgtgctgctgtcaaaggttgcatttatagggcgagccctggtgcagcggtaaagttgtgccttggtgacttgttggtcatgggttcgaatccggaaacagcctctttgcatatgcaaggaaggaaacatggttcagctatcatgttgtcatgcttggcatttcctggatctttcttcctgaaagccaggagggtagttgtggttctaagaatgccggttgtttcgctgcttatggataaggttactgggtcttataaaggtgttagattagcttcagggcaggatttatacagccaccaactaatcctggacccatccttcacaattccatcaccgttgtctttgtctctaggagattttcccagtgaaaggctccaaatgttgagtcagagagatattaaaggaatggtggctaggggaatatgtatcacaaggagttcaataaagccagatgtatcaagttgctcagtggtgtatcctcctagatctttgtatcctgaacaggtgacttcaatcaaagctcttcagataggatcaaatctcgctgtttgtcctgcaggaacctttattttatacctttccactttgtgcaatgatgccgatgaaggaaagaagctactaaaagcagccatgaatgctctacttacgctgcctgtatcgggaaactctgaaagcattccaagtgttcaaagtgacagtgaagatataaaacccattgtgctctggagtgcattttatattcagaaattaattatgagtaaatttgaatttatcagctccactcctacaccggatggaaatctgaactacaatgcccttttagatgcgaccgagaagctatttaatcagatgtaccccaatgaagaattctttccaaaggcaacatcacctgaagatcctacagatgaggatgataatgggttaactttggatagctaa

SEQ ID NO: 63411 - DNA, 276 bp, Glycine max
  Peptide Sequence Number=SeqID_180189
atgaaggtagacattaggtggaacatgactattcctctagtggaccaagataacattgaacataaaaggcagaagaagctggccaggactattgctgataaagacaaggctctagaaacctttgaccttgctaaaaagtacagagcactctcagggagtagatgggcaacgtccagaccaggaagcaagcctaacaacaagaggaagaagaagaaattatcaccaaagagcaacagacaaagaaaaatcatgaagagtctaaaccctctcctctag

SEQ ID NO: 63412 - DNA, 2301 bp, Glycine max
  Peptide Sequence Number=SeqID_180190
atgatccggcacgcagcgtttgacccagaagtggcaagcaaagtgtgtagtgtgattgaaccatttttgctgtcactggcaaagacttcaaaccccataactctgagatactgcaaccaaatccacgcaaagctcatagtctcccaatgcatttcacagacccacttaaccaacaccctcttgagcctctacgccaaatttggccactttcaccatgcccacctcctgttcgaccaaatgtctcacaggaacgttgtcacctggacaaccttaatttcgtcgcatctccgaactgggtcacttccaaaagcctttgagatgttcaatcaaatgtgtgctttgaatgagagacccaatgagtacaccttctctgtcctgcttcgagcttgtgccactccttcattgtggaatgtgggtttgcagattcatggcctgctggttcggtctgggctcgagagaaacaagtttgctgggagctctattgtgtatatgtactttaaaagtggtagtaatctcggggatgcctttcgtgcttttcatgacttgttggagagagaccttgttgcatggaatgttatgatttttgggtttgctcaagttggtgacttatgcatggttcgtaggttgttttctgaaatgtggggagtcaaaggcttgaaacctgatgatagtacctttgttagcttacttaagtgttgttcttcgttgaaagagttaaagcaaattcatgggcttgcatctaagtttggtgctgaagttgatgttgtggtgggcagtgccctggttgacttgtatgccaaatgtggggatgtaagttcttgcaggaaagtctttgactccatggaggagaaggacaattttgtttggagttctatcatttcaggctataccatgaataagagaggaggggaagctgtgcatttcttcaaggacatgtgtagacaaagggtgagaccagatcagcacgtgctatcaagtactttgaaagcttgcgttgaattagaggacttgaacacaggagttcaagtgcatggccaaatgataaaatatgggcatcaaagcgattgctttgtagcaagcgtgttgttgactctctatgccagtgtcggtgaacttgtggatgtggaaaagttgttcagaagaattgatgataaagatattgtagcatggaactcaatgatcttggctcatgctcggttggcacagggatctggtccctctatgaaactattacaagaacttcgtggaacaacctctttgcaaattcaaggtgcctccttggttgctgttttaaagtcttgtgagaataaatcagatttgcctgcaggtaggcaaattcattcacttgtagtgaaatcaagtgtaagtcatcatactttggttggcaatgcattagtctacatgtactctgagtgtggacaaattggtgatgcatttaaagcttttgatgacattgtctggaaagatgatggttcttggagttctatcattggaacttatagacaaaatgggatggaatcagaagctttagagctatgcaaagagatgttggctgatggaatcacttttacgagttatagccttcctctgtctatttcagcttgctcgcaactttcagctatacatgtgggtaaacagttccatgtttttgctatcaagtctggttacaaccatgatgtgtatgttggaagctccattatagatatgtacgctaaatgtggaatcatggaggagtcagagaaagcttttgatgaacaagtagagcctaatgaagtaatttataatgccatgatctgtggatatgctcatcatggaaaagcacaacaagccatagaagtatttagtaagttggagaagaatggtttaacccccaatcacgtaactttcttagctgtactatcagcttgtagccattcgggttatgtagaagataccttgcatttttttgcattgatgcttaacaaatacaagattaagccagaatctgagcattattcgtgcttagttgatgcctatggccgggcaggaaggcttgaggaagcataccaaatagtgcagaaggttggaagtgaatcagcatggagaacattactaagcgcttgtaggaatcataataacaaagaaattggagaaaaatgtgcaatgaagatgatagaattcaatcctagtgatcatgttgcctatattcttctttccaacatttacattggagagggaaaatgggaagaagctcttaaatgtagggagaggatgaccgagatttgtgtgaagaaagatccaggtagtagttggttgatctga

SEQ ID NO: 63413 - DNA, 598 bp, Glycine max
  Peptide Sequence Number=SeqID_180191
atggctggtcccggcaaatgcttcctcgtgacgggtcctccgggtgtgggaaaaaccactcttattatgaaagtattcgagtccctcaaagtcaatccatccctcaagcttcagggcttctacactcgggaaattaggcgcgccggccagagggttggttttgaagtggtcacactcgacggtcgcactgccccacttgcttccatcgacatttcaacccccgagtctctcagatggcctaatgttggcaagtataaagttgatgttgcttccttcgagtcactagcacttcccgagttacaggagattggattactaaatattttgccaactatattgctatccttgcaaatgtggtatgatgctcttcaactgttccgttgcatttttaaactaaaaaacttcgtaccctattgcccagaggctcttcgctatgcgaaggttaaagaagacactgatctcttcatcattgacgaagttggtaagatggagttgttcagttcctcattcttccctgcagttctaagagttttggagtcaaatatcccagttttggcttccattccagttccaaaattcggcagagacatacctgaag

SEQ ID NO: 63414 - DNA, 552 bp, Glycine max
  Peptide Sequence Number=SeqID_180192
atgtcaatattttattcaaatcatgttcaggcacaggtttgggacatagacaagaaactgttgccagacgtgtacattgttaaggaagaaatcacttgtttctcagtcatacaacatagcctttttatgtatattggattttctaatggcaatatgtcagttttgatgcttgatcaagaaccatggcatgtggtactgatgaaatacaccataccatggcctgtagtgttgttgaacgagcatacagaatctcgcacaattaagatggagcatcatttgtcagaaggttgtattgacatggagatcatatcaacctcaagcaagcatagacaaaattatttcattttgcttgggaaatcaggccatgtatatcaatatgatgataatttgattgaaaggtatccactgcaaaaccagtctaagtccactccttcactgccaaaggaagtggttgtgaagttaccactggcagattcaagcatcactacagcaaaattcatctccaacaatcccaatttgtttacttctgaagatgaggtactgtggttgtga

SEQ ID NO: 63415 - DNA, 1292 bp, Glycine max
  Peptide Sequence Number=SeqID_180193
tcaatggtctccctcaaattaagaatccacaagctgtatgtgagagatgtcttgttagcaaacaacctagatcaacatttgggtcttatgtccctagtatagcaaatgaattcagcaagaagttatggacctatccacttaaagctaagagtgaagtatttgatacctttaaggtgttcaagatactagtggagaaacagttagggaaaagtttaaagatcataagaacagatggtggaggggagttcacttctggagaattcgagaacttctgcagagataatggcataatccatgagatcacaactccatatacacctcagcataatgatgttgcagaaagaagaaatagaaccattatgaatatggttaaaagcatgataaaaggcataaatctttcactaagtttctgggctgaagcagtggagacagctacctatatactaaatcgatgtccaactcagaactcagtttcactagtaccagagaaggtttggtcagatgaagctataccacatggagaaggtaatgctgaacaaaacatagaacaaataagatcaggaagaatgaggagaatgcctacaagactcaaagattaccacatgttccctaacagtgcaatcacaattgaggatgccatgaatgaagaaataagagccatagaaaggaataaaacctgggatttagtcactttaccaattgggaagactcctatagcggtcaagtgggtttataaaaccaaactgaagcttgatgacagcatagccaagcacaaagctaggctagtagttaaaaggttcatgcaaaaggaaggagaggattactcagaaatatttgcaccagtggctagatttgagactgtaagtaaagacaaggtgtacagacttagaaaggctttgtatggactgaaacaggctctaagggcttggaataaaacaatagattcctttatacatggtgaagactttaagaaatgtactgtagagcatggtatctatgtgaaggcaactaaggatggtggagtcctgctaatatgcctctatgtggatgatttgctgattacagggagtaattcaattgagatagaaaagttgaaggacaatctcaaatctaaattcgagatgtcagatttaggcttgctatcagacttccttggtattgagtttgctgaaactaaggatggaatagtgatgcaccataagaagtacattaaagaagtattgaagaggttaaacatggatcaatgtaataaggcagctagtgggatgcttaagattcgtctgccacagtag

SEQ ID NO: 63416 - DNA, 181 bp, Glycine max
  Peptide Sequence Number=SeqID_180194
atggcagatcaagaaagtgcacatgaagaaacaactcatggtcctaactatactccttcatattctccttctgctcatgctccttcagcaacaccaaatgaatccatagtagcacctgaagtagaagaaacaaccgataatctggaggggacaatagaaaaaggaaaaagtaggcttaaaa

SEQ ID NO: 63417 - DNA, 2594 bp, Glycine max
  Peptide Sequence Number=SeqID_180195
gcctggaagctcctcgcaatagtctagatctgcaagtacaaacacctaagaactactgtccagaaggaaaattaccatacaattatcaagtagaagaaaagggcaggtctgagaataaccgctattcaaacgtgggttcaatgaaaaaactgatcaatgaggagctatccaaacaatcaagcaccagacaaaatgcgccaagccttgtggcaaggttgatggggatagatacaatgccattagacactaaatatgttgttccatcagacaaaaaaataagtgaaaacatggggaagaggtcatcagtcaatggagtgaatcgaagggtttcagttagttggggttcttccaactttaattcttctagccagatggattttgattcattatataaagacataggtgatgaagatgatggatggaaccggagttttggagaaccaaggccgcgagaacatcctcaggaagaggaactccaaaaattcaagaaagagtttgaagcatatcaagcagcaaggtttctggagtgttcaaaggttgttgaaattggcagtgctcctagacaattgcttgctcaagaaaacctgaacaaggaaaaggtgatgcataatgattcagttttacaaagagcagcagcacggaaacttgcagatcttgacagccattcattcaaaatgccacctgacagttatggttcagaatatcatggtaacatgatggacctaatcccagctatgcaaaggagaacatttcctccaaggagcagaacactaagtagagactttgaggagtccttactgatgaaatcttgcaacaaattagacatgtcttcttctcccactaggatagttatcttgaagcctggtcctgatagcattcgcaaccatgaagagaattggactatttcgtcgggaactatacaaggaagaaatagtatagaagattttcttgaagaggtgaaagagcgtttgaaatgtgaactgcaaggtaaaattgtcaaaaaaggttctgtggttcgagggagtggaattgagacaccttacaatgaaaagccatctgatcctaaactaatagcccgtcacatagtaaagcaagtcagagaaagtgtgactagagatactgacacaactttactccactcagaatcaacaggatcatacaaaagtgaaatgcagttcaatggaccaagctccccagaatttttcagcagagataccaggaggttcttgtccaagaggctaagaaatgttgtgagaagggaagcacatgctgacattcctgagggaaaatcaatgtcacttgcattagacaaccataaagctagactaaagccagcggagaatattaagaagtatgcaagtaactgggaaatttccaaagaggacacatcaatacaaacaggatctttcaggcatgaacttgatgagaatatatttctccacaaggagttatcaccaagaaaccttgtaagatccttgtctgctcctgtatcacattcaggaacatcatttggtaagcttcttctagaggaccgccatattttaactggtgctcagattcggaggaagcttgaagctgttgaaactatgtctgttgatgtcaagaaacggaaaaatgatagatttaatattaaagaaagagtctccaattttagatataatcttgctttaagagggaggctttttggcagaagggttcaatcaatggtagaatcacatggtaacgaatttggtccctttgtgagagatgccacaagtggaccaacagttctcatgaactgtggtgagaggcatgagaactccactgaggtacctcctagtcctgcttctgtgtacagcagtgctcatgaagacatttggaggcaaactgaatatttaagtccaatatcaactcctgacgtgtcttcaagagacgataatgttgtgccccaggttttcagggatatcagctctggtttgaatgagctaaggagacaactcaatcaacttgaatctgatggtcttgaggacttgactatgaaacaggagcctgctgagtctgaattagaccaattagagaatccagcagaatcttacataagagatctacttgttgcttctggtctgtacttcggttcatgggataaatctttattaagaggggacacatttgcaaagcctattggcaactctgtttatgaagaagtggaagaatctcacaagaaattggtcaaggaaaatgatgaaagctgtatcaaggatcagaatgagagtaagctagaccacaaagttttgcttgatttgttaaatgaggcacttccagttgttcttggacctcctttgacattgtctagattcagaaggaaattaagcaacccttccatgttgccaccttctggaaaggaactgttgaagttagtgtgggacattatccgtgtttctttttatcctccatctgacatatctactaattcacttgatactttggtggctcaacacctaggatccatcccttggtctggattaataaatgatgagatcaatattttggaaagagatatagaatgtctaataactgatgatctggttgaagaactcacaaaggatatgttctaa

SEQ ID NO: 63418 - DNA, 318 bp, Glycine max
  Peptide Sequence Number=SeqID_180196
cgacgaggcaggtcgttacaaacaacgacttcttgagtgctcaggtgggaagacaccagatctagcactccaagcacaaacatacaaaaaaagaggagctcatggccgaggaagaagacataaaggaaggggtcatgatagggtagccaaagataatccagagagaaataatgaaactcaagaacatttcaaactgagcaagatgattggacatttttcatctgaatgtcaatacccaatccacaatcagaataatggaagacaaggcaatgaagcaaatatggccaaggaagcagattcagaagatgatgttctctt

SEQ ID NO: 63419 - DNA, 804 bp, Glycine max
  Peptide Sequence Number=SeqID_180197
atgacctttgaacagaagaatgataaactggctaacattcaaagtcaaaacaatatacttgacatttcttctggattcttgcatcttgctggagactcattgattcctgaaactatcagtaagaaatgcctagaggatgctaaagttctgcatcaagtggacaaaaaattcattccagttgtggctggcagaacccttgctgttattgatcagcatgctgcagatgaaagaatcagactggaagaattgcgtcaaaaggtattgtcaggagaagaaaaagcaataacctatctagatgctgaacaggaactggtattgccagagattggttatcagctacttcatagttatagtgaacagattaaagattggggctggatctgcaacattcatgctcaaaattctgaatcctttagaaggagtttggatatcctcaacagaccacaaatggccgtcacacttattgcgcttgctgacactgatggatcatcaacaattccaccctctgtcttacgagtgctaaatttgaaagcatgcagaggtgcaattatgtttggggattcattgctaccatcagaatgttcccttatagttgaagagctaaaacatacatcactctgtttccaatgtgctcatgggcgaccaacaactgttcctctagtcaacttggaggcactgcataatcagatagccaagcttcgactgatgaacgagcgttcaagtgatgagtggcatggattacatagacataaagtgtgcattgaacgtgcagcacagcgtttaaattttgctagaggaatttga

SEQ ID NO: 63420 - DNA, 291 bp, Glycine max
  Peptide Sequence Number=SeqID_180198
atgcacccaaatcatgtttcaatttcttctctcaagcaacaaagtaagaataaagggaaagagcacaaacttgagcatgaatacgaggctagagcgcgaactgagcatgacggcatgggcagagcaccacctgaccaagagcttggtaatggtgaagttgagagggacaacaatagcgaaggttgcaatgaggcaatggcaagcatgacagcgagcgcgagagcgacggtgagggagagcaagagagcgacaacaagggagagcactaggtttaaagtaatgagggtgtga

SEQ ID NO: 63421 - DNA, 717 bp, Glycine max
  Peptide Sequence Number=SeqID_180199
atgggtgagcttgcgattccatggaattttcttgttactgacagtgctcgtcctgcgccagtccgagaagaatttatcccaaagcaagtgccacctgaggtaggcaccagtgggatccaaggtgaggaagctgtcactattggggaggtggggcctattgattacggaattgcaattgctcgagaggaggttgctactcaaggggttgtagtttctgatggggttgtagctgatcacgagattattattgttcagggggcttcgattgtagttcctgaaaaggaaggtaacaataatgggtctgcagaaatcttgattttgcagcccaatctgacatctaatgattggaggttgctggttgttcaaggggctacagcagtggctcataatgctttggttgatgaagtagttgatgaagtgggtgatggtgagagtctttctggtgcagaaacaacacctcaacaggaactttatatggttctttgtggggaacaacaggagagaaatgatattgctttggtttccaagttatggagtgatcatgtagaggacacatatgatttagagaaatcttctccgcagcaacaacaagagcaaattccttttcaaacgatcttatcaaagtgtcaaaagaagaggttacgccagaaaactaaacctatagctattggtgcagtatcttacaaccttcatgggagtcctaagtcaattgcttaa

SEQ ID NO: 63422 - DNA, 828 bp, Glycine max
  Peptide Sequence Number=SeqID_180200
atggcttttggagcaaacataatacagaggaggattatagaagtgattactaaagattctgatttcctagttagaccgttgtctgaagaaaattgtctccctccagattcatgctattcagcattacgaataggaagctctgggtcagatgatcagttgttaaattttgaatggcatcctgtccaccaaatcccctcatctcaagcatctgcattgggtgtttgtcatacaactgatattgaggatgagcttggagaaatatctagatactataaaaggatccatcatacaaaacattttgatgatagagaggctgattgcagattcagctacaatatgtcaaggaatgccaaccaacatcgccgtgcatcaagttttgcaaatattggatttaattttgatgttgctggtgattgtggtgaaatattcaacagactagttgacaggcctgatttcggtgatatacattcttcaaaaaggtcagatattttaaacgaggagccagactggctgttgtccaagtcatgtattaaaagctgcaagagacctaacaagaacaaaggcaaaagggatcgatttagaaattcaactttggaggagaatcttgaaagatctagaagaagcttttccgctcctccttttcatagaagcaaaaggaggtttttctctttaaatcatccttcagaaatgatagccaaaagacagattggccgagtgtccaaccctgctttcaatcatcaagaagctagtaattttaaatatccgcaacagtctcctgttgctcttcaccagagcactgaagatttcttattgcaagaattcaagtag

SEQ ID NO: 63423 - DNA, 981 bp, Glycine max
  Peptide Sequence Number=SeqID_180201
atggacatgtttatgtttgaaaagaatcaaataccttatgcatgtgtcctgttggccttaacatggttagatgtcaactcacaatttgtttgcaagggcccagttcacaagcttgtgagtcaactggctaataggcttgagcatctgaactcatggaatactgataaagaattccgaagcaagaagagaaccaggtgtcaaccatgtccagcttatctcttgaatttgagttgcccccgatctttgtatgatttggcctttgagccatcaaaaactcatgttaaattcaaggattggactcctatactaaacttcattgagaaggccatcaaacaattctgggaggaaaacgtagcttgtgtagatccgtccaatgaagccacatacatggtagaagatcaacaagagaaagcagatgtcaacatcatttcagcagtatcagatatgtcaaagtttagaaaccaaaatcgtaaggattgcctagatctctttttttctacttcagacaatctaattgaagatgactatcatcaatccaaaagggaagatgttgattactttggagccacaatgttcaaagtgcaacaaagtaagggagactttcttcttcagactggttattctggcaacttattggatggttcttatgccaagtgcaactccactgtgatgagaaagcataatagtttgttgatgcatgatagcaatagtttactggaaggtgataactttttttatggtgaaattcctgctgtagaaagtttcaacattgatgtaccttttgatgcaccgagttcttcacatggaagaagattccataaagtagaagctgatgtgatcaatgaatcatttgaagatgatttactttataatagctgcagtgggtatggttatgatgtaaagattaatggggatttgcaacaaccttttctaaagagatgctctatgctaggaagtatcctgcatgagaaggctttgttc

SEQ ID NO: 63424 - DNA, 522 bp, Glycine max
  Peptide Sequence Number=SeqID_180202
atggccagcataaagcctttgccggaggctgtgcgtagctcactgcgttctggcattttcctcttcgacttcacgcgtgtcgtcgaggaacttgttttcaatagcctcgatgctcgtgccacaaaggtatcagtgtttgttagtactaggagctgctatttgaaagttgttgatgacggaagtggaatccctcgagacgagctggagttggtgggagaaagatatgcggtaaagttgtgccttggtgacttgttggtcatgggttcgaatccggaaacagtctctttgcatatacaaggtctctttgctggaaattgtgacaaaaacatatggaaggcccaatggatatcgaaaagtattgaaggtggggataacttcctatgctttattcagggagacattaatcatatcattgcttctattgatgcaagaaaggaagtgggcaccacagctagggtttatgggattcttcaatcttccttctcttcctcttttctctcacaaaagatagttgccatctga

SEQ ID NO: 63425 - DNA, 528 bp, Glycine max
  Peptide Sequence Number=SeqID_180203
atgtcgtgttcgtcgtcatcggggtcggaggaaggtgatgagggattcgactcttaccggaaaggagggtaccacgccgtcagagtcgccgatcagttcgccgccggcaggtacatagcgcagagaaagttgggttggggtcagttttccaccgtgtggctcgcttacgatactaaaactgagattatttggcttcttgatgtggattgccactacggctctatgaatctacgattccttattttgctcagcatgtgtcacaaaatgaaatctatgcatgttggagtagcggaaaatggcgaatggtcctcacaaaacgtgaccacctggtttcacatggatgatgatttgtcttcatatgttgctctcaagatccagaaaagtgcagctcagtttgctcaggctgcccttcatgagattgaacttctttcatccattgctgaccacaatccaacaaattcaaaatttgttattcaattgattgaccactttaaacacacaggtccaaatgggcagcatctttgcatg

SEQ ID NO: 63426 - DNA, 1170 bp, Glycine max
  Peptide Sequence Number=SeqID_180204
atggcagcagaagaagccacatgtttcacgtgtgaggcagctataatgagtggtgttggtggtgggtgcccctgccccaggggcaatagtgagtgttccatggaagatctgaatggtgatacggtggggaatttgaatcagaatgctgcaaaacctccaagggaccattcggttatgcgccattgcagcagctcttcttggtctgctgaaccggaatcaaatattaatattgttggacttaaatcaagcacagaagaaaaaccagactttttagttgtattgcgatctggatgttgttctgacaaaggaccaaagcaatacatggaggatgagttcatatgtgctgatattcttagtgaatgtgtcgatctaagggaagacctcccttctcctgcagcattttatggggtatttgatggccatggtggtgttgatgcagcatcatttaccagaaagaacattctcaagtttattgttgaagatgctcatttcccgtgtggaattaagaaagcagttaagtgtgcatttgtgaaggttgatcttgcgtttagagatgctagtgctcttgatagttcttcaggcaccaccgctctaatagcccttatgttgggaagttccatgcttattgccaatgcaggagattcacgtgctgtattgggcaaacggggcagagccattgaactttccaaagaccataaaccaaattgcacatctgaaagactaagaattgagaaactgggtggtgtcatctatgatggatacctcaatggccaactatcggtggcgcgtgctcttggagattggcacatcaaaggttctaaaggttccaagagtcccttaagttctgaacctgaactggaggagattgtgctgacagaagaagatgagtttttgataatcggttgtgatggattgtgggatgtgatgagtagccaatgtgctgttacaatggtgaggacggagctcatgcagcacaatgatcccaccacatgtgcaaaagtacttgtttctgaggccctccaacgcaacacgtgtgacaacctgacagttgtggtggtgtgtttctccaaagatccacctcctaaaattgaaattcctagatcatataggaggaggagtatttctgctgagggccttgatcttctcaagggagttttgaatggtagatga

SEQ ID NO: 63427 - DNA, 786 bp, Glycine max
  Peptide Sequence Number=SeqID_180205
atggcttaccacccccagactgacgatcagaccaaggttcttaacagagtcctcaaacagtatttgcgctcattcacacatgaccaacctcatcattggtacaaattcttatccttggcagaatggtcttataacacctctgtatatgtcaacacgaacttttctccatttgaagttacatatggcaaaccatcatcttcccttccaccataccttcaaggttcttcaacaatggaagtcgttgacacaatactcacttcacgagccgccattcattccgtccttcaacgaagtttacagaaatatcaggcttcaatgaaaacccaggctgatgttcaccgacgggatttagaatttgctataggcgattgggtttatgttaaactccgtccatacaggcagacattagttcagcccacttactcaaaattatccaagtgctattatgggttgttcctagtacaagcccgcataggctttattacacttccccacttcctccttccaatactgacaatcaccccattgtccaaccatcacagctcctggcttggaagatggaccacaccaccactccacccacccaacaggccaaaagaagagaaggctcaagtagctaatgactcgctaagtgcagcagatccgcttagcgagtgtcatccgctaagcgaggcatacaacttgcttagcgggttgggaaaccctaaaagaggattagtcagagatgtgctcgcccagcgcgccaccaactcgcccaacaaggtcgttgtcccttcttgcgcttag

SEQ ID NO: 63428 - DNA, 432 bp, Glycine max
  Peptide Sequence Number=SeqID_180206
atggagaaaacgcaaatactgtttgaggactctgttaagaaccttggtctgatcgtcagtctgggggtggtaagccatactcatgcgaagcttagtgccactcaggcagaacaattctcaccagaaggatggggaagagggtcgaggtgtgtgccttttgagtacatatcaacaacgaccatgatcgttgtgaaaccattggaaactggtaatcttgtgatgaaatccatggataaatcttcccaaatagtcgaaggaatgggcaaaggttgcaacaagcctgcaggattgcaaaaagaagaaaatttggaaggtgctgaagctgctgtctcgctaagcctggaccatgtgcttagcgagcatcaaccgctaagcgagacatcagcccgcttaacgagtaaagggaatcttggagataatatgccacgctag

SEQ ID NO: 63429 - DNA, 2262 bp, Glycine max
  Peptide Sequence Number=SeqID_180207
atgcgtaaactttggaaagcattcgcatatcctacatcctccccaacccattttctaaggcgttttcaatttcagacgcattcatcttcatcctctgcaccaagccaggagcatgtttcgcagctgatactggaccagaaatctgcttccgaggcactggaatacttcagatgggcctccaccgtccccaacttcgtccattctcaatccacataccgcgccttgatccacaagctctgcactttccgccgtttcgacaccgtcaagcaactgctcgacgaaatgccccactcactcggcgcgccacccggggatgacatcttcatcaccatcatccgcggcctcggccgtgcccggatgactagaactgtcatcaaagtgcttgacttggtgtacaagtttcatggcagcccctccctcaagattttcaactcaattttggatgtccttgtgaaggaggacattgacatggctagggagttttacagaaagagcatgatggcaagtggggttgagggggatgattacacttttgggattttgatgaaagggttgtgcctcactaataggataggtgaaggttttaagctcttgcagcttattaagtctagaggggttgccccaaacactgtggtatacaacactttgcttcatgcactttgtaggaatgggaaggttgggagggccaggaatttgatgaatgagatggaggaccctaatgacgttacctttaatattttgatatctgggtattgtaaggaaggaaattcagttcaggctcttgtcctgctggagaagagttttagcatggggtttgtgcctgatgttgttagtgttactaaggtgctggagattctgtgcaatgctggccgcaccatggaggcggccgaggttttagagagagttgagagcatgggaggtttgctagatgttgtggcttacaacaccctgataaaggggttttgtggagcagggaaggtgaaggttgggcttcattttttgaagcagatggagaacaaaggctgtctacctaatgtggatacctacaatgtactgatatctggtttcagtgagtctgggatgttggatttggctcttgatctttttaatgatatgaaaacagacgggatcaaatggaactttgttacatttgacacattaatcagaggtttgtgttcagaagaaagaattgaagatggtttttctattttggagttaatggaagaaagcaaagaaggctctagagggcacataagtccttataatagcataatatatggcctgttaaagaaaaatggatttgatgagtcagctgagtttctaacaaagatggggaacttgttccccagggctgttgacagaagcctgatgattttagagcactgcaagaagggtgctattgaggatgcaaagagggtatatgatcagatgattgatgaaggtggaattccaagtattctagtttataactgcttagtgcatggattttccaaacaaggtaacgtccgggaggccgttgagctgatgaatgaaatgattgctaataactgtttccccattccatctacattcaatgctgtcataactggtttttgcagacaaggaaaagttgagagtgccttgaagttggtggaagacataactgcaagaggttgtgtaccgaacacagaaacttacagtcccttgattgatgtcctatgtaggaatggggaccttcagaaagccatgcaggtctttatgcaaatgcttcaagctcatgggcctcctcatgctcttcgccatcgccttccacacccgccgcaaacgagaatctctctcctcctcgctgccaagagtatcgtgatggtcgaggatgtttttgtttttgttaagaacaagcccgatttgaaaatattcgggggtttatcggtgttcttctacggcataggtgtggctgtgtatgctttcgagggaattggaatggttttgcctttggaaactgaggcgaaggacaagaagaatttcgggtacttagcgtttggggaagaaactaaggatattattaccaccaatttggggcctggggtgattagtgtattggttcagttggggctttgtgttaatctcttcttcacttttccgattatgatgaacccggtgaatgaggtgggtgatggtgttggccataagcttggtggcgcttttggtgcccaattttgcgggaggagttggggtggaggtgtgttctttgggatggggcaattgcggtttttgggtttgtga

SEQ ID NO: 63430 - DNA, 219 bp, Glycine max
  Peptide Sequence Number=SeqID_180208
atggtttggcggtccttgatagtcgaagaattgttagattttgaagatccagccaaccggatcttggccattgaaatgaggaatcactggagatttaggggaagaggggttgatggtgagagcaacaagatgatcaaggatgaagtccatcttgatgcattcaatggctatttgtctggtgttgtgttctggcatggcactgagctgagaacagagctg

SEQ ID NO: 63431 - DNA, 2094 bp, Glycine max
  Peptide Sequence Number=SeqID_180209
atgattaaagcttggctcttggttttaatggttctctccaatgggttcttttcaaatggggatggcatgcataattccacaataccagattttgtaaatattggggctctcttctctttcaatactagtgttggtagaagtataaaaattgctatagaagctgcggttgaagatgtaaattctgaccctactattcttggtaaaaccaagctgaacctctcactgcaagaagattcgaagtatagaggtttcctgagcatttctgaggttttgcaggtcatggcaagacgcactgtggcaataataggcccccatagttctgtaacagctcatgtcataactcatattgcaaatgagctccaagttcctctgctgtcattttcagctttggaccctaccctttcttcacttcaattcccattcttcattagaacttgtcacagtgatctttatcaaatgactgcaatagcagaccttgttaactaccatgattggaaagatgttattgctgtctaccttgatgatgataatgggagaaatggaattggcgcattaggcgataagcttgctgagaggcgttgcaggatatcatataaagcacctttgagccctgatgcatctatggaagagattactaatgtgcttgttcaggtagctctggcagaatcacgggtaatagttgttcatgcaaatactcaatttggccccaagttgtttagtgttgcaaagaatcttgggatgatgggaactgggtatgtctggatagccactgctttcctctctgctctccttgatatcaacagtcccctctctccagattcattggatgacattcaaggagttcttacaccgcgtatgtacataccggattcacagctcaaaaggaggtttgcttctaggtggaaaaacttgactagtggaaatactgctaatgcccaccttggattgagctttttacctctctatgcttacgacactgtgtttgtgcttgctcgtgcacttgatgcatttttcaagcaaggtaaccaaattacattctcaactgattcaaagctatctagcttacatggagacaacttgaatcttgaagccttgaaaatcttcaatgaaggaaatttgttacgcagtaacatctatgaggttaacatgactggtgtatcaggtccattcaagtatacatctgatagaaaccttgttaatcctgcatatgaaatcattaatgtcgttggaactggaactcggaggattggttattggtctaattattctggactatcagttgttcctccagaaactctttattccgaacccgccaatctttccagggaaaatcaaaagttgttccctccaatttggcctggaaacactggtgagagacctcgtggttgggtttttccaaacaatggaagactcttaaagattggtgtaccaaaaggtgttagttacaaagaatttgtctcacaaataaaaggtactgatatgtttgagggattctgcattgatgtatttcttgctgcagtgaacctgttgtcttatgctgtcccctataagtttgtcgcatacggggatggtaagagcaatcctagtatgactgagcttgtccgtctgatcacaacgggtgtgagtatcatgccaataactttttttgtggagtttgaatgttttaaggaatttgatggtgcagtaggtgacattgcaattactacagaaagaacaaggatggtggattttactcagccatatattgagtctggtctggtggtagtagcaccagttaggaagtcagaatccaatgctttggcctttttggccccttttaccccaaacatgtggtgtgtcacagctatctttttcatattagtgggagctgttgtttggattttggagcatagggtgaatgatgaatttaggggaccacccaaaaaacaagtagttactgttttatgctttggttattatgtttgtaacttgtttgtgttgcatctggcagtaagtgccagttctttgtcttttgtgacatctattgtcaaagtggcagcttcccttcgattaatcaagttgcttttgtctaccatgcaggggaaaatacagtga

SEQ ID NO: 63432 - DNA, 201 bp, Glycine max
  Peptide Sequence Number=SeqID_180210
atggagaatctgggcactgaagaaaagtggagaaaatggagccccgagttggcaaaaaggatagttaatgctaagataattgtcgttgtatacaacagcacaaggcaacaacgtgatgatgtgaactctgaggactgtcttctcacacaggagtggtgggtcggattctggaacaggatatacattcacacacatcattag

SEQ ID NO: 63433 - DNA, 234 bp, Glycine max
  Peptide Sequence Number=SeqID_180211
atggcgggacatgccagcgtggacagtcccgccattggctcctgcgagaccaaggtggccatgactcatgctaagctagggcacgtttttgctttggaggagactaggacactgttgttgcattggttagggcaatcagaagcatgcagcaggtcacatgcattgcagagcacttgcaatgacactcagcacttgcaaaaatttgacactgaagagagtaacaaagtagtgtga

SEQ ID NO: 63434 - DNA, 714 bp, Glycine max
  Peptide Sequence Number=SeqID_180212
gaattgaatattgatgagtccaggcttgttcctctaacaacaccagaagaagctgctaaagcactgagaaagggtccagaaaatgggggtgtagctgcttacattgatgagcgtgcctacactgacatcttcctctccagccgttgtgatttaactgttataggtcaagagttcaccagaaatggttggggatttattataccaactgctaatgtcaatggactttattactgggcctttccacgggactcgccattagcagttgacctgtcaactgccatattgcaaatgatagatagtggagatttgcaaaggatccatgacaaatggcttttgagtagcgcttgcttatcacaaggtgcaaagtttgaagtggaaagactccaacttaaaagcttttggggcctctatatgatctgtgggcttgcctgcttgcttgcactcttcatatatcttatacagatttggaggcaataccataagcactacgtctcagaggaacttcattctactgacggccaaaacataggatcaaaatcttcacatctcaagactttcctttcatttgtagatgaaaaagaagagacctttaagagccggtccaagagaaggaaaatggagaggatctcatacagaaacagtgaaggaagcttatccatcagctccaaccagggatatgcttcacgcagaagcgaatgtgctagcgaagtatga

SEQ ID NO: 63435 - DNA, 2028 bp, Glycine max
  Peptide Sequence Number=SeqID_180213
atgaacgtggcagaatttaaggctagattaatttgccaacataatgaaaatccttctggaagggattcgtttgatgcagaggatgggtatgttgtagaccgtggcttagattttgctatgccgtatgcatgttgggacatgaaactgaatgaagtctaccgccaacgcaagaattttctgttacatcctgctgaccctggaagattgtctggtatttatcaagagaatattatgctcccattccatacttcagagctgatgcttccatcacaacctgatatggatggatttatccttggtcagggcggtaatatgatgctacctttgcccatatcaaattctttgccctctttgcaacaaaaactcgatttctgtgagagcaatgataatgtagccatgctcccttggcctcttatggagatcagtacacaagaggaagttgatccaaaaaaggtgattgaatggtcaacaacactaccccttatattatttaccatctttcttggcttttttgttttctaccactatttggtggttacaaataaagaccaaaacagggagttaaattcaagaagtttacctcctaagaagaagaaagcacgcaagtcagtaaagaacaatatcaccattgacaacagacaggataaacctatgtcatcagctgaggaggataaactagcacgtaaggagacaaacactgatacatatacacaaatgcaagttgatggacgcagaattggtaaactgtttgtgtcaaacaaagaaattgctaagggaagcaatggtaccattgtttttgaggggacatatgaaggccgagttgttgctgtcaaacgtcttgtcaaagcccatcatgatgtagcccataaagaaatccaaaatctcattgcatctgatagacatccaaacattgttcgatggtatggggtggaatgtgatcatgattttgtttatcttgctctagaacgttgtacatgcaacttggatgatttaattcatatgtactctgatatatcagagaacccgacaatttgcgaggatcaatattctaatttttttaaaaatgctcgaatcgatacgaggaatgatatgcgatatctttggaaagcaaatggatttccatcacctctgttactgaaactgatgagcatttctataattggagaaagaagaaaaggatctatcgtaaatgtggtgctagatctaaggtggtataggttgacagctcccataaagaaaagggatgtagtttctggacttgttcatttgcatgaactaggaataatacatcgagatttgaaaccccaaaatgttttgatattaaaagaaaaatcattatgtgcaaagctttctgatatgggaattagtaaacgccttcttgaggatatgtcttctttgggtcacactgttactggctgtggaagttcagggtggcaagcaccggagcaacttgttcaaggacgtcaaacacgagctgtggatttatttagtttaggttgcgttctctttttctgcatgactggaggaagacatccatttggagaacgtcttgagcgggatttcaatattgtgaaaaatcaaaaggatcttttcttagtggagtttattcctgaagccgacgatcttatttcttgtttgttaaaccctaaccctgatctcagactaacagcgattgaagtattgcatcatcctcttttttggagctctgagatgagactttcatttcttcgtgatgtaagtgacagagtggaacttgaagacagagaaattgattctgatcttttgaaggctctagaaagcattgctccactggctttaggtgcaaaatgggatgagaagctagatcctgatttcataactaacattggtcgttaccggagatataaatatgacagtgttcgacacttgctgagggtcatgagaaataagctaaatcactacagggaattgcctcaagaaattcagccaagtacatcaaccttgactgcagataatgatggtgataatgttgatgattggttgccatga

SEQ ID NO: 63436 - DNA, 171 bp, Glycine max
  Peptide Sequence Number=SeqID_180214
atggcttccggggcttcttggacttccgaaaaatttccgaaaaccttggggggtgaacttaacaagatgggggtgcaaatagccattttcaaattttcgaatctgggccctttcagaacatttttaaagctgggttacttaaggaagaagcaacccagatcgcctgggtga

SEQ ID NO: 63437 - DNA, 201 bp, Glycine max
  Peptide Sequence Number=SeqID_180215
atggctaccaaaggttggagctttgttggagcttcaatggtggaggaagaagaagagaatggcaacccattcaaaatgcaccgtttacaaaaattctgggtagaaatttccaggatgtcacacttggcacttcgtattcacttgaaattagtgaggaaaattgtttccgtgaagaaaatccaagctgaggcgcttccgtaa

SEQ ID NO: 63438 - DNA, 261 bp, Glycine max
  Peptide Sequence Number=SeqID_180216
atgcccagggcacagaattccatagcacaccatagtgcctatttcgggaaaagagctctggaggcagcaagaggagcagcttttgtagagatacctaggttttgtaagctcattattgttaggaacttaaatgaagcagaattgaaacttagtcttacaagagggatctgcggattaagttttggttctaagtatgttgttacaataatgttgttgggtctaactctagtccaacaagagggatctgaggacaaagcttag

SEQ ID NO: 63439 - DNA, 441 bp, Glycine max
  Peptide Sequence Number=SeqID_180217
atgaagtgtcgtgtttcaatctttctgttatccctaatccttctcttcttcttcttcttcttcttcttcttcagcttatccgcctcacaatcccaacaactctctcttccctctctaccagcaccctcgcttaaaccggccacggcacttgttgctgccctcgatggcactatgtatttggtggacagtgtttctgggagggttttttggtctttttcaactggatctcccatctaccaccactcctatcgtgctcccatcaatgaccctgaggacaacaacgttaccggtctcatcgaatgcggagatgactgggaattgatcgtccacgatgctcgctttgagactctccgaatcaattgcaaattatgttgctttaacccctaccgaaacaaaggagggagcatcgatatttggatccaaaaaagacactatgtttga

SEQ ID NO: 63440 - DNA, 1260 bp, Glycine max
  Peptide Sequence Number=SeqID_180218
atgggttttctggaactattggaggtggcttctttgccagttattcaagtcctacttatcagtgcattaggagctttgatggcaactcagtatttcgataatcttctttcaccagacattcggaaagccttgaacaagattgtcttccttatattcactccttcacttgtattttccagtttcgccaagagtgtttcacttgatgatatgatatcatggtggtttatgcctgttaatgttggacttaccttcttaattggagggattataggatggatacttgtaaaattactgaagcctaatttgaaagtggaaggtcttattattgctgcatgttcatcaggaaatatgggtaaccttcctattgtaatcatccctgctatctgtgatgagaaaggaggcccatttggtgcacgtgatatttgccgcaataatgcactctcttatgcatctttctctatggcccttggtggcatcttcatttggacctacacataccagacggtaaaaagcagatctttgaaatttaaggcactcgaggctgctgagattgtaaaggttcccaacaaagattttgatgctaatgctgaaactcaccttctcaaggataatgacagtgaagacacaacaatagaagtgccgacatcgacttatattggtgacactgaaaaccaaattattgtagaccaagatcagtccaatgtatcgaaaaagacagaatcatcttggcatagaatggtagaagttatgagccatcttctggcagaattagtgtcaccaccggcaattgcaacattttttggtttcctctttggtgcggttgcatggctaaggaacctaataataggagacaatgctccactgcgagtcatccaagactctcttcagttgcttgggaatgggaccattccttgcatcacccttttgcttggtggtaacctcactcaaggcttgaaatcatcaagtgtcaaaccgttgaccctcactagcatcatcatagctcgacttttcttactacctgttattggattgtttattgtaagagcagcagcaaatttgggcttactccctgttgatcctttattccaatatgtgctggttatgcagtatgccatgccaccagctatgaatattagtaccgtggctcagctgtttgaagtaggaaatgaagagtgttcagttattctcttgtggacatatactgctgcagccatagcactcactgcctggtcaacattcctcttgtggctattatcttaa

SEQ ID NO: 63441 - DNA, 180 bp, Glycine max
  Peptide Sequence Number=SeqID_180219
atgactatcccttactctgatagagctgtttgggtggaataccaacatacactgcaagctgccaaacgattaaaaaagaaaaaaattgagtccaaaatcatggaagtgttatgtttctcattggctgttggtgatgctgcgcagctaacaattgctgacttggactgtgattgtatctaa

SEQ ID NO: 63442 - DNA, 333 bp, Glycine max
  Peptide Sequence Number=SeqID_180220
atgaagaacaaaaagaggagcgcgctaagccgctgcaagacagaggaacgagcacgaagcacgcgcttagccagcacggtcgcgctaagcgcgctcatcaacctcaacgaacgcactaagcgcgtgctagtggtgctaagcgcatggcttcccgtaaacgtcgtgccctgcccacaccaggggaagcgtccaactgggactcttcctgctttacctcagagattgcttgacacaggaactcaggaggcgcagatgggaccaggtgcttacacgcctaccagagaagagaatcgatgtggctctggtgaaagagttttattcgaacctttatga

SEQ ID NO: 63443 - DNA, 297 bp, Glycine max
  Peptide Sequence Number=SeqID_180221
atgacgcagagcactttcccaccaattctgttatttccaaattccatttccgcatcaggaaaaggggggacatctttcagggaagaaaaatttgaggaacttgtggcagttgcgtttgattttgaggataaaaggactcgcgaggtgctaactgagaaaatagcgcagttgaactctgccatagatggtgtttctgcacagttgcggccagatgaagactcaaatgaaattgccgtgaactcagaggaaattgaaataccaatcagcgatgaaagtgaaatcgaagtcaacaaataa

SEQ ID NO: 63444 - DNA, 207 bp, Glycine max
  Peptide Sequence Number=SeqID_180222
atgccactaatccttggaaacactggttctggaagcacaagtcaggtcaagaaatggaacatgaatagcacaaggtgggaagggcaaaaacaaaagagcaagagaggtgtcaaaagaaaagtgttgtggggaaataaaagggttgttagtaaaattgcaaacactgaaccagacacttgtgagcagagggaaacaccagccttgtga

SEQ ID NO: 63445 - DNA, 1308 bp, Glycine max
  Peptide Sequence Number=SeqID_180223
atgtctacaatagaaaagtttgttcaaccggccattccaagatttgatggccactatgatttctggtccatgaccatggaaaattttctgcgcaataaggagctgtggcaactagtagaagatggcataccaacgttgggagccacgcccactgaggcacagaggaggagtgctgctgaggcgaatctaaaggatatgaaagtaaagaactacttgtttcaggctattgaaagagagattcttgaaacaatactggacaaaagcacgtcacaagcgatatggaggtccatgcagcagaaataccaaggctcaacacgagtcaaacgtgctcaacttcaagcactacgacgagagttcgaattgctgatcatgaaagatggtgagaagattgatacctacctgggacgtacactcagcgtagtcaacaaaatgaaagcaaatggtgaaatagtagactcgagcacagtggtcagcaagatacttagatctttaacccaaaatttcaactatgtggtgtgcttcattgaggaagccaacgacttgagcaccctaagccttgatgaactacatggcagcttgcttgttcatgagcaaagaatgcagagttttcaacctgatgaacaagtgttgaaagttactcatgatgatcgtttgggagcaagtcgtggtcgtggtagaggaagtcgtggacgaggaagaggacgtgggagacaacctttcgataaggcgcttgttgaatgtttccaatgtcacaaactaggacattttcagtacgaatgtcctggagtggagaagcaggctcattatgcaacatttgaggatgcaacagaggcagaagatgagattctgctggtggcatatgaagaaatgacacaatctgtccagagggaagactggtttctagattctaggtgcagtcatcatatgactggtaataagcagtggttcacagaaatacatgaagaagggctcaataagaatgtgaaacttggaaatgacacaacactaaatgttgcagttagaggaagtattcaggttcaaatcaatgatgttactcatgttatatccgatgtttactacgttccagagcttaagaccaatctcataagtttgggacaacttcaagagaaaggtttagctatcttaatccaaaatgatacctgtaagatatttcatccagatagaggattgatcattcatactaacatgagaggaaatttgatgttttatgtatcagcctcaatgacttcccaacatcctcagtgcttccaagctgaagatgattcagataaggcaactctgctgtga

SEQ ID NO: 63446 - DNA, 909 bp, Glycine max
  Peptide Sequence Number=SeqID_180224
atgggtgggagctggtgcggttctgcgaagatgccgacgaaggtgtcgagaagggagaggatgactgatggtgtattcagaagtgttgtgggtgattgggtggaagacagttgggctgggttaggaatgggtgttatgtggtacaaggcagagatgctccgtggtaatggagcccaacaatttcaaccattgcacccccaggacaatatcggcaccactgagaaggtggaggaaacgagcgacgcgggattggatgaagttgtgggtgctccctccatcaatcaagataaccatgtgatgataggcgatggagctatagagacgaaatgtctctggagccgaggggaaagaggctcaggaggagggctggttagtaactggtctagggttggaggatccacgtccggctcgactataatgagggccatgtcttcaggaaataatctcttgaagggtagtctgggtgctgaaggacttgctggtaacggcggcaaaactggagagacctcatggcataattccagcaagagaccagacacgaagcagcttagtagaaatggggggagcgaagcctacgatccgttttgcgaggcactcatattcagtgagatagttattcaccgttcctctctattgcaacttaaacaaggcgccctatggatcatcgtagaaggatggggtgatttgggcgaggaagatgagggtcacaaggtgttcaaggatggagtcaattttagagttgagggtggattgggcttgggaaagggtggcttgtgtctgggtgaggttggtgtggctctaggtaaggcaggtgaccgcctcctcgaggcggttagtggtggttcgacgcgtgttatgcttaggcatgatcgacagcaggtcgaaccagttgttacagctatcaactaa

SEQ ID NO: 63447 - DNA, 2697 bp, Glycine max
  Peptide Sequence Number=SeqID_180225
atggtgattggtctaccttctctgaaaactcccaagactatatgtactatttgtctcgtggggaaacaacatagagatgtcataccaaagcaaagttcatggagagcattaatgaaactccaattaattcatgctgatatatgtcgtcccatttcaccagcttcacatagcaataaaaggtacatcctgagttttattgatgatcattcttgtaaaacgtggatttactttttgcatgcaaaatctgaaacgttcaatgcattcaagagcttcaaagcatgtgttgaaaaagaagctggcacccacattgtgtgcttaagaactgaccgaggtggtgaattcaattccaaggagtttttagacttttgtaatcaacacggtatctctaggcaattgacaactgcctacactcctcaacaaaatggagttgtagagcgtaagaatcgtaccatcatgaacgtagtcagagcagtgcttcatgacaagcaggttccaaaatccttctggtctgaggcagtgcggtggtgtgttcatgttcaaaaccgaagtccaacctctgcaatagatcaagggactctagaagaggtgtggagtggagtgaagccgcatgttgactactttcgcacatttggatgtgtcgcacatgctcatattccagatcaaaagagaagcaaactagatgcaaagagccaacaatgtattctcttgggcgtaagtgatgagacaaaagcttacaagctctatgatcctattacaaagaaagtcattgtaagcagagatgtggtgtttgaagaagacaaaagctggaattgggatgcacatgtagatggaggtacaacccctgctcttgattggggagacaaagatgttgaggaaattgaaactgcagaatctgcatcccaacaaataacagtcagccatgatcaaccagtcacactcaagccaacttcaaattcagcacctgctgattctccagttgaagggagggcaaccaggacccggagacaaccattatggatgtctgactatgaaaccaacctatctgtagaagaggagagcttactggcaatgatgataaccgattctgaagacccccaatcctttgaagaagtttacatgagtcagcacttgagagaaatgatgataactgattctggagacccccaatcctttgaagaagcttacacgagtcagcactggagagaagcaacgaatgttgagatgaaagcaattgaaaagaacaagacgtgggaacttgtaaatcttccagacagtgttaaacccattggcgtaaaatggatcttcaaaaccaaattcaatgaacatggccagatagagaagtataaagctaggatagtggccaaaggctatgcccagcagtatggaatcaactacatagaggtatttgctcctgtggctagacttgacacaataagagtgttgttagctgtggcagctcaacgttcatgggaagaatttcagcttgatgtcaaaagcgcgttcttacatggtgaacttcaagaagaggtgtacgttcaacaacctattggattcatcaagaaaggcagagaaaatcatgtatacagactcaagaaagctctctgcggacttaaacaggttccacaaacctggtacagtaagataaaagcctactttgccagagaaaagtttgtacgttgctctagtgaacacaccttgttcatgaaaaaggttcatgataatgttttgattgttagtctctatgttgatgatttgatttttactggaaattgcaaagatatatgtgaagagttcaaaagttcaatgcagctggaattcgacatgaccgatttgggtaaaatgaggcattttctaggaatagaagtaatacagagtaaggcaggaattttcatctgtcaaagacagtacgcacgtgaggtgctagctctgttcaacatgatagagtgtaactctgttcgaaatcccattgtaccaggaactacattgtccaaggatgatgaaggagcttcagtagatgctataaagtttaaacaagctattggtagcctcatgtatttgacagtcacacggccaaacttgatgtttagggtaagtctaatcagcagatacatgactaatccaaaggagtcacattgggctgcaacaaaacgaattttcaagtatttaaaaggcactattgagcatggtcttttctatcaaaaaggaaagaaaataggtctctcagcctacagtgatagcaactatgcaggagacttagatgatagaagaagcacctctggatcagtatttatgatgggaactgcagctgtatcatgggcttcgaaaaagcagcctgtagctagtttatctactactgaggctgaatacattgctgcaacatcttgtgcatgtcaatgcatttggcttagaagaattctggagcatcttgggttagaagaaaaagaagccactgaaattttatgtgacaacaagtctacaattcaactatccaagaatcatgttctccatggaagaagtaagcatattgcagtgagattccactttctcagagatctggtgaatgatcaagtagttcaactgaaatactacaatactaatgaacaagtggctggcatgatgactacagctgtgaagctcgatcaatttgagaagttcagacacatgcttggtgtagttaaagttactgaaataagctaa

SEQ ID NO: 63448 - DNA, 204 bp, Glycine max
  Peptide Sequence Number=SeqID_180226
atgtacggtgtacttcaagaattatcaatgcaaagaggatttattccagccctaccccttcttccattgaactggacgaggttgactttatcgctcctacttcttggctcgaagtttcatgaagaaagagattggttaggaagacgtgcgcatgtcatcgatgagttgttggtaaagaagctaaatcttagcttgacatggtaa

SEQ ID NO: 63449 - DNA, 312 bp, Glycine max
  Peptide Sequence Number=SeqID_180227
atggagctggagaaacaggtggctacgatgctcaacgttggtcttatccaaccaagccacattcctttctcatctccggtactgtttgtcaaaacaatggatggaagctggcgttattgtattgattacagggccttaaatgccatcacagtcaaagactgttttttgatgcccaccatcgacgagctgttggataaattgggtcacgcgtcgtggttttctaagctcgatctgtgtcaaggatttcaccagattcgaatgacggaggaagacattcctaaaacggcgtttcaaacccaccacgaccactaa

SEQ ID NO: 63450 - DNA, 396 bp, Glycine max
  Peptide Sequence Number=SeqID_180228
atggctactctatcaagcttcattactacgccgaagaatcccaagacccactttctctcaggtgattacttccatcaccatcaccatcaccatcaccatcaccattgccattgcccaaaaggggaaaagtatataatttgggcccctaaagatgttacttgtcatccacacaattctgatcacctgatgtcaggggatgcaggcttgggcaagcttatccaacaccccctttctagtgattttccaggaaatcttatattcagattaatgtcaggttcctcattcatgtcgatggacaaatgcttcttgaaaatcagcaccagcggacactttacagatttctctttaagggctaaagcaacaagtaaccaaccacttgttattcgagctgggtag

SEQ ID NO: 63451 - DNA, 318 bp, Glycine max
  Peptide Sequence Number=SeqID_180229
atgcctcagttgcacaagccaaagtcttgctctggagtaaacagttgctacccgctattggtgcttggtctaaatatctatgatgagattggagaagttaatgaagataatggtttctttgattattcagtctcgctcctcacataccctgttgtgtatgtgggatggagcaaatatatgacgtttgtgatagattataaaaacaagcgatccaacgaatgggaaggaattggcatatttaccttgtccaacgtaaagtatttgttgctcgaaattcgtagtggcaaaagggaattgttcaatagtaaaatgctttaa

SEQ ID NO: 63452 - DNA, 1143 bp, Glycine max
  misc_feature (1059)..(1059): n is a, c, g, or t
  Peptide Sequence Number=SeqID_180230
atggcttcggtggaccccgagatcgcgaagacgcaggaagagcggaagcgaatggagcagcaactggcgtcgctcacctccgtcacgtttgataccgatctctacggcggaagcgacaagggctcctacctcacttccatccctgccaacgaagacgacgagaatctcgacgccatggacaacgaggtcgcgcgcaagctggcttcttacaccgcccctaagtcgcttctcaaggacatgccctccgcccccgactccgacaacgacatcggcttccgcaagccgcagcgcatcatcgaccgcgaggatgactaccgccgccgccgcctcaaccagatcatctcgccggagcgccacgacccctttgccgccggcgagaagacccccgacccttcggtgaggacctacgccgatatcatgcgcgaggaggctctcaagagggagaaggaggagactctgaaagccatcgctaagaagaagaaggaggaggaggaggccgccaaggacgcgccgcctcaacagcagcagaagaggaggaaccgctgggaccagtctcaggatgacggtggtgccggcgcggccgcggccgcgaagaaggcgaaaacatctgattgggacatgccggacaccactccggggcggtgggatgccaccccgacgccggggagggttactgacgcgacgcctgggaggaggaaccggtgggatgagactcccactcctggtagagttgcggattctgatgcaacacctgcaggtggtgctacacccggtgccacacctgctggtatgacttgggatgctactcccaagctttctgggatggctactccaactcccaagaggcaaaggtcaaggtgggatgagactcctgctactatgggaagtgctactcctttgccaggtgcgactcctgctgctgcttatactcctggtgttactcctgttggtggtattgaactcgctactcctacccctggggctttacaaggctccattacgccggagcagtacaatttgttgaggtgggagagggatattgaagagcggaatcgcccnttgactgatgaggagcttgatgctatgtttcctcaagaggggtataaggttttggatcccccctgcttcgtatgtgcccattag

SEQ ID NO: 63453 - DNA, 453 bp, Glycine max
  Peptide Sequence Number=SeqID_180231
atggcaagacacaaggtcacacgcacacacacacacacacactcacgcaggcacaagggggaggaggggcttggtcgggacggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 63454 - DNA, 432 bp, Glycine max
  Peptide Sequence Number=SeqID_180232
atggaatggtatttttcaaattcgatacctttcctgattatgcaaggcccacagacaacatgcacgaaggaggagaacacatccaatcctaacattgtgcccaatgaagatcagaagccatctcatcattcatctgcattctctatatctcaacaacaaccatattcaaatattgacaatcttccacactcatttgcattgactcttgtagaatttgttagcaatttgtttggtgcaaaccttggaatgccagaggcaacttatgcatacatgcaaagtatgtatccatcatatcatcataatgatgccaacaattcttcattgtgtgcagcacttggtagttttactccgccgtcgtttaatttaaatataagtcaagatatggatgaatcacttcaacaaactgctgacaatggacaaaatgcaacatga

SEQ ID NO: 63455 - DNA, 813 bp, Glycine max
  Peptide Sequence Number=SeqID_180233
atggagagctctgctagagccaggagtcaagcgtgcattaattgttggagtaggacttcaaatacttcaacagaattatgtcatgaagaccagtaccctatgaggaagttgttcttttccctcagttgtactttgtcatatatttttatccctcccaacctcatagaggctgctggtataaatgggtttctctactatgctccccagattcttgagaaagcaggagtaggggatcttttatcaaatttgggccttagttcagcatctgcttcttttcttgtaaatatcattacaacattctgtatgcttccttgtatagctattgcgataagactcatggatatttctggcagaaggtccatcatgctgtacactgtacccattttgatagtttgtctcctgatactagtgatcaagcagttctttcaaatcaattctgtcgtcgatgcagcaatcactgctattagtgttgtggtttatgaaagcgtcttctgcatgggctttggcgttattcccaacatcatatgtgctgaaatctttccaacaagtgttcgcggaatctgcatttctctgacttctcttacatattggggttgcaccttgattgtcactttgatattcccctacttgctccagcttctcggtctcactggtgtctttggattgtttgttgttggctgcatcatttcatggatatttgtctacttgaaagttcctgaaacaaaaggcatgcctttagaagttattattgaattctttgctattggtgcaaagcctggtactgatcctgccgcattgggaatcaaaggctga

SEQ ID NO: 63456 - DNA, 132 bp, Glycine max
  Peptide Sequence Number=SeqID_180234
atgggttgtccaaacagatgctactgcaacaactattgcaaatccacaaattggaacaagaaggtgatagcgacacaggcaaatcagtcgctatatggatcagcgactaattcaacgactaacattgcttag

SEQ ID NO: 63457 - DNA, 699 bp, Glycine max
  Peptide Sequence Number=SeqID_180235
atggagaaggtttaccataaaccatttgataaggggattgtcttgctcggagatattgttccagcaattaaggacctctgtttgcccatcggtttaagagagatagacggtgctcatacggagttaggtgccactaagcttgaagagttcacgccaaaatttgctaataaagacagggtcgcgatcaaaaaccatgctacaggagaaacggtcaacaacaacaagaataatggaattgtcattggattaaggaaggcctgtgatgaaatcaagggaaaggtcctcccaatggttggagcagaccagctggttgcatcggagcttgtcaaagaaggcgaattgagggacaaaaagtatcaagcattggtcgtccaaacaggaaagagcgtctacaaccatattatgtcgtctgacgtggtattggatcgaataatcgtatcccatgagttgagagataaacttgttgttcaggtgtctgtataccgacgtcatgagatccttgaggctcttatggcgcaagctaagcatgggaagaatttcttattgaaaaaggctatggggtggttggattgcatgaggaaaacgcctataacgactcctgaagcatctgtttccaaaacaaatggtaaggcaaaatctgaaagggccaaaacaaaggcctcagtcatggctcgcttcaaggaatcaaaagcctgttaa

SEQ ID NO: 63458 - DNA, 213 bp, Glycine max
  Peptide Sequence Number=SeqID_180236
atggctactcgtggtggccaccggtggtcatgggtggtggaggaagactttctagggtttttaggcggagttttgagagaagaagacataaaaattatctcgcttagcaagcttgtctcgctaagcgagaatccatttttgacgctaagtgtcacttttcgcactggtgcaatttcctctcgagttgggatttgtgttaagtgtgataattga

SEQ ID NO: 63459 - DNA, 834 bp, Glycine max
  Peptide Sequence Number=SeqID_180237
atggccatgaaccggcaaatgaacggagctagtgtcgtgttcatgtcgagcttagagaaccatgaactgccacccaattcatcaagcaattcgtcgatggttggaataggaaatctgtcgcaaatcgttattgcgttcaaggctcggaaatctacacaacaacgccagaggcattggggtcaagggatgaaaggtaagggttggggtggtcaggatagtcaaggaggatgggaatggagttctactgaggtgttatccctaataaatgacatggtcgacaacaaaatggtgcccttgaatggaaataggaacagtagaagtgaggtgcaggcaatcaatgacgaagtcgtcacccaccatgacccagccttactaacggagatccttgtaggtggggtggtcgggcaatgcattaaaactgatctatggatgtggcatttcttggttgggctccttggaggagccatcatccacattagtgacttcttcctcgatgatgagcaggaagaaacaagccttccagcgatgattggggccaaacttctcatcacagtttggggccgaggtgttgctggagaagatggaacaagagaatgggtgggagcgattgcggatgataggggtggaggtcgtggctttgtgggaaacagagcgccacaacttatggccaagaatgtgattggccagacgtttgaagttgttgaggtactccgtgaccatgccacgctgggtgagcttgaaaaaggcatcttaaggggtggagaagaaggtgtgggagtaaaggtaacaagttgggtgaggatggaatcgactttaaaagccaagtctgattga

SEQ ID NO: 63460 - DNA, 1357 bp, Glycine max
  Peptide Sequence Number=SeqID_180238
atgatggaggttgtgattgttgcaattgctgctacacttggaaatcttctgatgggatgggatagttcaactattgcagcgggtatgacctacatcaagaaggaatttgtcttggatgccacacttgaagggctaatcgtgtccatgtcatttataatcggcactgttgtgacaattttctctgggacagtgtgtgatttggttggaagacgccctatgttgataacatcttctatcatgttcttccttagtggtttggtaatgttgtgggcacctaatgttgttattgttctgttagcgaggataattgatggggttgccattgctcttgctgttactcttactcctctctacatatctgaggtagcgccggctgacatcaggggccaattgaacactcttactcagtttgcttgttctggtggaatgttcttggcttacatcctggtgttctcaatgtccttgtcggattcgccaagttggagactcatgcttggggttattttcattcctgctgttgcttattttttactggctgtgttttacctgcctgagtctcctaggtggcttgtgagcaaaggccggctactcgaggccgaaagagttctgaaaaggcttcgtggcatcgaagatgtttcaggggaattggcgttgctggcagagggtctcagccctgggggtgaagccacatccatagaagagtatgtggttgccccagctagtgagcttcttgttaaccaggaagcagagaaagattatataaagttgtatggtcccaatgatgagggagttacaatggttgctcaaccagtgaatggacagggtagcatgatatcccgtagtatgttgtctcagcaaggaagctttggaactctgactggtggtggtcttaaggatcctattgtcactctctttggaagtttgcacgagaatactctccctgagagtggaggttcacgcagtatgctacttcataatgccaacagtatctttagcattggagagacgtcgagtccctttggtaccagtgacaacctgcatgcgccactaatgtcatttcaagggggtgctggggagaaggatagggcttatgggtccaaggacatattaggcatgaggagcaatagcagcctgagaagtaatagtagtttggttcatgggaatgctgttgatgctcctaaaaataccaacattggtggaggttggcagttggtttataaatcagctgatggtgctgggggtgggaaaagagaaggactccaaagggtttatttgcacgcagatactgctgcactttctcactctcagcatgtttcatttgtttcaacttctggctatgacataccgatagatggcg

SEQ ID NO: 63461 - DNA, 438 bp, Glycine max
  Peptide Sequence Number=SeqID_180239
atgagttacgcaggtgctgctgataaaattcatggcgacgtattaaaaatgaacggggatttccatgcatatacacttttggaaccaattggtgttgtgagacacataattccctggaatgcccccaccctctcgtttttcaccaaggttagcccttccttagctgcaggttgcaccatggtcctcaagcctgctgaacaaacacctctctctgctttggtttgtgctcatctagctaagttggctggaattccagatggagttgtcaatgtggtatccggatttggcccaactgctggtgcagctataagctcacacatggacatagatgcgttcagttttagtggttcagttgaagtagggcgtgaattgatgcaagctgtagctatgagcaacctaaaaccggtttcacttgaattaggagacaagtctcattag

SEQ ID NO: 63462 - DNA, 516 bp, Glycine max
  Peptide Sequence Number=SeqID_180240
atgcaagacccgatccgcatcaccctcactgtcgtcgatgacgatgatgacctggagcccgaggaagccgaagaaaaagggtccgaagagaaccgcacgggagagaaagtctcacgagaagctctagaggtcaagaaggagctcgaccttgttccccccgtcccacaagcttccctcactggccagaaatacacggatgacagcgaggctaccataaacgaacatatcaaggagagagaagcaggaataaaggcagaccctgagattgatgcattcatgaagggtgtagcatacttggattggatatttgtgccgacattgatccctctgtccattacggaatcagggatatggattgcccttacgtattacaccatagggtttgctccttctgctagcagaggtccttggggtccgctttcacctatccttgagaataatgctattactgacaacactcatggggatttgtttttgccgcatctggtgattcttgtgcaatattgttgggatgtt

SEQ ID NO: 63463 - DNA, 1119 bp, Glycine max
  Peptide Sequence Number=SeqID_180241
tttaaagggaaaactgtgttgtgcgatcttggaaatattcctatggcagagaaagggtttgcggtgaaatctgccggcggtgtgggcttagtgttgggaacagtggaaaacgatggggaggaacaagcaacagaacccactaatttgccaacaattgtagtaggtattgaagctacaaaagcaataaaaaagtacctattgtatgatccaaaatcgatggctacgattgtgtctcaaggaacaaaggttggaattgagccatcgccagttgttgcggagtttagctctcgtggtccaaatctacttacgccacaggtaatgaaacccgatttaattgcgccaggtgttgatattttaggggcatggacaagacataagggtcccactgattacaaagaagatcataggcgcgtggacttcaatataatctcgggaacatcaatgtcatgccctcacgtgagcgggatagcggctataataaagtcagttaatccaaattggagccccgccgcaatccgatctgcactaatgaccactgcttattcgacttacacaaatggtaaaagtttgatagatagtgccacaaacaaatcgtcaacaccatttgatattggtgctggacatgtgaacccagttcttgcgcttaatccaggactcgtttatgatttgacgaccacggatgattatctccacttcctttgtgcgttaaactacacacccaaaaggatcgagtccgtggccaggagaaagtacaagtgtgatcctcacaaacactacaatgtagccgacctaaattacccttcttttagtgtggtgtataaaacaaacaacccaacgattgttaagcacactcgaactcttactaatgttggggtcgcaggaacatacaatgtatcggttacgttggatattccatctgtcaaaatcgtagttgagccgaatgtcttgagcttcaaccaaaatgagaacaagtcatatacagtcacatttacaccatccggtccatcgccctcgactggttttggttttggacgtttggaatggtcaaatggaaagaacattgttggaagtcctatctcaatatattttgagcctcctggcgtcattggaaactcctaa

SEQ ID NO: 63464 - DNA, 285 bp, Glycine max
  Peptide Sequence Number=SeqID_180242
atggttatctctattggagaacctgatacaccaaataagactgtcaagcaactaggtaattgggttaagtcaaagcaaaataagcataaactatgctctgaaaagccctacacccacaaccaatatcaatcaagctattccctcttaactccctccaaattcaacaagaaccattcaagttttgctgacactaaccattctagaggccaatctctagatcttgggagagaaaatactgcttcaagttctgccagaaactcagacattgatcatgccttaagttga

SEQ ID NO: 63465 - DNA, 303 bp, Glycine max
  Peptide Sequence Number=SeqID_180243
atggcggattttcgtggtggttttttgaaaaaacgccaccgaatagcggtggcatggcgggttgggaatggtggcgccatggcggtcatggcggttatggcggcgagttggcctgacctgacccaaccctactcggtaattcatccaaaagcacaaccctcccctccaactaaaagcgcacccagccgcgtcccccccgcacccagccgcaatgccccgcagtctgcacgcagccatgacaccccctgcacacagaatgcagccaacagtgactacctatggcgacgacgagcaccggcatga

SEQ ID NO: 63466 - DNA, 569 bp, Glycine max
  Peptide Sequence Number=SeqID_180244
atggctgaaccatcatccgatgctgctactgcaagtgcaacgaggaaaaataaggcagacccaggctggaaatattgtcattctctggtggaaggagatacaaacaccattgtttgtaatttctgtggaaaaatcacaaagggaggaataaccagagccaaacaacacctgattgggaagtcgggtaacgttgcagcttgcaagaaaactccaccaaatgtagtcgaagagttgaaggaatatatggctaccaaaaaaagtaggaccacatatagtacttctggcagtggtaatatggcaaatataagagattttgaatttggtgaaccaattggatgtgacgaaagtgaagaagatgagtttgcagactcttgtaatgctgctgcaagtgtaaagacaaagcgtgggactaaaaaaggaccaatggacaaattttgtaagaatccagaaaatgcaatcaatcggagaaaaatggagatgttgaggcaaatgaacataagagagtcattggataagaatgacgtatctgaaggtgcatcaacatattgctcgcttttggtaccaagcag

SEQ ID NO: 63467 - DNA, 507 bp, Glycine max
  Peptide Sequence Number=SeqID_180245
atggggagtagaggatttctcattcacaaccaaagcagcagcgtccagtctaacttgtccctcggattttcttcctcccacgcctcgccgcctcctcgctctgacccgctagtgccgctacagctcatggaaccacagacggagaatggcaacttagatgttgaatcggacgacgatgaggacaaagaagtcaaggagtttctcattctaggcgactcaatgtgcctcaagaggcgaagagattgcgactcctcatcctcctccttcgccgccaagagggtttccatcgagcccgatctcgatgcgcgtaaggccgttgtgcgcgcgtggggttgccaacccctctacattggagttgttgacggcgatcatgccatgcctatggacatggtcattgtgggtgatgagagaggctcttttgactttgtacacaaaagtgggaatgattctagaatcatttgtagtaaaagaggaaacatagaagatgttgctcttgtatttgcttag

SEQ ID NO: 63468 - DNA, 357 bp, Glycine max
  Peptide Sequence Number=SeqID_180246
atgaagttgagcacaaatggaggaaatgtccctgcgcaattgctggttcttgatggaaaaaattgggagcggtggcatattcaaatgaaggcgttgtttgaatttgaagacgtgatggaggtagtgaagaatggcgtagcggcggaaccaacagaacccgctactgaggcgtttgactcaatgacgatggaagagaatgagaagattgttgacttctttgcacaagtaaaggtagtcatcaatcagatggctacacaaggtgagactctaactgatggaaaaatttgtgagaaaattactcgatctctgctggaaaaatatgattatatagtatgtgcaattgaggaatccaaggaa

SEQ ID NO: 63469 - DNA, 582 bp, Glycine max
  Peptide Sequence Number=SeqID_180247
atgaaaatcccagcattccatcccgcgaggacggcggcgctgcgcgagctcagaggactggaggagctctttcaagcttacaacatctgctactacacagcagcgaagatcgccgagctcggatttttcgttggtacctcttcatcggcgaacgcaacggcatcaaagccgtcgtcagagctgaacgacgccgcattgaagatgacgacatcaagcgcctggatattgaagattgtagggtacgagaacatgtatggttctcgcattaaagctttggacaatttagttgaggagtttataggaaataaccagttaacttttgaagaattgaattctgaaaaccttaaacttcaaaagaaggttgagaagaaagaaaatagcaagagaaggaaggatgatcataatttaactcagaaaagtaaagataaaaagttttggaatagacaaaatattgaaagggtttttgatcctgcagtaaagtcatctaacttcactgctcgatccaatgtgtccccatatgctccaccattgattacaatggacaatgatgatggcatctcttatacaggttcagtaacttag

SEQ ID NO: 63470 - DNA, 1140 bp, Glycine max
  Peptide Sequence Number=SeqID_180248
atggctgatttgaggtccttaaagctagaaactgttatccctgctcagatgtcctttaaagaggatcctgctcgtcttggtttatcattatcaagggagactgaggctgcaatgtggaaatattcttcacttgttaagagcttggacaagaataaaattatgattgaattgaactacatgctgtcttatggcgctgctgaaccatctttgcatctactttggaaattcaaattacttgaatttttacttcctgtgcatgcagcatatcttgatgaacaagctattaaagaagatgctccggcttccaatatgttgatggctccaatccaactgaatctttttggatttcagatatttgtacccaagaaagcagggaaacttgcttctgcgattttcaaaatgctggccagtgatgttgaattttacaagactgaaagaagaaaaaattcaaagataaattatggcatgcttgggaagggacacctttcagagattgcatttgttttgggcaaaattgttcttgaaactatgagtagtggaactgttggggatggggaggattctgaagctggacaatgccaccttaagactgagggaaccaaagaaattgctcaatcgcaacttccagatctagtaaaccatgaagtggcggcaatgaatggtgaaggacaccttttatcaataccaaattcagaatgtaggcaaggaaaaagcaagaaacggaaattggttaagaatagatgcattgcaaagaagaaaatgagctccgggaaccaagaattatctgagaaatttgaatacaaggaaaataaagaggagcaacagaagctagttaagttaagccagaaggttgatatgtctacagaggattctttgcccaaaaagaaaaatgatcacagaaaacagttgataagtgataggaagaaaatcaccagtgccaataaaagttttctacaccaagctaagcatatgaagacggatgaagacagcacatgcatgccatcacaatctacggtatccgagaatcatcaggtgatagctaacagcaacatagacgtgaatgcaaaaacaacaaatgagtcgaacttaaagaagaagaaaaagggtttatcactagttgaaatgtttaaagggaaataa

SEQ ID NO: 63471 - DNA, 379 bp, Glycine max
  Peptide Sequence Number=SeqID_180249
atggaacccatgagtgccgtgatttccttcccgatcccctgccgcgttcccagccgcgcgccgcccgcgatccgcgcgtggccgagcgcgagcagcacaagctggccaagcgcctgcgccgccagctgcagaagaaggcgccgtgccgttcgagctggtggcggtgaacctggaccagaagcagccggacttccccgagcacgtgctgccggagtacctggcagggctgggcgtgccgtaccacatcatcgagcaggacacctattcggtggtcagccgggtcattccggaaggcaagacgatgtgctcgctgtgctcgcggctgcttggtggtgcgctgtacaaatccgccgaaaaccagggcttcacctagatcgcg

SEQ ID NO: 63472 - DNA, 345 bp, Glycine max
  Peptide Sequence Number=SeqID_180250
atgggagctggccatgcccgaagtcgttaccttaaccgcaaggagggggatgccgaaggcggggctagtgactggagtgaagtcgtaacaaggaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 63473 - DNA, 252 bp, Glycine max
  Peptide Sequence Number=SeqID_180251
atggtggcagagaagaccatagaggcgaaaggttcccggcatcacagtgccttccatggcattcaagctaatatgaggaattgggattgggtctgggtctgggtctgggggctccatattagttgggaaagtggtggtggtggtaactgggaacgaggttgtggtgagacatacgtgccacaacgacagtcatggagttatgtctccggaagcttggccaaggctgttgcctatgtcaacgtggaaggttga

SEQ ID NO: 63474 - DNA, 462 bp, Glycine max
  Peptide Sequence Number=SeqID_180252
atgactgaagctcctattttggtttctccagatttttccattgcctttacggtggaaacagacgctttcgcattggctatgggcgcggttcttatgcagaattcacaccccatttcctattatagcaaggtgttgtgtcctcgtttgcagtgtgcctttgcttatgtcagagagcttcatgcaattacggttgcggttcgaaaatggcggcattacttgtttggccacactttcaccattttgactgattatagaagcctgaaagaacttgtgtcgcatgcaattcaaacaccaggacaacaaatctacttatcgaaattattgggttatgactatgttatccaatacaaatcaagccctcagaatatcgttgtcgacactctgtcccgactcccgacatctgaagctgctcagctatattcactatcaatgcctaattttgtttttttggaccagctctga

SEQ ID NO: 63475 - DNA, 957 bp, Glycine max
  Peptide Sequence Number=SeqID_180253
atgggtgtcgccaagacatttctccgtctgcatcataatttcgattggccacatattcacgatgacgtccatcgtttagtctcgcagtgtgttgtatgccaacaaatgaaatatgagaccaagaaacctgttggtcttctccagccttttccagttccttcatcagtatgggaagatgtttccttagacttcatcatggggctgcctcctttccacaggtttacaactatcttggtcgttgtggatcatttttccaaaggagctcattttggtgcattcccaccacacaattcagcatacaagactgccatgctcttcctcgacatgcagtacctccgtgcatttgtctatgataggccatctcaatggtttcgttttctctatgtggttgagtggtcgtataacacttccgtccattctggcataggtttatccccttttgaagtgatttacggcaagtcatcaccgtcaataccacactacattctgagtgacacactcgctgccacggacgctcatcgccgtgatgtcgaatttgcaataggtgattgggtgtatgttcgcgttcgaccgttccgacaaacatcacttgtgctggcttacaccaagctgaccaaacgatattacggtccttttcaattgccttcttcctctaggattcacccaacattccatgtttctttgttgaaactccatcacggtccaccactcactcaacctgcagttcttccaccttccagtatcgacaatcaccgcatcattgaaccccttcatattctggattggaaatgggattattcctcctccccgccaaccaagcttgtattagttcagtggaatgggttggcacaagaagacactacatgggagcccttggctaaattacgagactcctacaaccttgaggacaaggttgtttttggagagggtggtgatgatagcaattcaaaccattag

SEQ ID NO: 63476 - DNA, 1725 bp, Glycine max
  Peptide Sequence Number=SeqID_180254
atggagtgttggaattcggtggacggggtggtggaggagataatgaggattcacagatctcttccagcacggcctgggattgatgaagttgaagcggcgagaggtttgatcgggaatgtggagaaggaagaccaggccaggctcgaagccatagcccggcagagcaagggcgttgatgtgccagaagagctcttcatggtgctccaagagatgcagaggaacgtcctttattaccagagcaaggagcagaaaagggaggccgtcaagctcctcgatctcgacaacgtccattctctgttcgatgaattgattcagagagcttccaagtgcgtcgcctctccctctgccaaaacaagttactctaacggctctgcttcctcggtttccacaagcttgtccaagaattcggtttctaattcggtttctgtgggtggttttgataagccgccacttgccccaactgctgctgctgctactactactacttctagaaagttcaacgtagagaaagaacgttctgaattggtcactcgagatgacagttatgtgaagaaagccaaatcatcgttttactccaatgggtatggatttgagcccactatcccatcaaaagctagtatcttggattcatcgttaaaacctacatcaactgcaggccaagatggggataagttgagtttgatcaagcttgctagcttaattgaagtgtctgcgaagaaagggactcgtgatctcaaactgcagaacaagttaatggatcaggttgattggctacctgattcgatagggaagttgtccagcttggtgactcttgatttgtctgagaatcggattatggccctacctgctacgattggtgggctttcgtcgttgaccagattggacttgcattccaatagaatcacggagcttcctgattctgttgggaatcttcttagtctgctttatcttgatctgaggggaaatcagttaacactattgcctgcttcttttagcaggttggtgcgtctagaggagctcgatttgagttcaaatcagctttcagcgcttcctgactctatagggtcgcttgttagactaaaaatattgaatgtggaaacaaatgatatagaggaacttccacattctgttggtagttgttcttcccttagggagcttcgcgttgactataaccggcttaaggccctgcctgaagccgttggaaagattcagagcctggagattttgtctgtgcggtacaataacatcaaacaactacctacaacaatgtcatctctaacaaacctcaaggaacttaatgtgagtttcaatgagctcgagtcggtgccagagagcttgtgttttgccacctctcttgtcaagatgaacataggaaacaattttgctgacatgagatccttaccgagatccattgggaaccttgaattgcttgaggaattggatatcagcaataatcagatacgtgtgcttcctgaatcgtttaggatgctcactcgactacgtgtcctgcgagcagaagagaatcctcttgaagttccaccaagagaaatagctgagaagggagcacaggctgttgtccagtacatggatgagcttgttgagaagagggaaaagaaagatgttaaagcacagccactaaagcagaaaaagagttgggctcagatctgcttcttttcaaagtctaacaaaagaaagcgtgacggggttgattatgtgaaaacctga

SEQ ID NO: 63477 - DNA, 654 bp, Glycine max
  Peptide Sequence Number=SeqID_180255
atgaatggtaagatgggacagcaaagtgatgcggctcctccgccgttcacttcaacccccggcggcagcaacccactgattccggcagctatgggaatgagtgatgatgttttgaagacgaaggctttggaagagggatcagagaattccttttgggcatcagttgtcctagtagattgcaatgaggatattttacagaaattaataccatatgctgcagatagtgagattttcatcttgggagctaccggagaagtatcatacgttgaacttgtcaatccacaagaagctcccgtagaaaacactgttctacaaggaaatttcgagatttcagcgatcgagggtaatattgtatggccaggaaacgatgacaataacaaaaagagccaggtgactgttttagtgtctggaactgatggtcagattcgaggaggacctgtgcgaagcttaattgctaaatcttctattaaggtgtttgttagcacaacgagtaagcatgatacacacaacatggcaagtgaagaatactacccgagggaaaacgatgaggttccattgttccaattccaggaccaagctgaacgtatggcagagatagtggatcagatctataagactacgttgaaggagctcaataatcaaacaaatatataa

SEQ ID NO: 63478 - DNA, 594 bp, Glycine max
  Peptide Sequence Number=SeqID_180256
atgaaaatcaacaacactttgttctttttgcaggttgctattataaactttcagaagtacaagtttttcattctacccccttctatagcttcagaatctagcccggtcaatgttgcatatgagatagataatacatgttcagtagatactcatccaagggattatgaatcagctaaagatcttaagtttcctcctcgagctgaagaccatgtcaatctttttacagctgaaacttgcaatgaatttcaatctcgactccctgtgaaaaatttcatacgggtagacccaagttacctgaaaactcttggtcaggttcattctggatggatttttggtggaatagctgagcttgttgataattccagagatgccaaagcaactaagatggacatttttgtagatctgatcaacttaaagaaatctgggaaggatgtccctatgctgtcagttattgatgatggtaatgggatgaaccatgcagaggttatgaaaatggtatcttttgggcacaaacaatctgataaagatgacaaggatcacattggcaagtttggtgttggattcaaagtatgtttgttgaactctgcagcctaa

SEQ ID NO: 63479 - DNA, 1086 bp, Glycine max
  Peptide Sequence Number=SeqID_180257
atgaattcctgctttccatccccagatctaggtaccaatgtgattgtgactagagaacaatactttaatttccacaacattgatcgtcaactctttgctcgttttgtggtggtattaggacgtgacactagtcaatccgcacatgtcatggccttcatcatgtggcttgaaaagcagtgcaaggataagaaaatgatgaagaacatgctccaatggcctgacaccatgcttgatagccttgcagatgaggccatgttggttttgaattgtattgagagtcatcaattcccttatgatgatgttgttaacgatgagagcttgcctttgatcaaaagtatcatgcaaaaaaatgttgtctccttgaaatacttttatgttaatcatgtgattatcattggagcagtcaccaggttactcaacaatatttgtgtaaaagccttcaccgacatagtgcaaaaagtgcaatatatgaaagagcagaacttacaaattgcaaatatttacgaagttggtccttgtgtgaaacaagtggtatgttatactccaatgcctagtgctaatattatatcccatcaggttgcaatactaacaccactatggggagaagggagtttggtctcttgggagaccaataacaatatcaatcctcctgcagaggcttatgatgttgcaaaccaaatagagcttaatcaaaatttcaatgaggtcttggccatgttgaatcagactagtattactactggtactaatgatgaaaaaaaggaggtgcaggtgccgatagatgataggattatctttatgacattctctaaagggtacccaatttcggagcctgaagtccgagatttcatcacaagaaggtatggagatatcattgaagcattttgtatgcaagatgtggttcctccagagcaaccattgtatgctcgtttagtaatccgtgctgaggccatacatataattgatcatttccttgagagctcaaacaaagtgaaactctcaatcaatgggaagcatgcttgggctagaaaatattttcgcaaaggtaacaaatcactgaaggaaaaatccccaatgacttcttga

SEQ ID NO: 63480 - DNA, 189 bp, Glycine max
  Peptide Sequence Number=SeqID_180258
atggctacaagattaggatcattggtacctatgcaacaatcaaggttggaaaaggagaaaattgaatccaacaagtggactgcaaactgggttagtgatcctgatgtaactagatttgaggtctgccttgtaggcatgcgattgctaccatctgatacaataaccacatatcagaggactacaatggtg

SEQ ID NO: 63481 - DNA, 652 bp, Glycine max
  Peptide Sequence Number=SeqID_180259
tgcagaaaaagtggttgaggttattcctaaggactctactgagaataatattgaagatatgaatgttgatggtgctaacggagtgggtaaagttaacaatggtgcaaatgacgatgaagttaaagaacatgatgaggatgctgacttttctgatcattttgaaagtgacccagactatgttgggatggagtttgatattatcaaaatgtttattgaagctgtaagagactataccatttttcatgccagagatctgaaatggcaagctacaatgaaatgggtggcaaaaagggtgactgataagcttagggttcatccaaacctaaatcatgtagagacacatgaacatcttagagaacattatggtgtgtacattgatgaaagaaagatgtttagggctatcaaagaggctcagtcactggttgagggaagtatccaattgcaatgtgctaagctttgggactattcacatgagttaacaagaaacaatgaaggatcaactgctggttgcaaaccttttattggtcttgatggttgttttctgaaagggtattatgtcagtcatttacttgtagtagtaggacaagatgcaaacaatgcattttttgtgattgcatatgtggtagtaaatgttgaagataaagataactaa

SEQ ID NO: 63482 - DNA, 105 bp, Glycine max
  Peptide Sequence Number=SeqID_180260
atgaaggatgagattaactgctctctatctactccacgagttaagcaatcttcaactaatttggaaattactcaaactcctaatgttgaaagtgctctagcttaa

SEQ ID NO: 63483 - DNA, 231 bp, Glycine max
  Peptide Sequence Number=SeqID_180261
atggatttggtgccagtggttctttttgatggcaaatgggtggatgattctaatgtgattgtggggatactcaaggaaaagtacccaaaaccctctctcatcactcttcctgaatttgcctccgtgggatcaaagatatttgggtcttttattcttcgattgcaagagtgtctaagcaaatatgagggaactgatgatcggagcacaccacaggacagggtggagtgctga

SEQ ID NO: 63484 - DNA, 909 bp, Glycine max
  Peptide Sequence Number=SeqID_180262
atgactgaagttccttctgagaagttcatattccttcaccttcaaaccactctccaaaagttgcatcgccttgtcacctctgacagtgacatagcatgcaatcttctcatttcttctaatcccaaaggaagaacagtgtaccttgctgtcaaaaccaagggtttcaaccttagcagctatggtgagacgatctgcactcttgccaacggagatattgaggacgagcttctacacctttatctccctcattgggaggagcgccgccatgaggaggtggatttggtggagggaaagcttgttcaagtagcagatgtatatctagagggcgaggaagacgaagtaggcgaaggagaagagagagtagagagtggggagttgggtctggctggcagagagctcgttgtggacgagcatagagacggaggttccgggggcgtagttggcaaagaagagggagtattcattgcggattgtgatggggtaggtgttgtaacgacccgcctcgtcggattggggaattttctccaccgaaaccttgaggaagattctgaggattcctctccgattaaagtattcctcttgatgtgggggttcaatggcaagcagcgacagctcacggcggccactggtggtcttggcacacctctgggcgctcagcgtcattccttctctattggaactgcgcttagcgcgccattcgcacttagcgagagaacaaaagttgttattttcaaaatcacgacgggtgttacaggtgtgactggtggaggcgaagggtggaggagagagtttgcggaaagtgaaaaggtgcatggtgtagcgggagtcaaggacgcagaagctagggttttgctggatctcaatcaggacttgcaggagcaactcttcgctcaggagaaagaaccctaa

SEQ ID NO: 63485 - DNA, 228 bp, Glycine max
  Peptide Sequence Number=SeqID_180263
atggccagatggcttggctgctttggtctggccttaaaactattgtttaattcagagggtctaggaattcgtcctggagttatggatggggccatcaatatatctgctgttcaggcaataagtgcatacctactctttgaaaaagactgctttgcgtttcagaagcataacagaatagaagttgattccttcttcacagttattcatactcaattttgtgtttcttga

SEQ ID NO: 63486 - DNA, 246 bp, Glycine max
  Peptide Sequence Number=SeqID_180264
atgggtgagaaggggagggtgtgggggagtaggagggcaagggcgaggtggagggccacgaggaggttgaaatcaagagtgatggcgatagagacggtgaggcctacagagatggcgagagagaaggtaagaaggaacaaagctcgcaagaggatgttagaaaagaggagtttgagatataacggtggacccgttccggtgtctcttgatgacgagtttgtagcagataatgtgcaaagaatttga

SEQ ID NO: 63487 - DNA, 652 bp, Glycine max
  Peptide Sequence Number=SeqID_180265
tgctgacatcatttgcggacatgttgcacacgccgtttggagtgaacaggaacgtcctgatttgaagttagtgtcacatgggaggaaggtgacattgattgggaggccagtgcctgagattgaaggaatggtaggtgctacaggattaagtccactgatcgattgttcagttgttactggcgatcctggacttgtatccgcatttgtggagagaggaggcaatctattgctgaccgagttgctagaggtgtctgccgaggaggctagagccgagacagcactgacacgtggggcatacgtacgactgggatgggttcgagacatttatgagaagagatgtcaggtccggcggtggattgtagcagctcgtgcttatctgttgcacctggtcggttgcactctttttgctaataagagtgcaacatacgttcatgtgattcacctagtcgcttttcgcgacctcgatcagagtggtggttatgcttggggagttgccgcgctggttcatatgtatgaccagttagatgaggcttctaggaccaccacacgacagattgcgggtgctagatctatgagcacttccctagtgtgcaccagtgcgtcacagatgatacatactaggagacgtccccacgtgcttcccggtggctga

SEQ ID NO: 63488 - DNA, 1245 bp, Glycine max
  Peptide Sequence Number=SeqID_180266
atgcttttaaatgagccttcatcttatttctaccttaaagcctttattttccacattttcccgaagaaagatccgatgtttaatcaaatgaaatcaaatagccaagctctaggtgctgatattcaatttggtgctttaaataagtcaattgcaacatcggatataaacctctctgctgctattgctgcatctcaggcactggtattccaaaaagattcgcaaccaactctggcttcgacatctgctggtcgtgagaactggggagagaccaacatggctgatgctagccctaggactgatacttcaacagatgatacagaagacaaaaatcaaaggcctgaaagggatgaatccagtggatcaaaagataaatcagatcaaaaggttacattaagacggcttgctcaaaatcgtgaggctgccaggaaaagccgactgaggaaaaaggcatatgtgcaacaattagagagcagtaggttgaaactgacccaacttgagcaggagctccagcgatctcgccagcagggaatatttatttcaagtactggagatcaggcacagtcaatgagtggaaatggcgctatggcatttgatgtagagtacgcacgatggttagaagagcataatagacaaaccaatgagctaagggctgcaataaattctcatgctggagatattgaacttcgaaccattgttgacaatttcatgacgcagtttgatgatatcttcagactgaaaggtattgcagcaaaagctgatgttttccacattctgtcaggaatgtggaagactccagctgagaggtgtttcatgtggattggaggctttcggtcatccgaactcctcaagcttcttctaagtcagttggagcctttagccgagcaacaattgatgggcatctacaacttgcagcaatcatcccagcagactgaagatgctctttcccaagggatggatgcattgcagcaatcactatctgagacattggctaatggttcgcccagctcatcaggctcctcgggaaatgtggcaaattacatggggcaaatggctatggccatgggaaagcttggtacacttgaggggtttcttcaccaggctgacaatctgcggcagcagacattacaacaaatgcttcgaatattaacgaccaggcaatcggctcgtgctcttcttgccatcagtgattatttctcacggctgagagcgctgagttctttgtggcttgccaggccaagggagtga

SEQ ID NO: 63489 - DNA, 1277 bp, Glycine max
  Peptide Sequence Number=SeqID_180267
atggtaaaggaagagaaactagatttgctatgcatgcaagagacaaagcagcaagaagtatcaagtaacctgtgtaaagctttatggggtagggatgatgtgagttggatcaactatcctgcaagtcttgaaagaatttgggctaatggagacatacctattgtggttaacatatatgccctatgtgatctagcatctaagaagaggttgtgggagtctattttgttcgaaagaagaagaaacacgatggaggcatgggtcttattatgtgatttcaacgacattagagtcttgtcggaaagaaaaggtgagtcctcacaaaactatggtgatttggataggaaagttttcaattgttttattgaagatatgggtttggaagacctacctttgattggtagaagatttacttggactagaccaattggaaaatccatgagaaggatagaccatatgctagtatctaaggagtggccttttaggtttctaaattgttggcttgaagatagggattttaaaacatttgtggaagagaagtggagggatttcaatgtcatagggaggggagcctttgtgctaaaagaaaagttgaagttgcttcaaaaggagatacgggcatggaacaaaaaccaatttggtgacctgaatgcaaaaatgaagattttgcaggagaagatgagatacttagaggtaatgatcaattggattcaaaatggggattacaattccaagttctatcatgcctatgtcaatgctagaaggaggttcaatttgataaaagatctaaagcacgaaggacgatgggttgaagaaccaagggagatagagatcaaggaagcaatttgggattgtgagggcttaaaggcacccggatcggacactttcaactttaagttcttcaaagagttttggcctcaattgaagaatgatattttgctctttgtgaaagaattacacatgcatgggtgcttttctagaggggcaaatgcgtcattcattgcacttatcccaaaagtgaatgaaccacatggcctaggggaatatagacccatttctttagtgcgttctctctacaaaatcatcacaaaactcctagcaagaagaatcaaagtggtcttgcctggtgtgattgatcaaaggcaaagtgccttccttgaagggaggcacctcatccatagtaccttgccagcattcaaggtggtcgataaagctagaaggaaaaagaaaaagtgtgtaatcttcaaggttgactatgcaaaagcccatgactcggtgag

SEQ ID NO: 63490 - DNA, 174 bp, Glycine max
  Peptide Sequence Number=SeqID_180268
atgactggtgtagatggttgggtctcctcaggagtaggtgtagaggatgcctcaagaagggtgagctcatcctccccctctactgctgctgctgctactggctcctcagaagcaagctcctgggctacggaggccccaccccttccagaaggagaaggttgggctcctagctag

SEQ ID NO: 63491 - DNA, 267 bp, Glycine max
  Peptide Sequence Number=SeqID_180269
atgtttctcttgtcacttcggactatgtctctgtctttcttgtcccttctcctttgccatttcgacctccacaacgctacccccaccaggttctcctcaccctccctttacaacataacctccacttctccttccaggacttccttgcccttcacaatgccatcctcaatgagaaacttcaagtgggataatcatttcattctccttcattgcaagttagatttgaatgtttgggagtcagatctactcgttgatgaggtggcgtag

SEQ ID NO: 63492 - DNA, 288 bp, Glycine max
  Peptide Sequence Number=SeqID_180270
atggagaggccacggatggaggagttcctcatggtgatgagaaggtgggggctcgacctgaaggagaaggaacattgcacccacgctatacccacccatcactgcgtcgcacacaccacagcacccccacctcacgtgaagtgcgccactccaccattaccaataatgggactctcgcaagattgggcgatattgaatcaacttaaaacaactcgccacatgttcctctatccaaaccacatcgaacaagcatcacaatcgcgggctccaaactatagtcaacaatga

SEQ ID NO: 63493 - DNA, 471 bp, Glycine max
  Peptide Sequence Number=SeqID_180271
atgggagatcttgtggtagggcttgtggttcttctttcctggcttctcgtgctttctagctcttgggttcttctccgtgttagccccgaaagttcaagggggccgttcggctttgtcttgtgccaattggcccatttgaacttccagattccgaatggctgcatccatgctcttttgatgggatcgtgtttcctggatgaattacagcaacagttcttctatattggtgggcttttcttgctgattggggccctggctgggatgcgggcatggcggttgatgagttcccctggttgtaaccctggaatctgcgatttggtatgcccatatagtttacttcttgagaggtatcctgttggcttacacattgtccaggctcatgggttcctccgcatgtggggcatccttctacctgcaaaacagaagagtgggaagaacttaccgcttgtaattgctgaggtaatttgctga

SEQ ID NO: 63494 - DNA, 663 bp, Glycine max
  Peptide Sequence Number=SeqID_180272
atggccaaagaatttgtgaatggctttgttcatcaaaacggcatcgctgtcataaccgacaatccccccaaagtgtttgagaatatcaacccaaattcacgcagtgtgccttgcatgtccatcaaggctgatttgaagtggccgaaagaggcatggattctaggtcaagatgtttctgccagtatatttgtcattttggttccggccttgcctcttaagcctcttaagagggacaagacgaggtctaagaggtccttggaaattcaacaattgagggagcgtaagaaagagtatgacttgaagacagcaatatctttggttaaagagacatctaaaaccaagtttgtagaaacagtagcagcctatttccgcctcaacattgaccctaaatataacgatcaacaattaagagcaacagtcaggacaaccacaggatttgaaaaatcaagtgatcatgactatgctagggtgttgcctaggatattcccgttattcaaatttgtcaccatgaacaggtcaaggacaaccacaagatttgaagaagatatttgcgtgattcaaatttgtcaccatgagcaggtcaggacaaccacgggatttgaagaaggatttggcaggcacatgcacaagaaattttatagtcaagacaaccacgggatttga

SEQ ID NO: 63495 - DNA, 243 bp, Glycine max
  Peptide Sequence Number=SeqID_180273
atgtgttgccgtaaaaactcgtcctcagcaacttgcgggcatggagtcggaatcgcctgcatgaaggaagaaacaaaaagaataaaaagaaaagagaagaagattcaaaagagaaagatggagaaagagaaaattgagggagaaaacacagagagagaaaacgtaataatggagaaaactcaggaaagagaagaaagagtaatggagaagacacacacagttacgagtattaagcgtaattaa

SEQ ID NO: 63496 - DNA, 924 bp, Glycine max
  Peptide Sequence Number=SeqID_180274
atggatcaaggagagcttgcacgagtttttcaaatgtttgatcgaaatggggatggccgtatcacgcgaaaagagcttagtgactccttaaaaaaccttggaatcaccatcttggagcaagatttgagcctaatgatcgagaagatcgacgtaaatggagatgggttcgttgacatggacgagtttggcgaattataccaaacaataatggacgagaaagacgaggaggaggatatgaaggaggcattcaatgtgtttgatcaaaatggagatgggttcatcacgggagaagaattgagcgcggtgttgtgttctttaggcctaaagcatgggaaaaccatagaggattgcaaaagcatgatcaagaaagtggacgtggatggtgatggaatggttaactacagagagtttaagcaaatgatgaaggctgggggcgcttctatcactgcttcactgtttcttctccttcgtagcgtaatctcccatgtgggctcttcgtcgagcttcggttcctctcacgacccgagggtcaaattagcgggaactagttctgttgaagaagagagtgttgttatctatgaatctaatggaatgacgtatggcggatttttgtcgccaaatatgcgataccattcgggacataacgcttcgcttaattttactgatgatttggaggatgggttttccgagctcgagacacctgccggcgatggaaatgaatgtgacgatctgttaacttctgattatgccgacctattatcggatgatgttgaggagccacacaaggagaaagaaagaccacgtcgtggaagggttgaatcgaagctattccatgagatcatgaatgcgcagtgtacctctcttcatttggttttggaaaagtggctagaagaagggaatgagctgaccagagaggaagcgtaa

SEQ ID NO: 63497 - DNA, 1335 bp, Glycine max
  Peptide Sequence Number=SeqID_180275
atgagtggtttagcctctcatgacaatgagagacttactaatacaaaaagaaaacaagaggtgtggaaggaaatggaggaaaggatccccaatattcagggctgcagaggagggaggaagatccatgtcttgcatattgagcagttacaaatgctctcagaatggctcgagtcaaaaaaggagtttgaatttattgaaagagattatgcaagtcggcttgatttaattgccaaattgcgtggcttacataaggcagaggtttacatcgagactattccagaatcttgtagtagagagataatgtaccggactttattggctaactgtgtcagtcagaacaatgtgaagaaagcagaggaagtttttagtaaaatgaaggacttggatttgcctattacagtatttacttgcaatgagttgctatttctgtataagaggaatgacaagaagaaaatagctgatttgttattgttgatggaaaatgagaagatcaaaccttctcgtcattcttattcaatcttaatagacacaaaaggccagtccaaagatattggtggaatggatcaaattgttgatagaatgaaggctcaaggcattgaaccagacatcaacacacaggctgttttggctaggcattacatctcagctgggcttcaagataaagttgaaactttgttgaagcagatggaaggtgaaaacttaaaacagaatcggtggctatgccgaattttgcttcccctctatgcaaacctaggaaaggtggatgaagtgggaagaatttggaaggtctgtgagacaaaccctcggtatgatgagtgtctgggggcaattgaagcttggggaaagttgaataaaattgatgaagcagagaaagtttttgagatgatggtaaagaaatggaagctttcttccaagacctgttccatactgctgaaggtttatgcaaataatgagatgctaatgaagggtaaggatcttatgaagcgaatcggagatggtgggtgccgaataggcccattgacctgggacacaatagtgaaactttatgtccaaactggggaagtagagaaggcagattctgttcttcagaaggcagcccagcagagccagatgaagccaatgttttctacctacctaactattttggagcagtatgctaagaggggtgacatccataactcggagaagattttccttagaatgaaacaagctgattatacatctaaagcaaagatgtaccaagttctaatgaatgcctatataaatgcaaaggttccagcctatgggattagggacaggttgaaagctgatagcatatatcccaatagaaatttg

SEQ ID NO: 63498 - DNA, 1620 bp, Glycine max
  Peptide Sequence Number=SeqID_180276
atgggtggcccaatagacccaataatagtcagcagaataggttctaattctattttagaatttgggtttaggtctaactcaatcgatatatatataattaaagcgtatagattcaaattttttgtacactggagcttgcagatacatggaaattcagttgaagggcggatattgcatgggaactcaccttgtgaactgattgaacgttccacagaaagcattggaaggctacctgagcttccagagtggataatatcaggtgctatagttggaatgcagggtggcacagatgctgtacgtcacatttgggatgaactaaggacttatgacgttcctgtctcagcattttggttgcaggattgggtagggcagagagaaacattgattggttcacagctctggtggaattgggaagtggatgcacaaaggtattggggatggaaggaacttatcaaagatcttagctctcagaatataaaggttatgacgtattgcaatccttgtctagctctggttgataagaaacaaaacaaaaggagaaacctctttgaggaggcaaaaaagttggacatattggtgaaagacagcaatggaaatccatacatggttccaaacacagcttttgatgttggaatgctagatctaacgcacccaaaaactgcaacttggttcaagcagattctacgagaaatggtggacgatggagttagaggatggatggctgattttggtgaaggccttcctgttgatgctgttctatattcaggtgaagatcctatttcagctcataacagatacccagaactatgggccaaaattaacagagagcttgtggaagaatggaaaagtagctccctggacaaggtgaaggaagatgaagacgagggcttggttttcttcatgagggctggttttagagatagccctaagtgggggatgctattttgggaaggagaccaaatggtcagttggcaaacaaatgatggaataaagagttctgttgttggcctactcagcagtggaatttctggctatgcctttaatcacagtgacattggaggatactgtacagtaaacttacctatagttaaatatagaagaagtgaagaattgcttttgcggtggatggagctaaattcttttaccacagtcttccgcacccatgaaggaaacaagccatcatgcaacagccagttttactcaaaccaccaaacaatgtcacactttgcgcgttctgcaaaagtatacaaagcatggaaattttaccgaattcaactggtgaaggaagctgcacagaaaggattgcccatatgtcgccacctatttctccattatcctgatgatgaatgtgtgcatcgtttgagttatcagcagttcttggttggttctgagttcctagtggtgcctgtccttgacaaaggaaagaaaaaagttaaagcttattttccattgggagagagtagcagttggatccatatctggacaggaaaagtgttttccaaacaaggacgtgaagaatgggtagaagctccaataggataccctgctgtatttgttaaggttggctcccaggttggagaaacctttttgaataatctgagaagtttaggcattctttaa

SEQ ID NO: 63499 - DNA, 243 bp, Glycine max
  Peptide Sequence Number=SeqID_180277
atggtgcgtcgaccatggtgcagtttcacattggataaagtggaggagaaaaagagatgtggagacactgaatccattttgtcttctcatgatggaattgatccttggctaaacatatttgatgcaatcctccctgggaagggaccaatcaccagagccatgagtaagaggttccaagagggttggactagagctgctgaagaagaccatagggttctcatgaacctgaaggtagatttctga

SEQ ID NO: 63500 - DNA, 216 bp, Glycine max
  Peptide Sequence Number=SeqID_180278
atgtcaatgaaaaacctcgtcaggcaccgaggagtacatgacaagacgaaccacacactagcaagtcaagtcactctcactagaatgctccaaccatgtgggataggcacaggcttaaaggagcactcaaaccgggtgacccccaaggcctacactccgaagagtccatcagggcctctccctcctgattcaggtccaacccaggggatcctctag

SEQ ID NO: 63501 - DNA, 1004 bp, Glycine max
  Peptide Sequence Number=SeqID_180279
caggtcgagcctgaaccttctgtggctgtcgagggtggtgagccagccaagaagaaaaagaaaaagaccaagtcttcaaaagaacaaggtgacaatcaacctgttgacgtccaaccaccttcgaccgatattgacggcactgaggtagaagctgctccttctattgctgagatgggcaaccctgtcgagcaaccggactcaccacaagaacaacctgccgtcgaggtgcaacaaaatgtttctgcagaagaaataccctcatgtgcgcgaacatctcccgctcctgaggcggatgcagtgaatgttgaggaatggggtgaaggtcaaggcattggatccagtagtcctcatggttgggcagaggttgatgaccatcatgagccgaaccagtcagataataccattcctcatgaatcgagtcagaaaagttcatctgaaggaaactttttcgatgaagacgccataaaagaggctgaagctggaggctcagacatttacccggtgtcctcaacatctaaactttccgctagcatagggatagcagaagatacattcattcaaatgcaaaatgaagaccctgctgcagcccttcgactcctgctgaacacaagtcaagccaacacctcaagtgacaagattcctggtgcttcgaccccatctgatgctgaaataaactcttcagtacgccaagattctctgctcttgaagttatcaacggaatacgcacggaaagatgtgcttaaatccattgaagagaacccctctgctgcctttgggcacctgaactttttgaagaaattgcacaacccccttacctctgatgagactttaggcaaagttatccaaatcgaggccatcattgaccagtttgcaagtgctgtgcagaaaaaacgcgaaaatggcacaagactagatgcccagaaacaggcacatacccttctgctcgagaaagcccgagctgctcaacatgaagtcgaacgtctcaccaaagaggcaaaagaagg

SEQ ID NO: 63502 - DNA, 984 bp, Glycine max
  Peptide Sequence Number=SeqID_180280
atggctgaagatgggaacaacaacgatgtacccttacacaaattcaaagacagcaatccaaaccctgaagagttcgatgcaaagggttacagcctcagcggaaaaatcatgctttcagcaataatccttcttttcttcgtcgtcgttttgatgttgtgccttcatatctacgcgcgctggtacctccggcgtgctcgccgccgccagctccggcgccaacgcgagctccgccgcacccagcttgtcttttacaacgacgacgccacccccgcagccgtgtcacgtggcctcgacgccgccatccttgccacgctccccgtcttcaccttcgacccggaaaaaaccgggccggagtgcgctgtttgcttgtcggagttcgaacccggtgaaacgggtcgggtcttgcccaaatgtaatcacagtttccacatagaatgtattgacatgtggttccattctcatgacacgtgtcctctttgtcgcgccccggttgaacgcgcgccggaaccggaagttgttgttataacagtacccgatccggtttccgaaaccggttcaggcgaaaatgagaaccgaaccggttcttcttcttcttcctcttcggttggattgagtaagcctaagccttcgttggttggtgtgacaattgaggtgcctccgagggacgagaattttcaaaacgagttgcaaccgagttgcgactcatcctcctcgtttcggtcgccgatgagtcgcatgctgtcgtttacgaggatgctcggcagggaaaagaaggggaacgtgtcgccgtcgtcgtgcggcggcggcgattgtagctccgccgcggagcgaggcggtgagcggcgctcgtgggaggtgatattcttgattatgggtgagatgccactattgaagtggttgtggtcttggatagtggttttaactttgaattggtctatgggtgacatcgagaacagttacgatttccattaccacacatactga

SEQ ID NO: 63503 - DNA, 450 bp, Glycine max
  Peptide Sequence Number=SeqID_180281
atgggtgaagtagaggaggtgcaagagcagatgaaggccgacatggaggccatgaaagagcaaatggccacaatgatggaggccatggtgagcatgaagaagataatggaagccaatgcggttgcaatagccgctaccagcaccattgctgaggtagacctgactcccccatatggccttaaccaaataaatcatttaatcccaaatatggtaggtttggaaggcaaagatttgggaagtacggacggccccatgatgtgcaaattcagaacgagcatgccttcccgccatatggcttgcctcccaactatacaccacccaatatggcgtacactcccaatgaggatgtcaataactctactcccatactcattgagagccgacaacctcgtcatgtacatgtctctcaacccgtgggggagacacatgaaattccccaccacaatctag

SEQ ID NO: 63504 - DNA, 297 bp, Glycine max
  Peptide Sequence Number=SeqID_180282
atgtgcatatatttcccatactcggacagagaaaggagactaacttctctacatggttcgattgaaaaactggtatatggtgctgaacagaatgaagagcacataggcttgttaaatgataaatcaaagccaattatcttttctatggcaagacttgattcagtgaaaaatataacagggcttgttgaatgctttggtaaaagctccaagctgagagagcttgtgaatcttgtggtagttggtggctacattgatttacaaaagtctacggatgtagaagaaatgggggagatatag

SEQ ID NO: 63505 - DNA, 357 bp, Glycine max
  Peptide Sequence Number=SeqID_180283
atgagtccaaaggcatctccatcagcaagccttatcaaaataggttcggatggctttgatctgatagagaggcactatggtcgattcagaagaaatcaagttcctccttttgaagtgcctatcattgtgaatagcaataaccctggtgcttcatttggtggggctaatattgacaacaaagaaaacccaaagccaccacgtcgtaattgggctgtgttacatacttgcaccaagtatgaaagtactgatttatcaaaaagaaaaaagaaaaatatgagagtactgaaagagcttgtgcatatggtagtgtgtataaggtttgcagctgaatgcttatatgttatgattgccttgtag

SEQ ID NO: 63506 - DNA, 408 bp, Glycine max
  Peptide Sequence Number=SeqID_180284
atgtcttcctcttcctttctctctcacacactctttcctttttgttctgtctctcttttccaatgcttcacccagtttttgccatttccaataccatgcccacttccggatatattcgacagagcttccagtttgagggagagagtgcaagacaccctctctaggtaccgcaacgagttcatctctcttctctccaggtatgttgctgggggcaaaggaatactacaaccacatgaccttctagatgaggtagaaaagcttcttgaagaggatgaagatatgcagaaactcaaagatagcccttttgtcaaagagttagaatctgcaaaggaagccatagttctacctccttttgtgtccatagctttgccttccaagacctggtgtttaggagtatgttcgtgttaa

SEQ ID NO: 63507 - DNA, 2463 bp, Glycine max
  Peptide Sequence Number=SeqID_180285
atggcgaggaacacagcagacctcgcaacgaacttcaatgttgctcaccacttcccccacgactctctgctccgctattgctcttcccacgtttctggcttccctcatcccccaactcacttcaccgtttcccagtttgggcatggacaatccaaccccacgtacttgttggaagtaggttcatatggttccgtggtgaagcgctatgttctcaggaagaagcctccggggaaattgcttgcttcagctcatgccgtcgacagagagtttcaggttctccatgcattgggcactcataccaaagttccggttcccaaagttttttgtctgtgcaatgatccaactgttattggaactgcgttttatatcatggaatatttggaggggcgcatatttcttgaccccaagttaccaggtgttacatctcaaaagaggagggcaatttacagggcaacagctaaagccttagcttccttacattctgctaatgtagattccattggtctgggaaattacgggcgacgcaatgattattgcaaaagacaggatagaaagctgaacacagatggatgccataagaagttattacaacacaataaaattcatgaaaatgaatgttgcggagaccttaaaaaggttgagctctccatttggttctttaaaaagtttgatgaggcacttatcccttcctttccccatgcccatttattggtcctgctattgtaccgggacacaaaaagaaggattgagaggtgggctaagcaatatgttgcctcaaccagtgagggtaaacctgcaagtaatccaaaaatgtttgcccttattgattggctacggaatcaaatccctcctgaagattcttcgggagcaacaggaggtctggttcacggagatttccgcattgacaaccttgtgttccatcccacagaggatcgagtaattggaatacttgactgggaattgtctacccttggtaaccaaatgtgtgatgttgcatatagctgtatgccttatattgcagatattggacctgaaaaagtacatgaaggtatagagcattttggattacctgagggaatcccttcattaccagaatatttggctgattactgctctttggcacgaagaaaatggcctgttgctgaatggaagttctatgttgccttttctttcttccgggcagcttcaatttatgcaggagtgtataatagatgggttaaggtatctaaacttgttagggatgctgttgtcgttaaagtttcaagatttaggggtaatgcatcgggcggtgaacgtgctcgacacacagaagtacttacaaatggccttatagatactgcttggaaatttattgaacacaaatctgtgcttcctcagcatccaccctcagatgcaaacgctcaagactattccaaagagttaccgaatgggaatgatatacaggaactctcaaatcaggggaagtttgttcctaatcaaaaggttttggtgctgaggaacaaattaattaagttcatggaggaacatatttaccccatggaaaatgaattttataaacttgctcaatcagactcacgttggactgttcacccagtagaggaaaagttaaaggaaatggcaaagaaagaaggcttgtggaacttatggattcctaagcttttcttatccatctatcagcttgatagtgctgtgagagcaagaaatcttctctttgatgggagcaataattatcactctagtgatgcaaatgacttgctattaggggctggtctcacaaatctcgaatatggatacctttgtgagatcatgggtcgttctctttgggctccacaagtgtttaactgtggtgcacctgacacaggtaatatggaggtattactgcgctatggaaataaagagcaactacaagaatggctaattcctttgcttgaggggacaattaggtctggatttgcaatgacagaaccacatgttgcatcttccgatgcaaccaatattgagtgttctatcaaaaggcaaggagattcgtatattatcaatgggacaaaatggtggacaagcggtgctatggatccaagatgtagaattcttatagtcatggggaaaactgacttcaacgctgcgaagcataaacaacaatctatgatcttagtggatgtcaagactcctggcatccacataaagagaccattgacagtgtttggctttgatgatgctccgcatgggcatgcagaaataacatttgaaaatgtttgtgtgcccgcaaaaaacatcatacttggcgaaggacgtggatttgagattgcccaaggtaggcttggtcctggaaggctccaccattgtatgagactgataggtgttgctgagcgaggcatgcatatgatggttcaaagagctgttagcagaagaacatttgggaagttgattgctcaacatggttcatttatttcagatatggccaag

SEQ ID NO: 63508 - DNA, 1740 bp, Glycine max
  Peptide Sequence Number=SeqID_180286
atggctgattacgatggtaaagaacaaaaaagaaggtttgccgttcttggcatctcttcaatccttcttgtggcgatggtggccgcggtggcagttacaataaaccgtggaggtaataaaggagaagaaggggatgatgaatctcgtgtccaaaccgctcaaaggaacaacgtagaaatgatttgcaattcaacagaatacaaagaaacctgcaagaagagccttgaaaaagcgtcgtcggacgaaaatgcggacacaaaggagctcatcaaggccgcgttcaatgcctcggccgtggaacttttgaaccacataaagaactcaaccctttacaaagagctggccaaggacaacatgacaagacaagcaatggatatttgcaaggaagtgtttgattatgcgattgatggtgttcagaaatccattgagacattggacaagtttgaattcatcaagttgagtgaatatgtttatgacctaaaagtttggctcacggggagtctttctcaccaacaaacatgcttggatggttttgagaacacaaacacaaaagcaggtgagaaaatggcaaaggctatgaacgcatctttggagcttagtagcaatgcattggacatgatcaatttcatctctggcttaatcaaggatcttaacataagctcacttgttggtaataataggagacttctcagctctaaggaagaagcacttgtagatggttacccttcgtgggtgagtgaagggcaaagacgtcttctagggctttcaagtattaaacctaatgcaactgtggcaaaagatgggtctggccaatttgcaacactcactgatgctcttaagactgttccccctaaaaatgctcaagcttttgtgatctatgtcaaggctggtgtgtacaaagaaaatgtgaatgtgggcatggacatgacccatgtcacagttattggagatggtcctaaaaagacgaggttcagtggtagtttaaattacaaagatggtgtccaaactttcaactctgctacctttgctgttaatgctgccaacttcatggccaaggatgttggatttgaaaacacagcaggggctgagaaacaccaagcagtggcacttcgagtaacggcagaccaagctgttttttataactgtcaaatggacgcgttccaagacaccctttacgtccaatctcaacgccaattctaccgtgattgcactatcactggcactattgactttatctttggagatgcgtttggagtgttccaaaactgcaaactaattgtgagaccacctttacctaatcaacaatgcatggtgacagctggtggcagaaacaaagttgatagcgctagtggccttgtgttccaaagttgccacttctcaggggaaccccaagtggctcaactaacacgcaagatagcataccttggaaggccatggaggccatactcaaaggtggtgatcatggactctcaaattgacaacatctttttaccagaagggtacatggcatggatgggaagtcagttcaaagagacatgtatatattacgagtataataacaagggccctggtgctgacacttcgcaaagagttaaatggccaggtgttaagaccataacatctgttgaagcaactaaatattatccggggaggttctttgaacttgttaattcaactgaacgtgattcttggattgttgatgctagggtaccttactctcttggctctatggctgcttaa

SEQ ID NO: 63509 - DNA, 135 bp, Glycine max
  Peptide Sequence Number=SeqID_180287
atgagaaggtggacacatattgagtattgtgtcagagcgaggaaggtagacgaaaaggtgcattttgagagaagattgtcacttaggactgaaaatatgcctgataacttatcgggagcccatatcctgggctag

SEQ ID NO: 63510 - DNA, 252 bp, Glycine max
  Peptide Sequence Number=SeqID_180288
atggcagcaggggaagatattcaagcccactttatggcattcgggaagctaattaaagggaagaaacaaaagattgcgcttgggcttggttcaaggcgaggcaagggagaacttgttgggttggatggtcggactggtataatttcccaatgggatgtctactttcattgtaacgtcaagtttggtggacgtagcaacagaatactgatgatgctggagtgtgctggagatgtgctgcataatcaacactga

SEQ ID NO: 63511 - DNA, 531 bp, Glycine max
  Peptide Sequence Number=SeqID_180289
atgggtggacataacaatgaccatgaacaacaacgaagctttgccatttttatcatctcttcaatccttcttgtggctacgatgcctgttgcaatggcttttggtttaaaccctaaccctgttggattaaatactaaccctaaccctaaccctaaccctggaggtgaaactaatggagaaacagggcatcaatcgaatgtcttgagcactcatagtagtggaatcacaatttgccaaggaacagaatacgaagaaaagtgcaagcaaagccttggaaattcactttttgtaaacacagacccgaagaagctcatcgaaactcagttcaaagtcgcaattggggaacttgtagacaacataataaacaactccaccctttataaacagattgtcacagatgagaggacaagactagctatggatgattgtaaggaaattttgggctatgcagttgatgctattatgaaatccacaagtctattgattcagtttgattttagcaagttgatggaaattgtttatgacctcaag

SEQ ID NO: 63512 - DNA, 1500 bp, Glycine max
  Peptide Sequence Number=SeqID_180290
atggcacatgttcttctacgtcgccctcctctgcttcgtgtcatcatggcctctcgcttcatcacctcctcttcctttcacatgcgcctttcttcattcccttcctctactctctccaaaaccaggacgagttttcctctgagaaagtttttggctccctgttgttcggttccaaatgcgttcactccaagggcgtttatgtcttctatctcggcgaccgaagcttttctcaaaagtgaaagttccacagcttatagttctgatcaaattcagtatggagtatcaccggttttgccgatgactaatttccgtcagacaacctggctggccacctttagtgtgcttgaaggcttggaccctgtgaggaaaaggcccgggatgtatattggaagcaccggtccacgagggttgcaccatttggtgtacgaaattttggataattctgttgacgaagctcaagctgggtttgcttccaagatttatgttgttttgcatgcggatgattctgtgagcatcacagacaatggtcgtgggattcctactgacttgcatccagttacaaataaatctgccttggagacagtgttgacggtcttgcatgctggcggaaaatttggtggtgccaacagcggctactctgtttcaggaggtttacacggtgttggtttgtctgttgttaatgccttgtctgagtcgctagagataacagtttggcgtgatgggatggaatacatgcaaacatattctcgtggaaaaccagtgtcaattctgaaatgccttgtgcttccagatgaaaggaaagatcttcgagggacacgtgtcagattttggcctgacaaagaagtattcaccactgctattcagtttgatcacaacacaatagctggacgcattagggaattagctttcctcaacccaaagcttacaatcacgcttcggaaagaggacaatgatccagagaaagttcaatataatgaatatttctatgctgggggattggttgaatatgtgaaatggcttaacaccgataagttgtatggctactgggtgggtagcattgttttctttacatgctgcataggcattaataactctggcttggtgtctgacagtagcccacaactgaagaataacaaaataaagccaatagctgtaaattggttactgactagtgaccttctgttccagaaagctcttcatgatgttctgagttttagaaaagaaacagatggcatcacagttgatatagcttttcaatggtgtgaagatgcatattcagatacaatactgggatatgctaatagtatacgcactattgatggtggtactcatattgatgctatgaaggcttctataacaagaacacttaatagtcttggaaagaagtcaaaagttattaaggagaaggatattactctaagtggcgagcatgtgagagagggtctaacatgtgttgtctcagtcaaggtcccaaatcctgagtttgaaggacaaacaaag

SEQ ID NO: 63513 - DNA, 1425 bp, Glycine max
  Peptide Sequence Number=SeqID_180291
atggcgagcagccacattgggaatgccggagacgccgacgcgaaggccttgaagggtcgccccaagaagccctccgacgacttcatctccctcttccacggctccgatccgtgtctagaggaagttcgaatccccactgggagagagaaagacagagagcttggggatgcacttgcggaaattaagtcattgaggaattcagagcgtcttaaggaaaggggggttgaagagcaacaacaatatatccagcagctaggggtgacaacaaatggagattgggaatggcagttccagtggaggagattatttttggagggtgatatagacatagctgcaaaatttatggaggacatagagggtctgacagtacaagttcagcaacaagacatttggatttgggagggggatccaagtgggagctacacagtggggaatgcttacatgatagtcttctcaaatgaaagcttcaacggtaaaaaattgatggatgatgcattatttttctgccggacatggcttaaaaatatggaggaaggatttgacattcctttccactcttggtccagcaacatcagggctgagttctgtgttcagggggggattagattatatatttttgtgctaactgatgagctgatcaaggtggatgaaaagctaaaagcagctgaagctcttctggaaagcaagaaccttgaaataaaaaaaatcaatgaggagaaaagggcagcactggctgcacaatttgctgcagaagccacacttcgaagggttcatgctgcacagaaagacgatgaaatgcctcctattgaagctattattgcacccctggaggcagaactcaagcttgctaggatggaggtggcaaagctgcaggatgacaacagagcactggatcggctaaccaaatcgaaggaggctgctcttcttgaggctgagagaactgttcagattgctttggcaaaagcatccttggttgatgatctgcaaaacaaaaatcaagagttaatgaaacagattgaaatatgccaggaggagaacaaaatcttggacaaaatccttcggcaaaaggttgctgaagttgaaaaactaactcaaactgttcgtgagcttgaagaggctgtcttggctggtggggctgctgctaatgctgtccgtgattaccagcgtaaagtgcaagagatgaatgaggaaaggaaaattttggagcgggaagtagctcgtgccaaagttactgcaaacagggttgcgactgtagttgcaaatgagtggaaagatgctaatgataaagtgatgccagtgaagcagtggctagaagaaagaaaattttttcaggcatgtgaacagctcagaaattgcttttgctttgtcttttgcaagttacttggatgtttcttgcagcagatgttcacaaaatactcctgttga

SEQ ID NO: 63514 - DNA, 747 bp, Glycine max
  Peptide Sequence Number=SeqID_180292
atgaattcattgcctagcgcttttcatgcatcctccaccaacgagtctggcggcccgcgaattgattaccaagcactgttcgccagttcttcattctccacttttattcggagccccatgaatttattgcctagcgctgttcatgtgtcctccaccttcgagtctggagccccacgaattcattgcttggcgaagttcgccaattctccattctcctcttttattcggagccccatgaattcgttgcctagcgctgttcatgtgtcctccaccttcgagtctggagccccgcgaattgatcgcctagcgctattcgccaattctccattctcaacttttattcggagccccatgaatttattgcctagcgttgttcatgtgtcctccaccttcgagtctggagccccgcgaattgattgtctggcgctattcgcaaattctccattctccacttttattcggagccccatgaattcattgcctagcgctgttcatgtgtcctccaccttcgagtctggagccccgcgaattcattgcctagcgaagttcgccagttctccattctccacttttattcggagccccatgaatttattgcctagcgttgttcatgtgacctccaccttcgagtctggagtcccgcgaattgattgcctagcactatttcgccaattctcaattctcaactttaattcgaagccccatgaattaattgccaaaggttgttcaggtgtcctccaccttcaa

SEQ ID NO: 63515 - DNA, 597 bp, Glycine max
  Peptide Sequence Number=SeqID_180293
gagccatctggtcttcctccttgtcgaattggccatgatcacaagattcctttaatgcaaggagctaaccctgtcaagaagaggccctatagggatcttaataaggcaactgttaagaacaagttccctataccattagtacaagaccttctggatgagttagctggttacaatcaagttcgaatggatgcaagtgatgttcacaaaattgccttcaaaacttatgggggccactttgaatacttggtgatgccctttgggcttaccaatgctcctgccgcatttcaaggactgatgaattcagtttttcagcattacttaagaagaactcacagtttgtatgctaagaaatccaaatgctactttggtgttgacaaagtggaatatttgggccattttataactaaagaaggagtttccatggatccttctaaaattgcagcaatacaagattgggccctaccacaaaacttgaagcaattgaggagtttcttgggtattgtcgcaaaagaagcatttcaggaattgaagcaaaggctagtagcaacaccagttttggccctacctgatgtgaaccttacagggcggaacgtttga

SEQ ID NO: 63516 - DNA, 124 bp, Glycine max
  Peptide Sequence Number=SeqID_180294
atgggtgcaagggataaatcaatcatgcacaagggaaataaaaatcttgatcttgtcactgatcctatgcatgctcattcaggtccagtgctggtacagatgatggatcctgagaaagaggaag

SEQ ID NO: 63517 - DNA, 225 bp, Glycine max
  Peptide Sequence Number=SeqID_180295
atggagtcaggggcaaacgagcccgttgacatacagagaataacatcgtcttccgcaccttttgtcatccagggacagcaagttaggtggcaggcagagataccttatgatcatccgctcctttcatcaatcgaggtgaacaaattcgacggtttttactctcgtcgtctggagacttacaagcttgacgatgcacgagattcttcgctgctgggcggggggtga

SEQ ID NO: 63518 - DNA, 330 bp, Glycine max
  Peptide Sequence Number=SeqID_180296
atgaggtgtctccgcatgtcatcatacttgccgtctctagatgacaaatgtgagactaaaaggtgtctccgcatgtcatcatacttgtcgtctctagatgacaaaggagagactaaaggagtctcatcaatgggcttgcttgcctctagttggaaaaaggtgcagataaccatgaggtgtttccgtgtgtcatcggacttgccgtctctggttgacaaaggtgagactaaaagagtctcaatcaacgggctcgttttcctctggttgacaaaaggtgcggataaccatgaggtgtcttcgcgtgtcatcggacttgccgtctctggatga

SEQ ID NO: 63519 - DNA, 360 bp, Glycine max
  Peptide Sequence Number=SeqID_180297
atgttgaccgagactcctttagtctctccttcgtcatccagagacagcaagtccgatgacatgcagagacactttacggttatccgcacccgagtcaaccagaggcaagcgagcccgttgacacacagagatcaacatggtcgtctgcccccatcgttgaagactcaacgtctgtcgattgagactactttagtctcacttccgtcatccagagacaagcaaagttacactaagcgtgcaagcaccaacaaggcaacctatttaagtctgaaatcagattttggaggggattttggccattttctcgaggagcttttgcatagaatggagcttgaagaggaagtcgtccagagagcttga

SEQ ID NO: 63520 - DNA, 711 bp, Glycine max
  Peptide Sequence Number=SeqID_180298
atgccactggagaaggctccagcgctgcccagccagctaacacggattatgacaaccaccgataacagagcaccgagcatcaacagcgcttcgagaccatcaagggatggtcattcctcagagagtgggagctcaggatatgcgctcatgggtgcgggaccagtggatccccttcgatgcagatgccctcagccagttcttaggccacccgctgatcttggaggaaggtcagcagatttcgcccagaccactgcagggagacgggtgcagatcatgcgcaccaacatgaccaccctgacccagatatggatgacgttgctgctcagcaacatcctgccctgtgaccacaagtctgatctccctctaccgaagtgtcagctggtgtatgccatcctggcacaaatgagtattcacatggctcagttgattgctgatgccatttatcagtttgcaggaacggtgcctacgaggcaccctgcaccacaacagcctggggatgatcagcagcaggctgcaggtgctccaccaccacctctagagtctacctctaatcagttgtggagattggagcgcccgtacacgtggccgactacggagcagtttgaggctacagtagcatgcacggggattggcccgaggatcaaacaggacccgcctgcactcgtggaggtagggacgaggctgaggatgattaggacatggcagacatga

SEQ ID NO: 63521 - DNA, 318 bp, Glycine max
  Peptide Sequence Number=SeqID_180299
atgtacctttcggagtttgaagatcttgtgaaccgtattgtcagattacctccgctgtttctcttgagttgctttatctcggggttgactccggagatacgtcggcttcaggaggagaagcttcttgatgcacattccctgagccaagcgcgaccacccaccctcgtcgtgccacccccgcgacccctgtcgtcagtcgcgaccccattgcttctagtcccagcgaaaaccccatcatcggtgcctctgaagcgactctccctggaagaattggcttcgcgtagggaaagatgtttatgtttcaattgtgaagaatga

SEQ ID NO: 63522 - DNA, 624 bp, Glycine max
  Peptide Sequence Number=SeqID_180300
atgtgttttgtacatgactcattgaaggaacaggcgtcacagggttcctttgtcccccatggacgtcataatgtcctgactgctgccattgggcgaccagaacaccctggtcatgtgcatgttgctagagccggtgtaaccatcaagcaatactttggatcggctccatggacctccctcacttcttcctccatggctattgaagaactagagcatctgactcaacaaattagggaccggctgaaggaatcgatcacaaaaaaaggacttgcactacctccggagcctgaggttggtccctcaactgctcatgtcagcacaaagaagagttatgttggtccctcaaggaatgatccagacacgggtgactcagacaaatgcgggttgtacattaaagaaaatcctccccgcctgggttccctaggaagagtttatgagggatccacaactgttcacagcatccctttgttgcatgatcaagtgaaggttggtgttgaggaggttaaagatgcagatgctcctgttcctgtacccactaacgaggttaacttagtggggcagacacttaacacatttcttgtttggccaacccgcaactcagtgtactggagatgcgcttattaa

SEQ ID NO: 63523 - DNA, 351 bp, Glycine max
  Peptide Sequence Number=SeqID_180301
atggaagaaaagaaaccgaaagtgaacgaaataaagacgaaagccaaaaaaataagaaatgaattgaaagtctcggattggaaaacttacccgttgaagaacgaagaacgaataaagaacgccaagggggtttgggatatttggaatagcctcccttcgcctatttataagaaaaagggggagaaggttgctgcccagctcacccagattgcgcaacaatgcttctttttggcttctggaatgtcgcggaactttgcagattacctaacgatgaatgttaagtacctcgaggcggtcaagcgaaggttgcatgccaccaaacaatggtcctcggacgaaattagggtatga

SEQ ID NO: 63524 - DNA, 195 bp, Glycine max
  Peptide Sequence Number=SeqID_180302
atgaccacattggtctttgcttgtcaatccgactttgggtctccgaatgacgaggttaccatcgggtgtctccgcatgccaccggactcttgggtcacagtagcaaaaggtagggttgtcgacaaaagcagggcttttgctcctacgtatcctcaatttgcgatgaggaactcagacctacgtagttcttgctaa

SEQ ID NO: 63525 - DNA, 429 bp, Glycine max
  Peptide Sequence Number=SeqID_180303
atgtcagttttggaattgtacgtagaaaaggatgtggctggtggttctatgtttcattatgcaaattctgttacatcatgtaaaaataatttatctaataatgagtcggaaccgccaagaaacgtaagcaatttacatggtgatgaagaagatgatgatgatgattatcttgtgtctaactcatacattgaagagtctttagacgaagatgatagtgttgaccgtatatctgatacaaacgatgaagtaaccgacatgattcaaccaaaggaattcaaaatccattttggaatgatgctttgcattataacaatatcaactggagtcatcctgatgaggaggacatttgcggtttggagatgccatcgagttttaatgttgggcaagaattatatgttggcatggattttgatagtaaagatgtggtaa

SEQ ID NO: 63526 - DNA, 591 bp, Glycine max
  Peptide Sequence Number=SeqID_180304
atggctaagtatgaccctgagatagtcatggagttttgtgcaaatgcctggcctattaaagaaggagtcatggataagtgctcctggagggataactttgtgaatacgccaaaagaagaagccaagtatcagatcagtgttcatgtagcacagcttatctcggatgccatctaccagtttgtaggtattgcacctccgagacacttagtggacccagaaaagtccaatagggcattgggatttccagcattgatcacaggcttctgccagttctacggagtaccggaccaacagcagcagctggcagcagatgcaccaccatcgcctccacatcaactgtctctagagtccatctcagctcacatgcagaggatggagctccaaatgaacgagtacatacaacatttggctaaccagcaggaccccaacccttacccatggcctactctcgagcagttcagagccactgacgcatggcctggggacaggcctaattttcagggaggtataggtcccacagaggcccagggagatgaagacagagctgaggaggatggagatgtggcgaatgtgatagatttcttcctttga

SEQ ID NO: 63527 - DNA, 714 bp, Glycine max
  Peptide Sequence Number=SeqID_180305
atggattatgtaatctgtatgagttatatggattccaaagaagacgaagtagccattaacgaagaacaagaagccttaccccaacggcggaaacggcacgacgacaatggagacgtccttaaagccgacaatggaagcagccaacagcggcggtgcggcacgaaccaaggaagaggaagcaagaagacgaagaaagaagatgagacgaagaaagaagcaacgacgcgacgtacaaacgaagaagaggagcatgatggagaacccaaagccgatgtggaagaagaagaaaaagaggtagacacattgaaggcgatgaaggatcacatggatatggactcccaaatagagaaaccctttggcgaccacgacttgaagggcagcttctgctcacacactgcgaatgtattccatggtgaaatagatcttgctcttggtgtgagcctttctctgaacaatgttggggtgacgcacacggtgcagtatagagatcttgtgcttgatgcgcgccaacaaaccacctttgaggatcttctccttgtcaattaccttgatggcaacgccttcgccatgattggattggcctctaatgaaggtggttgggaggggcgaatggatggagggaggaaggaggtcttcgtaggtgaaaacgggagggaagaggctcgtggagcgatggttgcggcgactcttggcatcaacaaaggaagagggtga

SEQ ID NO: 63528 - DNA, 309 bp, Glycine max
  Peptide Sequence Number=SeqID_180306
atgattatagttagaactagaggtttaggtcgtgttttaggcagagttataggaaaagtcatagggagagaagataatcgtgatttagatgaaactccccagcggcaaaggcccaaagcatccgcacgtaggcaacggaaagttgccacttttgctaaggatgttcctcacgtggatgacgcagttgaagaggtcttccaacagcttgaagaagcagctgttgatgatcaggattttccatgcggaccgtgtgacacatcagttctgactgcctatgctgatcatgttgcagtcattgtttggaattaa

SEQ ID NO: 63529 - DNA, 132 bp, Glycine max
  Peptide Sequence Number=SeqID_180307
atgacagatgtagaagttccaggatcagaagccatgtttgctggtcttggacacttttcccagctatcactcaagggtaggtggttgatctacctcactatagaaacagtaatataccatgaattgatttaa

SEQ ID NO: 63530 - DNA, 176 bp, Glycine max
  Peptide Sequence Number=SeqID_180308
ttgtctctagaatatgtccattggatttaatgatgaaatatgtgcaatttcaagtgaaaaagaggctaagtcatgaagtgccaaaagtgaaaaagcgtgagatcagtgcgctaagcgcaacaggtgtctttagccaggctcagcacaagactggcgctaagcctgaatccacttaa

SEQ ID NO: 63531 - DNA, 141 bp, Glycine max
  Peptide Sequence Number=SeqID_180309
atggccagggcacaaaatcccacagcacaccatagtgcctatttaaggaaaagagctctggaggcagcaagaggagcaactttggcagagatacctaggttttctaaacaccctagttggggatttctaatgaacagttga

SEQ ID NO: 63532 - DNA, 798 bp, Glycine max
  Peptide Sequence Number=SeqID_180310
atggcatgtagccccctgaatatgaggacgtgtagtcctctgaaggcaaggacgtgtagtcctctgaaggcgaggacgtgtagtcctctgaaggtgaggacgtgtagtcctctgaaggcgaggacgtgtagttttctgaaggcgaggacgtgtagtcctctgaaggtgaggacgtgtagtcctctgaaggcgaggacgtgtagtcctctaaaggtgaggacgtgtagtcctctgaaggtgaggacgtgtagtcctctgaaggcgaggatgtgtagtcctctaaaggtgagggcgtctagccctacgaaggcgaaggcgaggacgtgttgtcctctgaaggtgaggacatgtagtcctcagaaggtgagggcgtgtagccctacgaaggtgaaggtgaaggcgaggatgtgttgtcctctgaaggcgaggacgtgtagtcctctaaaggtgaggacgtgtagtcctctgaaggtgaggacgtgtagtcctctgaaggcgaggatgtgtagtcctccaaaggtgagggcgtgtagccctacgaaggtgaaggcgaggacgtgttgtcctctgaatgtgaggacatgtagtcctcagaaggtgagggcgtgtagccctatgaaggtgaaggcgaaggcgaggatgtgttgtcctctaaaggcgaggacgtgtagtcctttgaaggcgaggacgtgtagtcctctaaaggtgaggacgtgtagtcctctgaaggtgaggacgtgtagtcctctgaaggcgaggacgtgtagtcttctaaaggtgagggcgtctagcccttga

SEQ ID NO: 63533 - DNA, 552 bp, Glycine max
  Peptide Sequence Number=SeqID_180311
catccaggccatgttcgtgtcgcagggacaggtgtcacaataagccaatactttggccaagcctcacgtgcttctagcacatcgtcaccatcgatcaaccaacaacaattggcttatatcattggtggaattaaggatgacataagaaagcagctacaagatgagataagaaaggaggaacaggatgagataagaaaggaggcgctagaaatacaagctctacttgcgcgtgttagcacaaagggtagctgcactggacctgaaggaagcgaattacttaaagagcttttgaatggtgatgacgatctgatgggcttgttcgtagttgttgggcaaaatactatgcttgcgggcttgggaaaagtgtttgagaattcatccaccatacataatgttcgttatgaaaatgatgttgttaaggttcaggttgtcagaacatacatgcctcacgctgaggtccctattcctacatcagaggttcattatcttgagcaggccgttggcacattcgttgcatggccgacacatcttgttagggaagtaactaatgag

SEQ ID NO: 63534 - DNA, 339 bp, Glycine max
  Peptide Sequence Number=SeqID_180312
agcaggcaggcgtggtgcagcggatggcggaacgagttcaatcaggaaaagccgcatgaggcacacgggcagcagccgcccgcaaaaatatggacgccttcaccgcggaaatggaacggaaaagtgccggaggtggggtatccggagggggcgaagctgtacaaagtcggtgaaaaaggcgacctgaggctgaacgggcggaccttcctgagcgcagcgttacggggcgagtacgtgcggttcctggaagtggacgacggcattgacgtcatcctcttcgacaggctcatccttgcgtattatgaccgggcagaaaagcgtattatccggatcgactga

SEQ ID NO: 63535 - DNA, 411 bp, Glycine max
  Peptide Sequence Number=SeqID_180313
atggtgcgccgcgccgtggcgcgcgtcagcaatcgcgtcagtaacgatcagccggatgatcagggaattgaacagttaagcgggcgcatcagcctgaagcagggcaacgtcatgctgccggatctgcagggcggcagcagccggctggcgctgcaaacccacggcaacgtggatgtggtgaagcagcagctggatgtcaccattaatatgattctgcgcggctggcagggcgacgaccggctggcgaaagtactcaacggccagccgattccgctgcgcatgtacggcagctggggcaatctgcagtattcgctgccggtggatgacgtggtgcgccagcagttgcagggagaagccaaaacgcgccttaatcagtggctggatagccagaagtctgcaccgcggcaataa

SEQ ID NO: 63536 - DNA, 348 bp, Glycine max
  Peptide Sequence Number=SeqID_180314
atggtgggagcaggtttgaaaaaggatcttagagtgtctagggttgtgccaggagggtctcttaatgccttcctttttcttctcatcggagttatttcacaaagacttgccatgggtttcctcatttgggatcctggggaagaggatcaagctggcccttgcgaacagcttgatgcactatctcccttcaaccctttgagcgaaatgtggcaaaagggaaaaagaatccatggaccgaccccatcgtctccaccccgtaggaactacgagatcaccccaaggacgccttcggcatccaggggtcgcggaccgaccatagaaccctgttcaaaaagcggaacgcattag

SEQ ID NO: 63537 - DNA, 354 bp, Glycine max
  Peptide Sequence Number=SeqID_180315
atgggtggggcaagctcttctattctggttcatggtttctcttggctatatggttcatccgggggagagatcgagcttcaagaaatagtgaacggtcttatcaatacacaaatgaattgggttcaagctttccccagcccccttctcatcaatggactcctgacgtatacgaaggagtgcggttcgttcgataaattcctatctctttatctatttctgagatgtttggatttttcaaaactccatggacatgcagaagagaaatgctattcccactcggaccaagacataactttacttgttcaaataacaattaaggtgaagcagagtcaggaacaacgaatccctttatga

SEQ ID NO: 63538 - DNA, 595 bp, Glycine max
  Peptide Sequence Number=SeqID_180316
atgggtctatttgcaaagatgaaagggaagcggataggattcaagggtccccaggcagttggacagaccatacgtaacaatcttccacagtctgaaacgatagaatcttgctctgtagctggtcctgggtttgtgaatattgtctcgtggaagaagtggatagcacagaacattgcgtacacgaagtgtggacctgggaataatttcttcctaaacctatcaattactccaaggattgatttgattttcttttgttctccaaacaatccaattggtagtgctgcatctaagcaacaacttgagcaacttgtcaagtttgcaaaagcaaatggatctatcatcatttatgacgctgcttatgctgcttacatatcagatgaatgccctagatcaagttttgaaattcctggagccaaagagggggtgacaattgaaatttcaacattctcaaaatttgctggttttattggggttcggcttgggtggacagttgcccctgaagagttgttgtatgctaatggttatcctatcataaaggattatgatcgcattgtttgcacatgcttcaatggtgcatctaatattgttcaagctg

SEQ ID NO: 63539 - DNA, 423 bp, Glycine max
  Peptide Sequence Number=SeqID_180317
atgaaaagagacataaaaagagaaaatgatctggaagcagagaagagtgagagagggagaagatatagaaacgggagtgcgataatggcaagtgtgaaggtttcttttaacttccaaaatagccttaaccctaacgaagactgttgccagtggtcgttgacatggactaatattcagacccacattgagagggacaaacaaacacagagcacaaaacaacctcaacacatggaaattaacaaaaatctaaaatacgaggtacctaaagaggtggatttgatggaatcaagattaggcactgcaattggagattatagcaaaacaaaggtggctcgggaaggcacaaagaggaagaagaagacacaaacgtggattgaaccattgccacacaaaggagaagaagaagaatcgaagcggccatga

SEQ ID NO: 63540 - DNA, 492 bp, Glycine max
  Peptide Sequence Number=SeqID_180318
atgactctcaaggagatggttcagaaaccctttgacctgtcaaaactgagaggctcatttgtcacttctgtctatgttctcttcttgacaactactcaccagcttggattacgcgtggcattcgctaaggtcctaagaatgtatttggagtggagtgctatgtggaacatgagtcttgtcatctcggtgttggaggggatatacggtgttgatgcatttagcagttcgacttatttcagcagaggatgtcacaggagggggctctttttgatgatgattttctttgcttggggacatcttttgaggcttccatgctaccatgttggaggctatgagcaagggaatgcaatttttgtacaagttggcttgttttgcatggtaaatccgctgaaatgggtggcctgcatgatctatttccatgattgcaaggagaggaagttgaaaaagaaaactgatgaggaatcaggcatagatgttaagaatggtttgtga

SEQ ID NO: 63541 - DNA, 312 bp, Glycine max
  Peptide Sequence Number=SeqID_180319
atgagacgattgagggggcatgaagcagagaagcaggcaagacgtagtaagtggcaaaatggtgctgttttggccggtaatcacacctcaaaacaaagaaacgtgaacattttaggcacctttaatgcaaaaatatatcaaaattaccatagtggattaggaagactgaagcaaccttcaggtttcagtaagctgaagagagacagccaatgcaaaacagtgtccaacgcacccttttgccagctacaaccctatgtagttccatcaaaagccaagttcttaacaatacccattgtcatgacatcaacataa

SEQ ID NO: 63542 - DNA, 561 bp, Glycine max
  Peptide Sequence Number=SeqID_180320
atgtctcgtgtttatgttgggaatttagaccctcgagtcagtgagagggacctcgaagatgaatttcgtatatatggtgttcttaggagtgtctgggttgctcgaagaccaccgggatatgcatttattgagtttgatgataggagggatgcacttgatgcaattcaggccttggatggaaaaaatggttggcgtgtagagctttctcataattccaagggtggtggccgaggagggcgtgggcgtggaggtgaagacacaaaatgctatgaatgtggtgaacctggacactttgctcgggagtgccgattgcgcattggatcacgtggccttggaagtggaaggaggcgaagtccaagtccttatcggcgtcgtagaagtccgagttatggttatgatcgcagtagttatagccctcgtgggagaagatctccaagacgacgtagcatttcacctccctggggtcgcaactacagcaggtcccctccatatcgtcctcgccgtgattcaccttatgccaatgcgtatgtttatgttcaactcagttgttctttactctga

SEQ ID NO: 63543 - DNA, 1173 bp, Glycine max
  Peptide Sequence Number=SeqID_180321
gtaggtgtagcggttcaacagcacatcgacgttcacgcgctcggtgacatccacgccgtagccgatcaggtaatcgacctcggtcttcgggtcacccgcaccaaagtccacacccgagccccacacgccggcatacaggccaaccgggctggtgtaggtgaaaccggcctgcagggtcggatcctcgtcggtctgcgacacaccacggaacaggcggggagcaggcgtagcggccggagcgggacagctccggttcacgaatttttaaccagtttgctattgcgatgcaacatgtgccggccgtggcgatgccccagccgggccggtcggcacgcggcgatgcccggtagaatcagcggtttccccgttcagagccgtgcccacgccatgaccgacgcttcctccgccctgacccgccactacgccgaggaactggacgccatccgcgcccagggcctgttcaagtccgaacggatcatcaccagcccgcagtcggccgagatcaccctcgaggacggccgcaaggtgctgaacttctgtgccaacaactacctcggcctggccgaccatccggacctgatccaggccgccaaggatgcgctggatacccacggcttcggcatggcctcggtgcgcttcatctgcggtacccaggacctgcacaagcagctggagaagcagatcgccgacttcttcggcaagcaggacaccatcctgtatgcggcctgcttcgacgccaacggcggcctgttcgaaccgctgctcggcgagaacgacgcgatcatttccgatgcgctgaaccatgcttcgatcatcgacggcgtgcgcctgtgcaaggccaagcgcttccgctacgccaactgcgacatggccgacctggaagcgcagctgcaggccgccgatgccgccggctgcaagaccaagctgatcaccaccgacggcgtgttctcgatggacggcttcatcgcgccgctggacgaaatcaccgcactggcgaagaagtacaacgcgctggtgcacatcgatgagtgccacgccaccggcttcctcggtgccaccggccgcggttcggccgaggtcaagggcgtgctggagaagatcgacatcatcaccggcaccctgggcaaggccatgggcggcgcactgggcggcttcacctgcgccagcgccgag

SEQ ID NO: 63544 - DNA, 717 bp, Glycine max
  Peptide Sequence Number=SeqID_180322
atggttcatggcccatgtggaatttcaagagttgaatctccatgcatgaaagaaggcaagtgcaatcatttctatcctaaaatgttccaatcgcatactgttttagatgcaaatggttatccagtctattgtaggagaaacaatggtcacacaattgagaaaaatggtgttataattgataacagcagaaaacttgttgaaagattacagttccatcttccatgccaacatagtgttgtctatgaaggccatgatgatattgatgatgtgttgtctaagccaagtatctctgattcaaagtttttttcatggatgaacaccaaccaaaattctgttgaaggaagaagtcttacttatgcagaatttgtttctaagtttgtatatagtaagaagaaaagatgttggcaccttaggaagaaaggctacaccattggaagattactatgggtcccaccaattataggtgaactattttacttaaggatgatgcttactgtttgcaaaggacctacctcatttgaggatttaagaacagttggtaatgttcagtatcctacatatagagaagcatgttttgctatgggttttttgcaagatgataaagaattcattgaggcaatcaaagaagcaaaagactggggctcaacacattatataaggaagctatttgtgttgtttcttttaactgcaacaatgaacaaacctaaacaagtttag

SEQ ID NO: 63545 - DNA, 228 bp, Glycine max
  Peptide Sequence Number=SeqID_180323
atgaattcttttcaaaagaatgtgtgggatgaaatggctctgaaaaagctttccgcgaagaggtgtaggagagatgtcgcggctgaagggaccagtgccgcccacgagtttgatagccaccgtttccggagcgccgagcaccagcagcgctttgaggccatcaaaggatggtcgttccacagagagaggcgcgtccagctcagggaggatgagtacacaaatttttag

SEQ ID NO: 63546 - DNA, 249 bp, Glycine max
  Peptide Sequence Number=SeqID_180324
atgggggagatgcttgccacccagctcacccaggcgagcaaggtgacttcctccagaagcaaccgccttctggaggaatcttctggagggcccaaaacctcacgaattgtgcaacgatgcttccttttgagttccggcatgtcacggaacttcacgaattgtgcaacgatgcttccttttgagttacgacatgtcacggaacttcacaaattgcctgatgatgggtgccaagtacctcaaaatggttaa

SEQ ID NO: 63547 - DNA, 240 bp, Glycine max
  Peptide Sequence Number=SeqID_180325
atgaagaacggcgaagaacattcacggaattggtcacgaaaatgttacgaaagcgttacggaagggaggagcttgccgcccaactcgcccaggagagttcagctcgcccaagcgagctggtggcttagttcagaagcaaccttgctcgcccaggcgagctggttgcttctcccctatattatccagtgggcccaggggctgaggaatgttccagaatggaccattttgtccctaccttga

SEQ ID NO: 63548 - DNA, 294 bp, Glycine max
  Peptide Sequence Number=SeqID_180326
atgaagcctcttttttgggagacctttctgttctttcttccgagggtttatggccgaagggttgacgtgttggctcaaaaaggcttgaggaaggcaagacatgacgtatgtcaaggtatttgctcggcaagcggttcagggatatgggaattgatgcaatcctaccccgcaagggcattggatagaagactccaggaggtgagcttagctattagagagcttcttaaggaagttttctcaaagaagcttctcaaggaagttttctcaagaaagcttctcaaggaagctacctag

SEQ ID NO: 63549 - DNA, 143 bp, Glycine max
  Peptide Sequence Number=SeqID_180327
aaaatagagtagatgatcatggagatgacaaggaagggggaagtggtgctgtgggtgctccaaatggtccgtggtgtcgatgggcagcagcggcggaggaagtggatgagccctttcgctttttcgatgattcagccatttga

SEQ ID NO: 63550 - DNA, 135 bp, Glycine max
  Peptide Sequence Number=SeqID_180328
atggagaaagaggcacgtcaaggggagtgtggctacacagcgctactggtttacgtggctatttatagaagatggcgttatgtaattgattacaaggatgctgtaatcgattacaggctatctgttcttgtgtaa

SEQ ID NO: 63551 - DNA, 519 bp, Glycine max
  Peptide Sequence Number=SeqID_180329
atgtttccatggctagccttcggacacttaatcccaagccttgaacttgccaagctcattgttcaaaagggtcatcatattagtttcgtgtccaccccaagaaacatagagtgtcttcccaaattgtccccaaacttagcttcattcatcaaatttgtgaagcttacactgcccaaagtggacaaccttccagaaaacgttgaagccaccattgatgtcccttatgatgtcgttcagtatctcaaaaaagcctatgatgatttggaagaacccttgacctgttttctcaaatcttccaaagttgattggcatttctatgacctaattctcttctgggcaagtactttggcttctaaacttggtataaagagttccttttacaacatctgtacttcaccatgtgtgggcttcatcgtacccccttcagttctcatgggtgatgatcccgtcagagcaaaaatcaaagacttcatagttcctccgtcatggatctctttttcgacaattgtggcatattga

SEQ ID NO: 63552 - DNA, 243 bp, Glycine max
  Peptide Sequence Number=SeqID_180330
atgagtcaatcaagaccaaatgaggatgagcctatagatgcaacaccgatatccttttgcgtttcttacgactatgatgttaattgtggtgatgtggttggcaatccaacaaatttgaatgaaactccatctctgacacaaagttcacggccaaagagaggaagacgttccaaactactacctgatgaatggatgaaaaattgggaagttgaaagatttgataaggtacataatccaatttaa

SEQ ID NO: 63553 - DNA, 240 bp, Glycine max
  Peptide Sequence Number=SeqID_180331
atggtaatcgattacatgttgaaaattcaaattcaaaacctttttcaacaactatttctcaaccctgtcctctgcaaatgcttatcctttgaagcagccttgttagattcttctttgacatcatcaaaatcatgttctatgagctataaagttgttgctgaatgtgctaatgtaatgaatgaaatggtttcagatgaaggtgaaatgatgggtgctggtgtcactaatttggaagaatga

SEQ ID NO: 63554 - DNA, 270 bp, Glycine max
  Peptide Sequence Number=SeqID_180332
atggtgtggaatagtaagccccggttgggcaccatagatgaagactatggattgaactcgagggtgtgggaagtgaagaagatggggtattcaattcctaaggacgaacgagatggatcattcacgagtgatgcggtcgctaacttaataaggttggttatggttgaggaagaaggaaggatttacagggaaaaggttaaaaaggtgaaggatttatgtctgaatacttttagacaagaaaaatatatcaacaaattacaacactactag

SEQ ID NO: 63555 - DNA, 264 bp, Glycine max
  Peptide Sequence Number=SeqID_180333
atggaggttgagagatacgagaatgaaggaattcgtattcgacgtcaaaaagtaaagacacaagacaaagaagaaagcaaccgcaaaaccaaagaagaaacaaaagaatttattgtagctcaagagaaaaataaagaagcaaaagctgaagtgagaaatatgctaggtgctcaaggaaaaagtgaagcaaaagatatgagagtcattgttgaagagtttctttctaaagctcattacaagcagcttcacatgttcaacccatga

SEQ ID NO: 63556 - DNA, 333 bp, Glycine max
  Peptide Sequence Number=SeqID_180334
atggtagtggatgaaggaatggttagacaatcaagaatgtcgcagtgtgttgtatgtggtgtttggaagcaaagcgaaacaaagtcaagattaagtcacagaaatagctctaggtttcgagaaatcaaaacttccatttttttggctgttcaaaatgagaaacctgtatttctatttatgtttcttgaagaccaaggattgaacacaaaactgttggaagagaagaagatgaggtatttgattcctagggatgaactagatggatctctcacgagtgatgcggtcatagactcaataaggctggttatggatgaggatgaagaaaggatctaa

SEQ ID NO: 63557 - DNA, 669 bp, Glycine max
  Peptide Sequence Number=SeqID_180335
atgtttccatggctagccttcggacacttaatcccaagccttgaacttgctaagctcattgctcaaaagggtcatcatattagtttcgtgtccaccccaagaaacatagagtgtcttcccaaattgtccccaaacttggcttcattcatcaaatttgtgaagcttgcactgcccaaagtggacaatcttctagaaaacgttgaagccaccattgatgtcccttatgatgtcgttcagtatctcaaaaaagcctacgatgatttggaagaacccttgacctgttttctcaaatcttccaaagttgattggcatttctatgacctaattctcttctggaactgtgatattgtagggattaaaaggtgtacagagttcaaaccaaagtggtttgaagtgctagagaacatttaccggaaattggttatccccgtattgagccacaaggcagttggtggggttttgactcactctggttggacctctgtggtggagatggggtattcaattcctaaggacgaacgagatggatcattcacgagtgatgcggtcgctaacttaataaggttggttatggttgaggaagaaggaaggatttacagggaaaaggcatggcaacgggaagaaacggggacgggtaatgcatttcccaccccgccctgcccccgctag

SEQ ID NO: 63558 - DNA, 210 bp, Glycine max
  Peptide Sequence Number=SeqID_180336
atggaccctaatcacgttgcttctcaacttcctctagaaattactgttagtggtccaactcacggaaaaatcctagctcagtggctagtaggagttcaccaggggacacgaagagctgcacccaccagtctggggagcagctgtcatatccatcacgcaacggaggtgctcgacggcgcagagggcctaagtcatgccttgcacggttga

SEQ ID NO: 63559 - DNA, 282 bp, Glycine max
  Peptide Sequence Number=SeqID_180337
ggagaaggtgcaaacacattaaatgcaaaagcaaaaaccttagaagagggggagagtaagccgactcctaatgttgatggattggagtttgtggctgttcaaaatgagaaacctgaatttctattaatgtttcttgaagaccaaggattgaacacaaaactgttggaagagaagaagatgagatatttgattcctagggatgaactagatggatctctcacgagtgatgcagtcatagactcaataaggctggttatggatgaggatgaagaaaggatctaa

SEQ ID NO: 63560 - DNA, 495 bp, Glycine max
  Peptide Sequence Number=SeqID_180338
atggcaacaacacaaaaatctgcatgtgcaatcaagtggagagccaccgtcttgatcgtagctaccaatcaagggattgggtgtggcttccactctagtcgtatcgtcagaccacagtttgggatcatggttatgagaaactttcaaagcaatacttttcggctggagggtttttcgtcttcagagtcaacatgggaagacgagactttcattaagacttatcctacttttaaccttatggaaaaggttgttttaggtggggagggtaatgatatgttgttaagggaaacattaagcccaaatgaggtaatggaggacaatgctcattgtggaccagtcaatgaaactaattcttacccttggagtccttcctacttagaaggagaatctttatcccaattcactatacaattggtgctttcattagtcactgtgcctccctctaaagttaaggacctcttgaaacaatgtctcactcagatgaaggacctatag

SEQ ID NO: 63561 - DNA, 925 bp, Glycine max
  Peptide Sequence Number=SeqID_180339
atggtacttatggttgaggcagaggtcgtggaagccatacatctagtggaagaggtagaggcagaagcacacaaatgtgcacttattataacagatcaggtatatgcagatgcatcatctgtagctttcacactagagcaatataaggctcttctttccttgttgcagcaaacctctcaagcctcttcctctcacaccactaataagttagttagttctcgtaagaatggtaattcagtcaagttcaaagctgatggatccattgacaagcacaaggctacattagtagccaagggttttacacaaactgctggtctggactacattgaaaccttcagtcctgctgtgaaaatgaccacagtcagacttgtgttatcactagctgcttctcagggttggcatctccatcaacttgatgtcaacactgcctttttgcatggtgatttgaatgaggaggtatatatgaaggttccaccaggcttgacagttgacaatccaactctagtttgcaagttgcagagatctttgtatggcttaaagcaagccagcatacaatggaatgccaagcttacttctaccttacttgattcaggatttcaacaatccaatgtagattattctcttttcactaaaaggtctcccactggtctcactattatccttgtttatgttgatgatttggtgcttactggcactgatcttgctaaaatccaacaattgaaccactccttggatgcaaaatttagcattaaagaccttggaatgcttaagtacttccttggttttgaagtagcccgatccaactcagatattgccttgtatcaaagaaaatattgccttaatctcttacaagacactggtctgcttgttgccaaaccctgttccacacctatggatcccatactgaaacttcacaaatcctctg

SEQ ID NO: 63562 - DNA, 309 bp, Glycine max
  Peptide Sequence Number=SeqID_180340
atggctgaaaatgctgacccaattgtgaacaatgctattgtcaataatgcagctcttacaaacttgttgaatccctattatactcatccaaatgagaatcccgatgtggcgattgttgctcaggttctcagtggtggaaattaccactcatggtcgcgtgctatgctccttgctttgaagaccaagaaaaaggtcaaatttgtggatggttctttgcctcgtcctgctcttaatgatcccaatttcactctatgggatcattgtaataccttggtggtttcatggcttcatcattctcttgatccataa

SEQ ID NO: 63563 - DNA, 192 bp, Glycine max
  Peptide Sequence Number=SeqID_180341
atgatgagaatgataattataaaccatcaaaatctaatcgaagaaagaaatggacgaagcgttgaaactgtcatgtgcgaaggacacgaaggagaggatcacgggtgtggagtgcctccactgacttctagaagcatccagaaagagcctatcttcttccgaaacatccatatgacctttatcctctgttga

SEQ ID NO: 63564 - DNA, 690 bp, Glycine max
  Peptide Sequence Number=SeqID_180342
agatctttgtatggcttaaagcaagctagcagacaatggaatgtcaagctgacttctaccttacttgattcaggattccaacaatccaaggcagattattctcttttcactaaaaggtctcccactggcctcactgttatccttgtttatgttgattatttggtgcttactggctctgatcttgttgaaatccaacaattgaagcactccttggatgcaaaattcagcattaaagaccttggaatgctcaagtacatccttggttttgaagtagcccgatccaactcaggtacctccctaatatcatggatgagtaagaaacaatccattgtgtctagatcatcctcggaagctgaatatagggctctagctcaagcatcttgtgaagcacaatggttactgttcttattaaaggatcttcatattgagcatcctaaaccagttgttctatattatgataatcaagctgccctgcacatagcagcaaaccctgtattccatgaacgcacaaaacatatagaaatggattgtcatgtggtgagagataaagttcaatccggtatgatccaccttcttcccatctcaactcaagagcaattggcagatatactcaccaaatctttacatgttggtcccttcaaccttattcattccaagttaggaatgcttgacattcacattccagcttga

SEQ ID NO: 63565 - DNA, 402 bp, Glycine max
  Peptide Sequence Number=SeqID_180343
atggaaatggaagtagctttggcatctggatcaggccctcacatagagatagtaagacaagctcagctgggcattgaccttctaaacctgagaactgtggacgctcatggtttgccccttcagcccgatgggctgcatctttcaaccccggcccaggctcatcttgggcagatgatggctaatgcattccttcagttcgtaccctcttcaaataagaacaaaggagagggaaaaagggtgatcataagaaaaacggaggagaaaggggggagggtaacaaaggaggaggatgctactagaacgaagaaggacatgggagacgcagtaacagaagcagtggaggagaatgttttcactgtgcggaggtggtttggggtgggtgatggtcgtagaggttggtaa

SEQ ID NO: 63566 - DNA, 465 bp, Glycine max
  Peptide Sequence Number=SeqID_180344
atgagactaaacataaggtctgaaatagggcttataactagctgtaaatgttcacagaacacttgcaatgacattgaatacttgcaaaatttcatactgaaagagagtaagaaactgaagagaggaagaaagaggtatatcatgaattcaattattacagtgttgtatttcaacggaagagtatatgaagacaatgatggtgtaatatttgaaggcagtaaaaaggccattcagattaaacgcggaattagtttcaatgctttgaaaaaaaaattggagataagatttttagtttcaggaaaatatgttgcgttgcaaatttgtgatgacgaagatgttgaaactatgatcgaaagttttcaacaacaacaacaaatgtcagttctagagttgtacgtagaaaaggatgttgctggtggttctatgtttcatgctgcaaattctgttacgtcatgtggacgtaat

SEQ ID NO: 63567 - DNA, 1101 bp, Glycine max
  Peptide Sequence Number=SeqID_180345
atgggttctaactatgaagagattcttcctcttccaaaatgttcacctcatgatgaagacaatgcatgcctatctgctatgcaacttagctttagcccaatggtttatactgctgtgttgaatgctgctattgagctcaacttgtttgagatcatagcaaaggcaaacccaccaggcatgtcagcctctgaggttgcttctaaacttccaactcagcacaaaaatttacctaaaaggcttgatcgcatgctgtgtctacttgccagtcattctcttcttacctgttctacaagcacaaaggaagatggtggggttgaaagactctatgaactttcacctgttggcaagtactttgtcaatgatgaaaccactggctctttggccttgttttcaacgtttatgaatcatggaacgctcgttgacgcattccttaatttcaaggagatacttcttgactgtgataatggcctatacattaaagttcatggaatgcccatttatcaaggcatacaatctgatccagcgtgggatcatacttttaataaagcaatggccaatatatgcacaagagagatgacaaagatacttgaaatatatactggattcgaaggaatatcattgttaattgatgtgggaggtggagttgggcagtgcttgaatatgataatctacaagtatccttcaataaagggtgttaattttgatcttccacaagtaatacaacaagctccaacttatccagggattgagcattttgaaggagatatgttcgaaagtgttccaaagggtgatgccatactattgaagggcatattgcacaattggtccgatgaaaattgtttgaaaattctaaataattgctacaaagctttgccagaaaacggtaagttggttgttgtagacttcataatgcccgaagcagttcagtctactgaagcagataagatggttactagctttgacaatcttatgtttcttgacggaggaagcgaaagaaccgagaaagaatttttgaatttatgcaaatgttctgatttttctagtttccaagttgtttgtcgtgcctttactgctttgggagtgatggaattttataaataa

SEQ ID NO: 63568 - DNA, 180 bp, Glycine max
  Peptide Sequence Number=SeqID_180346
atggcggtgaaggaggtggtgatgacggtgatagtgttggtgacagggacgatgccgatgttggtggtgataacaacgacaatggagaattttggtgatggtggatgtgacaaaggtaatggtaatgacgacgacaatgatggtagtggttgtagtggtggtagtgagagtgttttttaa

SEQ ID NO: 63569 - DNA, 219 bp, Glycine max
  Peptide Sequence Number=SeqID_180347
atggcgagcctaagcgagagtttcttgtgcaccgaaatcgaagaatcaaactgcgttgaactcataatccaagttaatctcgtgagaaatgaacacctgtgcctctacatcttcattggcacctccatggggatctccacgacgatggaggcacgaacagagagagagagagtgcgaggaggagaattggatctgagaggagtgtggactgcattgtga

SEQ ID NO: 63570 - DNA, 753 bp, Glycine max
  Peptide Sequence Number=SeqID_180348
atgtttataggagattcagtcagtctcaaccaatggcaatcacttatatgcttgcttcgttcttctgtgcctcaaactgaaatattagagcagggcgatgtgaacgtatctaactacacattccaggactatggagtttcggttattatttttcattctacatatttggttgacattgaagaggaaaaaattggtcgagtcttgaagcttgattcccttcagagtggaagcatatggaaagaaatggacattttggttttcaacacttggctttggtggtaccgcagaggacccaagcaaccatgggattatgttcaaataggtgacaagatactcaaagacatggatcgcatggaagcttttaaacttggtttgacaacatgggctaattgggtcaatgcagaggtagatacaaacaaaaccaaagttcttttccaaggaatttctccttcccattacaatggcatggagtggaatgagccaggagtacgaaactgttcaaaggagccacagccaataagtggatcaacttaccctagtggattgccagcagcattatttgtattggaagatgtgctgaagaacataaccaaacctgttcatctgcttaacattacaactctgtcacagttgagaaaagatgcacatcctagttcttacaatggctttagaggcatggactgcactcattggtgcgtagcagggctgccagatacatggaatcagctgttgtatgcagcagtcacttgttag

SEQ ID NO: 63571 - DNA, 321 bp, Glycine max
  Peptide Sequence Number=SeqID_180349
atgaggatgcatccttgggtttttggggtcatttgtctctgccaattgctctgtgtggtgaatactggtggaggagggcatgttaagtccaatttcaaatggcaaagatcacaagaagaacaagaacatgaattgagttgcaacatgtacgaaggaaggtgggagttggatgattcttaccctctctatgactcttcaacctgccctcacattcgtaaggaatttgattgcttgaaatatggtcgtcctgatcaacaatacctcaaatacagatggcaacccaacgaatgcgacttaccaatgtacgaattcacttcttaa

SEQ ID NO: 63572 - DNA, 156 bp, Glycine max
  Peptide Sequence Number=SeqID_180350
atggttctacccaatgagaaaagcataaaagccgaagttgcaacaagaaatatgctagttgctcaaggaaaaagtgaagcaaaatatatgagagtcattgttgaagagtttctttctaaagctcattacaagcaacttcacatgttcaacccatga

SEQ ID NO: 63573 - DNA, 378 bp, Glycine max
  Peptide Sequence Number=SeqID_180351
atggcaacaacacaaaaatttgcatgtgcaatcaagtggatagccaccgtcttgatcgtagctaccaatcaagggattgggtgtggcttccactctagtcgtatcgtcagaccacagtttgggatcatggttatgagtaactttcaaagcaatacttttcggctggagggtttttcgtcttcagagtcaacatgggaagatgagactttcattaagacttatcctacttttaaccttgtggaaaaggttgttttaggtggggagggtaatgatatgttgttaagggaaacattaagcccaaataaggtaatggaggacaatgctcattatggaccagtcaatgaaagtgagtccataatagaaatgcctcaaagatga

SEQ ID NO: 63574 - DNA, 192 bp, Glycine max
  Peptide Sequence Number=SeqID_180352
ggagaaggtgcaaatacattaaatgcaaaagcaaaaaccttagaagagggggagagtaagccgactcctaatgttgatggattggagtttgtgctggtcaacactaggtttgagggcgacaaggataatgtgacatggcagtggatgaaggagtggttagacaatcaagaatgtgggagtgtgttgtatgtg

SEQ ID NO: 63575 - DNA, 438 bp, Glycine max
  Peptide Sequence Number=SeqID_180353
atggatattggtgtgagtggaaatagtgctcttgctattggtattggtggggttttgggtagtgaagggaggcctacaatgtgcatatattgtttgcataggcatttttcccattatggttttcattcaatgcttgcactggacaagatgacacaagaaatgagtcaaagtgacaactttacaaaaatttcagctaatgatatcgtgggtaaggtaatgggaaaggatcatactgggcatgtgcattgtttaggactaggaggtcttcgcagtgttgcatttcggtccaccacaagctatagtggtggagggtctagtttttcaaattctgattcagccgagaactctagattgaaagaggaggatgaaggaagtggacaagacgggccaacaccaagaggaggatcatcgttagatagtatttttcatgcaacttga

SEQ ID NO: 63576 - DNA, 174 bp, Glycine max
  Peptide Sequence Number=SeqID_180354
atggcggggatttgcgaaaatgagtttctaacccagtgttcgaatgtaatgatgatccaacggttaacgattctaggatcgcaattttactggcataggaggttatacattttggtgactagatcatccttgaagaaccaattgaaaggtagacttcctttatgtggtgattaa

SEQ ID NO: 63577 - DNA, 591 bp, Glycine max
  Peptide Sequence Number=SeqID_180355
atggcagtcagtgaccatgccatactttgtgatagggctcacacacctgcaaagaggattctcttggagcttacattgcaggatgccttgttggcacagaataattttttggccaagcaacttgagaccctcacaaaaaccttgaataaaattttgcaacaattgcatgcagttcaacctgctccttcagcgatcatgcaagtcgaggggtgtagtatacgtggaggaactcatgagttgggtgcttgcatgaatcatgatgacacctccaaggaaggccaaggctggaggacccaccctaggaatcagttcaacaaggaccaatggggtccatccaatcggcctcctaaccaagggcctaacttgtatgagcagaccaccaagttgaaggacacattgactcaatttatgcaggtatctatgtccaaccataaaatcatggagtccacaattaaaaaactagagattcaagtggggcaattggccaagcagctagctaaaaaatccactgggaatttcgtggcaaatactgagaaaaacccaaaggaggagtgtaaagcagtagtcactaggagtcaggatagagattga

SEQ ID NO: 63578 - DNA, 318 bp, Glycine max
  Peptide Sequence Number=SeqID_180356
atgatgctctcctacaacctaagaaaaggtagatggagattacaattcaacaggcttaaggttcaactcaatcaaacatattcaagctcaaaatgggtgcaatgggataactcattcatgaacaaggcctccactaatggtgtagcaacaggtgaagtctatgaagtggcctctggtgtgacctctggtgtaggttatgcctctggttgtggctcctgggctataggagcctcacctccccctagaggagaaggctggactcctggccagaccacctgggccataaatgcctccatgctcatgatgggtcaatgttga

SEQ ID NO: 63579 - DNA, 486 bp, Glycine max
  Peptide Sequence Number=SeqID_180357
cttgtgctgtttgaatgttgtattactttgatgttgggaaagcttgggaggattgatggggacccggtgttgagagaaacgaggatatgggctacgtgggagtacgtgagcttagttggaggtgggcaacaggggatgggtgaaacttcctacttttattcgttgaccacagagtggtacctagagatatgtcgcgggggtcaggagaccttggtgacgtcaggtggggtgctattgcccaaaaccaagcttgaccaatcccgacccaacccgggcatagtcgttttgtgtgatatatgggttgtggtctctggtaatcgattaccaagggaagctaagggagcctctggtaatcgattaccagtctgtgtaatcgattacacagaggaatgggtcactggtaatcgattaccagagatgaaaagccttaagataccccttttaattgcatgtagtggttatgagacgcattgtgcggcggcatag

SEQ ID NO: 63580 - DNA, 207 bp, Glycine max
  Peptide Sequence Number=SeqID_180358
atggtctatggaaaaacttgtcatctacttgtggagctagagcacaaagcttattgggccatgaaatttttaaattttaatcctacacttgttagtgagaagaagcttcaaatagcagaattagaagaaatgtgcctcaatgcttatacttcttccaagcattataaggagaaaacaaaggcatatcatgacaaaaagctagtgtag

SEQ ID NO: 63581 - DNA, 801 bp, Glycine max
  Peptide Sequence Number=SeqID_180359
atggcacgcagagacaaatatggtcatctgccccctttgttgaagactccaatgtctttcgaccgagactattttagtctccctttgccttttagagccaagcgagcccgtctgcacgtggagacaaattatggtcatccgcatcctttttgctatccagagacaatcaaatttgatggcacgcagagacaaattatggtcattcgcaccctttttgctatccagagacaatcaagtccaatggcacgcgaagacaaattatggtcattcgcaccctttaccatccagagacaatcaagtctgaaggcatgcggagaccgtcatgacaataattgcttcaatcattgcatgctttcaaaaggcaacaatgaccctcatttacatttcgaagacgacaatgtcttcagtcattacatgctttcaaaaggcaacaatgaccttcatttacatttcgaagacgacaatgtcttcagtcattgcatgctttcaaaaggcaacaatgaccctcgtttatatttcaaagacgacattgtcttcagtcattgcatgctttcaaaaggcgacaatgaccttcatttacatttcaaagatgacaatgtcttcagtcattgcattcttacaaaaggtgacaatgaccttcatttgcatccgcacccactgtcatccagagacaatcaaaccactggctcacctaggcaagcctctggctcgcctgggccaccaaaattacttcatggtgaagtaaccagctcgcctgggcgagctaccttcatcctaaatgccttgttttgctataaatag

SEQ ID NO: 63582 - DNA, 270 bp, Glycine max
  Peptide Sequence Number=SeqID_180360
atggcaataatcataattgcaagtttgcaacttagccacaaggcaaggcaaggcaaagtggcgtggagcacgacagtggagcggaggagggtggtggtggggacagagaagaagagctttttgaggtcgtggaagctgaggtcgtcaacgggaggaagcacgatggagatcggcaagggagctgggatgcagagagaaggagagagaggagggtatgccaccttggatagtttacgtggcattgtaattgccaacaatgcacctcactaa

SEQ ID NO: 63583 - DNA, 892 bp, Glycine max
  Peptide Sequence Number=SeqID_180361
atggagatgtacatcaagtccactcaatatagaatctggcttatcatcaccactggggatatttgcattctcagacttgaagctgaatggacaaatgacgatttgaccattataaagatcaacacaaaagccagatatactctgacatggactgaagatgtcaaactaaggatagctacgactttgactaggcattatgacagcttcaacatgaaagataaagagtctatggatgacatggtcgatgaagtccaccttcaaaatagggagcatctacaaataaagaattctactgcccttaagtctgaagagacaagcttcataagaaaagagaagaagaggttgtccaaagctctaaaagtgaaaatgcaagaatctgatggatcagaaaactctaacaaatccatagatgatgaagtagccctcataaagcttggacacaagaaggttgaatgtcctcatctaaagaagaagaaatattctagggataagaaaaagaaaagtatgatggtcacttgggataactcaaacagtgagaagagtagcaattcagataatgaagaagccaagatttgtctcatggcagatacagaggatgagtgtaaaaagtttgatgaaaaattcaaagtttctgcttctgaaaatactgatttaaagaaatcaaataaagatctgaagaagaaaaatgcaaactctagaagagagtttgagcctggccaggaagaagtagcatgttttactaatgactttgggaagctcttggaaatttcaaagacttccaccactcttttgaaattccatcaacatccccatgacaagtctggtctgggttttgaaaaaggaacagcattctccaagtcacagtttgtttcagacaaatgtgacttatgtg

SEQ ID NO: 63584 - DNA, 804 bp, Glycine max
  Peptide Sequence Number=SeqID_180362
atggcaaataacaacaacaatggtcaattcatttttgagggagcatccctcatgaggccaccgggctttataggagaggactatccttactggaaggacataatggagatcttttccatgaaggaaaaagagtttgtggaagatatgtttggaagactacaagtccttataaacaatccaaaagatcttggtcaaacatataccaaagcccagataaacttgaaggttttggacaattttcccaaggtgtgggaacctaagaccacaattatccaagaaggcatagacttaaagaatctttcccaggatgagctacaagaaaataagagctcttccaaagctcttaaagtgcaaatggctgagtttgatggatcagataactctaaagagtctatagatgatgaggtgactctcatgtccaaggtgttcaaacaaatgatgaagaagaaaggaaaattccaacactcctccagaagaaaggtcacaaggttcaaaaagaaatacaagatacaaaacaatgaaatcatttgttttgaatgcaaaaagctcaaacatatgaaggctaagtgtctccagctaaagaaaaggagatactttgatgacaataaaaagaagagtttgatggtcacttgggacaacttagacagtgagaacagtagcagttcaaatgatgagaaagctagcatatgtctgatggctaacacagatgagaaggtagaggtaaaaacttgctttgaatgtgatacctcttccaatgtttcatcagatgatgaagaggatatgtcctatgatgttcttctttag

SEQ ID NO: 63585 - DNA, 1216 bp, Glycine max
  Peptide Sequence Number=SeqID_180363
attgatcttgaggaggatttgaaaaaatccttagatgatgctgaaattggaatagatgccaccaaagaaagatttctccaagaacaaaaagaaggagattcagatgaagatcaccaatctattgtctggtctcatgaagaaatgagcattggaagttactgcagtgatggggaacaagacatagcggatgttgacatgtataattctgattccaaaacctatgacatggagtgggaggaggagcggttgcacgaattcgaacaagatgaggatgctgattcttctgtgtacacagaggaggacaactcaaaagttgagtcctcatcagggagttctcatgatgtatcagtgacatggttagatgatatccttggtggctattatgaggactttcttgttgatgaaacacacaaagaagcaaattcagaagaaagaacctactttgaagaacaacctagtggcactagttcttctgtccttgaagacacaaatggaagcactgaaactcaagaaaacctgacgaatacacaagataatggtggagaagatgaaaaacataaggatgatgatgaggccagttgcaacacaaagccacttgatgaagagacaattgacaacactcaatgtcagaagatgagtggaacttgcaaaattgaagagacaaatgaaaatggatactcaatcagtctagagaacaatgatgagagcaacaaaggggagagccaaattgagttggaggatgtgtctgaaaaagaaagtaacatagcttctcaagatcaagatttgttggacaaagaccaaggcaaagctaaaaggttccagcaaaacacaagttgcatagatggtaaagaggaaaacacatgcaaaaattggaaagatggtattaggagaaagaagggtgttgaagatgatgatgatgaaatgagaaagttcaacccaaaagagccaaattttctgtcattggttcctgagccaggacaaaagaaggttgacctgaggcatcaaatgatggatgagagaaagaactcagaggattggatgcttgattgtgcactaagacaagttgtgacaaagcttgcaccagctaggaagaagaaagtggcacttctagttgaagcctttgaaatggtattgccagcagcagcaccaaaatgtgaaaccagtgtgagaaacaacaattcttcagcatttggtcattcaggaagaattcaagctt

SEQ ID NO: 63586 - DNA, 240 bp, Glycine max
  Peptide Sequence Number=SeqID_180364
atgagagttatggttttgtcttatgagagtctcttgggtgctagtagtgcaaaaggaaggtttgggatggagtcattggagaagttgtcgctggtagaggaggaggaaaatggtttgatcttccatgtaaaggaggaattagagaatcaagccaatgtttcattatgtttggtagggagattcctcatggaacgaactatcaaaaccaatgtgatgaaggatagaatggcgaggatatga

SEQ ID NO: 63587 - DNA, 1018 bp, Glycine max
  Peptide Sequence Number=SeqID_180365
atggttcaaagaaaagtgcctagcaagcttggtatccaagctgaacatgttaaatcagacaagaggttgtcaaacctgaagctactatcttcatctcatcaccaagatggaaaaaatagaggggctgatatgaagaagaaaatgaaaaaatcaaggtcaataaagctttccgatcttgaggctcttcaatcatcatcatcatcatcaccttcaaggagaagcttgtctcttcacactccaacaactacaacatcagcatcaccacagaagcaacaacctttgttcagaactgttgatggttcaccaaattacatgaagccaacaagcagttcacatgcaaaaaaggagcttttcctggtaagccaaaggaacactcaacctggttctgattttaagaatcttcctagaaaaatttccagtgattccaaagctgcatgtgttaagaaacctgcaaaagccttgacaagaacatctaatagtttgagtttggtgagaacattgaccaaaaccactagtttcaaggcttctagagcttgttctagaaaatccaccagggctgttatgtgtgctgcaccacagagagctacatgttcttcaactttgaaggactcaaagttccctgcatacctcatgcttagctctgggggaactcagtcagagggaacttcagccatgaaggtttgcccttacacatattgttctcttaatggtcatcaccatgctgatttgccaccgttgaagagcttcgtgtccgcgagaaggcaccttttgaagacgcagaagcgtgtgaagcttgaagctctcagccctcggagactgaaggttccccttgagacacagaaggaggactctgatgttgagccgaatgtctttgatgcaaaacctgcttgtgatgaaattggcattgatattttcattgaaatctatgccaatgaaaaggatgcaaaaccaacagcagcagaaggaatggggagaataattttctcaaagagattgaggatcatgaagataatagcaa

SEQ ID NO: 63588 - DNA, 588 bp, Glycine max
  Peptide Sequence Number=SeqID_180366
atggaactctcgcaatgcttggccacacttggtgagtccattgggtcgttgagtctacttgttgctggcaaaaccgatttggaagacaaccaaaggaagttgaaaatgcaagttaaggagcttaggaaatttgttgtggaagcagaagtggaacctaacttttggtttctaccatttgatatggtggatctcatgtggtttggagaactagcgttgaagttcctccaacaagaattccaacgatgtggagcttgtgagaaagaggatgtgaagatgctagatggtgaagttggacgctttaaggagttgatttgctcttcaatcaaaagtcttgcggagatttctagtacgaactttgttgctaaagaggttgagaagaataacaactcttgtgatctcgaagcaggaaagtcaaatgggggtgagaaggaaatgaagagccaagttgttcttagtttgagtgcggtgggattctccttgtgtgcatgtatacgggggacgatggaaattgaagaagcactcaaggaacttgttcaatgggagaatccctctagtgagattaattcacctgggggaaatggtgggtga

SEQ ID NO: 63589 - DNA, 167 bp, Glycine max
  Peptide Sequence Number=SeqID_180367
acatgtccaagatgtcaagcgatgaggctttagcattagaggaagtacaccacccattgttggaagactactgcgcagatggagaagaaaaagaatattttgttagaagggcttttgctggtcacctaggcgaccttgagttagctgccacttccattgctattaat

SEQ ID NO: 63590 - DNA, 759 bp, Glycine max
  Peptide Sequence Number=SeqID_180368
atggaatgttttcacttttcagaaccccccaaaagctctagcctcaccggtcatcaccagcaccacatattgctagctagcgactcagagatgccaagcaaagaagcttcactgttaggagaagcaaagcttcaccttttagcagatgaaagagaacaagaccaaactctctcacgaaggttttggattgagtcaaagaagctttggcacatattgggtatggcaagcgctttagaaacgctatgcgggcaagcttttggagcgaagaagtactacatgttaggcgtttacatgcagcgttcatggatcgttcttttcatatgttgcatctttcttttgcctttgtacttgtttgcctcgccggtgttgaagttgttggggcagccggaggagttggcggagctatccggcgcggtgtcgatctggatgataccggtgcactttgcctttgcgtttcagttccctctgcagaggttcttgcagtgccagctgaagaccgcgcccatagcgtgggtgtctctggtggcgctcgtggtgcatgtgtttgtaagttggttgttcgtgttcaagcttcagtttggtgttgttggtgctgctgctactattaacttctcttggtgggtcctcactttggggctttttggctacgttgtttggggtgggtgccctcacacttggagtggtttctctgttgaagcgttttctggtctttgggagtttctgaaactctctgctgctgctggagtcatgctatggtaa

SEQ ID NO: 63591 - DNA, 375 bp, Glycine max
  Peptide Sequence Number=SeqID_180369
atggaagatcacgaaagccagagaaaactcagaatcctgtgcctccatggattcaggactagtagtgaaattctcaagcaattagtcttaagatggcctgaacctgtcttacaaaagctgaactttgtattcctcgatggccagtttctcgcacagggaagatctgatgttgaaggcatttttgaccctccttattatgaatggttccaagccaatgaggacttcactgagtataccaactttgaagaatgtttagtatacattgaagattacatgctgaaaaatggtccttttgatggtttattgggtttctctcaggaatattgtcttcagggagcagttttagcagctgcattgctaggattgcaagcacag

SEQ ID NO: 63592 - DNA, 162 bp, Glycine max
  Peptide Sequence Number=SeqID_180370
atggcccttggaaccatggcagctcgcccaggcgagctgatgcttcatcctaaagtaagctggcttgcccagaaacaaaggacgttgagtcctaagaagcacaaagataaggacattgagtcttataaaagacagaagaggttgaagtcttataaagtgtaa

SEQ ID NO: 63593 - DNA, 618 bp, Glycine max
  Peptide Sequence Number=SeqID_180371
atgcaagaggaacttgatcaaattcaaaagaataatgtttggaagctagttgagttactaaaagggaagaaaatcactagaacaaaatggttcttccgtaacaaactagatgaaaatggtaatgttgtgagaaacaaggcaatattagttgccaaagggtactcatggaaaaaagtttattgcaatatgaagttatatcaaaccgatgtaaaaagtgcattcctaaacggattaatccaagaggaagtttatgttgaacaacctctaggatttgagagtgacactcttcatcatcatgtttttaaacttaacaaagccttatatggactaaagcaagctcctagagattgggaagatttcatactcataagcttctgtgatgctaattatgctagaggcaaagtcaaaaggaaaaacacaagtggaagttgccatttcattggtagaaacctggttagaaggatatgcaagaagcaagcttcaaactcaccctctgttgagatcatctcaatccatgttgaacacttctttgatatcaatgagcttgaaaaagtaggtctcaaactcaacaagacactgcttttttatggagcaaggctcttcttcaaagagtcttaa

SEQ ID NO: 63594 - DNA, 1999 bp, Glycine max
  Peptide Sequence Number=SeqID_180372
cgacgaggcgggtcgttacaccaagtatgtgaaagaattactaaagaaattcaacatgggtgatgcaaaaaaggtgaagactccaatgcaccccaccatataccttggactagataaggaatcaacgaaggtggacgagactcaatacaaagaaatgattggttcacaactctatctcactacatctaggcctgatataataagagaaagtttcagacttgaaagctattgtgatgctgactatgttggtgacaaagttgaaagaaaaagcacaagtgcaaactgtcactttataggtggcaacttaataacatggatatgcaagaagcaaggctcaactgcattgtccactgctaaagcagaatatactaaagctgctatcaatcttttgaaagatccaataattggtatcagagccaaggtcacaagtttgattcctagtggggaaattgctgagggggagattgtttgccaggttgtggcatcaattgtcccatggcagaggcccagagcaaagatcgccaaaccaacacctgtacttgcacccaaagaagctgccattcagtctatcatccccaaatgcgtcaaaaccaaagccactaaagccaatcccaagattggtgacaaagagtggtcaatttcctttagtagtaacaaggaaagtgtgactacatcttcattaggaatggacacatctagtgcagtcacaaggcatcaagatgcaaccgcattggctagcacctggaacctaacaacatttaacttggctgatttggagctcaccttcatggactacttcatgcttgatagactacattcacaaatgtatgtgtgctcctgtttacttatttggaatgctgctaagaagaagggcttcaagctggacttttatgaagaaattccctcaagacaaataaaggtggaagtgaatcagattgtatgggctgacacttcaaatgcctcctcatctagttatgatggtagtgacaatgttgatcaccatgactttattcaagtgttgtgtccaacttggacgtatcatttcaatgatgcttgtgcgtgtttcactaaggatgctgacatctattcctttatcaaacgaccaataagccttctcactattcttgaagagaccacctatgatctcaacaaaatggaggaaaatgagttcaaagatcatgtgactaagctccatgatgctcagaaagaaagaaaatccaagatggaagaagaactggcttctggtgctactaccaaggagaaagttatggacgacaacattgttcatgagatcattattgatctcacaaacattagtgttatgaatgaagttttaatgtcatccaacatagctatagccgatgagggtgcacttgatgctgttattgcctactcaactagtttaggtcctaccaccctcaactatactcctccttttgttgtgtccaaagatcaagtgcaagagatgatagttgttgctacccctacacttgttgctgctcctgcacccccaattcttatccatcaaccatcacctcctgaaccaacaccaccattcattgatcaaacaccaccacactatcttcaccactacctacgcaacctccaccaccacctcaaatccaagatttgctatgatggggcaaggtacctcctctccatcatcgatgattactccaagatgacatgggtattcatgatgaagcagaaatctaaagcttttaagtgtatcatgcattgggcaattcttatgaagaatcaaataggaaagacaaaaaagtgttttaggactgacaatgacttggaattctattctatggaattcaatgaattctttaaggatgaaggcattgcaagacaacacattgtatgctatactccacgaccaaatggagttgagccagtcaatgcatcatgctatctcgtgaatcactcactatccactactatagatatcaggacccctattgaggtatggtctaacaaacctgctaaatga

SEQ ID NO: 63595 - DNA, 489 bp, Glycine max
  Peptide Sequence Number=SeqID_180373
atgtctcgtgttccttatgaacttccctatcttgggaagaaacattggcaagttatgaaacgtatattcaggtaccttaagggtacaactgatattggagtcgtctgctatggagacacgtcctgtgctcttgctggttactcagattctgactatgctacagatttggatgcaaagagatctatggctgggtatgcattcaccattggccactctcttgtcaattggaaggaaacacttcagcctacagtggcgttatccactacagaggaaaatgttattattttctatgacagtctgagagcaatctgtttagccaaggatcaagtccatcatgagaggaaaaagcatatggacatcaaataccactttatctgttctaagaaagttgatacaagagagaatctagatgatatgttcatgaagcctattccaagaagcaagctcatacactgtctagatctacttaacatagattattggaaatga

SEQ ID NO: 63596 - DNA, 258 bp, Glycine max
  Peptide Sequence Number=SeqID_180374
atgactaaagcacgtccaaaggggatacggaaaggaaaagagggagaagcttgccacccaactcttgcaggcgagctaggttgcatcctcccgaaggcaccgccttctggaggaacttcctggaaggcccaagtgggcctgaatgctattttcaccccctatttactaaatacacctcctgccctttttgctgattttttttcccgtaacattacagaactttacgaattctgtaatgatacttctttaatgccgtaa

SEQ ID NO: 63597 - DNA, 249 bp, Glycine max
  Peptide Sequence Number=SeqID_180375
atggtgacaaaaaaggttaagaaatatgagaaaatgatgacacatctaccatcttgcaaaaaattagggcaaaagatggatcgggttacatcgctgcttcgtctattgccaaacacatttaagactgttgatgtccttgttacttctagtttcaccttgacaaagatgtcatggaccatgaaagaacacactttacggtgcccttaccgaacccgtgctagagctagagtaatgggtgaagtaatggag

SEQ ID NO: 63598 - DNA, 276 bp, Glycine max
  Peptide Sequence Number=SeqID_180376
atgctgacatctccgagaaaggtgcaggtgacgatgttagtcactgcatgctatcgggctttgagtcttacgatagtagaaggtggggtggtcgacaaaagtggggcttttgctcctacgtatcctcaatttgagatgaggaactcagacctacgtagttcttgcgaaagcggtgtgagactaaaagagtctctatcggaagatgttgacatctcaggaaagggtgcagatgaccacattggtctctgcttgtcaatcggacttagggtctcctaa

SEQ ID NO: 63599 - DNA, 450 bp, Glycine max
  Peptide Sequence Number=SeqID_180377
atggcttccggggcttcttggacttccgaaaaatttccgaaaaccttggaccacaccttttcggtttttctaacgttttcctcgaataaacgttggtggcgactcctcgcgccttcctcccttggaagatgcacccgtgagccccgcgtcgccctcccgctgaaagaggttgttattccttccgagtcaaattcaccaccaacgaacaatctgatgtcctcttttggatatgattcctcatctgaggatactgaggccatttcccctactctgatgtctcatcaatctgtgttgcctgagtttcaagtactgcctagggtagacttggtggatctcgtgtcggaggatgaggaagaggagttggaggaggacacatctttcgaggaggacccatcgatggatgaggatgaccccttcacagagtcagagtttatggatgagtcttactag

SEQ ID NO: 63600 - DNA, 150 bp, Glycine max
  Peptide Sequence Number=SeqID_180378
atggctagagctgtctactccaattctcatgtgtacatctttgatgatcccctaagtgctctcgatgcgcatgtggctagacaggagaggatgactgttaattttgaatctttgattgtgggagtagcagcatatattcctgccctgtaa

SEQ ID NO: 63601 - DNA, 687 bp, Glycine max
  Peptide Sequence Number=SeqID_180379
atggcaaccattatttgggttcctacaaatcctcgaggggctgaaaggcttcccccaaaaattgtcaaatctgaatcagatttctatcttcatcggttatggggcatgccctatcaggacctaagtatcaaaccgaagtatcttgtaacatttactgttgggtcagatcaaaaagacaacattgatgctgcagtaaaaaagttctctgaaaacttcaccatagtgttgtttcactatgatggacgggctagtgattgggaaaagtttgagtggtcaaagcgagcaattcatatcagtgctaggaagcaaactaaatggtggtatgctaaacgctttctgcatcctgacattgtggctccttatgactacatctttatttgggatgaggatcttggtgtggagcattttgatgcagaagagtacttaaaaatggtaaggaaacatggtttggagatctcacagcctggtatagacccaagtagtagttttacatggcagatgacaaggaaaagggatagtggtgaagtccataactctcctgcacaagttttccacaaccactgtcatttctgctacatcacaacagctcttatatcataccagcacatgttacgatcttcaagcattgaagaggttccatacaccgtacatacaaaggcacatcaaacctcgtcatatttgttctaa

SEQ ID NO: 63602 - DNA, 658 bp, Glycine max
  Peptide Sequence Number=SeqID_180380
atggcgacgatgatgtggtccttggagaggagtgattgggactcggtggagaccagatctgatgatgctgaagttgaactcgctcttagagtcttggaagggtgttttttgcttcaccctcaaagtactgctctcgcccatcaacacaacgctattcaagttttaatgaatatattatccactcgtggagtgcttgagcaaggtgcatgcttagatgctctaatctcattgattgtggattcatcatccaatcaaatggatgtactgattgatgttcctcttgatgcttatgagatagtttgtctaagggttggggtcgctgttcacaaccttgggcagttttaccttggacaacggaagttggaagaagctccatatgttgcggtttccagaagtggtcaagaaaatctccttcaggctcccttattgtctagatcaaatagcatggaggcttccttggcaaaggatacttcctctaatgatgtgaaaaatggtcaagggttcaaaggccatagcatgcttgctcctttcacagctgggtggcagactactaatttgcattctctggtcatagaaaagtcagagggaagctatgtatatgacattaacgggaagaaatatcttgatgcacttgctggtctatgggccacttctttag

SEQ ID NO: 63603 - DNA, 4302 bp, Glycine max
  Peptide Sequence Number=SeqID_180381
atggctggctcgaatcctccctctccaccatcttctgttacacatcctgcactcacagtccccaacattaccaattttatcaaagttaagttagatatagaaaagagtcagtacaacacttggtcagaattgttcaaaatccatgcaagagcctaccaagttattgatcacattattccctcctctgctgatgatacacgtgatatatctctcaaacaaacagaccccaagctttggtcacgccttgatgctgttgttctccaatggatctacggaactatttccgatgatttgctgaacacaatcattgaacgtgacacgacggcagaaatggcgtggaaccgcttgtttgaaatcttctttgataataagcattccagagcactctatctcgaacaagaattttcgcgagtgcagatggaacaattccctaatgcttcatcatactgtcaacatttgaaaacactatctgatcaattgtcaaatgttggtgcgccagtatcaaatgaaagattggtgttgcaacttatttctggactaacagatgcctatgccgccgtcggatcacagattcgacatggagaaactctcccgcccttctacaaagcccgttcaatgattgttttagaggaaacagcaaaggcgcaaaaggctgcaaccgttacagacaattctgcgtttctcgcttctcaagatgtcagcactgttaataattcttctcaacagaattataacaatacaccaaacagcaccaatcatggaggtcgtggcagcgacaatacagcctctaaccgcggtcgtggtagcaaccgtggtggccgtggtaatcgtggtagaggtcgcaacggaggtcgcaataatcggtcacaatattaccaatatccgcaacaacaacagtgggctgttccaccttgggctgcaccgtggcaaccatgggccacgccaccatgtccgtacccaactacgccaaattggcaacatcagtccactcctcgccagcaaggaattcttggaccaaagcctccacaagctcatatggcagccacatcagcaaataatgctcaaccatcatatgcatcaaccgacattcaagctgcgatgcatactctttctatggctcctcctgatgatcagtggtacatggataccggggccacctctcacatgactgcaaatggaggtaatctcacttcttattccaatatgagcaataatattatcgttggtagtggtcataatattccagttattggtcgaggaaatgcattaatcccaaattctcaccaccccttaaccctacataatgtcttacatgcacctcagttaattaaaaatcttgtttctgtaagaaaatttaccattgacaatgatatttctgttgaatttgatccatttggtttttctgtgaaggattttcagacagggattattttaatgagatgtgatagctcaggcgatctatatccactcacctcaagaccaaccactacctacccatccaattttgtcgctttatccaaagaattatggcacaatcgtttaggacatccaggcattccagtttttaattctctacaaagaaacaattttattttatgtaataagcttccaaagcattatttttgtcattcctgtcctcttggaaaacacacaaaattacctttttatgaatcttcttcttatactatgatgccttttgatattgttcacagtgatatttggacgtcccctgtgctcagctcaggtggacatcgttattatgctttgttcctagatgacttcacgaattttttgtggacttttccaattgcaaataaatctcaagtccattccatctttattcagttccgtgctcatattaaaacacaatttgaaagagaaatcaaatgttttcaatgtgataatggaaaagaatatgacaatgcacattttcataaattttgtgaactaaatggaatgacgtttcgattctcttgtccatacacctcaccccaaaatggaaaagccgaaagaaaaattcgcaccatcaataatatcattcgcaccctcctggcccatgcttctctcccatctcatttttggcatcatgcactacagatggctacttacctcctcaacatactccctaacaaaaagcttgccctacaaacccctactaaaattctctaccaaaaagatccgtcatattctcaccttaaagtttttggttgtctctgttaccctcttattccctctgtaactagaaataaattacagcctcgctcaactccatgcgtctttttaggttatccttcaaatcaccgaggttataaatgttatgagttgtcgagtcgtaaaattattctttgtaggcatgttacttttgatgaaaatacgtttccgttttctgccttgaatgctcctccaacctctagttatgattttttggatacaagcgacacaccatttcttaaaaccgacccaacctcttcacccctcatgacaccaacgcctaaccaacattcccctcatccaaatactaccccattaccaacacctatctcattacccaatcgcactactacgacccccacctcccaacatatgccatcatcaacctctgtcccttcctccacacaaactaccgaaccaatcagctcatcgtcaccatcacccccttcccctcaaatgaccactagagcacaacatggcattattaagcctcgcaaacttttcaatctccacgcatcagcttcacactcaatttctcccttgcctaccaatcccattaatgcattacaagatcctaattggaaaatggccatgaccgacgaatataatgctcttattgaaaataagacgtgggacttagtgccccgtccaactgatgctaatgttatccgaagtttgtggcttttcaggcataaaaagaaagctgatggttcatttgaaaggtacaaggctcggctagtaggtaatggttcgaatcaacagactggtgtcgattgcggagaaacctttagtcccgtagttaaatcagcaactattcgaacggttctcagtattgctctttccaaatcatggggtcttcatcagttggatgtcaaaaatgctttcctacatggtaatctcaatgaaaccgtgtacatgtaccaacctgctggcttccgcaatccgcaataccctgattatgtatgcttgttgaagaagtctctctatggtcttaaacaagcacctcgtgcttggtaccaacgcttcactgattttgttgctaccttgggcttttctcatagtatatgtgataactcattattcacctaccacaatggcaatgacacggcctacatccttctttatgtagatgatatcattctcactgcatcctctgacactctacgccaatctatcatgtctaaactgagttccgaatttgctatgaaagatttgggtcctcttagttattttctaggtatctcagttaccaggcattccagtggtatgtttctctctcaacataaatatgctgaagaaatcattgagagagcttccatgtcctcctgcaaaccggtttcaactccagtggatacaaaagcaaaactcagtggaacctctggcaacccatatcatgatccatctgaatatagaagtcttgctggtgctttgcaataccttactttcacaagacctgatatttcttatgtcgttcagcaagtatgtcttttcatgcatgatccaagaacacaacacatgaatgccttgaagcgaatcattcgatacatcaaaggcaccatcactcacggtttacatctctctccctcctcagctgacaaactcaccacatatactgatgctgactgggggggatgtccggacacccgcaggtccacgtccggttattgtgtttatcttggagataatttagtttcatggtctgccaaacgtcaaccaactctttctcgttctagtgcagaggcagagtatcgtggtgttgctaacgttgtctctgaatcctgttggcttcgaaatttactcttagaacttcagtgtcctattgcgaaagccacactagtatattgtgacaatgttagtgttgtctacttatcaggaaatcccattcaacaccaacgcactaaacacattgaaatggatattcattttgtgcgtgaaaaggttgctcgtggccagatacgcgttctacatgttccttcacgctaccaaatagctgacattttcacaaagggccttccgctgcagctattcagcgacttcagagatagtctcaacattcgtcctcctcccgtttcgactacgggggtgtattag

SEQ ID NO: 63604 - DNA, 1062 bp, Glycine max
  Peptide Sequence Number=SeqID_180382
actgagttggagaggcataatctccataaatgcctcaccaatttggttgatgggagcatacatgtggctttggtgaaagagttctatgcaaacctagacagctctgagggtccttctccaaagcaagccagggttagaggccatctagtgaagatcgacgctgacagcctcaacacattcctagagacacctgtggtgttggcagagggtgatactttgcccacatactccagatactgcaggctcccttcagatcctagggagattgaggctgccctatgcataccaggccgagggttcatcctgaacactgagggccatcctgggaggatcttgaggaaggacttgatgactttagccaaagtgtggagtgttctctcatactccaacctggcccccacatcgcacacctctgacccgacagtggatagagctaggctgatctttggcctagtctctcgcatggacatgaacataggagctctcatttttggccagatgacttctatagcccagtctaactcttctagacttgggtttcctactctgatcactgccctatgtcaagccaaaggggttgtctctgacagcctcacttttgagcgcctgagcccggtcattaacttagcctacatcaggaagaactgttggaatcctaatgatctgacagtttttatccgaggggacaaaagggcgagggcaaggccagctgatcttccttccacatctgtagctcctactccagcatccacttcagcagctccttcaatcccagatcagattgattctcaggaagatgaaggtcccatagcccaagtaccacaacatgtagaggatgcatcatctgaggccaccgttccagagccattcattgtagaggaggaggcaggtgagacacaggttagacaggaagttgctgctactcctgagaggtcacgagaggacccgaccacaccaatcctaactttgaacacttcacctccagctactcacgtacttcatctgacagatgaggaggatgttcagacacaggacactcaggaccagtcacaggaattctaa

SEQ ID NO: 63605 - DNA, 837 bp, Glycine max
  Peptide Sequence Number=SeqID_180383
atgtttcatgagggtaggtttgttcaaaggccaactcctctagcagcccttttgacctttctatggttgccaattggcatcatactctccatcttaagggtctaccttaacatccctttgcctgaaagaattgcttggtataactataaactattaggaattagagttattgtgaagggtacccctccaccatccccaaagaagggtcaaagtggtgtcctatttgtttgtaaccaccgcacagttttagaccctgtggttactgcagttgcacttggaagaaaaattagttgtgtcacatatagcataagcaaattcactaaaataatttcaccaattaaagttgtggcgctctcaagggaaagagagaaagatgttgccaatatcaagagactacttgaggaaggggacttggtgatttgccctgaaggcacaacttgtagagagcctttcctcttgaggttcagtgcactatttgctgaactcactgataggagtgtcccaattgctattaacacaaagcaaagtgtgttctacggaaccacggtttgcagacacaagttgttggacccctactttgtgttcatgaatccaatgccaacatatgagatcactttcttgaaccagcttcctaaggagctcacatgcagtggagggaaatcagctattgaagttgcaaactacattcaaagggttcttgcagggactttgggatttgagtgcacaaatttgactaggaagagaaaatatgccatgctttcagggactttgctttcaattattttcagctatataattttcaattattatcacagacacttgcgcacttctatataa

SEQ ID NO: 63606 - DNA, 342 bp, Glycine max
  Peptide Sequence Number=SeqID_180384
atggtgattgatgctgtagtttggaaagtagtagcaggtatagacatgggtggagtccacaagtgtgaggaatctatggatggctacaacaaaatacagacgtacataagtgagcttcttaatcctgcaagagcattgaggaacagactaggtgttggtggtctgatagctgaagacaaaatgttgaccgtaaactttaccaaagcctcgaatgagatgactaaaaggcatctcaagaagcttggtatgacatatgttgatcatgagtggatcatggcaggagaacaacaaacaatagcggatgttgatatgatggaagaagaagttgaaaaagaaacttag

SEQ ID NO: 63607 - DNA, 144 bp, Glycine max
  Peptide Sequence Number=SeqID_180385
atgatgatcatggtgacggtggctacaatcatggtggtgcatgcaacgataatcatggtggacatcagcaatgataaaaatcatggtggtagagctgaagccatcatggtgaccacaacgacaatcatgatagtaatgtgttaa
